United States Patent 11,913,074 (METHODS FOR ASSESSING RISK OF DEVELOPING A VIRAL DISEASE USING A GENETIC TEST) - sequence listing, part 20

SEQ ID NO: 2056 - DNA, 113474 bp, Homo sapiens
  source 1..113474: mol_type = genomic DNA
gcggaagtgtgggagggtctgcggggcgggctcaggaggtccgcgggaggatggagcagtgagcgggtctgggcggctgctggcagcgccatggagacggtacagctgaggaacccgccgcgccggtgaggggccactggctaagaggacgggcatggggtcaggggaagaaaaggcgggaactggttgaggggatacacctgtgtgggagtccccggagctaagcgacccagccgatggggcacctgctgagtgaggggggggacgtctggtgggtgagggtccggctgaggggagcatctgctaaggaggttagacttgggaccggttagagggagcactcgctgtggtgagactgtgctgaggaacgtggggacaagttagggagagtacctgctgaggccgggccactcgggggaacgctatccaagcagggactcacggaggtgggggcgaatgctgaagcagggtgagaatctgtgagggatctctttaagggggtggatcgagaactggccaagaggaaggccgggtggactttctaagggtctgaagtcccacttgaggggtgcggtggggggatctgtggaggggaaaagctttgcgcctaaggctgaaagcatgcgaggaaaggttgagggtctagcaagggaggggatggtggagggtagcatttcagaggatgctgttggtggtgtccccactgtaggatggcatcttttattactgatgttcagtgtcttcctaatggtcttcacatcctcctcagctcttcagaacctgacattgggaggtaggtaaggaaataagaggatattttcgagatggggagactgaggtccagagtagttgggaagtgtttccttctttactccgggtcactgaaccctgccagtctgtgcccttttcaggcctcagttgttttgtgaatatcagcaccaaatcctagtggtacctggaattgctttagttcaagatcaggatggtggctgatcctagaaaatctcaactcctggatttcccttgtggacatcccgggtcttttgccactctaccacatctggagaaaagtagggactagagaccgaaggagtcatgcttctctgaggttcagtgtggttacttctatttcacagagacgtctgacttcctgcagcagaatgagctctaaagaaggaagtgttcagggtgtggaagtgcagggcaaccaagaggtgaagagaagggattgactgcctgggcagcactcttaggggttgtttgagcttggggatgtttgaggtgcacaaacattgcagaaggcaaataggtggttgggatgggctttggattcaccctagcgtagtgtgctgagactgtaatagtaatgattattacactcatattgcacttaccgggtgccaggcactgttctaagtgctttccatgtgtcctgctgaagcatatgaaattgctgatatttgaccatttttgaaccataaaaacctcatttgaactcatttgaacctcacaacaatcctgtgtggtagatatccctatatgtctgttttacagatgataaaactgagatacagagggtagtgatttgctgggagaagtcatagcaagtaagagacagagctaggattttaatgtctatggggtctggtccaaagtccatgttctttttttttttttgagacggagtctcactctgtcgcccagtctgaagtgcagtggcgcaatctcggctcactgctacttccgccttctgggttcaagcgattctcctgcctcagcctcctgtgtaactgggaccacaggtgcgtgccaccacgcctggctaattttttgtagttttagtagagacggggtttcaccgtgttagccaggatggtctctatctcctgacctcgtgatccgcccaccttggcttctcaaagtggtgggattacaggcgtgagccaccgggcccggccatgctcttaactgcctcactctgatgcctctctaaaagtacccctgtttcacaggtctctgtgtatgttagcagatatttactatagtaccatagtgatccaattatgaatgcacactagttatgtttctttctgaactatgttcgttcgttcttcttggtttctttctccgaggccttggtttaattgaaaagaggattaggaatctgagttttgtttccccctttgccttgtcttacataatcttgagcaaaggactaaagtttcttggcatgctcattcctgtaccttttggattttaaaaaatgtattaaaagcacaagagaagagcattgcaggactgggttctgaagtggctggtgattcccagctcattgtaactagtagattgcctaatttgaagcagatcaattttattatcacgtgtatcagtttatcaggacaagacaaagtgtcatggagtgggtggtttaagcaacgtaaatttattctctcactgttctgaaggctagagatctgaaatcaaggcattgtcagagttgtttcttttgacgcctttgcttgactcgtagatggccatctccctgtgtctccatgttcttccttctgtacctgtcagtgtcctaatctcctcttataaggacaccagtcatactggattagggcatgcccatatgacctcattttatcttaattacctctttaaaggccttgtctccaaatacagtcacattcttaggtggtgggtattaggacttcagcatatgaattggggtaagctggggacacagttttattatgtaagattttgtccatttatcatgtatagttgttgtaatccatatcaaattctgtgtggaaaaagaaatagttacacataaaatgaactttatgggagttctgaaatgggagaaagctttgagaattagccagacctgtaagtgactacttcatagacaccattacttgtgtttggaaagatacaggtgtcttttcagaaattcagatggcatgtgtttccaataaccccagtgcaggaaatgccctttgtgttcgtgagtttgacatttgtgtgtgtgtgtgattaagtgatgacagattggtgtctcatataggagttaataattttaaaaaatgagttgccattagattaatgttatagtggaaggcgtagagtgcattcctgggatgctggccatccacatggccatctgacttaggagaggagcatccaccagtatttggtccatggatgctctgttgatcaggcttgttcatttatgagcaagtgctgaaaccgtctggaacctggggaagtcccagataagagaactgtattatcagagtcaggctgttttggtaatagtgttttttctgtgaagagtcatggtataaaatattattatgaatcacttatcaaaatatttttatagaaatgttgataattcagtaatacttcttaggtgaaattctgttttattgtgataattcaaagattgctgatgaaattcgtgattcccatcattacatttgtgaatccatttcacaaatatattttgaccacctcttggttatcaggcaccagagatgtaatagcgccttaagttcaagttgtttttaatagccccggatcaaaaacaaacaaaaaagcacttagattgtttcaaagatgtattcgagccgtcatatgctaaatgacgagttaatgggtgcagcacaccagcatggcacatgtatacatatgtaactaacctgcacattgtgcacatgtaccctaaaacttaaagtataataataattaaaaaaaaagaaaaaaaaagtttgtcaaagtattatcagaggtttgcagctgtctatctcaaggcagtggcaatttcctttgttatgctgtggtccctgaagtagttgaaatagtgacttttgcattttgtaaaccacagagagtcaacacttcaaagaaacatacttgatcttcctttgtataagctgtttatacaactttgattatacttgagaagtgaggtattgtccaatgtttatacaattacaattcaggactttaccaaaaaaaccctggcatatgagatgttcgttctgacttctgagtttatagaagtttcagttctgaagtttaagaggagtttcacttcatcccttttcattttgaaggtaggagtttttatgatgtcattggtatttaatttttaggaccttttgattttcaaaggtcactgtgatcattttgttctgttgatatcaagttaaggcagttttgacttggagcagttctccatttctctagtttatagtccttgatattcataaactataagattgtccttctgagatcagtgtttattggtagatacacttgatgtggtcagggtttttgttggtttgttttattttttgtcttctaattttaatctgttttatttaggaaggtacacatttgtgtgtgtgtgtgtgtgtgtgtatgtgtgtgtatttaagtcttttgttgtaataattgatattatccagctagtctaaacctttttttttctacaaagaggtctccagtgtgactacttccatatttcaccgtttcctcagctctctattctttgttgttctttgtagtttcaggaagccattgtgtagactacacacacacacacacacacacacacacacacacacacacacatattccttggcaagttccttctttaagctcattagtaattttcagagatctcagagttttaaaaaaatgttaatttataacctcccatgtttgttatgattgtctagcatagtcagaaatctgaattatctggaaattgtgagcagccaagtacctttgatttttgggactagtcaaaggtatgtatctactcataggaaggtctttgtgagaatatctgaaactcacagctgcctagtgatttttcacttttgatcatatctaaatgtacactttccactttctgtttctgtgatacctacagaatttatgtgttttgacaaacttacaaaaaacttgctaatggaagagcaaaggtttcccgtgtcttccttagtctgcagtccaattcatagttatgtttcaattcatagttaccttacattaaacaccttttctgaagagataattacatcattttaattcatgaaatctcaagatttaaatagattttgaaggatacatcgaatgcttgaatctacagcatttcagccacatgactttttttttttttttttttttttttgagacagtctctctctgtcacccaagcttgagcgtagtggcgcaatttcggttcactgcaaactctgcctcctgggttcacgccattcttatgcttcagcgtcctgagtagctgggattacaggcatgcgttaccacgcccagctaatttttttgtatttttagtggagacggggtttcaccatgttagccaggatggtctcgatctcctgatctcgtgatctgcctgtatcggcctcccaagaaaccttgtttcttaaaacagtcttaactagtgaagtctgtatagagaagttcctgagatgctaattataaaaaaaagatatattttatgttctagttcctagcaaataaaatgtattttgtgtttatatttctttattcacaggcagctgaaaaagttggatgaagatagtttaaccaaacaaccagaagaagtatttgatgtcttagagaaacttggagaagggtgagtgtaaagaaactataggtaggtcattgggtcccagtctttttcctgccccagaagaagcagaaggatatgaacctttcagcattgttctaggtggggtggaaggtaaatttacagcttgtgatgtccttcttcgctttactccaatccctattatagacagatttagtgattcctggtctttttaacacgaagaatatctattgttttctcttttgtaggatctgtatgattttatctacttaacagatagcactaattagattaaaattctataagaaactttttaatttgctgttcataatttctgattggtatgcaataactgtttcaatgaaaatcaatgtaatttagtattttaatatttgcacctttgtgaaatatagtaaataaattaagcactatcaccaccttcacagctacttaggagatccacaatcctgggttgggagccagtggatttcctgaaacacagatttgttaatgcgtttataaaatactgatgaaatgatattagtaatgtgcagtgaccatcattgactttcatgatacaattaagtttacataatttttatacttttatatatcattttaattcaatcctgtgtatttattccttcttctgtaatgaccaggaaattaaaatgttaatgacaccatttcttaagtttttcttgttaatttttgaataggcgatacaatcatatgattcaaaatttaaaaaaatattaagacgcatacaataaaaaaaaaaaaaaactgcctcctacctctctctgtctcttagccacccagaatcaccaagggtagcggcttcttgtgtgtctttcagagacaggctatgtgtgtgcgagcgcacactcgtgtttgtgtgtgtgtgtgtctgtatttttaatcccttgggagtatttctggatcaagggaagacctgacatactaacttgtaaaaacaactactgactgatgactatatgctctttaaaataatttcctttatgtcattagattattttttgggtttagtattttttatgttaggagacagatttacaacgttaaacccaatcctggattacatgaaatggtttttttatgatttacctccttgtaaaaaacatgagtcatcgtctttttgtaagttggaaaaatactctttggaatccagcaagaaatcaagcagagaagggaagtaaaaatgacacaccagctgtgctgtgaaaagacaagtccaagatgaatctgaagactgccagttgactggcatcattaaaggtatggggaaatgacagtccctctacatctgttgcctgccattttcagctttagcttgccatccttgctattttccctaaggcagcaaggctgtgacctttaatctaacaatgctcataagttatacttagaataagttcaagactgataggcataattgactatgtaacttatttctctcatttctaatacagtttgctcttactactacaatgtgaggctgacctgggttaaaatccttgctctactgtttactggtcataatagacaagtgggcttaagcaaattgcttactattttggaggctcacaatcctcatctgtaaagttgggataataatatatcaattcatagagttgtgttattacctgaggtaattggggtaaagtatagtgcttatcacaataataaatgttcagtaagtggcaactattgctattctattttaaatgtatcaactgaagcattttcaagacctcatcatgtcaagtcttaaagtatttttaggtgttgttataggtagctctgagctgattgggtttgtggaatgtcaaaggaagactatagacagagaatatatcagaaatataatgtaaacaaaaaataagctaattatgattttttaaattgtattttatttatttgtttgtttatttatttttgtagagacgaggtctcactgtgttgcccaggctggtcttgaactcttggccttaagtgatcctcctgcctcagcctcccaaagtgctaggattagagacgtgaaccactgcacctggacaaattgcgttttagatctatggatgtcttctgcaaggaatgtggaaatttccctatgaagatatcaccagggagaaaacaaagcttcagatctttcttcccatactatcaccttattgttcttctaaataataccagatttctggtatttcttggatttctgttattctgactgaatgaacctaagcaagcctcatttaactaggaatattttgaaggaagaccttcactgcacttcttttccaaacatgtgacacaatgctattctttttttttgagattaagtcttgctctgtcaccaggctggagtgcaatgtcacaatctcggctcactgcaacctccgcctcccaggttcaagcgattcccctgcctcagcctcctgagtagctgggactataggcacacaccaccacgcccgacttattttttgtattttagtagagatggggtttcaccatattggccaggatggtcttgatctcgtgatcttgtgatctgcctgcctcagcctcccaaattgctggaattacagatgtgagccaccacgcctggccaatgctattcttaaattgttcgggaggatgaatggtttgtgaactctcactgacttgtatcttgtgaaatgagctatggctaaaaaaactgttggattctggaggctgcaatcattctgtgttatgaggatcatatggatctgtggcagagtagagccaaagctccagaccaggatgagtggagagcacttgggaagtgttttcaagtggagcctagcaccttttttcttctacttaaagttgtacacattgactcatttgaatttttatcatagaatgataacaaaagcatcttgcccatggtttcataaaaaatgagtgctattgttaagacttgtatctgattaatttggcctcagatactgtggtatttccatttttctacatagatccttgccttgcatggcttatgtaaaacacctacttctccattctctgctgtcagttgtaattcattgaatcatctcattttgttgtagggaatcaagttttaagggacttgcttgtgagtatgattgctgaaatcttctaaccaccccctatccctgccttcagattactgtagatgcagtatatggaatcaggaatcttaacttcatgtgagctattggagttttccttgctatcaggatgcatagggaggtatgaagagtgttctggtcaagattgctgagtgagtgtatgaagagaactttctaatatataagaataatgagtgaaaattattttaaatataaggatatatagacagctatggacaagggataggaaagaaatctaaataatcagcggagactaaagcatgccttatccttgtcaggagattgcatttgagcttcctgcatgaagttgggggctggaactcggctctccatctgtgaactaaagctgaaataaatttgcctgaccacaaccagaaagtgtcatttgcctgtggcctagggaaaaaatggatatactggttcgataataggaactgagcttggattgtatttaagtatggtatcttgaagggcaaaaaccccaaactctgaatataagacctggtttaagttgtatatcccagactactgtactgagaaaaccatgaaatcatcgacagtgagtgtggtatagaggaaaatcattcaagagaaaatgaaatccatgcaaggaaatctactgccatgagataatcagcagaatgggagaattcacactgaaggaaaaagaaataatgaagcaatctcaaaaacaatttaatataattacaattttcaaaaagatcaaggaggagataacatttttaaaaggacatcagattattgacatgattattaacatatttgcccaaaggcagataaaaagttgggaatcttgacaatgaaaactacaacaattgaagttttaaaagcccaataaattggataaacagtaaactagacaaactgaaaggagaatttgtgaattgaaagatagaaatgagactgatcacaacatgcagaaatacagtgttggaaaccaggaagacaacatagattgaggaggtctaatacagttttggtaggaattctaaaagaagatcctagaagtggtagaggaaataatcacataataatcctgagagtttttcattcttgaggaaagacacgagccctcagattgaagaagtttatgaagtgccagatcaactcctagttacattacagtagaatagtagactgttaaggacaaaggaaaccttaaaaactatggggagattacccatggaaaatgataatctgataaaagctgacttctcagccacagtcgatgttggaacactgcaacaacagtgctgagggaaagctgttgtcaatccggtatccaaccaaactatcattctagagtggaggtgaaataaagacagtttcagacatacaggagctaatttatcaagaatgcctttggatggaagtaacaatacccaacaaacagtggctaaccaataaagacattaagaactaaataatacatctgggggtgtgagattcgagaagccgttaattggcttgacaatggtttgacatctgggtaattctcgtagtctcaaatggctgcattagtttcaagcatcatccctcacatggcagtaaccaaagaaagaagggaagtggcaggtggaaatgggccttcttgtgtgcttgtctcctaccagggaagaaagtctttcccagaaacctttcagcagaattatcttcaaatttcagtggccagaactgggcgacatgtttgccactagttcagtcactggcagaagggaataggaattctgtgagtggcttggactaccatggtatatctcctgggacgaagcacatcaccactgtaacaaattaggaagttattttagcaaggaagaagggacacatgctcaacagttgcctctctctggcaaaaagtatttggtgtaatatttaaggatgattatgctagttttgcaagtatgacagcttctaatggaatggaaatatttttatgtgctctgcatagacttaaaaagttttatgttactttcacattgaaacagttcatgagcatctatttggcagttagagtattgtactttgacatagtaggtggcactgctattttgattttttttttcaccaagacagtgtgaagatacagatgtgttgggaaatatgaaagacagtttactcagtattatttcactgacagctgcccaggattccaatgaaaatgttatctgtataaagtgatgatggtatctcatttgaccatcacaaatgagataccatcacatcttgtaaggtagtttgtattattgtcattttacagatgagaaaattcaggtacaacaaggttaataaggtgtaaatgatagctaaatgtagtgttggtaggactcaaatccagcttctttactttcaaaatctagtggatctgtagcctccaaattgactagatacacaaactttattttgatattaagctgttaagggaagatggagtaggaagcaaagagtgtgtgtgctgtgtttacctgatactaatattaaacaggcttagattttaattagtttccataatattttaagtattattgtaagtaagaggagcaaggacagaaagatcttgtggtactagagtgaatacaataaaacaaagactgccacttccatattgtaccccagtatagatggggagacaacgtaagctttgttttcagacacacccgggttcaaatcctggactgataacacaactggtttcaaatcctggactgataacttatgtgaccttgggcaaatcataaacccctttgaacctttttacatttacctgtaaaatagggatagtcatctcatcttcattttttgtaggaatgaattgagatggtgtacagtctctagcagatagcaggcatgcagtgcatggcagctactatattaccatctcataagaatacattcattacagttttgaatgtgaagctttcaagatgccattttgttgtagttctcttgacagttttttccccaaaagtattttagctatcttagttttgcaagtgtatatgtattaggcacttagggatatatgttagaactatcagttgcttgtgttttaccacttcttatatcttggcttgctttgactttataaatgttcttcttctcccaaatgtataggtcctatggcagcgtatacaaagctattcataaagagaccggccagattgttgctattaagcaagttcctgtggaatcagacctccaggagataatcaaagaaatctctataatgcagcaatgtgacaggtaaaggcatgtgggcttcctttggggagaatgtggttttgaattagctatgattgtgtagagtttgatacctagagacacatttacttagatattttgcagaagggagaattcgatggaatcactgtgcattttcttttcagaaaaaaatatgatgataatggttgtttttgtagctaaacctccgtaatttttatgcatggtgttttgtttttttttttcaatttttctttttttttttttctgagacaaagtctcgctctgtcgcccaggctggggtgcagtggtgcaatctcggctcattgcaacctccacctcccaggttcaagtgattcttgtgcctcagcctcccgagtagctgggactacaggcatgtgccactacgcccagctaatatttttgtatttttagtagagatggaatttcaccatattcgtcaggctgatctcaaattcctgaccataaatgatctgcctgcctcggccaagtcccaaagtactgggattacaggagtgagccaccatacctggcttttttcttttcttcagtgagcccttttagaaactaggaagaagaggcagaaggtggtgcttgcttttttttgtgtgtgtgataatgatcttttttacttcctattgagaaaacatttctgcagagatagccaagaacagataattcaaatgttttttagttctagaaaccttagaatatcaggtaaatctataaaaaaagagtagttatgtatatactactgtttgttccttcacattaaaaaaaattattctagctgagagtacctacgtatttatttttgaggaactaagatttgtcaaatgttgtaagcaggaagtcagaccaaaagacaaccacagaaaaccacgtggtttgctctgaaattccatgacaacatgggttggtcactgatagagcaggcttccccagcactatttagattagagacaaacacaaagttaggggcaatgccagctctagggagctgaagatgggtgagaaattctctcagttgaagctgcattcattcttctgaaggctttttggtcagcagatcaacttagtacctgctgtttgcaaaacttctacattagggtttaggtggggctacctaccaaaaaattagtccagaagcctttcagtctcacagacttgggaatgtagtcctttcttttttctctcccttctttttttttcccttctatttttgtgattactgtctactagataaaatccccatttttcttgattggattgaccagatgaaggtggcagttttccatttgctcctttttcagatacattttggaagttctttccatttggcaaattgggactttgtcactttcgatagactgtgcgggagctgtgttccaaacagagtatggaaatgtctttaattaaagaagagatattttcaagcgtctactctgtgctaagcactgtaaggaatacagtgaaatacagagcagagtccttgtgctttgggagtttatagactaattggacaggctaagtatatatatatgtagaggagaatctagccaacagtgcaagtctatagagaacatattccagtagtaaatacttgatagtaatggcctacagtatttaactcctgtcagtactgtattacagggagagtaaatgtgttgatatttaccttagacacttttttcattaatatttaatgtgtgtgtgtgttttgctgtccttgtcactggcatgtttcctaaggtttgaagaggaaattgtaagagttctgagttaatgaagccaatttggttttaacatcagttgttaggaaacttcatttggccatgataacaatctagccagttaaagctggcagctctcagagggcacattattttattttaataggatatttgatttttctctgaatttcttgtttggtatctctcttccagcttgagacctaaaattccaggtttgatcctgaacattttttctttataatagattgtagtatgtgtatgtttttattacaaagtacatatgacttcttagaaaaattcaaatgaaaagaaaagaaaatcacttttccctttggagaaatcatcattttttcttttttttgagacggagtctcctcactctgttgcccaggctggagtgcagtggcgcgatctcgactcactgcaagctccggctcctgggttcatgccattctcctgcctcagcctcctgagtagttgggactacagggcctgccaccacgccaggctaatttttttgtatttttagtagagacggggtttcaccatgttagccaggatggtctcgatctcctgacctcgggatccgcccacctcggcctcccaaagtgctgggattacagatgtgagccactgcgcctggctgaaatcatcattcttaaacactgcttgatacacatattcttccaaatcactttggagttttacagtaattcctgttttgtagcctgcttttttgtttgtttgtttgtgtaaacacagtatcttctcatgttatcacatagtctataacatttttcatggattcatgatattttattatacggctatagcattctttgttttttttgagatggagtcttgctctgtcgcccaggctggagtgcagtggcgcgatttcggctcgctgcaacctctacctcctgggttcaaacaattttcctgcctcagcctcccgagtagcagggactacaggtgcacactgccacggctggctaattttttgtattttagtagagacagggtttcaccatcttgtccaggctggtcacgaactcctgagctcaggcaatccgcccgcatcggcctcccaaagtgttgggattacaggtgtgagccactgcacctggccctgtatcattatttcttaaataaactccctaatgttggatggacatttagatgatatctaaatttccacttttgtcaatagtgctatgatggtaactgttactttttgaacatttataattcttttttgaggataaattgtagacatagaaatgctggttaaagaactcaccaagttttttatacttttgtgatttattaccctccagaaaagctataccattttgcattcttatcaggaggttgtccattttatccttaactatgaataattgatctttccagatgaggaattaatttgtatatacttgctagcatgaattaagagatatttgaaggccattttattaatttgtattgtctctctctctctagccctcatgtagtcaaatattatggcagttattttaagaacacagacttatggatcgttatggagtactgtggggctggttctgtatctgatatcattcgattacgaaataaaacggtaggtttaccttctagaacatgcaactgagctagtttcttatgccatcttcttttctctgcctctttttcagggcattctcctactagagagacgactgtcagatttccccttttccatggttattttccatctttattcttttatgtctcctaagtgtgacagctttttttttttttttttttcaagagaccagagtcccctgtcacccaggctggagtgtagtggcacagtcatagctcactacagtcatagctctacctcctgggcttcagtgatcctctcacttcaggctcctgagtagctgggactacaggcgtgtaccaccatgcccagctaatgttttgttttgttttttaattttttttttttgtggagatggtgtctcactgtgttgcccaggctggtttcgaactcctggcctcaagcaattttcccacctcggcctcccaaagtgctgggattacaagtatgacccccccatgcctggcaatgtggcagttttgacaccaatttagtccagtgatttttagcatgctttggttatttcttactgggaagaaaatgactgttagatcttagttatagaatgaattttaaatgtttaaatttggatttggatttgggtttctgcttctacctagcgtgttcacaaattaaattcctgtatttcctgttaatcagagaataatccccttatgaaagattatttgctgatactgtggttgcagtataagacctaggagtcatgggttttagttctggttcagttacttaatgtctttatgtattcgttcagtaaatatttcttgaacactgttttaggcctgaaggatctaatagtaaataaaacagatgacaactctgctgtcatggtagtgtacttcggaatagggcaacaaaagcaaattaatagtaactattaatagaaaagatataataatgatatatactatgaggaaaatgaatgaggatgaagtgatggtaaagttgtggagactggtgggctattttagagtagatagttgaggaaggtcactcagaagtggtgacgtttacaggaagactcaaatgacgaaaaggagctaagagtcctgaaggaacattgtaggtgggcagtaaccagtgcaaagaccttgaggctggaatgagtttggcatgtctgagtgatagaagggctaccatgactagaagggaataggcaaaggagaagctgtaggagatgaggtttgacaggtgggcagggctagattgtattggatattgcaggtcatgggaatgagtttgaattttatcccaggtattataggaaaccattgctggattctaagcaagtgagcgagccatctgatgtatgttttagaaagataactctggggctgggtgtggtacctcatgcctgtaatcccagcacttggggaggctgaggcggaggattgcttcagtccaggagttcgaggccagcctgggcaacatagcgagacctcgtctctacaaaagaaaaaagaaaaacaaaattagtcaagtgtggtgtcatgcgcctgtagtcccagctaacttttggggtgtgatgggggttgaagtgggaggattgcttgagcccaggaggttaaggctgctgtaagctgtgattgcgccactgcactgcagcctgggcagcagagcaagactctgtttcaaaaaataaaaaagataactctgacttctgggtagattgtgggtggataagtggagaagtagagaaaatcttagcctgtggtttttttgtcttaataagaaaaataagaataataatatctgtattccatatttgcaaagttgggaaaattaatttaaatatgtaaaagtactttgtaaattgtgaggtgctacacaaattataaggtgagggtgttttaaaactgagttataacttttggattattcatatactatcttcttaatttacattattcagaattagtgtgtttgcttaatcgaatagcaagttctttaggaataatatcctaacataagatatatgtaaagaagttccaaaactggaataatttattgaattaaacattggatttcagggcttcttatatgcagcattaagtcaatttatttcaggtattttaaactagtccaaaattaattttgatggcacttttggtttttttttgccattgtaatagtaggttattatatttaagtaaattttaacttaattactaagtgctggttttttgttgttgtcgttgtttttttttttttttttttttttgagacagagtctccttgctctgttgcccaggctggagtgcagtggtgtgaactcggctcagtgcaagctccgcctcccaggttcatgccattttcctgccttagcctccctggtagctgtactccctagtacaggcgcccgccaccacgcctggctaatttgttatgtatttttagtagagacgtggtttcaccgtgttagccaggatggtctcgatttcctgacctcgcaatctgcctgcctcggcctcccaaagtgctgggattacaggcgtgagccaccgttcccggcctaagtgctgatttttaattactacacgttattttgccaaatgttataactctgccctgtccaccgtgatatccactagccgcatgtggttattaaggacttaaaatgtggctagtctgaactgagatatgctgtaaatataaattatacaccagagtttgaagaattattgccataaaaattgtaaacaaaaatctttgattttttcatattgatgacatggtggagtgataatattttggataaatatggttaagtaaagcagattatcaaaattaattctttctttttttttttcaaagatagagtcttgctctgttgcccaggctagagtgcagtggtgtgatcataggtcactgtatgttggaactgctgggctcaagtgatcctcctgcctcagcctcctgagtagctgggattacagcaccagccactgcgtctgcttgtttcctttttcaatgtggctactagaaaattaaaaattatatttgtggttcccattatatttctattaggcagtgctacttcaactgattaacttaactggttagaataaagaggtggtaagtcaagtcatgagctttgttctcttccactatagaaggtaccccagactctagcctactaccttgccagtagtgtttgcctggactttagtgaaagctttatcatttctctctgacttttggcataaatgacttaacttgtctgtgccctcagcttcattatgtataaaatgatgatgataataatagttcctctacctcatttagttgttataaggatgaaatgagattacatagtgcttagcatggattaaacacttagtaacggttagcctttatttatttatttatttatttttgagacagagtctggctgtgtcactcaggctggagtgcacacaatctcagctcactgcaatctccgcctcccgggttcaagtgattctcctgcttcagcctcctgagtagctggattacaggtgcctgccaccacacccagctaatttttgtatttttagtagagacagggttttgccatgttggccaggctggtcttgaactcctggcctcaagtgatctgtccgcctcagcctcccaaagtgctgagattacaggcatgtgccactgtgcttgactttttttcatattattagcatagtacctggtgcttattaaatattgattgataatatcaaaggtgttaaattatgacatattaattgattttcatgacactcttaaaagttatattcctattttatagattgggaaacaggctaagagaataagagaaggtcagtaacttgcttaagtcacatgaaagtagagccaagagtaaaagctacgtcttcctagtcccaaatcctacagtttttgcaccagagcacactccatttcacatctgagttgtttgtcagaaggggaactatgtaacagtttgttgatagattgagtttgtttaggactggtgttgggtctgcagaaagtctatattggccagatcagatattctatactagtttctagcattctcactttcaacagatatttttttcagtgcctactgtgtgccaggtggctttattggtattagggaaacaaaagtaaacaaatcagacatttttaggagcttgtgtttctaacagggatgatatcacatacatagataaataatgggtaatatgtcagatggtagtatactgcagtgacaaggtaatttaagggaatagagtatgagctagaaatggagtaagaaagccctctccattttctgaggaggtgatatttgggcagattacaaactgaggaagcatactggatagacatcaggatgaagagaataggcagttgaaaagtcccagaaaggggagtgtgcttagagtgtttgaggaacagcaaggaagcaagcccttgttgaaacagattgagcaaggtagaaagtggtaaaagatgaagttaaagaggtagctgagagccagatcatgtaaagccttggtaaggactgacttttattttaagtgggttaggaagacattggtaggttttgactctggcttacattttaattatagcttctgtgtggaaaatacattgtagagtgtcaagagcagaagcaaagaagccagtcgggagattatgagaatagtgcagtcaggacacgatggtgacttggaccatggtgattacagagggtgtatttggatatacagtgttttgaagatagagaaaagtcaaggatgacttcaaggtttttgaccagagcaactgaaagaataaagtttccttttactgagagagggaggactgtgggagaagtggagtaggttggaaggatcagagggagaggggtaaggtgatagacatagagtttgattttgacatgttatgcttatgatgctggctaggtattctagttggagatacataaatctgattgaggggagatctggtatggaaatatagccttgggagtggtcagtgtatctatggtataagcagtcaaatgctgttcacaggttgaataagatctgtttatattaaagaaaggtttggatctgattttttctcctttttctaatgcgctgatgtaaactgatagaatttgaacttcttattcttttttcagttaacagaagatgaaatagctacaatattacaatcaactcttaagggacttgaataccttcattttatgagaaaaatacaccgagatatcaaggcaggaaatattttgctaaatacagaaggacatgcaaaacttgcagattttggggtagcaggtcaacttacagtaagtaaaaatattacttgtattgataattttcatttctgtcctgagaagcagttccttttatttacctatttttaaaatataatacttgacttaattgtattagtaaaaaatcacagaatctgccaataggttacaaaagagctagttagtgggttattttagatcttttcctggggttcaggtcacatagcttaactttgttcaacttttataaagatgaaaagtaaagcaagaaatgatagattactctagtgcactacatcaacatatttataaaaggaagaaaaattaagaggaagaaaaattaagtccaaactgctttccttgactaagacataacatcatctcattcaacttccaggtagtacttggcagttactgtactgaaaacactctgttcgtttgagtccaggatacagtctcttgattcttctcctgcctaactagtgcatggaagtgaaaaaagaaaaaaaaaaacttgttttcaaaataggaagtctagaattatttgattctacataagtatatatgaaagtatatatagaaaaatagaaatagttttaggcaggtatactctaaaatttgcaaaaatattacatatcaagtggttttcttgggtggtagaatgaatatatatagtgtgtgtttagaactggtgttatgtacggttttttttttattattttttttttattataagtctgcctgggacatgttagggagcctcaggtattgtaacagcacagaaattgctttgatgtttaaaataaatcagaaccttattcagtatcatgatttgtgggctctccaaaaggttttgttgttaacacaaaagtaaacagtaccagacaatattacctaaaccacagtcttagtcaggaaaccaaattgaaaaaatacaccctctgatggtctataaaataatataatattggccgggtgcagtggcttatgcctgtaatcccagcgctttgggaggctaaggtgggaggatcacttgaggttaggagttcgagaccagcctggccaacatggtgaaaccccatctccactaaaaatacaaacattagccggacatggtagcgcacgcctgtaatctcagctacttgggaggctgaacctgggagattgcgccattgcactctgcactccagcctgggcaacagagtgagaccccatctcaaaaaaaaaatgtgtatgtatgtatgtgtgtgtgtatatatatgtgtgtgtgtatatatatatatatatatatatatatatatatatgtatccattccatttactaattttagtaattgattgattacccaataatgacttacagtgttcttattgctataatgcctgccttggcagaatttttctccccttttaatatgtacaattcagtgtttagtatattcacaaaattgtgcagctattgccaatgtctaattccagaacattttcatcatcctcaaaataaactgtaccctttagctgttagtccccattctcttcccagcccttgacaaccactaatctactttctgtcactatagatttgcatattctgaatatttcatataaatagaatcatacataatgtgcccttttgtttctggcttcttttgtttaacataatgtttttgagttcatccatgttgtaacatgcatcaattcttcattcctttttattgctcagtaatattccattgtggctgtaacacattttgtttacttattcattagttgaatatttagattgtttctgctttttggctgttaggaataatgctactgtgaaatttgtgtacaggtttttatgtgaaccgttgttttcatgtgatacacagagttgctggatcacatggtaactctgtgtttaattttttaaggaactgccaaactgttttccaaagtggctcaccattttgtgttccctgctgatgtatgagaattccaacttctctgcatcctcgccaacattttcttttttgtgtttttgattataaccatcctagtgagtatgaggcagtatctctttgtggtcttgatttgcattttactaatgactagtgatgtcgactgtcattttttctgcttattggacattcgggtatctttgggaaaatgtctatttaaatcttttgcccatttttaattgggttatttaccttgttattgttgaattaagagttctttatatattttagatataagtctcttatgtacatgatttgcaaatattttctctcattctgtgggttgtcttgaaggtgtcctttgaaatacaaaatttttaaattttggtcgtgtccagtttcttttttcttttgttgcttgtgcttctggtgtcacatctaagaaatcattagctaatgcagggtcatggagatttactcctatgatttctttgaagtgtttaatggttctagctcttatgtttagatctgtaatctgttttgagttagttttcatggtgtgagataggcatccaatttcattcttttatatgttgatatgtagttgttccaacatttgttgaaaagactgttttttctttgttgaaatgtatgagtttatttctatgccttcaattctattccattgacctatatgtctgtccttgcaccagttctgtgctgtcttgattactgtaagtttgaagtaatttttgaagttggttaagtgtgagtgttccaactttgtccttctatttcaagattgttttggctattctgggtcccttgtatttccacataaattttaggatcagcttgtcaatttctgcagaaaaggccgttgggattttggtagacattattttgaatcgtaaatcagcttgaaaatactgccattttggcaatattgtcttccgatctatgaatataagctgtctttccatttatttagattttctttaattcttttagcaatgttttataatttgcagtgtacaagttttgcatgtatttggttaaattcattcctaagtagtttgtactttttgatactattttaaatggatttgccttattttcagattgttcattgctagtgtaacatacaattgatttttgtatattatcttgtgtcctggcaccttgctggacttttttttttttaaattaactgtgaacatgtatgttgttttgttaaaaaaaatgagattttttttccttcactaaaataaactgaaactgtagtacaagatgatctgacttggctgtttggttgtgaaacctccagtactactaagtttaggcccctctccggtctcttgtctagaggctgtaggccttgttggcagctttctgggaagtggtggtggtggtggcagtggggattgttaacatgttaatgctcatttaatgttcctgattcacaacaccacccacactctctatagtctagagatcctcggtttcactccccagagagtacacctccagtctaatgccagggtggggcgagggaagcccactagttgcttgatgggagaggaaggtttagggtgcttagctgcttcttaactctttcaacccaggcttcctatttggatgtccgttttcacccctcttttctctgcctgatgccaccaatttctaagtcttttggaggggttggtgttaaaatcaggttgtttcctagttttcctggcgactgactgaggattccatctgatagtctgttcagttagttactattgggccatctgctctccagcttttaaaattctgtggctgtagttattttcccctttgtttttttattcttgtagatttattcttaaaaaacaatccttttagtatctttttgagtgagttttgagagatagtgaaagtaaaatgtatttgctcaagctgtcatctttacccaagactctgtaatattatttctggtggcaacatgggtatttcattgtatggatatagcatgatttatttaactctttccctacagttggatgttgggtgcccattaaggttgcttagagttttcccaccactataaacataaactctgtgattaacattcttgcaactaaatttttcagcatttccttgagtaaatccttaggataatttatttacattggaatctaggtcagaaaatatgtgaatgtatattggcaaagtgcttttgatgcatagtgctgaatttcttctagaagtgaacagtttcagtttccaacttcagtatataaatgtgctcttttcccctcatatttgctaatgctgaatgggcagcaacttgtatcttccctgctatttctcaaagcagttgacatatttttgcatttaattattggccatttataaaaattcgtttgtaaatgttcatttttgtgtcagttttcctaattgaatgttgtactttttttttttgtttttgggagacagggtcttgctctgtcacccagcctggagtgcagtggcacaatcacggctcactgcagcctcaaccaccaggcttaggtgatacccccacttttggcctcttgggtagctgggactacagacgcacaccaccacccccagctaatttttagtagtttttgtagagacatagtttcaccatgttgaccaggctggtctcaaactcctgagctcaagcaatctgccccccttggcgtgccaaagtgctgggattacaggtttgagccattgtgcctggctgagtgttgcatcttttaaataaatcttattaaaaaagataaactaaaaaaatttatgttaaaattgttactcctattttgtatatgctgaaatatcttctagtttactagttgtcttttaattttgattatggctttttaaaaaaatactacataagtttccaaattttatatagaaaaatccatctaccttttatcttatggtttctatctttgatgtcatgcttaaaaaatccttttctccttaacattatagaatggttaatctatgttttttttattttttattattttattttattttatttttttttgagacaaggtcttgccctggcacccaggctggagtacagtggcatgatcatggctcattgtggtgtcaaactcctgggctcaagcaatcctcttgcttcaggctcccaagtagctaggactacaggtgtgtgccacttcgcccagttaaaattttaacattttttatagagataggctctccctattttacccaggctggtccggaactcctgcctctgcctcccaaagtattgggattagaggtataagccagcacacctgctctgttgctcaggctggagtgcagtggcatgatcatagttcactgtaatcttgaacttctgggctcaagtgatcctcccaccttagcctcccaagtagctaggactacaggcatgtgccaccatgcctggctaatgtactgttttttttttgtttgttttttgttttttgtttttgagacagtctcgctctgtcacctaggctagaggacagtagcgcaatcttggctcactgtaaccttcacctcccaggttcaagtgattctcgtgcttcagcctcccgagtagctgggattacaggtacctgctaccacacccggctaattttttgtacttttagtagagacgggatttcgctatgtttcccaggctggtttcgaactcctgagctcaggcaatctgcccacctctgcctcccaaagtgctgggattataggcatgagccaccgtgcctgactgtctaatgtacttctttaaagtattcgttgggctttgttttttatgtttaaaatttcaacttatttgaacttattttggtgaaagtataaggtaggcatttaagtgtagagttctacaaatgactagattcccagtgcttttttttttcataatctattctttgcttgctgattttaaatgacattttaatcataaatcatatgtatatgtggtatatataacaggttattatatatacatatatatgatatatatgtacacacacacatacatatacacatatgccatagtgaacttctggactttatattttttattgctatgctattgtactaatataactttataatacaaatctaagtggggttagtgtacactcattgctcttattaattttcaaaaactttctagctatccaagtaaccatttctaattgaaataatccagtgaaaacaattttgactatcaccatttgaaaacacccttgcaaatttgaagtttcagagctaaggaaatgactaagcagtaagttagttcctgtgttagttttttacataggactgacaatgagattgatttaaatgacctgtcatttgcttctgactggcatagcctaaatcacaggcatttcagaaggaatatcagtgatgatgatcggaagtcctttttcgtatttagttctgtttaaaaattcttcttttgctgggcattgtggctcatgcctgtaatcccagcacttcgggaggccgaggcaggtggatcacctgaggtcaggagtttgagaccagcctggccaatgtggcgagaccttgtctctactaaaaatacaaaaattagtcgggcatgatggtgggcgcctgtaatccaagctacttgggagactcagtcaggagagtcgcttgaaccccaggggcggaggttgcagtgagccaagattgtgcctcttcactccagcctgggcagaagatcaaaactctttctcaaaaaaaaaaaaaaaatccttcttttgctaaagcataggaactgtagggaggttctctttcagtagggccatgccatcctgagaaagtatgcaagtggttatttgctgtaatgtgtactgtatccacatattcttctttagcccataaactaagatattttgtatattattttttatatatcaagtttaaaatttttttattgcacatgtatgctcatataaaccttcagaatgttacagatgtatacaggatagacagtaaaaatctttagtgattctgcctactagatataattaatggtttggtgtgtattactccagattttttgtgctatgatataacagtgtttcatattattggttattgttttattattgttatgatcatcattattatatatattttccttttacaaaaacagggctatattatatataattgtacaacttttttttgctttgtaatgtatgttgtgcatttttttcatgctaggaaaaggtatatatcttcttttttttttctttttaatatggtgtttcagtatatggttatttattatatttaacttactatcttttgatgatcatttgagttgtttccttttcctcctcatctcccccattacagacatttctacagtctttgtgcatatcgtttgagatacttgaacataagatagatttcaagaaatagatttggatcaaaggatatgaatatttaaaagttgaataaatattgccaacttatgtactaaaatgtaccaatttatactacagtaacattttatttcggtgcctgattttctatgctattatcagcattaattattaatttaaaattttttgtcagtcattttagtttttgttttaataattgattgagaatctttttgtgtttctttgtcatttgaatttcttctatgcctgcttgatcatgctcagagtatggtttttatatgtatttcaagtacaaggcatttttttattgttggaaaagcctctttttctcagtagtttttttttttttcttctttttttctctgtagacttcctctgtggacatctcagtagttttaagcttagtgtcagtctctctccctttctattttaggataccatggccaagcggaatacagtgataggaacaccattttggatggctccagaagtgattcaggaaattggatacaactgtgtagcagacatctggtccctgggaataactgccatagaaatggctgaaggaaagcccccttatgctgatatccatccaatgagggtaagaaagtggacagaaagccagtggggtggttagttactgatcatcattaaaaagtgaagttcaagccaggtgttgtggctcacacgtgtaatcccagcactttgggaggctgaggtggatggatcaccagaggtcaggagtttgagaccaacctggccaacatggtgaaaccttgtctctactaaaaatacaaaaattagctgggtgtggtggcgtgcgcctgtaatcccagctgcttgggagactgaggcatgagaatcacttgaaccccagaggcagaggttgcagtgagctgagatcgtgacactgtactctagcctgggagagagagtgagactccatctcaaaaaaaaaaaaaaaaaaaaaaaagttcaatggcttacttgtttaagttgcaaacaataaatgaattatgtgtaaatttgtaagtgtcgctatagatgatacacctctactgactctagttgtagtcattaattaatttaagtgtgttccacccctctccattccagaggttgtgtattgatagccctctggcaggacataggccatagaaatgcttagtttgatttgtgctactctctctctctgtctgtcactcactcattttgaatagtttagacaaccacattttaacatgtcaacattcactagagctgagtagtggttcagagtatgaactctctactttatcagtctccatgattccctgttgtgtcaccaagtattagctgccacttattacagtatttctctaatgtttttcttataatagtgttaagaagaaagcaaactgtatttttgaactcatgtcactgaaacccagccttgttcattttttatctttcttctgcctggcccctataggtgttttgaatttgtaagttttggtttgtagatccccatatcctcttcatctggaggctgtgtactctccaacccctgtctccttctagaatgttaagggcccatagaatgcatctccagtgaagctcttccagtgctcacaccctaagcagttcccaggcttaactgtcccagaacccttcatcacagcactgttgtaatacacccccccgccaaccctgccttcctcaggggctctgtggtcctctccatccttccttaccacagctcttcctcttctctgactaattaattctcctattaaaagacttacacaaattcatgttcccaaggtaagtcctccctcttttttgggagaaggagtgaggagatttactagttacaattttagatttaaagaatataatttaagctgcttatttgtatagtgttttacttttcaaaaaacatggcttttttaaaattggaaatttaataaataatagtcttatttttggacatagtagaatgtaactgcaacgtagtgggccaatttttaatttttccccctcacacatgcgttgatttagcttactttggaagttaatgaccccattgtgatttttgggacttctggttgatgaccttattgtgtagttgctgctgacatctgggggtggtaataacttttaagaggcagggaaacttgacaactatggggtcaaggttatctttaggatgtagatactcttaggtctcgcctttctactttgaaaggcaatgtactgtggttaccaaaataataataataaaaaagcttgattgatgttgtgaggtttagggaacaagacccatatatgagagagggaaaaggagagagggagatatatcaggttctttaaccatcagatgcttagacttttgttggaatttgggtgagcttctcagtgggtaagtgaaaaatcatttaccaagcttcaaatgtaattccacatgtattttttattggagcattacttttattttaccagatctttttgtttgtttgtttgttctaaccaggcaatcttcatgattcctacaaatcctcctcccacattccgaaaaccagagctatggtcagataactttacagattttgtgaaacagtgtcttgtaaagagccctgagcagagggccacagccactcagctcctgcaggtatgaatcaccctgtgatgccatctcgctccatttcatttacttgctgaccaaaagatgccatgaggtcacctacgtggagatagtaaagaagtataaggcaggctgggtgcagtggctcacgcctgtaatcgtagcactttgggaggctgaggcaggtatattgcttgagcccaggagtttgaggccagccagcatggtgaaaccatgtctctacaaaaagaatgcaaaaaattagccaggtgtggtggcgcatgcctgtagttccagctacctggaaggctgaggtgggaggtgggagaatctcttgatcccaggaggttgaggccgcagtgaggcatgattgtgctgctacattccagcctgagcaatagagtgagacgctatctcgaaaaacaaagtaaaagaagtttaagacattctctacctctagggaggtttgaatctatttgagtagaaaagaatgttaaatcattgaacaagacaataatgtaagaaaatacagggcagtatgggattagagaaagggaactgacatttagtgagtacctgctgtccgccacatactttgcatatgtgccatttaatcatcacatagaccctgtgaagggtgggtattatttcagttttatagataaaaaatggaaacttagggaggtttactcatttcgggtcactcagctggtaagtagcacagtcagtattagaacttgagccttttttattccaaagcaggggtaccatcaagtctacccgagtctgacaaagaattaagagcagtggtgggtactgttgtagttcagggtgggagaaggcctctttggactggagatgcaaaaagtgttttcctggaggaggtagcttctaggcctggtccttgaaggacaggtggcatgtggcaggcagtatgcttagtggttaggagcttggatcctggtcagattgcccaggtttgaatcctggctcccaatttactagctttgtgatcttgggcaagtaacttaatctctctgttcttttggttttgtgatctgtgaaatggggatacagtacctgcctcatgtgttgtgatgattaaatgatataatgtgtgttactttgaacaatgttcacatgtattgaagacagtatggtatgaacgtgataaatattagctattataattgggctaggccaaccgtttgcagtcatttcagacccagtgccccctttttataaccaatgtatatatttaaaaactctcattacttttctggaatgaaactcacatataataaaacctttttatgcccataatttaaaaagaatcaatattgtctatgatgtgatggagaaaaataaagataatttataatgaaataatatggctttcaacgtgcagttacttcagcctgacccagtttgcagacataatgaaatagatacctgtgcctggcatcatgaatgagtttagatttaagagctgtaagaaaatcagaaactagccaggtgcagtggctcatgcctgtaatcccagcactttgggaggctgaggcaggcggatcacttgaggtcgggagtttgagaccagcctggccaacatggtgaatccccatctctactaaaacaatacaaaaatgagctgggcgtggtggcgcatgcctgtaatcccagcaggaggctgaggcaggagaagcacttgaacccgggaggcagaggttacagtgagctgagattgtgccactgcactccagtctgggcaacagagcaagactccatctcaaaaaaaaaaaacaaagaaaaggaaaagaaaatcagaaactacgccatttaagaaatacagtaaaaagaatgagtggacactagcatgaaactgatgttaaataataacaggccagatttatttgtctcttattacagaaggtgggatatgatcttacagattttctaagtggaaagaacaaggcaatatgatattattgcaaatgagctgggtcttatttctaagtggattgccaaattctttttctacctggatggggtagtgacaaaatgttacggaaatgtatctcctgtgttgcattctgaccacattttgaggtatactgtccatctctggagttcttacttggaacttgtatcctttgacgggtgatggagaacagagaatggattgccaagaaacaatggggacaatattggagtaagtttggaagacaacaggcaattccccaaaaagaatttccatatgtaactttcacagcatagatttcttatcacgtgctacaaatacaaacaataaaaacatatgatggtattaatattaaaaacttataaagcaaattttattaatgaaattcagcaatacccctttgtttcaagtatctttggtgattgaataatatttgggtcaaaatctgttacatatatatgatcagttttagtatgtctgcagcaactgcatttttgcactaaaatcctttttacctaaatgtgtagttggaaatgctaccatagaaagaacaagtcagatgagtagatttttcagtgatttctaaataatttctttattccattaagctcccctctctaaaatcacctcccaaatcactggcctttttgcatatctcttgaaaacatttttttagtattatctactaaggtgtatacacaccctgagacatttgaaaaatgtgcagaatctgccacagttcatggtcgtacaggacagttctgtactttgcaaaattgctaatgtcccatgccatttgtgctcaccaaacattgtggcagctataacatgttcccaacatgtttacacaagttcctccaggagatgatactccctattgagaatcgctagatttgacagagagaaatggcataggcatttcagccaggctgaaaaagataggcaaagactgaatttgctctactcagagttataaagcgagtgtggtttagctgttgtccgaagcacaaagagaaagatcagattcgttgattgattcaacacatgttatccagtacctactgtgttccaggtactgttttggcactgtcaccatataaactgtctccagtattttctactttgttcttttagcacccatttgtcaggagtgccaaaggagtgtcaatactgcgagacttaattaatgaagccatggatgtgaaactgaaacgccaggaatcccagcagcgggaagtggaccaggacgatgaagaaaactcagtgagtggcagccgttgctgtgggcctcagacattgatgcttgttattttatgattgccaaaccaggtaagatgagtaggaggtattggatcaacttggagctggagatgcttccagcataactatgtcctaacctggatcaacgcatgctagagggttgttgtatctgtgcttattcttctcccagtgcttcctaaaacacttttaaattttactctttgcccctcttttactcaatttaactttttattttagagagagaatgctcaggtctgggacttggcttttcatatccttttggggaatctgggatccatacttaacatgtagcttttacatttatagacttcttcacaaccctgagattccaaagatgttcacatgagtttcttagatctatgtcacaaaactctattaagaagagtagaggaagaattcctttagggttagatacactgcttattatcacgtggataaatttgtcttctttgcttaagtaacagcgctttcatttctggaaggtgagtttaggacctgaataagtgttaaatctcgaaatattttcactaagacaggtagtagttattcagaaaactcaaagtcttttgtcaaattagccccaatttgagattgtatccttttacaggaagaggatgaaatggattctggcacgatggttcgagcagtgggtgatgagatgggcactgtccgagtagccagcaccatgactgatggagccaatactatgattgagcacgatgacacgttgccatcacaactgggcaccatggtgatcaatgcagaggatgaggaagaggaaggaactatgaaaagtaaggctctgagtaaattcactgacttcttagaccaagcatacatatttcagagaagacagattctcatggttcatgcaggcttagccttgggttctttcttttgtcacaaccaaaggagtagaaaacttggaagtttgcgatggggacaggaggtttggtgagggggaaagctggcctgtggagtcaaagtcaagaaagcatcaacagtgagaaagaattttgcttttgaaccagagcagccattttctcattgaatgttgttattattttccttccttaccttgatctttggaggcaagcacatgcattgtttgatgcataattcctgtgaaggtgtaatgacattctgagttatttactgtacatacatcttcagtttattttcatgacagtttgggtctaacccaagtttaccaatactgtcagtcaatgaaagatgactgtacaagttgaaaagttctatccagtttcttctagtttaaactcatctctgcttctgtccgtatctggctgatccttttttgcctgtgactaggcctaacatcttgtgttcagctcctatcttagagtgaaattcttgtgtcattcagtgctcgtggtgctttatgtttcatcccctaaactcaagattaaggcactgtagaaatcccatgtttgatgatgtacaaattatcaactaaatgccatgtactagattgcccttctcctcccctcctgttttaaaagtagccagtatgatttgttagtaatgttcattttgcagtaatgagctactgacctctagttattttcattgactctgagtactaaattgtctacttgtcttaaggggtttaattatgtagatgattataaccgctgtgtaatacaactaggccaacctgttagtatgtgttgtacatgcacgtgttagggaaattgtgcccatttttatttaaagaattaatttttttccaaatgtgattttcataattcaaatgctaattcaatgagttgtttattcttttcagtttctgaacttgttttcagaactggatagttttagcatgtctaatgagaaacatgcatcttttattataatcatgaagagaactgtttaaaaacctaagcagtcacagtctgagtaacattaaatacaatttgttcacagacagtctgttgcagattttgtaattctcccttttggattacagatttgacagatttgccacttattttgagatttttaaaaattccttattgttttaggagttacttaaatttatcattatggaaaattaaaacatacatacaattacacagaataatataatgacccctatagacctatatcactcagcttcagcaatgatcaactcactgcccgtcttatttcagccccacctcaccaaaaagcaattagtaaacactttgtaaaagtattcatttttaaggccatgaaaagcagtgagaggagtaaggggtaaaaaagattcttaaggtaatgcaggcttcaaagtcctgatttataggacatgctatgacatcagtggtattttgggcaagatttttttttttttctgataataactctagaaaatagtaaaatgaattaattcaaagtaaatctgagtcatcataccatttctttataattgattttaagtatttatttaagttattatttttttaacagatagggtcttgttcttgcccaggttagcgtacagtaggtatgatcagctcactgtaaccttgatctcctgggctcaaactatcctcccacctcagtctcccaagtagctgggagtatgtataggtgtgtccagctaatttttaaattttttgtagagacagggtcttgctatgatgcccaggctggttttgggctcctggtcttaagtgatcatcctgccttggcctcccaaagtgctggaattagaggtgtgagccacctctcctggcctgatttaatatttaatattggaccaggtacaagcctggggctcagatactgatctatgtggtgttagataattcactttcctcctatgggtctcagtgccctaatcagtaaaattaaattattactaaacttgtttattttcattgtcccttattcctctaatagtcaacacatttataaaaattgtgtaattcatgacttgcagaactgaaatttctagaggttaaaatttgtgaaaatggatagactttcatttagttccttatttgaacctctatgaaatgtttatccttggaaattaaaattataaatgttaagggaggctatgcatgtgtggcagggagtatatgggatatgggaaccctcctttccttcctctcagttttgctgtgaacctaaaacgtctctaaattttttttttttttttttttggagacggagtctcactctgtcgcccaggcttggagtgcagtggtgcgatcttggctcacagcaacctccacctcccgggttcaagtgattctcctgtctcagcctcccgagtagctgcgactacaggcgtgtgctgccacacctggctactttttttgtatttttagtagagatggggtttcaccatgttggccaggctggtctcaaactcctgatctcacatgatctgcccacttcagcctcccaaagtgttggaattacaggttgagtcactgttcccggcctctaaaaatgtctttaaaaaaatgataactgttggttagtccgagtgcagtggtgtttacaactaattgatcacaaccagttttttctttttttttgagacggagtcttgctctttcgcccaggctggagtgcagtggtgtgatcttggctcattgcaacctctgccttctgagttcaagtgattctcctgcctcagcttcctgtgtagctgggattacaggcgtgtgccaccatgcctggctaatttttgtatttttagtagagatggggtttcaccatgttggccaggctggtcttgaactcttgacctcaagtgattcccccatcttggcctccccgagtgctgggattaaaagtcatgagccactgcgcccggccacaaccaattttttctttgtttttctccactcccactgtttcacttgactagccttaaaaataaaaataaaaaaaaaataatcttttaagaaatgcctgttcatgtcctttgcctaatttttcatggttttttttttcttgtaaatttgtgtaagttccttgtagattctggatattagacctttgtcagacgggtagattgcaaaagttttctcccattctgtaggttgtctgttcactctgatgatagtttcttttgctgtgcagagactctttagtttaattagattccgtttgtcaatttttgcttttgttgcaattgcttttgatatttttgtcatgaaatcctttttttctcctttttttttttcttttttcttttttttttttgagacggagtcttgccctgttgcccaggctggaatgcagtggtgcgatcttggctcactgcaacctccgcctcccaggttcaagcgattctcctgccccagcctcccaagtagctgggattacaggtgcatgccactacactcagccaatttttttttgtatttttagtagagacagggtttcactatgttggtcaggctggtctcaaactcttgacctcgtaatccgcccgccttggcctcccaaagtgctgggattacaggcatgagccaccgcgcccagcctcctttctttccttctgttggattgattgagtcctcaccgccatcacttcctttcccttaccttaatcccctctctccactctcttctaccaactggcaaagtgtatgcataagtatatgcttacttaaatttctactttcctaataaatttcaaagttaatcagtatctctctcctcttcctgaataagaaaaaggatttaagacacttcgcctttttttcaaactgcctctctcatattttgttattgttgtctattgctttggttcaccaggtttttaaaaaacattagcagctgggcgctgtggctcacgcctgtaatcccagcactttgggaggccgaggcaggcggatcacgaggtcaggagatcgagaccatcctggctaacatggtgaaaccccgtctctactaaacaaaatacaaaatattagccgggcatggtggcaggcgcctatagtcctagctactcgggaggctaaggcaggagagtggcgtgaacctgggaggcggaggttgcagtgaaccgagatcgcgccactgcactccagcctgggcaacagagcgagactctgtctcaaaaaaaaaaaaaaaaaaaacaaaacgttagctactataatcattatttagagtcaatacaatttatgaacatagtgagctactaatatgtttgcttacctttgcttctttaagcttatactttatcttatgggctcatttttcttctcctttcagtaggatgtaatgggtagcaaacttttataatttgtatggttaataaaagtcttaatttttttctcttttttgaatatagtttactgaggcatggatttctaagtggactcttattttctctttgtactttgaagagatcattttgatattttctggtatctgttgatggtgatggaaattctgttgtcaatattgttcttttctagatgatttacttttttctctttttttcattttcctgaatattttctgttttaacttattgtctctatgttggattttttttttccttctaattctgcttcttctggctctgtacttttcaatctaaggacccaggactttattcagttttagaaaattctctttggtttctctattattattattttttctaggatttctttttctccttttttattttatttttgtttcattttgtttcggatgtatttatttatttatttatttatttattcccagaaatgtggtcttgctatgttgtccaggcaggtcttgaactcctgggctcgtcatcctcctacctcagtctcccaagcagctgggactacaggtgcatacgactgctccgggcttgtcttacagatttttttctgtttatctctttgaacatttcaatttccctttaaaaaaaaactttcagatcctgctattattttgtgttttttgggtctaatttttctgtttattgtgtttgttatctctcatattgttacatttcttcttacactttgtaaattttgtttttgagcttatgtttggtgagaattatcttgctcggaggtcctttgtattccttgggttgtacaggcatccctagggccctatggggtatttctttctagagcagtctttagattatttctcagttccacattggacttgtggtacagccaagggaattgtatttctagaagttgattttttccacctcttacctaccgaagcagaagccatttttaagccatcttcttaagcttctgggcagtattgtcctggctcctatctttatgctgggaattgagttctggcttcccctttaacaggtatgtcttgccttctgccttatcctgattgctatttgcacatctgccttaaagctaaagtccttgtgatttggttttcccagtaggccactcggctcagtgctgtgggtttctttcccgcttttggcatctggaagttttcgttttctggttctgagcgctatgggttgttttttgtttgtttgtttgtttgttttttaagtcttgagtttctgtttgtttataacaggaggggaggccttagcacttcagctcattccgttatcttaactgtctacagagatgatgtttctccactttctctataaaggaacaggttcagagagattgagattgttgcttgttcatggtcacatggctagtaagtggtggagctggaaattgaaagcacttcagagttggctggacgcagtagctcacgcctgtaatcccagcactttgggaggccatggcgggcagatcacaaggtcagaagatcgagaccagcctggccaatatggtgaaaccccatcttaagaatacaaaaattagctgggcatggtggcgggcgcctgtagtcccagctactcggaaggctgaggcaggagaatagcttgaacccaggaggtggaggttgcagtgagccgaaatcgcgccactgcactccagcccgggtgacagagcgagactccatctcaaaaaacaaacaaacaaaaaaaagaaagcacttcagagtctatgctctcttcattccacagagcttctgatttgttttggttgcctattatattcataggcgttagatccataatagaaaactcatcatagttatggtgattctggtgctgtctttcactgagaatccagggatggcttttgtttgttcgaaacaattgtttattcatttatttatttaaaaaatttcaacttttattttacatacagggggtacatgtgcaggtttgatgcataaatatattatacccaggtaatgagcataggacccagtagctagtttttcgacccatggtcccctttctccctctcacctctagtagtctgcaatgtctgttattctcatgtttatatccatgtgtgctcagtgtttagctcccactaagtgaacacatgcggtatttggttttctgtttttgtgttagtttgcttagaattatggcctccagctccatccatgttgctgcaaaggacataattgcatttttttaacggagtcttgctctgtcgcccaggctggagtgcgttggcacgacctcgactcactgcaacctctgcctcccaggttcaagcaattctcctgcctcagcctcctgagtagctgggattacaggcatgtaccaccacaccaggctaatttttgtatttttagtagagacagggtttcaccatgtcgtccaggctggtctcgaactcctgacctcaaatgatccacccgccatggcctcccaaagtgctgggattacaggcgttagccactgcgcctggcctaattgcattctttttttatggctgcttacacggatggttgcgtagtattccatggcgtatatgtatcatattttctttatccagtccactattgatgggcacctaggttgattccatatcttcgctattgtgaatagtgtggtggtcaactcatcgtatgaatgcatgtgcatttttggtaaaatgatttattttcctttgggtatatagccagtaatgggattggtgttttaagttctttgagaaattagcaaactgctttttacagtggctgaactaacttacattcctaccaacagtatataaccattcccttttctccatagcctcaccagcatctgttgttttctgaccttttttttagtaatagccattcttactggtatgagatatctcattgtggtttggatttggatttctctgatgattagtgatgctgaacattttttcatgtatttgttagccacttgtatgtcttcttttgagaagtgtctgttcatgtcctttgcccattttttaatggaattgttttttgcttgttgatttgtgtaaattttttttttatagattctggatattagacctttgttgaatgtatagtttgtgaatattttctccctttctgtaggttgtttacactgttgatagtttcttttgctgttgtgcagaagctctttagtttaattaggtcccacttgtcaatttttgcttttgttgccattccttttgaggacttggccaaaaactttctgccaaggccaatgttgtgaagggtatcgcctaggttttctttttggatttttatagtttgaggtcttacatttaaatctttaatccatcttcacttaatttttatatatggtgaaagataaggatccactttcaatcttcttaatatggctagtcagttatgccagtaccatttattaaatagggtgtcctttacccattgcttgtttttgttggccttgtcgaagattagctggttgtaggtgtgcaggtttatttctgagtttcctattctgttccattggtctatgtgtctgttgttgtaccagtacaagaacagcattctggttactatagtcttatagtttgaagtcaggtagtgcactgcctctggctttgttctttttgcttaggattgctttggctatttgggctctttttggttccatataaattttagaatagttttttctagttccgtgaagaatgtcattggcaattttataggaatagtatggaatctgtaaattgcttcggagagtatatacattttaattatattgattcttcctatccgtgagcatacaatgtttttccatttatttgtgttgtctctgatttctttcagcagtgttttgtagttctcctagagatccttcacttccttggttacctgtattcttagatatttcattttctttgtggctgttgtaagtaggattgtgttcttgatttcactctcagcctggccattgtttgtgtatagaaatgctactgatttttgtacatttttttatcctgaaactttactaaatgtgcttatcaattctagtagccttttgacagagtctttaggattttctaggtatagaatcatattgtcagtaaagagagatagtttgacttcttcttttcctatttgagtgcattttatttctttcttttgcctggttgttctggctaggacttcccaattatttatttgtttatttatttttttctgaaacggagtcttgctctgttgcccaggctggagtgcagtggtgcgatctcggcttattgcgacccctgcctcctgggttcaagcaattctcctgtctcagcctcctgagattgggattacaggtgcatgccaccacacctggctaatttttatgtttttagtagagatggggtttcaccatattgggcaggctggtctccaactcctgaccttgtgatccgcctgcctctgcctcccaaagtgctgggattacagtcgtgagccaccgcgcccggcctcccaattatttattatatgtaacttatgtgttatactcaataggatagatgttataactgctaataataattattagtgattaggcacttaatatataccacacactgtgatttatcctttaagcatttcacatattttgatcattacaaccatgctgtgtggtaaattgaaccattccctgtttaatagcagttgaaacccagttgcagagattaagtaacatacttgtgattatataatgagtaatagagaagccaagatttgaacccagatatgtttgatttcagtggttatgttctgaatcattagattatactacttctagcagagcccctttatcaagtgttgggagctgggactaaggcttatgttacagatcatgtgttggtgagtctcagcttgtagtaatgtacttctccttgctggttattttgataaccagttactctacatatgtcctcagtatttccagaaagaaaggacagatggttttcaaagggagcatgcctctgataagctaatgatattgttacctctgagggaatttgttttggatgtatgtatctgaatctataggaaggagtcagattgcagttggagagaagggattaaggtgggatttgattgattttaagtggcctcaagcatacatgtgagaacgaaagaggcaaaccatggtccacgttacttggaaaacctctgtctggataaaatattagattggggattttggaaggcttcttctatttgtctagatatgttcttgtttttgttgttgtttttgtttttgaataagggctctagaatagccttgtttacctccccaaacagcaggacacattattgaagtgacatgagagggtctgtgtcagtgttaggatcattgtgcattctctgggccagcagagggagctctgtattaagttaatgggttataatcgtgttcccatttgagttcacaaatcccctttatataaaagtagcctttatgctagaacaagaccattacttattcattcttaagtgtattttaagtaaccgcagtgacactagggcaatgtctttattttatttagttgggagattggatacctcatacttggcaaagttcaaataagaagtcagccaaaacatctcaaaatagtcactttttctctcccttcccagatttctcagtggacttgacacaattggtgttctttttctgtagcatggtaccatgcatatagtttttaaactgtaatcagctaaaatggccttacttgaataactgaataaattttttaaaaaacctaataattcttgtgtagaactgatttgaaagttcttgtgtagaacatacatatatatatatatatatatatttttttttttttttttaagtcaagttgttgggagccaggactaaggcttatgttacagtaaataacagtaaaaatatatatattcctgatatagatcaggaatttgtttttgtttacaatatgagctctagtagtctgttttatttttccatctgaaagacttgcttcctccctctatccaggtctttgatcctgtcaccttctcagtccttctttgactatttgtctgcaatagatttcccatccccttatttttcttttcatcacagattacttcttgaaatttatatcactcttctccgatacaaatttttttttttttttgagatggagtcttgctctgtcaccaggctagagtgcagtggcgcgatctcagctcactgcaacctctgcctcctgggttcaagcaattcccctgtctcaacttcccaagtaactgggactacaggcacgcaccaccacacctggctaatggtttgtattttagtagagatagggtttcactgttttggccaggatggtctcgatctcctgacctcgtgatccgtccacctcagcctcccaaagtgctgggattacaggcgtgagccactgcacccggcctctcccatataaattttaggatcagtatatcaaattttataaaatactactggaattttgacttaattgcattggatacacagattaattaggcagaattgccatctctgtgttaattctttctatgcatgaacatggtttatctttcaatctgtttggtctatcttttatattcttagataattttataattgtaccaacaaagatgttttagagctttttgttaaatctatttttagatacttatttgttgctattacaaatggcatagtttaaaaaacttttgtttctaacatttttcttctatagacaactactgtagatatttatggactgttttattcattgtaacaggttttatggagattgcctttttaaaaaaatggagacagtcttattgtctatgaattatgattatagtttttccttttgatctttatatataatcttcttcttcttcttcttcttttttttttttttgaggcactgtctcactctggaatgcagtggcgcgatcctagctcactgcagccttgaattcctggggccaagcaatcctcctgcctcagccacctgagtagctgggaccacaggcatgtgccaccacacctgtgatttttttttttttttttttttttttttttttatagagatgggatctccctgtgttgcccaggctggtctggaactcctgggtgcaggtaatcctccttcctcaacctcccaaagtactgggattacaagtgtgaaccaccaagcctggccaaggtttttttcttattaagacctccaatacagtgttgcatagtagagctggtagtggacattcttgtcttgttgctcactttaaagaaaattcttgggattttttaccatggagtctgattttgcagcagaatttggtcgataccccttaacaggctaaataagttttggtttatttttagtttaagaggttttatttaaaaaaaattctttaattaatgttgttttgtctttttttaatttgaatagttagctttttaattttcttgcttactaatacatttaatcaacattgtaactttttctcttagttctgttttagctgtattccatacattttcatatgtggtatattgtaaatatttttttccagtgtgtagtgcttgtgctatacacatttattttttaacccatgagttattcggaagtgttttttaatagcaaatgtatgatttttaaaaactgcttatttaaaatttttaatttatagaattgtggttgaagagtgtggtctgttatatcaattctttgttattttttgagacattgtggcctaacatgttattaattttcattaaatgtgctttgtgtgtcttaaaaataatgtattttctaattgtttggtgcaggaatctgtaattagcaatcagttgctaattgtctttcatttgtctatctttaccaatttttgatacttgatcttttagcttctggagatttgttaaaattgttaaattgttaaaattgtcactgtgtggttgtgggttttgttaattttggtattactcacatatgtcatccaaaataatatactggtggcactgaatacaattggtagtactgtgaaaatgatggaattttttgcatattttctcttttatattaaattatatattttctctttcttttatcttaatatgcagaagaatagtttcaccattatccgttttcaagcaaccatttttttaaagcagaagaatttcttctgttttatttgatcattatgaaatagggtgttaatatttagagctaaaatgaaaacggtccaggatgtggtggctcatgcctgtaatctcagcactttgggaggccgaggtgggtggatcacttgaggtcaggagttcgagaccagcctgaccagcatggcgaaaccccatctctactaaaaatacaaaaaatcagctgggtgtagtggggcgtgcctgtaatcccagctactaaggaagctggggaaggagaatctcttgaaaccgggaggcggagattgcagtgggccaagatcgtaccactacactccagcctgggtgacagagcaagactgtctcaaaataaaataaaataaaataaaatggaaaggattaattttatacttgatgtagaaagaatccaagctttcacaacattattaaatatttaaaaagtatatatttgaaagcaaaaaaatattttttttttagtggcaaagataacaaaaacattttggagcaactgaagtagcttgatttgcacagacttgtagtttagcagttaaatgcttttgcccctcatgaggaaatgacaagccaaaggatggccacttgcagtaacatgtactcatccactaaagatttgacatgcggcggttcttcctctcaggattcattggcgataatgtcatggttttcttgtccttaccacattcccaagagatgcatagccctggtcacccctcctcatctccaggcttaataggtcaatgggaggcagaacttggactactaattgaaagaatgtttcccctgaccaagccttcaaattagattcagtgaattgaagggagtgagatgatgattcctctttaaaacttgtacttagtgcataagattctaatttttctcccagagcaacagccacattaatctctttgaaacagaattttaaagcataatgacataattaagttagggcaactaagagacatgttttagttaaattactgagatagtattttgtggtaaaaacattatgtgtttatagttcctcagaaagtcctaagtttcatgaaggcacctattgttgctgtgagtttcctcatgttgaaatcaggtgaaaggctaggctgttgtcaaaatgattttacttcaacaccgtccatcagatactgatttcagagctgcataagataggaattcttgactcagagcctattttctttccatctgcagtttgaaaggggttgttagaacattgtctcccttgtgtgttatctgtcttattctcactgactcagattatggcatttgcaagtacagtaattaggacataaagtactgcaagtattttaacacttcttttaccacggtagccttactgtccaatttctgatcccttcaggatttaaacatctatcatcagagtattgtgttggtgtatgcttgccactcacagtcagcatcacatgagagtttcagacagcattagtccagttatgcaccccaaaactaaagctgaaaacatttgattttgttggaaccctatctctgagtaagggcaagagaaggacaaaggagtagtggagtgaacattgatttttagcatcagtctttggcttgaaactttgctcagggtcttacagactacgtcaccttggtcaggttctttcttttttgatcctcagtttccttgtctgaaaaaatggggcaccaaagttcctattttgtagttttgtcaagatgatatgagattgtatgtgtaaaatatttaatgtgtaaatgctcaaaaatggtaggtattatagtaagtcttttaatgtatgagagtgtttttttcattggacgtaaacatttcttcaacagtgctacttttcttcttcctaattccttttctcttgatactaactttttactaacttttagtttttgctcttggtattgatgatgttttgtaggtgccaccccaggaatgcctgagtgctggcatgaacatggttgagctaagggaaggtcacttgtcagtttcagtaacattttaccattgtgccgagaagagagagggaggctctgtgtggtttgtgtctgtgtgtgtctgtgttttaaattccttggcaataagatgatacatgttttgagaatctattaaatagcccagaatacaaggtgacggatttttaagagggccagactttagatacacatgagccttcttttgtaaagtttcagcctcttatcttaatacagtggaatttattaccgactggattttttttccacccccgaaagataaccactgtggttcactgtgcattttatcagtagctccctcgtgggtgagatttacaatagaagagcagacatcttggtacttaggtttttctcacagtttcaaaaataattcaaggttgtcctgccagagtggagactaaatcctaattgtttgtgcagtttttcttattgtatccagatgttgggcccccttttatctttggaaaccattagcattcttgattcttttggaatgagccaaaaagcacagaactcctgatgcctgaaaattcattcagaacaccctgccagaccacattttaggatatgaaagtaccagatctcagtataacttgagtgaagggctcaaggcctatatattttgaaagatagctactccagtatagttatattggtaaaaggagagccaagaacagccatgagggaaatacatttttcaagagagggcagtagcataatggtaatgaagaacataggaaagtgaatcacaaacaatatactttggtccttaagcctaagaggcagataaatctttcttcatcagttagtggaatatattatttctctgttgctctaagcttgctgttctgaccttcttttgttcagcaagaaaatggagatacatttttaaatatcaatttaagtggatctataaagaaaaagcagatgattcttttcaaatgtttatgctctataaatatcaatttggaatcagtatttgtttataatgaatatttaataccaaccaagaagcatttattaaatagtcactatgtgtcattaacatgtagagtatgaaaaccaaatgaggcattcactgctttcagtaacttatatattaaaaggggaagatgacatttgtcattatcattatctaatacttatggcatgtgtactgttctaattgttctaattccttatgtgtatagagcattactctaggcgcttcaaataatagtatttgataatgatgcgacgtaggagaaaggacttctacatatgaaggtaataatatactaagacaaatgctaggtaagtggtacaggaaagcgttaaaggatttgtgaaaaggaaggcaatgactcagatatgcaggaaggctggggaaggatgttacaggcaggtgcaaagtcagaaaggtagaaatgtgttttcattattcaggttggccgaagcagatgtgggtgttgactggattttggaagactttgaatttgaaagtaaggagtttgaacctgattctcttgttaatagggtatctgaagacactttgactaggaaagtgataaaatggagtttcaaaagactgtaaaaggtgagaccaattaggaaattcttgcaagaaccaagatgtggaccattctcacctgtgaacattttttatctttttagatgtgctgccactattgctctagttagtaatcctttgaattttggatttagctctctttgaatttatatatttcagttcaccagaattaaaacagctagagcaccattgcccagaaattaagtccattcatatagaggcagttactgaaactgcttaactggaagagttattctgggctccagggaaccttataacttatgattccagcaattcttagtggtttcaaaggacattcaaaggaatatttatggctgtacacagctacttggatagtaaccagtgtaattaaatgagctgatacatgtaaagcacttaggtgcctggtaacaaaaacaaaacccaaaaccacacactcataacaaatgttagaaaaaaacaaaccctgtgataagaattgcacattaaggcatactattccaagccagaggaaaacatttgcaggattaccagagttgttgttgttgttgttgttgttgtttttcctgcaaacattcatgcatgaaacagagaaaaaaaatcaggctctgcccagttctctggtttgcacagaattaattacaatttaagtagaaaagagtcattgtaggaattaaggaaacagtaggttgaccatattggtttacttagtgacagtctggaaaatgaaggtttgaaattgaaggtcatgaagtttaaggtctagtagatggtcattccaatggaacagtgggcttcagtctttggtcaaggtccttcccagttatgactacctagacattatgttgtagttcatatgaatccagaaataagagcaaatagttaaggaaaggtgtcttgctgcttaaaaaaaattgagttactgacatataatttacacaccatacaatttgttcatttaaagtgtacagtttaatggtttttagtttattcacagagttgtgcaaccatcaccacaatctaatttttaaaattctatctaatttttaaagttctactttttttttttttttttaatttggagacaggatcttggtctgttgcccaggctgaagtgcagtggcatgagcatagcttactgcagtcttgaactgggctcaagtgatccttctgccttagcctcctgaatagttgggactacaggtgtgcaccactatgcccagctaatttaaaaaaaaaatttttgtagagacagggtctcactatgttgctcaggctagtctcgaactcgtggcctcaagccatcctcctgccttggccacctgaagtgctggaattacaggcatgagccaccatgcctggccactatttttaaattgagatataatttatatgtcataaaatttgccattttaaagcatagaattcagtgtttttttaggatattaacaaggtgttgcaactttaagcactattgaattcaagacatttttatcatcccctcaaaaaactctaatcctgttagcagtcacttctcatttgcctctcacccccaggcaaccattaatctactttctgtctctatagatttgcctgttttggacagtttatgtaaatggaatcatataacatgtggccttttgagaatggcgtctttcattttgcataatgtttttgaggtttatccatgttatagcatgtatcactatttctttttgttgctgaataatattccactgtatggatacactgcattttgtttatctgttcatcagctgatagacatttgggttgttgattccttctgcttttacgtagcatttttcaaagaaaaataaatggaagatacagttgcttatgaattcactgctttgtctgtaggcttagacagattgttcatttagcttgacaaatgctgcttacaaagaaaaataggccagtcttagcataggaattcatgcatttccggcatcagataaaagaatcagagcaagatgtggtattttcaaggcttgatttctctcttcagtccattctttctacggctttaggtttcttgtattatcattcagctgaacatctttatttcttgggatacatctgaaaaaatatgctagctcaagttaaaacaaaaaacccacaagctagctgaagccctgggggacagcatggcctttaatcagcttggaatgattctcttacacttttcaacctgacaagctgctgtccagcacacttgatcatctatctagctaacgggtgctgaaagaaaagttcaaagataaggttactgggaaaattacatttccccactctttctgcacttagtttaatggcagttctaacatgtcaagaatctttattttgattttagagactgtacaatatgagatgtagatcactaaacttaaaacctgacatttggcattcaagtcccatccttgttggttactagcttagaaatctgcaaatttctcacttgtaaaaggggcataataaataacatatatctcaaaagactctttgaggattaagtgatatagtacattttctggcacttgatagatgcctattaagtgtaaggcttttccccctctactttatatggtggtcatgcagtttggatgtgcagtttggatgagaccattatgtgaaagcacctagtagaaagcctgaaatgtagaaggtatttagtgaatgttagttaaatttgaacctaagtttccaaagaatagaactcttttttccagatttaggggtgtatgtttatgcgtgtgtgtgtgtgtgtgtgtgtgtgtgtatgtttatgtttatgtttatgtttatgtttatgtgagatagagatactgaaactgtgtcagttagcttttgctgcattgtaaaccaccctaaaatttagtggtttaaaatagccattttatttaacttgattcatgattctgtaagttggcagttaggttggactcaggtaggcaggcaattctggtctgagctggttagctctgctctgtggtcagctggtgcaataacagctggggatggctgatttatttgttgagacatttgttgacttgggcctctccacgtagtatttcaccatctagcaggctcaatcaggtttatttatattatagtaaaatatacaagactttttttttttttgagacagggtcttgctctgttacccaggctggagtacagttgtgcgatcatagctcactgcagccttgacctcctgggctcaggtgatcctcctgcctcagcctcccaaatatttgagaccacaggtgcgtgccaccacacccagctaatttttttaaaaaattattatttgtagagaccaggtcttgctatgttgcccaggctggtctcgaactcctgggctcaagcagtctacccaccttggcctccaaagtggtgggattacaagcatgagccaccatgcccagcctacacaagaatttttaagtctcttcttgctgtacatttgctattgtctcaatgcccaaagcaggttagatagccaggcccagagtcattgtgagagggagtaaggtaaggatgaagataccaagaggaaattgttgtggccatttttaaaaacaatttatcttagatactaattgtgataggaatgcaaatctgtttactgagaattattatcagtctataaaatcagacttagtacaggtgctgcaatgtaatgacagtgttattcacaataggaatactgctgtcttcttcatataaacttaacatgtcagtaaagcactctcacacatgaagaaagaatcattatggtggaggcatttattttctggaatcactaaatacaaggatcagctaattgtttttgaatgtctgctgtttcttgccagttaaggtggcttcccctatcagtcagttcattcagtttttcactttagttccataaaatatttcatctgcatctctagacgatatctttattacagtttgagttacctcttccatctgttaaaccaccaacaacaaaaaatccaaagaatcagagatactcttgtcactaaaatatttcttgagtcttaactatttttcactttggtctttgctttatgcctgtacacatctagttgtagcatgttttagatgagaggcatccagtatcataatcctactagagataagaacttcttcttttgaatagttattaataactgagcataaatatgttttcatatgctactgccaagtcataaaatcacggaatttttcaaagctgcagggaacattagatataatctggccctgtgtcttctttttgcagattgggaacctgtggttttaccaagatcgtgtagtcagaaccagaatctaaatctttgaactgcaggatagggattactttccatttttttttattgtggtaaaatatacataacataaaatttgaggagaggaatttttccgttcttctgtctccaaaatcaactttagctttttggcaatctgataaatgtaacattttaactaatcattttgctataattaaatttctaatacatatgtgcattttacttacagcttatatctgaatatgtggttagataaaaaaaattctctttttatttcactttagtttttggaacttcgaattctaataaatgtcaggtataatcaggtccctggtattgatatcagaaggtaaaagcaaatacattttagatagactttcttatttgtggattttcattgttgaaagagacaaagaacagttggtgttttaactccaaaaattagaaatttttaagtgggttggtaagaaagaagaactcaaatatgaggcaagcagatgttctcactttttcatctgaacagtgacagaaatagacaaataattatattctcacttaacagacatttctttgatttttatgacatggtttagaattagaccacagaaatgttatctttagtgtttcatcatccttggtttaaagattcaatttcttaagtccacctgtattgcaactgaaagtaattaatgaagaaccatagaaatatattgttttattgttggatataatacattttaaaaaagaatgacgcccttatggtttttgtaaattccattggagaaaaagttttaaattacctgttatttctgtccagaagtcgccatttttattgatgaactcaatttagtcatttatctgtgcatatataaaaatgaatggatggatggataaacagacgtgaatgacagaaataatgagacaagagaggttggtgcgtgatatatgcagcttactctcaaattttaagtgtgtatttcctaagaaagaagataccctcttttgtttgtatttcctacaaaggagttgctcttttttgttaccacaataaagtggtcaaagactgatttttcctttttatttcttgggaccgtgtctcactctgtctcccaggctggagtgcagttgcatgatcatggctctaacatcatacctagagcacacaaaacaaaacaccatatacttgctgattggtcctagcaaataatgtatttaattcttaattagtgaggagaaaacagtgtagtaggaaaccattggcagtctgtggatatgggcagatacgggattggctgctgttgaacttagcaatggtgatagtgagaaaaatgacaaatgttctgagaggtagggtggctggcctgaaactggactaggaagtgtcatgaaataagtaagattgcatagaccaagggtgcctggagagaaacacttgctgttctttatcttctagataccttctcatctacttcttaaggtgctgagccttctggttgtttttcctgattactgtaggaaagggccgtataaacccctatgttcatggaaagcaatgaaaaatacttcctgtatttccctgtattagaatactaatcagaggcacaaagatacttcaacctttgaaacaggtacattcagctagtttgatttttaaatcatgccaggtaaaattattctttctgctcttgttactaataactaatagctgctgtattctgctctcttaacggttactgctactatgtaactgctgatgcttttctccaggatggtttgaggccccatctaagtccccttttaccagtcttccctgaccacacagcatgcaagaactgggcacatataattcttttaatcaattctatttattttatacctgttcaatactaacttctttttttttttttttttttttttgagacagagtctcgctctgtcacccaggctggagtgcagtggcgcgatctcagctaactgcaagctctgcctcccgggttcacgccattctcctgcctcagcctcccgagtagttgggactacaggcgcccgccaccacgcccggctaattttttgtatttttaatagagatggggtttcatcgtattagccaggatggtctcgatctcctggccttgtgatctgcccacctcagcctcccaaagtgctgggattacaggcgtgagccaccgcgcctgacccagtactaacttatttaaaaaaatgttcatgagaagtaaataaaatcaccaatagtcctactaccagagataaaccctgttaacattttgggtattttcccctagttttttttttttcctatatgtatgattttatagagtcaaaatcatactgtatatataatactgtatcctattttttcctgtaagtttattgtaagccatatgtagatagtatttttaaagttacctaatatttcatagagtggatgaattgtgatttatttatgttttctttttcatgtatgtttttctcattattccagttagattatgagattatcaaagaaagtcaccctactgtatcatcccctcttcctacttaaatgcctatagagaatattgtatgtgatagatgctaaatatttttgcttgcttctgtctcattctaaatattataggagctgtttgctatgggagactccaaatgtattatttgcagattatcagaatcattgcatcacccaaatctttccatttagaaagagggaccccagggaaatttctgaatgtattttaggggaaatcttaactcctctggaattccatgagaattttttgggcaaggatttgtgcattttttgtagtttcactagattcttgaaggagtcctttatctaacagaaatatccactgatccagagattgtagcccatctggagatatgtctatttattaaacttacctaaaatttagaatgtttcttttcatttttcatttttctttgttttcaggaagggatgagaccatgcagcctgcgaaaccatcctttcttgaatattttgaacaaaaagaaaaggaaaaccagatcaacagctttggcaagagtgtacctggtccactgaaaaattcttcagattggaaaataccacaggatggagactacgagtttgtaagtagtgttggaagtaaatggttatgtcttcaggggaagttatttgaaatatcacacattagtgcccaagcattttcttgtgcattttgagtctcctaaaccatccctgacagtgtctactgagctgaaggacagtattttgactgatgtttgggcagttctctggtccctgattagtggcatctttttcgctttcgaagtccatattcagtttttatttttgtccagttagaaattgttcatggtgagagaagtattcaatcatcaaatgaaattgcaactgtctttaatagtttatttggggttttgattttatatttaagaattagattggagggcaattgacactgttttgtggtgtccttgttgttttgctaactattctcctaattttaaccctgctgaaaggattattctcagtttttttcagaggatgaatgtataattattccagtttcatatgaaaaactggatgtgttttcctttctctactgtggaacattttccctcaaccatagacacttattaatgttcataggcatttaaggagtagagcaataaaaattttgggaaaaagtaagctaaggagtctgcattttcttcttgactattactagaaaagatttttctcttcaggagctttttatttttacattctaaaattctgaagtttgatcctccatctgtcataattctgttgtttataaaagaacttagattgggcattgggcttgaattctggtaggcctgtctagttctggctttccactatactactgactggcctagaggaaatgacgccattcttccataacttaatttctacttttataaaatggcaggaatatcacagtttatacaactaatggtagagatcctttgaggaccagaataactcatctgaggtaaattaactgattagtcactgaacccatgatagaacccaggctatttgttttattacctgtttgttcatttacttacttatccagtggtttttttttttttttttggatgtcatgtgtttgacactattctagggatgtggtcattaacagaacagccaaaaacccatccctcatggaggtttcattctaggcgaaggaaaataagtatttagtgtgttaaatggtagcaactattgtaaaaaatataaagcaaaagggaggttaggagacagaaagagtgtgtgtgtgtgtgtgtgtgtgtgtgtgtgcatagttttttaaaaataagagtagtcaaggaagttctcactggtaagaagatgaggatgtgaactatgtgaatatctagaggagagatttttaggcagcaggaatagcagatgcaaagatcctgaggcagggacttggctggtatgtttacagaacaacgaagaaacagtctgttttggaatggcatcaataggatgtgcagcaggaaatgatatcagagatataatggagagcgagataatgcagggctttttgtgtaataaaaaggactttagcttttactcttgagtggaatgaaagaccattggaagggatgacttgaccttatttatatttaaaaggtattattctagttgctgtattaatacattataggagaactgtagcgtttctgaacacaggtgcagtgtttttatttactattcaaaggtggcaaattatggggcacatctgctactattctcctcttctaggcctttggcacccatctgttccactgaatcagggttcagcttcagaatccttcttaacacagcacaccaggctgccactgctaatcatagtagacttacgaaatttgaattattgtgcgtctgttccatgttgcctgtatagttgtcttcaacatgtgtataaggactgatttctcagtttagccagtcttcaggcaaagatgtttaactactgggtaccaaatcacatcattattgtgatagaatgcttgagaatcctcaaatctgtagtacttctaagcttagtttccttgtttttaaatgttttagaagttagcgattttggctaggcgcagtggctcacgcctgtaatcccagcactttgggaggccaaggccggtcaatcaccttaggtcaggagttcgaggctagcctgaccaacacagagaaaccccgtctctactaacaatacaaaaaaatcagccagtgtggtggtgcatgcctgtaatcccagctactcgggaggctgaggcaggagaatcgcttgaacccaggaggtggaggttgtggtgagccgagatcatgccattgcactccagcctgggcaacaagagtgaaactccgtctcaaaaaaaaaaaaaaaaaaaagaagttagcaattttgaaaacccagtcactttaatcctttttaattttaaaaaatattgtttatgatatttttaggatacatgtaatattttagtacctgttcataatgtgtagtgatcaaatcagagtaattgggatatctattacctcagacgtttttctttgtgttgggaacattataaatcttcagccgttttgaagtatacaataaattattaactataattttcctactgtactatcgaatactagaacttattccttctctctgacatatttttgtaccccttaaccaacttctcttcatccctctttcacctctttcccagccactgctaaccgtcattctacactctgtctccataggatccacttttttagctcccacatgagtgagaacatgtaatatttgtctttctgtctctgtcttattgtagctaacataatgacctccagtaatatccatgttgcaataaaagaagcgacaacatttctttctcttttctggcggataatattccattgtgtgtataccacatcttctttatccatttatccattgatggacacttgggttgattccatatcttggctattgtgaatagtgttgcaataaataggagagtttagatatcttgttgatacattgatttcctttcttttggatatatgcccagcagtgggattgctggatcatatagtagacctattttaattttttaaggaacctctatactgttttttataatcgttttattactttaaattcctaccaatggcgtatgaacattcccctttctctacatcttcaccagcatttgttatttcctgtcttattgataatagccattctaactagggtgagatgatatctctctttttttttttttttaagagatagggtcttgcttattctcccaggctggagtgcagtggtccgatcatagctcactacagcttcaaactcctggcctgtagtaatcctcccacctcagccttctgagtacctaggactacaggtatggatcaccacgcctggctaatttttaaattttttccaaagatgaggtctggaaatgttgccccagctcatctggaacacctggcctgaaataatcctcctgcccgggcctcccagaatgctaggattacagatatgagccactgtaccggctctttgtggtttcagtttgcattttcctaatgattagtgatattgagattttttcttatgactgttgcccatttgtatgtcttttgagaaatgtctattcaggccttttgcccaactttaattctaatcattattcttggatcagtagtttcaacgtgtaaagaatttatttctctttgccacagttttctcatactaagatcattggcaggaaacttgttttggtgggcaagctacttatacggaggagctttaggagcttttagagagagtactttttattttggaagtagatgacttctagggggagtgggcccatggtgcacagtgaccaggttagcacattgcatgacttgtattcctcctgagactttcttctaaatctgaggtcataaactggcagcaaccagctcacagacctttctgtgtgtcctatacggtgtttaaatttttaatttttaaaaattagttgcttatgttaaaaacttatgagattttacacaaaatgttggatctccagcttattttgaaaatgtgaaagatctggctacagtagacctacattattggttaatggttgtctggagctgagtggcagctgccctctttaggtatgacctctctaattcttcacactatttgacctacttcactcatttgtattaactgtctgacctgtctgacacttaggggcatttgatattgggactcttgcactaaattgtttggatttatatatgcttgagccagcctattctgatatatgacattctactctatttgtaccttcagaatgttaagataatttacttaataaaagtctcttacagaaaaatttcaaactaagcaataaaattgagatgagagatacatgagctgctctcccaacaaagatcaaatgaaaactgtcttcatagttgatattcttgttacatagcttttaccttgatcctaaagcaagcatttgaaataatagtctagaacagtggttctcaaagtggtcccagaccagcagtgttagcatcacctagagactgttagaaaggcagttattcaggccttaccccaggcagactgaataggaatatctggggacagcacccattgattggtgttttaacctgtcctcctggtgactcttacccactaaagttgttctaaaaggtttttacagtagtatatcttcatatacatttcttgttttcttttctattaggtactatagaaattcagagataaggatgtatttctattttattaacattgtatgatttttaaatttccttgttattccccttttgagtctcctatactcttactggaggtaccaaagaagcacataaaatatggaaaatgtatgtttgtaagtgacatctggcaaataaagagctagtcctttgagtgaagaaagttctgaataatctcctgaaagcttaacgaaggatatgtgtcagacttgctaacatgtttccctcacagttgcttttttttttttttgagatggagtctcactctgttgctcaggctggagtgcagtggtgacatgatctcagctcactgcaacctctgccgcccgggttcaagcacttctctgcctcagcctcctgagtatctgggattataggtgcctgccaccacacccagctaatttttgtatttttagtagagacagggtttcaccatcttggccaggctgatcttgaacacctgaccttgtgatccactctctttggcctcccaaagtgctgggagtacaggcgtgagccaccgggcccagcctccttcacaatctcttacagactttctgatttctaggcagatagtatttaattatgaaaaaagataattctgtttcctcctatgaagagaattgctgctttccaatgacctttttgcccaaaatggcaaataggaagtaatttaatcaggagtagccgaattttgtactgacaaaacttcatattttcatctgaaactgaatatttgtctcatttctaaaagtgaattgcctgtttgccaagttgagaaacccctccaaaaatttctaatagtgtttaagatacatagtgattaaaatataaaaggtgcttaaaaatgcaatagtctctaaaattgatatttcatattctattagcagatcacttttttggaaaaaaatgtaatattttgtgagaattcagaccttcccattttgccattcataaagccacaaacagctgtaaacttaaatccaatttggctcatgaatcttccaaaaacacactgtaatattttagtttaagatgacccaggctgggtgcagtggctcatacctgtaatcccagcactttgggaggctgaggtggaaggtttgcttgagctcaggagttcgagaccagcctggcacatagtgagaccccatctctattacaaaaataaaaaaaagatggcccaagtgccaacagtggtgaacaaaacagaccaggcccatgttctcatggagtttacagtgaaggaaatagacattaagccagtaccctagtaggtatcagttcaggtaataatagcgaattttttttttttttaaagcacagttaagagatattgtgagaaaaggcctgtggagagacaggacattcagctgagacatcagtgaagaggggaagcaagtcacaggaaggtaggggaaataagtacagagactgtgaggcaagacatagactatgtgtaaggaaggaaaggagtccattgtggctggagccgagtgacacatgggatagcagtttaaatgtaaatgcatcagtaatcacagtaaatgtgagtgcactaaaatctcctattagaagagaaagagtctggataaaaataacagtcaaattccggctaaatgctgtttataagagatgtaacggaaagaaaatacaaccgaaaagtttaaaacagaggaatggaaaaagatacactaggcaaatactcactaaaagaaagtgggtgaaacaatattgatatcaaatgaggccaagcatggtggctcatgcctgtaatcccagcactttgggaggccgaggcaggcggaccacgtgaggtcaggagtttgagaccagcctggccaacatggtgaaaccccatccctactaaaagtacaaaaaattagttgggcgtggtggcagatgcacctgtagtcccagctactcagggggccgaggcagaagaattgcttgaacccaggaggcggaggttgcagtgagccgagatcatgccactgcactccagcctggctgacacagcgagacttcatctcaaaaaaaaaaaaaaaaaaaaatcagatgaaatagaatttaagacaaaagaatgttacctgggaaggatatgttttatactgttaaaaggtatactttatctagaagatgtaagtcatgcacctatatgaaacatacatatttatcccaaactgatagaaatagaaggagcaatgagaatactgcaattatagtttcaagaagttaatcaagaagacttaaatattcttctctccaaaattgacatttcagttagacaaaaaactaacgcaattaacaacactgataaaacagaaaatagacaaaatttctaatatatatgaaactttaaaaacatggaatatttgtaaaacaactattttattcttttttttacctttatttcaggttcaggggtacatgtgcaggtttgttacacaggtgaattgtgtgtcatgggggtttggtgtacagattatttcatcacacaggtaataagcatagtaacccataggtagtttttcgatcctcaccctcctcccaccctctgccctcaaggaagccctgatttctattgttctgttctttgtgtccatgtgtactcagtgttgagctcctacttacaagtgagaacatgctgtatttggttttctgtccttgtgttagtttgcttgggataatggcctccagctcatccatgttgctgcaaaggatgtgatcttgctcgtttctgtggctgtgtagtataccatgtcaacatgtaccacattttctttatccagtctgtcattgatgggcatttaggttaatttcatgtttttgctattgtgaatagtactgcagcgaacacaacacatgcatgtgtctttatggtagaacaatttctgtgcctttgggtatatactcaataatgggactgctaggttgaacagtaattctcttttaagttctttgagaaatcgacacatggctttccaccatgattgaactaatttacattcccaccagcagtgtataagtaatcccatttctctgcaacctcgccagcatctgttatttttgattttctaataatagccattctgactggtatgagatagtatctcattgtggttttgatttgcatttttctaatggttagtgatgttgagtatttttttcacatgcttattgaccatgtgtatgtcttcttttgagaagtgtctgttcatgtcctttccccatttttaatgaggtcgtttgctttttacttgttaatttgtttaagttccttacagattctgaatattagatctttcttggatgcatagtttgcagaaattttctcccattttgtaggttgtctgttcactctgttgaaagtttattttgctgttcagaagctctttagtttaattagaacctatttgccaattttaatttctgttacaattgcttttgttgccttcatcatgaaatcttcgccaggtcctatatccagaatggtgttttctaggttatcttctagggtttttatagttttaggttttacatttaagtctttaattcattttgagttgatttttgtatacggtttaaggaggggggtccagtttcagtcttttgcatatggctagccagttatctcaggatcatttattgaataaggagtcctttctccattgcttgtgttcgtcaactttgagttactatgttttttttgttttttgttttgagacagagtcttgctctgttgcccaggctggagtaatgcagtggcgtgatctcaactcactgcaatctctgcctcctgggttcaagtgattctcctgcctcagcctcctgaatagctgagattacaggcacctgctactctacctggctaatttttgtatttttagtagagatggggtttcaccatgttggccaggctggtctcaatctcctgactttgggtgatctacccacctcggcctttcaaagtgctgggattacaggtgtgagccaccatgcccagccaatgtttgaaagggttaaaaaagaaatcaggccacgttacctgactataatgcaataaaattagaaattaacattaagaaagtagtcaaagccactttatcccacctggagatataaaaatatattcttaaatcttactttaaagataaaataaaatataaattataaacaatttagaaatgaataataagaattatacaaaattcaaatccctgtaattcagaacctgtgggaggcagtaaacaatggcacttagaagaagatttatagccttaaatgaattttctttttagaatacaagaaagattataaataagttaaaaataggataaagataaaagcagaatttaatgaaaatagaaaacaaaccaaaaagttgattggtaaaaaccaacagcaagatatttgaaaggacctgatatttggtagatttgatcaagttaaaaaggaagagtgtaccaataaactgcagtaggggaaaggcgagagacagttactagaaacagaatatggcagtgtgattagagattattatttataattttatattattaaatttgaaaacttagataaatagatgtttaaacactatgccatatttacttcccatgtggaagtgtaaatgcataaaaatatgcaagatacttttgaacaagaagaacaaggttgatcttattctttcagagaccaaaacataccacaaaaccacaataatgaaagcactgtgatattggcataagaatagaacataggccaggtgtggtggttcaccctgtaatcccagcactttgggaggttaaggcgggaggatcacttgaacccaggaatttgagatcagcctaagtatcatagtgagatccccatctctacaaaaaaaaggaaaaaaaattagctgggcttggtggtatatgcctataatctcagctacttgagaggctgaggtgggaggatctcttgagcccaggagttcgaggctgcagtgagctaggattgcaccactgtatactgccctgagtgacagagtgagaccccatgtcttaaaacaacaacaacaacaaaagatcaatgttaaagagtaggattaagaaacatacctatgtatgtatatgtgtgtgtgtatatataatatagataaatttttaaaaatatatacacctttgttggatgcatagtttacattatatatgagtgtattatataatgataaaatacaaaataatgcaaactgtaaaatttgtgtaaatttaataaaacacaaatcatgctaccatttctatgtatatgcacacatacagctgcatagataaaaaaagacaggatctaaaaataacttgaaagtcattacctgtggagagaactttagttttagctgtctttacacagagagagaatatattactatatcaatatattacttgcttaacttaaaagaaataaatagagcaagatacatttttaaactttcaattgagattttttttctggttttagtctaaataaagttaaccaggttatatatatacagattaagagaaccacaatacttttcagtcagttatcagctttgcaagtattgttgattattagctttcagtatccttagcttttagagtaaatttcctatttattcaaatgaagttgctttcagatttcttatgacttcttctataaaaagagttgatagtaactggccctcacatattaattcaatctatatttattgaggttctctgtgtgtactatgtgtgaatagataagactgcgagatcttttacagccttcactttatcttacccgtctttgtattcataacacctagcaattgcccagcttagagttagcacaccatttcaaattaaactcagacatagtctctgaattcattcattattttattcaactactagttgaattaaactcaaatatagtcattacgcttagagagtttatgatgtagcagaaaataatcaaatgattttgatacattatactaatgatagcttacatttattgaaaatgtactatgtgccaggcattacatatgttacctcgctctcagaaccatcccatgaagtaggaatgttgttattgccattttaggggtaaaaaaactgaggcttaataggaagaataagttcaagagatctattgtacaacatggtaactagttaataaacaatgtattgtattttgaaaatcactgagagagtagattttaattaagtgttctcaccacaaagaaattgtaagtatgtgaggtagcacacatgtaaattagctcgattgagccatttcacaatgtatgtacatacagtatgtccttatgaggttcattttatgaggtttcagttacccactgcagtctgaaaatattaaatggaaacttgtagaaataaacagtttctaagttttaagtagcatgccattctgagtaacatgatgcaatcttgtgccatggcgcatcatcccgcctgggacatgaatcatccctttgtccagcatatctgtgcagtacacggtacccactcctagtcacttaggagccaatttggttatcagatcaccttttgaggtataacagtgcttgtgttcagggaacccttattttgcttaataatgtccccagcgtgcgagagtagcgatgctggcaattccagcttgccaaagagaagatgtaaagtgcttcttttaagagaagaggtgaaagttcttgaccaaaaataaggggggaaaaaccatatgctgaggttgctaagatctgtggtaagaacgaatcatccatccatgaaaattgtgaacaaatgtgaatcttccatccgcgaattgttgttgtaattgttctattttattattagttattgataaattcttaactgtaacaactttataaattaaacttcattataggtatttacgtatgggaaaaagctgaatgtatagggttcgttaccatccacagtttcaggcatccactggggttttcagaatgtatctcctgtggataagggagggactactgtatttcaaaacatcatgttgtatacaataaatatgtacaaactgtatttgtcaattaaaagaaaaccctgagactaaaagggaggtggttgactacagttatacagacagttagtggcacagtgaggattttaaccaaagcagtttggctccagagcccatcctcttaactatctgtactgtgtggcatttttctaggctattctggtaagttctctccataaagtacataaagaaggggctgtaggagcccaaaagagagagcaagaaccccagggaaggcaccaataagtgtcattggaagtgtgttttgaaagatgaagtgtgtctgtggggatactaaggagtgtggcatgggtccaggaagtactgagtaattgagctggagcattaccagtgtggatgtgtgcaaaaggggaggaagggagcgaaggagagaacttcaggtgaagtaaattaatgcccaatgtacccttttttgctggaaatatttagtactcttttagattttttccttggtatatcagagaaattaaaaatggagtcctaatgcagcacagagagctaatatccatctgacgttgtgtgataatgggtccatcaggatataaaaccaccaaactgttaattcaaaattaatttgataaaagtaacagaacctgaacaaaattgattgtttgaattccctggatagttataagccattcagttggctttttgtggtaaggaaggataaattttagccctgagtttttcccaggaggccgataacaacctatgattccatgaaactttatcttaaccattctctcctagatcagggctccaaatctgattgtaagttgagatttctttgggtttttacaaagaagctttactgaattgtcagaacatagtcagttactcatttattattaggttgtactttttgcttttggctgcacatgttagaaatcagacacttgctgggaggcaagaattattactaccttatttataattagaaatcatgattgaaatggtagaagaaatgctttatttgcctacgcttaagtcaatactgtcaagaatgcatcttgatgtttcctgggaactcagttatctacaatttgaaactttatctgccatttcatagagacaaaaataactctcccaaaacatttggtgaaattattgttcatttatttcaaagtgactctaaaagttagtgcatattcttaaatttaccagcctttaatggtaaggtaaaatttaatgtcccattactcagttacaacaatcatcaagtcagctattcttgttttatttaatccttcacctccactattcacccacactgcttgattgttttgaagcaaatcccaggcatatctcatttctaaatatttcatgtgtatttataaaatattattgaccttttaaaaattataatacctttatcatacttttacaaattaggagtaataaatttccttaatgccaaaaaatgccttgttactgtttagtctcctggatttatatatattttttagcttgtttgaattaggatccaaatgcgatttataggaagttggttgatatgtctcttaagccacttttaatttaaagcccttcctttctgctacccctgctcgtgtactctgagatactgttggagaaacccagttgttatcccatatagtttcaaccttcattcgggatattgctgattgcatctaagtggtcttatttaatatgttccctgagtttcttataaattggtagttttatctagaacagaggtcctcaggaccgcttcatacttataaacattattgaggaccccagagggctttcgtttatactaatatttactgaattagaaattaaaactcaaaaaatgtttaaagaatttatttacttaaaaaaaaagctaattatacattaatgtagtttttttcaatgaaaaatgaccattttcccaaaacaaaaacaaatgagtaagaaaaatagcattgtttacatttttcaaattttttggcttagacagatagatgatcctatctgttttgcattcagtctgttgtaatacattgttctgtttgaagtataggaagaaagtctagcctagcaaaaagaggtgtagttgaaaaagacagaactattgtaatagctgtttaagataactgtggatagtctttgaccctataccaaaactcaacaagtagtggtttcttataggttagttgcaatgtagaatataaaactaaattcatgaaattttcttactctgtatattaaaattcattgatgttttaaaattttgagtggaacttttactcacacatgattttgtaacatcacgcattgggcatttggaagatgttggttcattcagttacatggatcttctaaatgttggcacatttcattaaacaatataaaaaaaccccacattccttgaagttatgaccagtctcatcagaagagtagctaagtgtagggaagttgtcaagctcacagtggtagattcaagttttccagaatacttattttcatttgaaggtttgaattttatcatcagctacaacactcttagttgttttcctttgagtgacagactcacttttttcatttctgagaaaatgtctgccagatacccaagtctgaatactcacagtttgtcatttttcatgtaaaatggtgctctgtggaaaaagcagctggttgagcttgcagctcaattgcacaagtgctttgcttcaaaatgaccattgtatttcagttaaaacagaagtgctatatgcggacttcccatttcatcatagatactattaaaaagacatgaacttttttactacttcatcaaggacattcttaaggatttttaaaaaactgtagccagtgactgtaaagaatgcaataactgctgacactatttggtgccactttttggtttctactgaggctaacagttttagcccccactgcttttgtgtaatcagtacagatgtcaacacagtagaaaagtcaaatagtgtcttaagattaatatgaaaatagtttggtcttatagagtcccctaagagtgtgtcagggatcttccagggatctgcaagccagactttgagaattgctgatctagaagcttgatcagaatcaggttcgatttttttttttttttttggcaagggtatttcataggtggtatgtatacttccatcagaaggttcataatatctggatatatggtcatctctctttttccgttgttagaaaccagtgaaggtcattgtctggatgccatttcattagaggttacaaagtggtgacatttgatcatttcttctccatttaccaattgaagtaaagaagcatttcattatttagataatctcaggtacaatgtatacagaaaagacagaatatgcacttgattttttgatttttattataattttcaaaataatgtattggttccctggcattctccaaagatataaccagggattttttttgtatcataaattcgtggatttaaaaatatttgatctgtttcaatcctttcatctatttcttatgttcaaatggttccatcttgatataaccccagtagttacttttaaatgttttattgaggtatgctttatatactccctggtagtttgtgagagcatccttgctttctagtatgatgagatgtgagatgttccaggctcatcttgtccatgtcttgctccaaacctggaaacagaccttttttttttttttaaggaactcaggtttttaaaatgggaaatggtaattagagaccacagtctgggtgcaagttgtgctcattgcagttaggtcatttttttctaagccttttcaatgtatgaatccaggaaatgtgtttattacaaactcatgcgttcttatgctatttccagtgtagattgaatactactagttttttccttaaccactttcatcccacatctgtaatcctttcccccatgccaaatatcttcccagcaattctaatataattactcatttgtttttcaattcacaataaatgtcagcctcggaataataatgccagtacttctgacaacaatactgaaaacagttaaagatttgtgttgcagcttgttgtccttagggacatcccatatagatgtacaatgaaattattatatgttaaagctactgggaataatttctacgtggttatgccacaaacttaattggccaataggtttttttgtttcattttgttttttgtttgaggtattgctttttattgttttgctttataattatataaactatatggttccaaggggcaagtctacaaaacaaagttgttcagatttagtttctattcctatctcctctgtttcctcctttttttaatgtttgggagatatacacaagacacatgtatgcatgcatgcatgcacgcacagacaaatacatgtatgtttgtactaccattctgagataacagtagtgtcctgtccatacttttctctgtttgttttttgttaattatatatcctagaaattactccatagccatacatagagatagtcctcattcttttttcctatgcttagtattctgttgtgaggatgtattgtagtttattcagccagtcctctgatgatacacatttaggttgtttgcaacagtttttaagttgattgcttcataaacctattcataaatagggaatgcaattttttatgattgttttggttttttaggttcatgctttgtcagttttgagaagcaagttacatgttttaagcgtgtttagcttttttttttttttaaacagcaaggagtggatttattcagaggtctccctctgccacattttagtgctgtttgtataaagcagcccctaagactctagtcataacatcacgtgtcacaggaagagtgagtaatcaatctcctggcaaacattgtttgttagcctgccgcaggcattaaaatgttgccaggtgttaacaacctggaggcctggaattcctaattgctgtaatcagaacctgaagtttttaaagtttgaatctcattacaaccaaagccagatttggttcagttactttaatttttctataatttgaagtcagaaaagaaaaagaaaaacaactgtaacttcagtgttgtttattattcatcaagaaggtttcaatggctgaaatttaaaatgtaaattagctattactctagaaagcacagtttttagttttcagctgagatgaatgtatttttcttattcctggatctatagccacgcttttgaattatgatctcattcacttagacacatatttttcactcttcttttgagctgttgaagatattttcttcagtctttcttttcagctttacctcctgtttttttttctcacacgaactcttgacaattcagtaatccttattcctgggacatgaaatgttgagaagacaaaggagatttatgcaagttttcccactccatccaaagaaagggtctctattagagctcttgaaagtgatatttgcttatgtagcccagtgcctctgaaagaaaaaacatgatgcagaacttttctcattatctaaggtgtgttcctggtgtcatttccctctcccaacaggaccacttttacctaatacaaatctggatcctccactactcaagtgaaatacaacgcaattagcatcttttgtctttgataacacacctactccaagcaccagtaatgctggaatggaaagcatgtttcatttcctttcttcatttctctgttggagtttgatgctgatattactgagatttctaatggacagtgtagggaggagaaggctgattgatggtaatttattgtactgctactgagaaaaaaacacaactcagggtattggttgttcgatacatccagattttttgactgaaaatgttagattttactttttcttttttaaaaatttccaacttttaagttcaggggcacatgtgcaggatgtgctggttttttacataggtaaatgtgtgccatgttggtttatggcacagatcatgccatcacttaggtattaagcccagcatccattagctattcttcctgatgctctccctcctcccaagcccccaccctctgacaggccccagtgtgtgttgttccccaccatgtgtccatgtgttcttatcattcagctcccacttataagtgagaacatgcagcatttttttttctgttccgtgttagtttgctaaggataatcacctccagctccatccatatccctgtgaaggacatgatctccttcctttttatggctgcataatattccatggtatatatataccacatgttctttatccagtctatcattgatgaacatttaggttgttcattacagcactattcacaatagcaaagattttacatttgtttagaaggcttgataaagttgcagttgtgtaccaagtgtaccaaagtgactgttcttttagtgaagaagcagtagatttggtagttaagatcattggaatcaggctttcagcgttcaaatcctgacttcaccatttgctgagtagctgtgggccacttacctctcctctctgagcttcattgtcctcatctgtaaaatgaagtaatactagaacccataggatacattttgaacctatatgagagttaaatggagtaatgcacatcaggggcctgcaatataatacagattgagtatcccaaacctgaaatcctgaaatgctctaaaatttgaaacttttgaacagtcaaagaaagtgctcattggagcatttcaaatttcatatttttggattagagatggtcaacaggtaagtataatgcaaatatttcaaaatcctccaaaatccaaagtttaaaacacttctggtcccaaacattttggttaagggatacttcacctgtagtcacttcataaatgtcagcttctcctccctccttccactttcccctcctttcttgaaacattgtccatggagtaaatttcactacctaaacttttcccccagtgatttgccattgccttctgttataaaatcagagatacattcccaaagaatacttgctcccagagggactgatctaaaactactctaaaacaaaggaattaaaactattactgcttggaaattgattaccaaagtgatcataggtatcaattttagaacttcctaatgctttcttcctttcttttccttacatctctatacaataatacagtgtttctttctacccacctctcaaatcatgaactgttgaggttaacggaaattttcaaatcttgaagctctgaaactacttcccttacagtaacacacttctaccaatagatgccgccctttcacttcttgagtgcacaatctcctgtgtggcatttgcttaaggcagagcttgctggctatgtaaaatgaatgataaaattattgaaccaggccgggtgaatgataaaattaccgaaccagtggctcatgcctataatcccagctttttgggaggctgaggttgcaggatcgcttgagcccaggagttcaaggccagtctgggcaacatagtgagaccccatctctacaaaaaataaaagcacattttaaaaagccaggtagggtggcatgtgcctgtggtcccagctactcaggtggttgaggtgggaggcttgcttgaacccgggagtatatggtttgcagtgagccgtgattgtgccactacactccagtctgggcaacagagcaagatcgtgtctcaaaaaaaagaaaaaagttactgaatcactttagaaatttgacattgtgtgaagtgagtttgtttgaaaatagggaaaacttgtaacacagaccagtagaatgaacattacattacataagaagaagggtgaatggcccaggctttagctgggaccttgggtgagtcaccctcctctttgaattttagtttgtgatctgtaaaaattaaacataatagtacctatcctgcttttcccacagagttggagaaaggatcaaatgaaatatacattgggttatttgaactaagtttactttcaaaactttggtagaattttattagccaagaattataaggccgttgatgtttattttcggttcattgtgtattaagtattatcacttatttttatttcacattttattttactattataaaaaaattaactctttgaatgatgacaaataattcagaagtgaggaagacaaaggagcagttaagcctggatttctggtatgactccgtttgctgatgatagtaacattatcactttagatctaggtagcatttaatatagttaaagatgcattcatagtttgttcttttgtttggcaatgcttacagtgtttctgtgaggtagcagggtggggtttcttatcctcttatagtttgaggaactggagcccagagacattttacaaaggcatctttcctacttggtgccagaatcaggtctggaacccagacccctaagtggcttcctgtctgcgttaattcataagtgtgtgtgttttctcacatgaaaacaaaaacaaaaactatgcttacatattaaatacccaatgttataaaccaggaaaaagaatcttctttcaaataacatgtgatagggactacagtaaccaggaagaatgatttcaggtttattgcatcttcctgggaatttcgtgacattagaggagtatttattattaactcacagtgttttttttcatgcttattgagaacacaatgcagattgacaagctttgtatttcattaattgtttatgcaaacaattcttattggagcaatttaatttgtactttcttttgctgttctttcttatttactttctaattatgggttgtacagtaattttgctattgtcagaaagtgtcttttttttttgtttgttcgtttgtttttttgagaaggagtctcgctctgtcgcccaggctggagtgcagtggcccaatctcggctcactgcaacctctgcctcccgggttcaaatgattctcctgcctcagcctgctgagtagctgacattacaggtgcatgccaccatgcctggctaatttttgtatttttagtagagatggggtttcaccatgttggccgggccagtcacaaactcctgacctcaggtgatccgcctgcctccgcctcccaaagtgctgggattataggcctgagccaccgcacctagccagaaaatgtcattctaactaaaaaggcattattattttaagaacatttttggttttcgccaggtgcaatcccagccctttgggaggccaaggcaggaggattgcttgaggtcaggagttcatgactagcttgggctacatagcaataccctgtatctacaaaaaaaaaaaaaagaaaaattggctaagtgtggtggtgcgtacctgtagtcccagctactcaggaggctgaggcagaaggatcgtttgagcccaggaagttgaggctgcagcaagccatgactgtggcactgcactgtagcctgggtaacagaatgagaccctatctcaaaactaaaaggaaaaaaaaaaaaaagcaaatataacctctgaaaacaaaggtatctattgtggaggaatcttaatggatacaggaaatatttgatatattttctggttatatctctgtcacagtgtgcttgtcagtctcattcaggcacttgttcctgaatttttcttctcttctactctgttatctattgtctaatcagtatgggcttttctgctaatttgcttttctttttttttttaaatttatttatttattttttttccgagatgaagccttgctctgtcacctaggctggagtgcagtggcgtgatctcggctcactgcaacctccgcctcctggattcaagcaattctcctgcctcagcctcctgagtagctgggattacaggcacctgccaccacatctggctaatttttgtatttttagtagagacagggtttcaccatgttggccaggctggtcttgaactcctgacctcgtgatctgcccgcctcggcctcccaaagtgctgggattacaggtgtgagctaccacgcccagcctaatttgcttttcttactccagtgttagataatgaatatttttagtaatcttcatattggttgctcattatcttgtctaattttaaattttattggcagacacacttggtctcttaagactaactacattttggattttgacaaggaaatgatgaaaatagcagttattgaatgcttgttgtgtgttaggtccctgtaaatgttttataccatcttcttttcataatatcctcacatggtagatcttatagatcttattcccacttatttgacagagaggctttgaggcgctaggtgacaagagatgctaggtgacctgtcccacccttggtgcatgattaataaaagatagaccattatttttctcagaataacgcacgtttgtttgtgtgagaatggttatatatgtgccgatggtaaacattcatctaattcagatgctgcatcttttctttctctaacatgtgcagcccttagcgaattgccatagcatgcaggtgctcagaatgtgttatttgattatgttatttgggcccattgtgcactctttggaaatctttttaaatttcttcagattttctttttgtaatatccattcatctatgtgtataggaatatgttaattggactataatttcatagatgtggaatttagatttcttccctgcttctttggtaaaactgtagtaaaaaacattgattggaaatacagtgttgggaattcccttgatcgaattggataaagcataaagcatttagcaaagtgcctggcattcctaatctattattaatatgtgggttccttttagagtgatggcttatttatagtgaagaagagcagtgggttgggaatcaggtctcagctctgactgtaactagctttgtgtccttaagtaagccacctaacctttctgggactctgtttctttgtctgctaaaggtaagattaagccttcaagagccctcaaactctcttggtctttgtttgccaatttaaaaaatgcagctaatgcgtctctctcatagggatcatgtgagcctaaaataaagagcttgtgtaaagtgtgtaaaagatgctcagtatatataaggttcttttcctgttcttttaaaagcagagaaatgcttaggacacccaggacgccaacatgagcatagaaggcagtctgatatactgaccaagagcagatagacttggatccattgctggtttcattatttatgggaccagtaactctaggcttctcacccaacctaaaatgaagatactaatcatatttacttctgagttattgagaagattaatttaaaaatgcttttaaagtgcttagcagagtatctgacacagagtaggcattcagtaaattttatttacatgtgtaacacttagggtgggagacatggatgaactactggaaaagggaaagatactgaggtgggctgccctaaaaaaggaaggtaagaggaagacctacacttatttcacacttttgttgcaggccctgctagttcacacattgtttgctttgtgattttttttttttgagacggagtgttgctctgttgcccaggctggagtgcagtggcgtggtcttggctcactgcaacctctgcctcctgcgttcaggtggttctcctgcctcagcctcccgccaccatgcccggctaatttttgtatttttagtagagacggggtttcaccatgttggccaggctggcctcgaactcctgacctcaggtgatccatccgcctcggcctcccaaagtgctggaattacaggcgtgagccaccatgcccagccatgatatttattttatacctaagatgagcttaattctgttatgactttcttgttcctagggtgagcttaattctgttatgactttcttgttcctagggtttaaatatcaaggatactcactaaaacactgatagaccttttgtgttttctctgattgcttcccttctgtgcctgcctggaggctataggtcctggacagttcccacattgatgttttttttttcaaaacagttttttcctgatggtacatttgttaatgtaaaatagctcaagtaaatgtatgtgcgtatgtatgaaagagacagagagagacagagagagctgtatgggatccatcagctgccgagggtaccctttcatcaagcagagttcacattgcagagcattggatcagagggtggccagcagctggagggagagcaaacttgaatctactttatagacccactagtcacttccatttgccctttacttaggagaaaatacacagcaaaaactgttctttagacatggatgcatctagtttaataaatcttaatgtagtgctattaaaaatgaggtaaagtcaggaaattttctaccccctcccaagtgctcttattcctagatatgcaggaccaagcataaagttattttcacacattgggaagaaatgttccattccaatttcaagtggaggttttccacttttggaagtgctgctgagactgcaattataaactacaactattcttttaaaacagttcctgggatgaattaagatcttgcagtaaaaataccatatacaatctgtcacattatctgtggaactcttccctttgccagcttggtcagtgagggtaacagctgcccagagttcattgctaaacggatgtttaacaatggtactgtgaattcagcacttcatattagaataatgcttgagttcctggtattcggttaatggagttttacgtacagtgatacagaaaatatgtgatgcacaggatttcagctttttaagaattctcaccacttctcctcccatctcaattttgttgttgtggaaaatgaaaatcccacaggaaagccaagtgtagtcctcattccctgacttctggctttgtactccatcactttccacttccttcccctcccctctctacactgttcacctgggcctaaacgtctgaatgactgcagcctcaaggaaagcttcaagttagactagatgacctttaaggttttgttaatcctgagaatccgtttggccacatcaatgagctcctttgtatctactcaaatgtgatagaacagacgagcattcagagtaaggggatcttcctaggctggctgcagagagaacagtcagcagtgctcgtgccatggctacagattacacatctcactctgggggtgtgtggggactgggaaagggggagccagtttggcctgtggcacatgtaatttttatactttgaactactgaaatgggtctgagttctccagctcttcacagaccccatcacttcctgtttttgttttatgagcagactgttgagtttatttctgttgtctttgccagtctctcaaaacatttgtgtttgtgatctctgatttaaccagtctccagctgatggtcatttaggtagccttcagctttttaatattaataaatattgctttaataacatctttgcatggtacgcccttagaattaattcctgcagtagaattattgggtcaaactgttcacaaatttgaaattttgatacatattgttaaatttccctatcgtttttggtatgtgaattgttgctttatattatttactgaattttccatggaattcttattttctttattgattttaaagacttcttcagctatcaagtcaggttatgaaccttttaacatatgtggtaaagatattctgctagaatatcttttaaagctttgtatatggtatctaacttcagacatttaaatttttatatattttgatttattagctttttcttgtggtttctggaattttatgtcatctttgggaaagtttttcacattctaagattacaaaaatattaacccttactttgttttagaatgttttattattttttctttctcaatatttaatctatcatgtatttgtcttggtgttaagagtaaggtagcaatcgagctttatatttttctaacaaccaagggtttaaaaaatacataattaatttagaattaccaaatcttaatagcttatagtacctaaaagtggcttgtttttacagatagaaactttccacttcaaactctgagttttaatgtttttcggcttttaaaacctctagaaagaaactgtgaacagaacaccgtattggttttggcattaaccttaatgcatctcaaataggctgattctacagaatttgatccaaagtacttctatgtcttgatcctttttttgccaagcaaaattgattgtttctaaccaaaaggcctttagtgctagactgaaagaaaagtaaggtggtccttctgtgctggttgtattttatataatttggcatcaagtacaatgctttttatttttctctttagtttctttcttttctctagcctttgatggtccaggcctcttgttgctagggggctttttgggagacaaattcaaatccttactgtctagctcattgttattgtatcttttagtgagttccttttttcatggtagttcaataagtggttaccaggggtctttctttgacagttattactagcttctcttgtatagtgggatttagctgtgggttgatttgttgtgctggtatgttttcaactgcagcgatgcattgctctatcacatggattctttttatagcttcattagaggtgttttagttcctcttttgaatatttatctgagtatcttagtaccttggcagtcacactatcctaaattattatagtgccttctaaagtagattttgtcattgaggcttatgtttaggtcaggcttgcaggcagggagacagattatgccattgtggttgagaggcatatagtggttaaaaccactggagttattctgttagggctcatagcctatcttctccacctattatgccacctgtctaacccttgattgtcttatctgtcaaacatggtaaagtcatacctctttcatagggctgtcgtgagtatcaaatgagatgcaggttgcgtaatcccaaatccaaaaatccaaaatccaaaacacttctggtcccaggcatcttggataagggatactaaacctgtaatgcacgtaaagcacctttaggacaatggtccttactgctggcctgcaataagcacttaataaatgttattattttcttcttttttggtgttggtttgctcttctataatgttacaatgctattttgttaaccttctagttgtaaaaacacactcattatagaaagtttagagactgaagaaaagcttaaagaagaaaatgtctcttacaactcttccaccccccccagcaataataattacattttaacatttccttccagttttttaatacttagatattattttacacagctgagatcattctgcatgcataataaatcttgattttttttcacttaacatatcttaaacattttctcatatcattaaaaacacttgtgaaatcatttttaagggtcacatagtagcccatcacattacattcttttgattgatttaatcatcctctttttacttggcatttaacatttggggcttttttggttggagttgggttgttttcaggtcgttctaatatattaagccaggcttttttcttgtcaacaggaggtttggggattgagtctttgtgattgtttttattgttgcatttttttgcctgttgagtgtgtgaattaagctggggttttaaccatcagcacctgcgctctcagactcttgccaccacctttctggacaatctccatgctctgctttttaaactttttctgatgagtttcttttcttctgtgctagaagaaagatgaatggagactatgtttggtgtttaggtttctgacccggcagtgccatgtgaatgcccagtagctagccaaggtcaacagcactgcctgttaatggctttttactgaagtagtcctgtcgagcagtttctggtgagaagactatcctaaattgttcttgacagggtacactatttttgtttcaacttcttatttttcctgtaaagcttggtttaaagtatgttgagactgaatttatttgtgctttggaatataatgagattttgtgctcttttctttcagaaaactagccaagaacagcagtctggaaaagacatatgtatccaaaattgccagggaaacctgctgtgtagatacgctttctgagaaaccacatggtaaatgaatgtcatctttgtctcagaaccacagtagcctggttctgctggtggatcgtgctagctgatttgagctgggtttttaactcagttattgaaatggctttgagagcaggacttaaatgcctgcggtttttgacctcaagaggttgcttaaaacagtatcagcctgtgtgagcctgagactgtttttcatttcctttgtttggttcggagactgcttgatccatggctgcttggcaggcttcttctttagcgttcattcttgtggccatttattctctgatattaaactacaggataattttaatctcaactacatggtgagaaaaagagctgagtccagactggctcagaaatggagcctaagaactgcaataagtatcctagcaccttaggccctaggaaggactgttccatagttaacttctgtgtggcttcactgtaagcacaggtgacagatgggcatgtcttgaattcctagaagccattgtctctctcaatcatctgttccaacactgtatcagagaatgataaactttcagaattgaaaagggtcttaaaggacatattttccagctcttgctatatttccaacaagaggcatcatctcacatttgcttgactacctgcagtcatttctgagaagagggaattccacaagttggaagtagttcaaatcattgctcaaagctgtgtgtaaagatagtagtttttttttgttttttgttttttttttcagccaaaatttgtccccagggaacctctatccatgaaattttgattacttctcacaggaactttagcaaaagttagttgggattgtctggattttccgttttgcagatagagaaagccaccatctctttcccctaactacttagtactatggtaacttgggtttaggaaaatttgccagttcattgttaccaaggcaagtgactaaatcgtgggttctctgtatgctaatgctgccccgcatataggctttactgctgtccgtgcttcattctctctctgtttagctgagaaaatgagtgtgaaagcacttagccaatagtagtagatgttgggtgacatttcattaaaagtgcagactcctggccaggtgcggggctcacatctgtaatcctagcactttgagaggccaaagcgggaggatccctcgagcccaggagtttgagaccagcctgaccaatgtagctagaccttgtctctacaaaaaattaaaaaattagccaggcatggtggtgcccacctgtagtcctgctactcaagaggctgaggcaggaggatcacttgaacccggagtttgaggctgcagtaagctatgattgcaccactgcactctagcctgggcaacagtgggacaccctatcttttttttttttttttttcaaaaaaaaaaaaaaaggaaaaagtacagaccccagagtcagacagaacctgattcaattttgatttcaaccacttgcgggctgtgttaacctcaatggattatataattcttcaaacctcaaattccccatctgtagcactgggttaataattatagctgtaagatttaatgaagagcaaatgagattaatacatataaaatacttaatgtatggctgctaataatgaacagttaatgcttaaaaaattctggcttttattattgctattgttactattcctgtaatcactgtccaacaaggtccctgaatctgccctctcattaaggcaatacaggcagagcttaaccttctctcccacctgtccttgtgatttcttctctccataggactacccttggtattcattttcacctgatttaccaagaatagcaatataagcatcaaaagaaggggtggggatgggcatgtacacaatttctctggcccctggatatccctgcttctcttacatggggaggtttcaggagtgaccttgttactctgccgtgttgtcagaactggaggttgggcgttaacttattttttctcattttcctgcctttagggaaaacacgtatattcagaaatatcatggttgtctctattttcagagatggtttcatcctctgtggctctgtcatttgagtatgtgtttttaacaatctactcattccactttgtccttgtggtctagatttcttagtagtcagttttgtttggtttcactccagatgtaggtctctgccgcttcccaagacatcttaatttcatgcacatttaaaaatttattggcatcaagtttcagattttaaaatttgcagtatctgtatttatagcttgcttttcattcctgttatttgtttcttcttttttttccggggggtggggatcagtcttatcaaagtgtaattttttttttaagcccaaaccagcttttggttttgttgatccttgctactgcacattaacttttgaattcattaatttatgttcttacatcattttcttctttctgctttctatgggtttatttctcttttcttcacttggacaattcagcttactaatttttaattatctttcttttctttttctttctttctttcttttttttttgttttctttttccccgagacggagtcttgcactgttgcccaggctggagtgcagtggcatgatcttggctcactgcaatctttgcctcccaggttcaagcaattctcctgtctcagcctcccgagtagctgggactagaggtgcacaccaccatgcctggctaatttttgtatttttaggagagacggggtttcaccatgttggccaggctggtctggaactcctgacctcatgatctgcctgcctcggcctcttaaagtgttgggattaccagcgtgagcccccgcgccgggcccaattatctttcttttctaacatacatttaaggctgtaaaatttcctttaaatactatttcaactacctgccacaattttttgctatgtaatatttttgtaaagtcagatttgttgaggtttaatttatatgctatagaacatgctccttttaagtgtacagttggatgagttttaatagaaatatacagttgtataaataccaccataatcaagctatagaacatttctaatatcccatcaagttcccttatgccctgttttttgtccctaaagttttgtcttttctgggatgtcagatgaatggaattgtgcagtatatagccttttgtgtttggcctcattcacttagcatactgttctgagatttgttcatttgttgcatatgtctggagtttgttcctttttattgctgagtagtttccattgtatggatattaccagaatttatctgttcactactactttattttcagtgggagaaaatgagagtattttaattctgcatttggactgtaaatatcatccagactcttctggattggaaagtatcttggcatttttcaaatacaaatatttatttaggttttatcattttgaaagttcttccattagtgggcaaacatgagctcatgtgtattcacttgcacgcttcctcctgtagcagtctgggttcagagaggagatagaaaccacacagtagattaaagaggggaaatttaatataataagtattacctatgataaaagagtaactatcagatatgaagaaactctgtagcgttccctaaggctgagggcgtatatccaaggaaggacaaactgccagggcttcagacttcattggagaagatgtggttcagcccatggaatcacagaggagtttgctggtttgacaagactggagctgatccaaagtctctgggcaagccgtcgtttaccttctggagtgctggcagagagcaggccatccagtgggttactggccatccggtgggtagcagggtgtgggccctggctgggccaggaggcctttagaacacaagagccatgtggaggctttagtggccatgtcagctgagctcccaaaacgttaggataggctgagtctgcaaggtcacagaaagaccacgttctaggctgtcgctgggccacagtgtcgatggtcctcacacccacattgccatctcccatgctggacacttaggacagcctcttcctcccagtgctctactgagaaaacttcacagcacacgttcttcagagaaatgattatcacagaatgcatctagaagggtgcacttggatcttagaggtaacacactatccctattcttttaaaaagaagtgctatcaagtcaagagcagtaataactatatgcttgtgttattaacaatcagacccttcatgaggggaaaagagtttatgaaaattagaacttacgtagttttaagtaacaaagatatgtttatagacaaatagaactataccttcccatgggacctgtgttatatactaatcatgatattgtccctattctcccctctcccagtcattggaatcatagattccaagttgtaagtcagaccccagattggaagcactttctttgttcaagatgtttgctcattatagaaaacatttaggaagcacattttaaagaacggttttataccagagaagctaagtgtttttaactctgagcctagatgagcttactgctaggagtatagtgtttaaacctttcaaaatgaaaaactaggacacatggtctttacaaaatttttttctggtttaggaatttatacacatttgagaagtattaccatggcataaattaattcacatttgattataccaattaaacagttgccgaaaagaataaaagactatcctaaaatatttaggctatatacatactaatgcttttacagaataaggattaaacaaacctatcttttttagagtcttcaaccagaaaaatgaacaaatgataaaaacttatatttagcagtttgaaggtcacacacacacacacacacacacacacacacacacccctacccctatctagacctattttatgtttttgacactgtagagagttcaagtcctaagactttatggccattataaaaagattctgacatgctttgtggaattcttgtctgcttttgttgcagatttttttttttctttcaaaggattgcttgagagggtatttcttttttgggtatttaggttgtgaatctcacccttcattacatgggagtacccagcagtaaggcttacagagtgttatatactttccagaaactgagtgctatgtacttgcaatcttttccacgctaagaaatccccaattttaaaacttcaacctgcaaagtagcttacttagggaatttctatttgtattcttgacaagttttctgtaagcattcttttttcttttatgtgtttaaaattggatcctatttagtctgaagatgccttttaagactgcatctattaaataaagtgagatcaatttgcattttagctttcaaattttgctggggattctttgggctttttttatttggcaggaagagagagaagcagcttggcctttttgctatctcggaaatttccagcccaagaaagcatacagagacatagctcgcagggtttcttatgtgattagctagctcttttcctgaattattaagctgcattaaaacagtagctcggtgcagttggtgttttaggttttcataccttctgaaagattaatattcctacaagaatgaggttatttttgatgcctccctttagtgctttcaaacatcaagagcctcgcattcttgtactctaccttctgtagacatttacaattattctaggaggtgtaatgggtgtttactaacttcctgaaagtgtttctctcacagattggcttccttaagtgtgaaatttatacaccaatttaaaactacagtgtcccccttgtcaatgggggaatatgttccaagaccccccactggacacctgaaactgtagatagtactgaaccccattgccatcagtcagaacgtttctgttcatgtctttcacccacaaatttaatcccttttctatcttaaccaagcgcttatcacacaactgtggttgaaacttttgctccttgaggtatgacagcaaaactagcatgtatttctttttccttcttcacagtatcatgggtagaagattcattcttactgtaatcttagcagccttagtgtatgattttttgttgttagccaacaatgttcatcttttcacttaaaggaagcacatcatggtttctcttcggcatatgtgaattgccagcatcactactcttgcattttgggtctattattaagtgaaataagggttccctgaacacaaatactgtgataccaattctgcaacagtccatttgataaccagggtgactactgagtgactgaggggtggatagtgtgtatagcatggttatgctggacaaagggatgattcacatcccaagcgggatagagcaggacagcgcaggatttcatcatgcgtctcagaatggcacacagttaaaacttaggaattgattatttctggaagtttccatttaatattttcagactttggttgactgtgggtaactgaaactacagataagggggaatataatatactcttaaaatagaatttttcttaaagagcaatcataagcaaccaggactagagaatttttttcatttttttccttgtaattttattgcaagtaggatactgaattagttgcttattttgattttggtatgcatggatcaattttgagtaattgatacaactttatttaatgaacttaaattatcctcttaggcttatgtattgattacatactttcaaagctgaaatgcttgagagaacccagtaaaaagtcagtatcattttcaaacaaaggcttaaagattaaggatctatttctttattaaatatttattaagaattattttttgctggcctgctctctgaaaatatattagatatagtctttaatctcaaataggtcctactttagtaaaagaaaaagatacaggattgagagaggagttggagcttgtgctgagctggaaggttgaatgggcagccccctaagcagaagacagaattagatccagcagaagcttggaggtgtaaaaaagcatggcacctgaaggaattgggagttgttgttagtatttctgactaatgagctcataagtcttttcgtttatttaacctaatttgattagttctctgtatctcaaatgtgttacttgatataaccaaacttgcatttcatttttaaaagttaaaattcagacctttccctgatttagaatgaccccctcttctctgcactataaatgtgtgacgagataaagttttttttcccatagactctgaccacagggattcttccatctgtcaattcctatagcacatgttgccttgacacacagttggccaggctttacagtcagacacgctaaggttcctatcctaattcaaccacttacaacctctgggaccagaggcaaatgcctatatctctctaagcctccagtgtctgcgtctgtaagatgaggggtaagagcacttatttcttggactgttgtgaggattactcgagataatgcatgtaaggtgctgagcacaatgtccagcacatagaactcaattaaaagtatctctaattaatgttagtgatcattagccctcactaataccctagactgtagcttgttttcatgacttccctacctcttttctctccacaactagcgtgaagggagcatgccatatactttttttgtcccatacccactcttactcacccatactcctcgatccttacatgggttctgacacagagtgggtactggctacatttttaaaaagatgtaatgctagatatcagcaagtaaaccttgggggataggaaagtttctgatgggttcttgctgtggagaatcaaggtcaaaatgatagggaaaaaaatctgtgtttggtcaaaactgtattacctttggtcaaaggctgttctaaaactcacagaacaaaaacaaaacaaaacaaaacaggtgctttgtgaattccatagcaagtcgtaaaggctcatgccagaatagagttggaataaattctaagcatgcaaaatactactttaagaattttgtcctgtaaatttgagaatgttttttaattacggtagctcccaaaccttaactatggttttgctttccatggcttcagttacccacaaccaccgaatattaaatagaaaattccagaaataaacaattcatgaattttaaattatgcgtcatcctgagtagtatgaggaaaccttgtgccatcctgctccatcctgcctgggacatgaatcattgctctgttcagcatatccactcggttgcacccattagtcacttagtaggcatcttggttatcataaagactgttgtggtattggtattacagtgcttctgtttaacccttttgttttattttagtatggaaatttttttttttttttttacttttaggttcaggggtacatgtgcagttttttacataggtaaactgcatgtctctgaggtttgatgtagattatttcatcaccaagtaattagcatagtacccaataggtgatttattgatcttttcccttctcccactctccaccctccagtaatcctcagtgtctattgttcacctgtatgtactcatgtttttgttgtttagataagtgagaacatgcagtatttgtttttcttttcttttcttcttcttcttctttttttttttttttttttttgagatggagtcttgctctgtctgtcgcccacgctggagtgcagtggggcgatctcagctcactgcaacccccgtctcttgagttcaagcaattctcctgcttcagcctcctaagtagctgggattacaggcatgtgccaccacacccagctaatttttgtatttttagtagaaacagggtttcatcatgttggccaccctggtctgaaattcctgacctcaaatgatcctcccaccttggcttcccaaagtgctgggattacaggtgtgagccaccgtgcctggcctcagtatttgtttttctgttcctgtgttagtttgcttaagataatggcctccaactccatccatgttgctgcagaggacatgatcttgttcttttttatggctacacagcattccatggtgtatatggaccatattttctttatccagtctaccgttgatgagcatttaggttaatgccatgtctttgctattgtgaatagtgctgtgatgaacattattgtgcatgtgtcttcatgatttatattcctttaggcatatacccagcaatgggattgctgggccaaatggtaatgctgttttaagttctttgaggaatcaccacgctgctttctgcaatagctgaactaatttacattcccaccagcagtgtgtaagcattctcttttctccacaacctcgccagcatctgttattttttgactttttagtaatagcaaaaaattctgactgatgtgagacgataatcttactgtggggtttttttttgttttgttttgagacggagtctcgctttgtcgcccaggctggagtgcccagctttgtcgcccaggctggagcgcgatcttggctcactgcaagctccgcctcccgggttcacgccattccccggcctcagcctcccaagtagctgggactacaggcgcccaccaccacgcccggctattttttttttttttttttttgtatttttagtagagacagggtttcaccatgttagccagaacggtctcaatctcctgacctcgtgatccgcccgcctcggcctcccaaagtgctgggattacaggtgtgagccaccgcacccggccttttttttttttttttttttttttttttttggacacagggtcttgcctgtgtcactcaggctggagtgcggtggtgtgatcatggctcactgcagcctcgacctcctgggctcagttgatccacccatctcagcctcctgagtagctgggactacagggatgtgccactacacctggctaattgtttttgtatttttttgtagagatggggtttcaccatgtttcccaggctggtctcaaactactaggctcaagtgatccgcccacctcagcctcccaaagtgtgattacaggtgtgagccactgcacctggcctcattgtggttttcatttgcatttctctaatgattaatgatgttgagcactttgaatatgcttgttggccacatgtacattttcttttgaaaagtgtctgttcatgtcctctgcccactttttaacaggaaggtttgttttttgcttataaattcgtttaagttccttgtggattctggatattagatctttgttggatgcatagtttgcaaatatttcctcccattctgtaagttgtctgtttactcccttgatagtttacctcttgctgtgcagaagctctttagtttaatttggtttcatttgttgatttttgtttttgttgcagttgcttttggtgtcttcgtcatgaaatctttgccaggtcctatgtccagagtggtatttcctaggttatcttccatggtttttatagttttagattttacttttaagtctttaatttatctcaacttgatttttgtgtatgatataaggaaggggggggtccagtgtttttatttatttatttatttatttttgagacggagtctcgctctgtcacccaggctggagtgcagtggtgtgatctcggctcactgcaagctccacctcccgggttcacgccattcttctgcctcagcctcccgagtagctgggaatacaggcgcccgccactatgcccggctaattttttgtatgttttaggagagacggggtttcactgtgttagccaggatggtctcgatctcttgacctcgtgatctgcccacctcagcctcccaaagtgctgggattacaggcgtgagccactgcgcccggccaagggggggggtccagttttaatcttctgcatatggctagccaattatcccaggaccatttattgaatagggattcctttccccattgcttgtttttgtcagctttgtcgacgatcacttggttgtaggtatacagccttatttctaggctttctgttctgtcccactgatctgtatgtctgtttttgtaccagtgccatgctggtttggttactgtagccttgtagcctagtttgaatttggttaaaccaacttcaaacctgcagctttgttttttttttgcttagcattgccttggtgttttgggcttttaaaaaattctgtatgaatttttaaactgtttttttctaattctgtgaagaatgtcattagtaatttgataggaatagcattgaatctgtaaattgctttgggcagtatagccatgttaacaatgattcttcccatctatgaacatggaatgttttttcatttgttggtgtcatctttgatttctttgagcactgttttataattctttaagtagagatctttcacttccctggttagctgtattctattcacatatcttttatttccctggtattttatttttttgtggctattgtgaatgggactgagttattgatttggttctcagtttggacattggtatataacaatgctacttattatatttttgtacattgattttatatactgaaactttgctgaagtggtttatcagatcaaggagcttttgggcaaagtctatagggttttctatgtatagaattatattgtctgcaaacagatagtttgacttcccttcttcctgtttggatgtcttgtatttctttctcttgtctcattgctctgggaggacttccagtactgttgaataggagtggtgagaaagggcatccttgacttgttctggttttcagagggaatgcttccaacttttgcccatttagtatgatgtttgctgtgggtttttagtaaatgggtattactattttgaagtagtttcttcagttactagtttgttgaggttttttttttttaacatgaagggatgttgaattgcatcaaaagccttttctgcatctgaagtaatcatgtggtttttgtttttagttctgtttatatgatgaatcacatttattgatttgtgtatgttgaaccaatcttgcatctcagggataaagactacttgatagtggtggattaacctttttatgtgccgctggattcgatttgctagtattttgttgaggattttcacatccatgttcctcgagaaaaatggcctgaagtttttttgtttttgtttttgttttttggtggttgttgttgttgtatctctgtcaggttttggtgtctggatgatagacatagatggacacctcatagaataggttagggaggagtccctcctcctcaattttctggaatagtttcagtaggattggtaccaactcttccttatacatctgatagaattcagctgtgaatccatctggtcctggtcctggttctacattttgtagcttgtgagtatagaggtgttcataataggttctgggaattttttgtatttctgtgaggtcagtggtaatgtcctctttgtcatttctgattttgtttatttggctcttctctctttttttattagtctagctagtggtccatctatcttattatttatttatttattttttttcagaaaaccaattcctggattcattggtcttttgcatgttttttcacatctcagtttccttcagttcagctttgattttggttatttatttttgttagctttggggttggtttgcttttctttctctagttcctctagtttatatgagtaacccttattttacttaataatggccccaaagcataagagttgtgatgctggcaatttggatttgccaaagagaagctgtaaaatgcttccttgtttatctcttactgtgcctaatttaaaaattaaactttatcataggtatatatgtataggaaaaaattgtgtatgtgtatatatatacacacattatatacatatgtatatacacattatatatctacacacacacacacacacacacacacacacacagatatctagctagatagtaccaaaatatatacatctgtggttttggacatccactggaatgtatcccttgtggataggggggactactgtaatcacaaaaaactaacagtatgcaagtacttcatattttataaaatgttatttaaagaagaaaacttgttttttgtgtttgccatttattaaatcatattctttatacatacacgtgtgtacacgcacgatgtactgagtctcctctctaggctctgtggacaaagtctttgggttatttgaacgcagtcttctaagagatccgtgtcagaggtcttgtcattacatcaccatgcctgcttgaagccagatttctttgattcacccaggcttatgatctgcatttcattccagtcttcttggtaaatattttttatatatgtggtcaagttctctttgtttggaattttgataatgagaactgcaagtgttgattaattataaacctaaaatgggattgaggcaattgttaactcgtcgtggttttgctgctttccctccttattggagaagaattaggaagactttataggggactgatggaaaaataatttggcatgaccataatttgagtcagagaaagtctcttattaaaattcccacaaggcttatttaaggagcaagatcttttgaaactaatggtgtggtacttacttaatccacacaagttatgatttgattgtcatcttctttgatttttctgcttggctttctgtcatctgatgagagattactgcattacctgagaatctcatcttattagagtcacctctacctaaactagaatccattcctaaatagtaacatactcgcatcaagaaagagtaagtatcctcggtactaaattagtgctctagatgcctttgtacattttttttgttgcacttttccggactttctagtggccagtgttgaggtatgggatggtatgatggtggcttcattcaactttttagcttctatcgagcttccctgtcatcttgctaaattccaaaggtgtgttctttcctcattcttggtcacaacaaaacatcacctgagacgggatcagtctgactcgcccaaccagaagggatgatgtgtttgagaaatcctgtttgtgacactggaggaagaattgtgactgttcatatatgatacatatggaattgaaacttgtccttaaaagctctggcaggtctctctttgatggtttttagggacaatagacttttgaggtgagagtttgtagtggcagaggagcagaactttgaaataggcctaaaccctgtactttggatatgggccagacccatttgtgttccctatggggctggttgacaagggaagaggaagctctactatacattctcatgtgtttagtgtagcttaactctgctgattcaagatgggctaattgtcagtgtaattcctttgaattatctctgtgatgaagtatcagctggagcttgccagtggcactctgggccaattatgcagccgactttgaaaaatggtatgattcagaatgtcagagttgctaaggtgatttatgaagaaatcagttcccatcagccttcattattcatagagatgctgggaatcaggactttgcagtgacctggcccagaggaaataaaccaggtgggtatgatttagggtttctcacatagagttcaatagaggtgcctctgtgtatgtggtatgtgtcctgtaccgtgttgtgagctcatcttagagcaacagcagctattatttacattacatacttcctccatttcccaaaaaaggatataaggtggtagccttcacttacccactttctttctggtggatgcatgacattatgttatataccttaccaatacctccaaacctcacaaccgctgttgtagaacgaataatgtcctccattgaaaaatgagaaaattgaggcacatattagatgatttatgcaaaggcatccaactaccaagggcagaactcgtatagaacccggtccatctgacttaacaccagtgctcttgcccctaacctgagctgcttctctgacaggtgtattgccctttatattcatgttgcccagcagtgttcctggcctagcgtagctgccaataaaattgattgatttgatttgaatcatattcagcaccctggagtcactgcacgtcagcagcagcaccatgtgtgtagtaggcacttggtgcctactacaaaaggcacaaaagcagcaaagtagatagcatacccattttacagatgagaaaacggaatctcagagaggacaagtaacttgcctaaagtcacccgttaccactagtggcatttctgaatgtgagggccatctgatgtatctaatatcagctaaattcataattcttccagtcttccacatttttcacaaacacactcccatttccagaaacccttcatgtttcttccagttgcttgttgtctcttctaattccttgttgtatcacttaaattattttcccactcttatcctcagtgacctcatctctaaaaggaggataatgatgatacctaccttacagatggattaaataaaatagtgcagacaaaatgttgagttcagcatttaacagatgcaaatggtgaagtaattaacatacttcttccatatctatgtgtagaatccaacagtaacacagcatttgtatcctgctaacagagtgaggctgaactttaaactaaaaatatgtctactttaagatacaacacatttccagagatcacatcttttaagagaaatctcatctgcacaaatgttgttgcttttacttattcagacatcctttggcagacatcagacctcatcagactgggtaaaggcgatggtgagggaattctaggtgttagacaatagtgagtgagttcccataagacattagtactgtcaggctcggagcccgtcctcttcctttacccaagactgatgtgttgcttagccttatgatggcaaggaaattctaaataaccatgattaagaggcttattttagtttctccttccactgtgatctctcccagaaagagactcagaaatccttatacttggtctgatctcttcagcaaaacccaccttcagtagcaagcctgtggctctagggttggcccttattttgtcttgtccagcaggatggtgtctcttattcttttgatgatctcattctttccaaagtgtatttcttataacagaagttcttttttgtttgaataaacagtttaaatggacatgcctttagagataacttagccaggactggagccctgcttcttatcagacattacaaaacacagacattctcattaagtgaacagagatttcctttgatttcaaaagaatgttaaggggaattacttttaagtttaaaagctccttgagggcagaacgcacttcttattctacactgactcttcttagcacccatccagaaccttgttgcatatgatgatgccccatgtaagcttgcttcattggtttcagtggcttttgttcttagttgactagaaatgaaggataatttattcatttcttcaaccagtattacgtttagcatagtaaacaagacaaggtcaatcccttacagaacttatatcctagtaagagagacaagtaaaagaaaataaataaaaataattacaaggtacataattgttttgaagaaaacaagagtctgagatagaggataatggagaggaggcagtctttctagataagatggtcagaaaaggcttgcctgcatcctctgaggagttgacatctaaactaaaacctgtaggttaaggaagaacagggcatgaaccatgcaggcagaagattcattaactctgtaggccactgaggctggaaaaagtatggcctgtttgaggatctgaaataaagtgtagctgtagggtcctgagcaaaagagggagtaatagattatgaagttggaggggaggcaggggccagccatatgaggcccatgtagccactcatgagttggattttattctcagtgcaataggaaagaaacctaagggtgaggtgattggattcatttctgtgtttttaattatgtttgttgctgtgagatgatggcagcctggaccaaggtagatggagatggaaaaaagtggttgggtttgagttataccaatatttcagggacaaaattgataggactgctaaaggattggatgttggcaggaggcgggggtgagggaaaaggaaggatcagggatgattttgagcaaatggaagaatgatgataccattcctgagatggggaagactggggagtaaggagacaagatttggggatgaggaagggatgtgactcaagagttttgctttggatgtgttaagctgcagattctattagcgtggtggctcacacctgtaatcccagcactttgggaggccaaggtgggcagatcacctgaggtcaggagtttgagaccagcctggccaacatggcgaaaccctgtctctactaaaaatacaaaaatctagccgagcgcaggtggcaggcgcctgtaatcccagctacttgggaggctgaggcaggagaatcgcttgaacccaggaggcagaggttgcagtgagctgagatcttgctgctgcacttgcctgggggacagagccagactccgtctcaaaaaaaaaaaaaaaaaaatcagatctcatcaggcttactatcattagaatagcatgggaaagacctgaccatgctatttaattaccaagatttaattactttccactggatccgtcccataacatgttggaattgtgggagctaccattcaagatgagatttgggtggggacacagccaaaccatatcacagatttttcacgagataatcagggactgaaatatccagtgggagctgatctggatgtgcgagtatggagtatgggtatcacagaatagagaggatattcacatcctatgggatagatgaggtactgaatgggtgatatttcccatacctcgtgaaaacagctcaagctacttacatggctggattgagaatttgctgcttcaagattctggctgtagcaaaactgtagaatcacagttattttactgcaagatattcatttgaaatgtatttatgccaccaaggaccaggaaggtgaaatgctacacttggcgccatgaaactattgtctgagcttgtttttcggaaaaatccatatctggatgatatgactgagtcatcagcagtgcctggctggctgtgttgtaataggtcagatgtaacttaagccccaaagttcttaggacagccataaattagtctgaaggtggctgagataaggcaagggtgcttgttgcctccagattagaatcaagggcaacaaaactgcctagaaattggaaacccaggagaagctttaggctagagacaggcagcaatactttgtgagaattttactaacagaaaaataaggaagatacagaatcatgtttatcaaacttgaggatttataagaaatacctgtatagcttctttattttagtttatttttattattatttatttatttttgagacaaggtcttgctctgttgcccaggctggagtgcagtggctcagtcacagctcactgcagccttggagtgggctcaagcgatcctcccatctcagcatcctaagtatctgggactataggtgtgcaccaccacacctggctaattttttttcccccgtagagatgggatttcactatttgcccaggctggtctggagttcctgggctcaagcaatcctcccaccttggtctcccagagtgctgggattcaggcatgagctaccatgcccagcgtgaataccttcttcaaaatgcaaaatcctgtacctcacctcccagggagtcttattaagtagctttggactggggctcaggaatctgtgtttttagcaagtgattctgatacaggtgatccataggtcatacactgagaaacattgagtctggaaagacttctgagatcatctagtcagccctgtcttacaaatggggaaattaaggtctgaggaggagaacgggcttgcccaaagttgcagaataagttgcaaagtcagtgcagctccactaacttatatgtcttcattttgcaatttattcttcatcctagtggctagatgaaaagcaagtctaccctcctaattcccagctccccttctttcacactattttttattttcttttttccagagcaccttctaatataaaaataatttactaatttactgtgtttattgctattttccttgcttcattaaaatgtaagcttcacaagggcactgctttttgtttgtttgtttgttttcattaaagtagcctatgtgcctcgaatagcacctgacccatagtaggtgttcaatgagtatttataaatggatgggtgaaaaatattttgttaaactgtacataagttaacaggtattatgtaccagcccttaggcattagcatgaaatagagtagaatattttctttttcacatgtttgattctagcttgaattagaggttacagaaacagcttatttatggaagattaattagagacttaccaatcatatgtacaataataataagaataacaatagcaacaataacaacagtgataacatccatttgtggaatatttactatctgcccaacacatactatatgaagttctgagctaagaccatcagaccattatctcatgtaagtcttagtaccgccccagggtggaggaacaaaatagtattgtctgttttccaaaggaggaaaccgaggctcaagaggtgaaattactgtttaaggttacatagccagtacagatttaggacctgtgatcccaaagattacattcttaactaccagttacattcagtagtaggcttggggaattctctctttgcagaaggaattgaaaatgccaaagactaggcaagcattgctattaggggtgtccttgggccaagaacaccaacctctaaggtagtataaaaccacaggctggaaagatgcattttttttttcagcccgactttccagcatttacccacactctcaagtcttccattctcacattacaaagaacctttcgtcttgaactattagggttttctcacttctcagacaccctccctgaagcaggccaaggaaaattcctgtggtgacaggccatttctagggaggccactgtagcacttcacacttgctctcaccccacccactcaaggaagggtagacagacagagggccctttacccagctcctatactactttcctgtggagacctcaggaaagggccgaggatcatgattttctaaatgtgggcacaacagacctcttgtaagactttgagttcttgaaacactgtacctattaaactggttgtgagcacacagaataaagtatcaccacccactgtggataatgtcagcattcattcccacccctgacagccaatattggccaggcttggaatcactgaacacacatggcagcagagtcccttgccccatagctgcagacacaggttgaacactggtgtatccctgggcttttatgaagagagaggcttataacacccattgccatctttacacacacagtgcagcaggtactgtgctgagaactttacagccgtgatcttatttaattcttacaatacatgtgatgagacactgctgtctgacttctgtagatggggaaggcctggagagattggtaacttgacagagtctcatggcatctgcaacaggcagaaccacattttaaacaaaggttgagttacttctaaaacctgtgctttgctagtcttctgttctgcaacactggttaagagcatagactctagagccatgctgcctgggtttgagtcttgattctgccacttactagttgggagacattgggcaggttacttagctaccctcctccttgggctgttcatctgtaacatagggataataatgtccttgtagcatgggttgctctgaggattaaaggaatccatatatgtaaagcactcagtgtctggtgcatagaaaacactaaatgccagccattattattaatttatatatcaactcattgtttttctttggatgatagaaacttaatctcagaagtttgaggtttttctaactacccacccttaccccaacccctgccaagggttgcgtctgtattcccaaggggcttagactgttacctggtatatagtagcctcaagtaaatgctggtgatgataatagggcagtgccaagacattgggggtgtgggaaggcagggttaggggatggcatctgcgcctcatcagcatcgatcctccatggtgtcgtatcctgaaagtgggaaaggcgctgtccagatagacgcttatctcgtagacagaacaagaacggggaggcaaccattatttcacatacagcaagttactgttattttaatgccctaacaatgaatctatatttaattaacttaaaagataggggaggtgagagtattattcactaagttcttggtcaaggcacattaaatcaaagcggttagcacttagatctcttccagggataaattatctcagacaagcttcaaggtatgccatgctttggaatgaattgtcactttccaaccaccaccactcaacctgtgatctgaccacagtgtcttcctcctgtctcccttccctctgggtgcctgggaaggctgggcttctgcactgttctgccactgacttaagctttgtcgtgactataccttccacttctcttctagcttaagagttggacagtggaggaccttcagaagaggctcttggccctggaccccatgatggagcaggagattgaagagatccggcagaagtaccagtccaagcggcagcccatcctggatgccatagaggctaagaagagacggcaacaaaacttctgagcaaggccaggctgtgagggccccagctccacccaggctttgggtgaattctggatggcttgcctcatgtttgttagccagcacttctgctctgtcgtctctccacagcacctttgtgaactcaggaatgtgcgccagtgggaagggctctcttgacagtcagcgtgccatcttgatgtgtgtatgtacattggtcaggtatattatctcaaaggatttatattggcgcttttaactcagagttttaaaccccaggaacagagactcctagttgagtgatagctgggaaagttttacattgtctgtttttcttctcccaatagctttcaattgttctttctggaagacttttaaaaaaatataaatatgcatatatatatataaattataaatagattccccacgcagtgtggtggcatctctgtacaggtacagttttaaacggtttgcctcttttctgtaagattatggtactgtggaacatgagggcagaggacaccgggaggctgttagggggtcactgaatcccaggagccaacctccccctttgcagggctgcatttaaaaattaggtttgggacagttcttgtaccgtggtttcagccttgtgtggtcatcactggcttctggagctattggtgatgtccaagggaaagctttgagagtttatgtttactctttgagtcccaggagaagcctggcaccctctttgcaaattggcctttgctctttcaatgcctttcatccatctccactctctcaactgcctaaagtcacagcacagatactgcccagtgccttaagaggagacatgatctctaccagggactctcagcaaacacgggactgtgttcagtccacaaaggaaaagcgtttttgaagctctcattgttcatgtaaaaatcatacacgtggcatgttgctccacattccttacacacaggggtagaggggattgcttttgtgacccacgttcaaatatgtgactgttttcttttctcttttactgctaagcagcctggaaaggataaatgaatattagactaagatttgttttccaggaggctcaatctgaacacacagaatgtcagagctggaagggactatagagatcatctgatctgatcctcttgtacggatgatcgcaaaactgaggtgtagagaggggaatggccaaaatcacaaagcaagttagcgttaagagctgagactagaattcagggtcctcactcccaggccaccgaaccatgcagccccttctttgggggaagagacctgtgtcagtcttggttaattgttccagggaaccttgctaacagaaacttgctcttgccttggctcttcagtagatgacctggctgtaaagagattccctggacgagccagatcattcagtttcagcgagtccttgagctccacaacatctaccagatatagcagacaagcacccatggaggcaggtttcgggcctgaagcagatcagagggctttgcaaaagacagcatagagccatcttcctgcaactttacctctttccctcagatggggagccatgactgggttgcacctcaggatactgtaatttgactccataattgcttttgctcctgaaacctgggaatcaatggaaaggcagggaatgtgcctcttctgtggccagattctgttatttgcaattaaagcaagtttttaaaaaatgcaagaggcagttgttagtcttcagggcttggcaactgaaatagctatgtggcggatacggaaaacagaggacaatttgaggatcttgctggaataataaatgacagctaccatttgttgagcacctattatatatcaggcactgagctgggtaggctctaaacttcacaataaccctgtgacttaactactttatctccattttgtagttgaagaaataagttcagagagaaagattccttcccaaggtcatgcagctagtaaatgatagaatcaggattcatagcatcactatagggggtcaatatttacacaaaaaaggaaagtcacaagcctgtttaaaatgaagtgaccaccttttcttgcatagactaaataactcgaactggcatttttaggttggaaagacagctgaattagtagttaagtctgatagccaagtaagttttaaaaaccaaagcatccaggatgcacacccctgcaccatttgctgtgcgaattaatagttctgtctctctctctctttcttttttctttttattctttgagatggattttcgctcttgtcgcccaggctggagtacaatggcacgatcttggctcactgcaacctccgcctcccgggttcaagcgattcttctgctgggattacagcatatgccaccatgcccagattatttttttgtatttgtagtagagacggggtttcaccatgtcagtcaggctggtcttgaactcctgacctcaggtgatccacccgcctcagcctcccacactgctgggattacaggcatgagccaccgctcctggcctctctttcttttttaaacaaagaactttgcacttggccagagaggaggagaaagcccattttctcccttcctaagctagatccaaataaaagaaagttcagttttcccccataactattcttgggtcatgaactttgatctggagtttgttttgtttcaggaatgtgtgcacccagcttgctgatccaacaaagtctattgcttaccagtctagcttgatgaagccttttggccagaagtcaatttgttttggatcagagaaatttcctgacaaggtatatttgttttctagtgacagaaaggcaaaggaacaagtcctagttgttgttgttgttgttgaatactaaatttaagatatgtcagcttgctttcaatgagccttgggcttctgttattgcttgagcatttggaactcgagcttccagagaaatttgaggtcctcgcttgttctctgccttcaagaaacaatgacctgattctgtctttaaaaaaaaaaatctcagaattctttttttgtttgtgtttttttttttttttgagacagagtctcactctgttgcccaggctggagtgcagtggcgccatctcggctcactgcaacctccgcctcccaggttcaagcaattctcctgcctcagcctcccaggtagctgccactacaggtgctgcaccaccacgcccggctaatttttgtatttttagtagagacagggtttcaccatattagccaggtgggtcttgaactcctgaccttgtgatccacccgcctcggcctcccaaagtgctgggattacaggcgtgagccaccttgcctggccaaaaatctcagaattctttaagactgttttaattgctccatcagtaattttgaagcactttcctttttttttttttttcccctttttgtccctttccccaagccaccaattggatggatgaatgtttgacggggaagaggaagggtaggaggatgcatggatgagtggatgagtggatcgatggatgtattgataaatagatagaaccagtcatctgaagcaacttaagaattgtagccttgactccttgagactgtagatttcgatccaggaaacatttatttagcacctgccagatgccagaaatttataccatttaaaactcagtaagtcttttaaatatcaggaaggagagaagcgacatcatgatacatcctatgggtattaaaaagccaatagaatattatgaataattttatgctaataaatttaacaacttcaacatcataaacaaattccttgaaaaataaaaagtaccaaaattcattcaagaagaaatagataccagcctgagcaacatggcaaaatcccatctctacaaaacatcaaaaaaaaaaaaaattagtcgggcatggtggtgcacacctgtaatcccagcttgtcaggaggctgaagtgggaggatcacctgagcccagggaggtcaaggatgcagtgagccatggtctcaccactgcactctagcctgggtgacagaatgagaccccgtctcaaaaaaaaagaagaagtagataatctgaatagccctatatctatagaaacttaatagtgctgggagatataggtattattatcctcattttacagatgtgaaaattgaggctcagagaagtaaagtctattgctcaaggtcatgtggctagaatatggcagagccatgattcagatccaggtcttctgattcttattccagtgtcctttctagcataccatgttgcctctaaagattgcagctccttatttactagaaaattgttcctgcccaatctacatctccacctcaccccatcttttcttaagcactatgtttgtgtttttatcagtattatattcattgtctttggaatacatgttcttgtttgtgtttggaaaaaaaatctcttttaccagcttgcactcggaccaacttggaaaaaaaaaagcttaaatgtttttgctatgtacagtttaaaaatgtgaagtttgtagctttaactttttgtaagaaaatctaataacactggcttaagtgctgacttgaaatgctattttgtaaggtttggatgtaagtaatcaattgaggtcagcagtttgtatgagacatagcttcctccattgcccccactccttttttcttttttaagtttgagatgcttcctgtgtttttatgttagaattgttgttctccttcttttcttcttcctatacctcatcacgtttgttttaaataaactgtcctttggaccacaa

SEQ ID NO: 2057 - DNA, 41423 bp, Homo sapiens
  source 1..41423: mol_type = genomic DNA
agatgcggccgcggcggcgcggagctcgggcggccgtggaggaactcagcctcggccgcaggaggcgccgggagcggagccgccgggagtcgcgcaacaggtttccttctccatcgctgcgcccacaggggacgcgcgccctgccgggagaggggcttctcggttcgcactctcgctcccagtccaggtttgtttttctcttcctgagcccccatttctcttcctgactattttccccgtgcgcggagagatcggggagggcgggtcggggcgggggcactgtctaggctcgggacccgcggctgtgccttaggtgggattttggatctggcgcaggtcctcacgccgcctctgggcaccttcggaaacacagcattgggtttctcatataaagcagaatgattttttaaaattacttttaatttcagaggctgagggacttaggatttagtgcttcgtaagaattattttagggatacctgttggtaggctgcctttataaagtgtccacccaagactacttttattttaaatcgaaaggctggagtgtttttttattatcacctcttcacttcctagtagggtgactgtgtcaaaaacaccagaatgggtacttcttgacttgaacttggcggtgtcactcagtagccaggaaagacggagaaattgatagagccttcgaggagtcccttcgaagcccacgtaagactttgttttagaaacatggagagaagtagtggcaatgcctgcgagagccacgccgtcctgagagggaattctgcctttttctagactccgctgacaccagctgagatctgtattacttcctgtggttctcacgcacttgtttcagccgtttctcagcagagggaggagctgttatttacaggtatccaaaaatgagtcacagggctgctctcttaattgtgagactttgttaatgaacttttgaaaagcgaggcttgctttaaaatgagactctagatgtgaaatgcctgccctgccaacctggggcagtggtatgggaagtgacgattgagttttcagtttcctaaggcgcctgatgttacaacatgccagtaaaggtcactgggctgatctaagataaccattgaaatcatgtgctttgccacagatgcccaagagaaaattaatttcattattcaatgaccattttgctgtcattttcactgcatgggagaaaggtatcatttaatgtggtgattgtaagtaactctctaaaatcaaaatatttcagacagtttgtgtttactaaattggtgctaaaaccacatgatgatttttgaagcgggtgggtcccagcgggagcagagaaatttaaaagttgaagctgacaagtcctattgcggtgggtaacagcccttaggaagggactgcacactatctcaacacggtagagaaggggacaccatctctactggagctgagttgagctgaattcagcctcaaacaacagttaccaggtaccttctctgtgccagcctcttccctgaaccttgcttgtacaaccatgaataataggatcctgccggcaaggtactagggtaaatctatacccagagtgaagtttctgtgccaatataactcaatatgctgggtcccagtgtatttaaagagtagactcagcagattatcacccctagataattgcggtcacgattagttgatagtgtgacttttaagaaatagtgtgactaattaatagtttatttaaatatgctggaaaattcaatataatgagataggtgctagggtaaatctatacccagagaaaagtttctgtcccaatatgactgatgtttctgaagatctgggatttggaatggactgggtcatggctggaagagcaaggaaacttttgagtttagtcatttacttgtctttgtaggcagcctattcttcatttgatacatgatttaaaaatgtatgaatttgaaaggtatggtttttaaagtgcttgaatgaaccatgtttcatgttatttaataaccatgtaaaacgaaattcagctgattatcacccctggacaattgcagtcacctttagttaacagcatgacttttaggaaatggtgtgactaattaataggttgttttgttttgttttgttttttgagacagagtctcactctgttgccccaggctggagtgtggtggtgcaatcttggctcactgcaacctccacctcctgcgtttaagcaattcttgtgcttcagcgtcccaagtagctgggactacagacacccaccacaacacccggctaatttttgtatttttagtagggacaaggttcggccctgttggccaggctggtctcgaactgctgacctcaggtgatctgcttgccttggcctcccaaagtgctgggattgcagatgtgagccaccatgccctgcctaatagtttatacattggtaacactatattgaagcgagtttatgatcattgtttttgtagttcaaatcaatgttttttatcacattatagccgtgtgagccaaaatgaataaatctaccgtatcacagtttactgttgcaattgaaatctgctgagatgcttttgaactggatgcccaagtatcaaggtttccaagtttccccagtttgctaagatatccaactggtaaaggcaacaatgctaaatttcagacaactttaccttaatttccaaactttattcctcctttgagagccctaaagttactttttctatgagaaagaaagggtcgagtttgtcattcagcattgtactccctgaacttggcccaggcttgtctcatgataagtgttagaaagtgtttattgatggaataatgaaccttcacgtaggaggatgaattgtcaggcaagtggaattgtctgctgtaggtgacccagcagaaggaacagcacccatagagaagtgaaacagcactggacgttcaggaaactccagcctgtttagtgacggcacagagggaggcctacggagacaggaagggccagatcacaaaggccccatgagggtttaatagtactgaagcctttgaacaagtgaatgatattgtcaggtatgtgtttaaaaaataataacaaaacttggaattttaaaaatcttagattagatgagagtgacattgaccctaggaagacaccgtggaaactgttgtcatattgcagatgggacattgaagaaggcctgaatcgggcagtgacaatgcagatgggaaaagagggaaggggctggtagaggtttaataggtggaaccctgtcgggtgtgtgtaatgaggaggtaggagcagttgagatgactcccatgtttctaatgaatgactaggataagaatatcctactcggtggaagaataggtttgggctaaagggtggtgaggagctcacacagtacttggcacataatcagtgctcattaagatttttcaaatgaatgctagtaatagctaaaatttattgagtgcttattaagggccatgtactatcctagactcactatgtgcgttaagccttttactcgtcagtacaatcctgtgagataggtactcaaattaactgctttgactggtgaagaaagtgcagtgttagtaactgacagagccagaaatggatcccaagcacttggttccagagcttgcattctgaagcaccctgctgtgatgtgctgtcttgatgaatgaatcaatgaggttttggactttgtggtaagctcaggttgaagtcactctcctgcccctaacaattcttccttatccaagaatggccttgatgcataagatgggccttcagtgtccctactgtgctacatgacatcccaccccctaccttcactccaagaaatacctgattcatctaggaagaaacctggaataatcagacatttttatcctgggaattgaaacatcttaatggagactcacagtgtctgaaggttccaagtgcttcaatcattgtgtctacagagctgccttggttaccacccctcctaaacactgaatgctcaacttttcatatttctcagatgcactcaatgttttgttgctaagattttccatagggaagcagaaaggctagcaagggaggcattaatctacagagcagggtcaaatggtggaagaaccactaacaaatgcagacaggtacataacaactccagatattacattcctgacttgtgatctgccttttgaatcctattttgttctagttttaccctgaagcaggcgccttacctgcctctaacttccagaattttattaagtgagtctggtcctgctgtgtctcctgtcctcttgattttaacttggcaaaatgattcaagtatcttgcattcagaacttgctttccatttggggcacctgggtagattcttttgtctgaacagcagtattttgaccaacaaccctgtccacccgcccccaccgcctccaaaaaaatgatcccaactcttaactgttctcattgttgataattcaacctaccctgacttggattaatatcctgatttttgttcagcaatcagggactaagaattgatctaggaagaaactggaataatcagaccttttctcctgggaatttacattttaatggagactgtctgaagattcccagagcttcaaccattatgtccacaaagctgccttggttatcttttcctcaaagacctcgactttggaccatgtaaggtttaaaacgcccaattaatgttgtacccaaactgaatcagcaaactcacttattgaagctttaaaatgttcaaatgtccactttgggaggctgaggcaggaggattgcttgagcctgggggcagcggcaggggcgggggagaatgttcaaatgtctaaagcttgaagttttaaaatagtttctccacacatgcattgaatgttttgttcagcatttcttcagattcattgggaaatcaacatatttatagttgcccatgaaatgagagtgacatgaagcctcgcagggtaatagagcccacatgtctaccccttggcctgagcttttatgtgcctgcctataattcattcagtgctcagatcacaagaaagggaagggttttggctaatatttcatatcggtttgtcttggctgttcaattcaactgtggtttccctgagagaagagaatagctagagttgggggctctgttaagccacctctaaggctcctccccgtcctaataaccattctgtgtcttttactaataatgaaaccatctgtcagagtaagtcatttcttggccactccttctgagtttatggataccagacattatctgtgtatttcattcaacttctttgtaaggctcagtaattgggtaatttttagaatgatgtagagttgtagaattggtaattttcagttgcccttcttgagctaattaaatgtgttttaaaatttaatctttctttctttctttctttctttctttctttctttctttctttctttctttctttctttctttctttctttctctctttctctccttccttccttccttccttccttcccctcccctcccctcccctcccctccccactcctcaggattttcccttttattgcacaggcgggagtgcaatggtgtgatctccgctcaccacaacctccacctcccgggttcaagcaattctcctgcctcagtctcccaagcagctggaattacagggatgcaccatcacacgtggctaattttgcatttttagtagagatgggatttctccatgttggtcaggctggtctccaactccctacctcaggcgatcagcccacctcggcctccctgagtgctgggattataggcgtgagccactgcacctggcctcatttccttcttttcagtggataggacatcacaataatccagaaaatactaagtcatctagaaaagtatttcccattttgtatacttgttttacttgtttccctgttcaaagttgcaaagagatattccattactccttgcataacttattgtgtaataaggtcaatttcagcttttcagaatagtgaaatagctctgtttttatcttcctatggaaacagtaagcaagtagttctgtcttcggtttcagtttcaggattgcagcaatctcttttcacggttatatttctaattttctattatgttctttgttatgttgattagtgacccaaatctgttgatttgagataagtaggacatagtgtattagctaaattctgtaataatacaacatttcccacctcctcctcccctcttccttgactactgcatggtaaaccaacatataatgatattcagctgataatattatttagctgtttattgtttatgaagtactgtcatatatattatttctgttaattctcataacagccagaaagaatggaaaaataaggattcattgttgctgttgccattatccacattttatagataaggtgggaaacacctggagagattaagtgaccacccaagattgcccaagaagttaaatgcagaggcctgctacatgatgctgtcaggacttgactgaaaggcgcaagttcagtgtctcaggtcaagttgccaggaaacagaccctgagactctgagatttccatacaggaggtttttattgggaagtgctctgggcacaatacacagtaggagagagggaaacgggattgcacagggggagagactgaactgtggggcatgcacaacagcggcctcaacagggaggagcttggaagctgggattgttgttcagaattgttctgcctcctgaggcaagaggctcagcatttgtacctacatcaactaatcattggatgcaggcagcagctcccttcagtccagggcaatttctggaactgggagccttcagcagccaaccttcctagtacctgggggactgaggatcttggtccagaaggggatctggataccacatcatttactacatttgtagccaagagagcattctcctctgcaacagccttgtttgtgtctgatggcccagaccatcaccttgcagagtggagcccagaaagttgtcatttttttccaaggcccttaaggattttagaatagttgaccagagagcaagaagacaaagtagtcttaatcctaagaagattaggagcagaagagccagggagagtaggccgtggtgagggcagtagtggtgtttaacaaagaaggctaaactctggcacccagagtggctaaactcagccacccaaacagctgtggctatccagacccagaacaaaagcataacacacaccagtccttgctgtaatgctaggctttaacattgttaaatgttgaacaattttgtgatattagggttccccccgctctctctctcgctctctctttcaagcccttgaaagtcctcaaaccagtccagtgtgtagtctgtagattataaccttcagaattaccaaagatatttcagtacaaaaaaaaaacaggggaaaaacaaaaaaaaaagaaaagagaaataaaagtccagggccccattctagatccactggaatagaatccaggggtggaacccatgaattgacattttcaacacattttccccagaagattttgatacatgctatagtttgagaaccttcaccctaaactcttatgcctttcgtggtgaccaactctattgagattttttcagattatccagaagtcatgggaaccgtgggacagcagaggagcaccggagccttagtcccagcaggcctggtatagtgagagtcatcccttgcttttcatttaaattcttgatgtggccaacagacagcacagcccaaattcctttgctggcttctgaccaagattgcaagagggagagtggtgtccctggcttggccttatactatcttagatagcagagtgagagatgccaaattttttgaatagttgcagatgggggatgggaatcagtgaacttagaggaatcagtaaactttctaggagaataagaaggtttcaggatatcttatgccagaggaagctttgaggtgcttttttttaaactttaataattgtctaataagatcagagataacttacaggataatgttaagcattcataaatgtaggatggatttctaggagaataagaaggttttaggatatcttatgccagaggaagctttgaggtgctttcttaaaactttaataattgtctaatgagatcagagataacttacaggagaatgttaagcattcataaatgtaggatggtatattatctgattcactgacattggcaatgattttttcttcaaagggaaaagcacttttaagcctaccaatttttactcctgaaacaccaaattgctgtgtttcttacactttccaggcttcatgcctttgctgaagttgtctgtgcctgggtccctttcccttctccctaccaagctaactccttttaaaccttttaggatcagctcagacaccaccttccctgccctgtggccagactgacttctcaaagtattcccatagatccctctattatggcatttattatcattattctctctaacagcctgtaagagcaagaacagtctttttcatttttgtgtatgagagacctagcctcatcaaaaatgagtgaaaaaaataacgattctggtgagcgtatttattcaacaactatttatcgaggctttcctatatgccgggtgctctggagtaaatggtgcagacacaacaggtacagctcctgaccctatgaagcttatgggcaagcagagaagataagtaacaattgaatatgttatcaaacaactaccaataaaatatggtgagtaccagaaaaagcgaagtgaaattatagagctggaaacccagcctagtctaaggtcagaggaagtgtctcattttcctgaaatataagttatatcaaaatagaagttacggatttggctttggttacaagagactactttttaacaaaggaagatcttttggttgagctagttcaaaattgactctgtgtgtgtgtgtgtgtgtgtccgtccagtatgtggaaaaagacagtacaggaaaatgacgccttcatttaatgaggtaaaataggtaacaaggaacggagagggaagtttctgtgtgtctcattcaatgcaccattactagaagttactttgttaatattttaatatgtaatatacagtggaagaaaataaatgtaaagctctgaaaatcatgaacttacatcacagccttttaaaaattaatctcaaggatctgattactacggcctaggagggtgcttgacagatttgcttttgggtcttgttggagacagtgggtgaagtgcattgccccagaagtccatgcccactgaggtttctcatctttccaggtcacttttgatgccctgggtgaagaggccacaaccccagtgttgcaatttgcaacctccacccagcttggtggctcatgctgggtcctttttctccttttctggccagttcttgttttttaaaaaaatattatgatttttgagagactctgtcgcccaggctggaatgaaatggcacaatctctgctcacagtaacctccgcctcccgggttcaagtgattctcctgcctcagcttcctaagtagctaggactacaggtgtgcaccaccacacccagctaatttttgtatttttttagtagagacggggtttcactatatttggccaggctggtctcgaactcctgacctcaggtgaaccgcctgcctcagcctaccaaagtgctgggattacaggagtgagccactgtgcctggcctttttaaaaattatttttgtacctccttatttctccccataaattgtaagcttagggtaaggtttgagacttcctgatttttaacttttgaagctttgcagctcttctgctgcaatttatttacatttattatattcaatagataaaggaccttaagtttaatatataagttaacaggcaaatcttgggttgaaaaagtaccagattcgttctctagtaagaacctatttcttgtttaacctgacatcacaaagcaaataggccaagtgctaacatgtgcatatttaacctatgaacctctacattaagtactaagaataccaaacatttggctgattgcagggagggagggattaattcaccataaagcagcacttactagatgtaggtggagttatgtaatcctctgctgtgtcccattcaagtggataaacatatccacaccattcagcatcttgaccacaaagacaccaaaaaaactggaactataaattatagtgcaagtgaacatttaactcaggcttgaagtatgacttcaagtgaatggatgtgtgaggtcctgtgatgacgaccatttgccatgtattttcatatctttcctcaccccctttggcatattccttggtttatctcaagtataacttgattcatgttctcattttttgtcttgcttttaccataaatattatataaaaggagcatatgaatggtaaagaaataattctagacatctgttcttgcacttttcattttgtataggttgaacttggttcattgctgaagtgtaggtaatgattttagccacggtaaatccagttgaatacttaattaactgtaaatgagctccatttattatattttcatgaagaatttgaatttttaaataagaagcaatgatggcagaatggagtattttctctttttgaaagtaaactcgttagaggatgaaacgtattccttaaggaatcaaaattataatagtgtcacttcatctgaaaacattaacagttagtggaggaaaatcctgtttagtcagcatatttttggattctttaattggaaattttctttttttctcctttgagacaaagtctcactgtcgcccacgctggagtgcagtggcatgatctcagctcactgcaacccccgcctcccaggttcaagcaattctcatgcctcagcctccctagtagctaggattacaggcgcccgccaccacgtccagctaatttttgtatttttagtagagacgagctttcaccatgttgatcaggctggtctcaaactcctgacctcaggtgatccacccacctcagcctcccgaagtgctgggattataggcatgagccaccgcacccggccggaaaatttcttaagttattaactgccttttgctggaacttcaagtgctatggatagtttgtatttctgttgacatctagatacgtgcacccaccactgttaacagcagcacaaacacaatacatattttcattcgtaggatgttttctctctgaaattcctattatttggaatttgaatgtaaggggctggacctctaagctccttatctttactctgttattttttcaactcttttttctttctttctctttatagaaaaagatcttctatttttctgcctgtaagatatagctcagtgtgctggtaagtaggtgaaggaggagggtttgaaggtgcaacattccatgtaaaaatattcactgaatcctcctcttttcagttggctacctctaccgcactctagattctcttttaccctgttcagagtctaatctgtcatctgtctactcttctgccagggtggaacagaggatggagggccctcccacttctttaaaaagcttctgaccaaacccaacttgttattaccccaccatcacgccctttcccgtagatactcggccttttattatgagttctgagtctttagaaatttatttgatggtgtaacttcggttgcttcttggacttctccattgttcactgaggatttaactttcttaaatctactagaccaattatcatttatccatttgcttcataatttccaacattgtgttgctgttttcttctctcttattctttatcctagttggcttatgcctttagaaagttcctttagtggagttttggaagggagcaaaagtaatgttcaatttgctattttatccagaatgtggaaggcgtcttcaaaaatgcaaatatgctttcttgatggagcagtatattaagctattagcacttacaagcagatacattcatcagaacagttgtttactgccctaaaacatagaggatggatcataggcatgggatgttttgatggacaaatttgaatttggataggggatgggaaaggttgagggacatctctggttggagggcatctccagaagaaaggcaggataaggtggtttgccatggtggagtttgtgtaggccaagacaggctaagagcagtaagtaaaaaattactcaactatcatttataaatcttcttgttgatattcatagaaagtgtgtatgtttaccaacatgagtgacaacataagtattatctaagaaaatacctgcatttgttgggaattcattcactgtgtgtaaataccttttgaggttcattgtcttattctagtttgctcagtgctaggagtcccatacaggcttattcgattctgcatccttatttaaacactaagctattctttgtgtcgtagttgaaaccagtgattgaaattaataaattcattgtaaatacatagaaaactgaagatgaatttctcccacgatcttcatagttccgtctttaaatgtgttgtgaacctctgtcagatagtcgataatggggaagttgcgtaagtcagttttggtttcaactgtgtctacatttaaaatatctcatcagtcttaccttctgtcaaatttataacattttaatttatttttttaaaaatgctttatgggctaggcgtcatggcttatgcctgtaattccagcactttgggaggccaaggcaggaggattgcttgagcccatgagtttgagactatcttaggcagcatagcgagaccccatctctacaaaaattttaaaacttagcccatggtgagacaccatctctacaaaattttttatttttaaaattttttttttaatttttgttttttgagacagagtcttactctgtcatccaggctggagtgcagtggcgcaatctcagctcactgcaacctctgcttcctgggctcaagtgattctccctgcctctgcctcccaagtagctgagataacaggcacctgccaccacacctggctaatttttgtattttttttcttagtagagacagggtttctccatgttggccaggctggtcttgaactcctgacctcaggtgatgcaccctcctcagcctcccaaagtgctggtattacaggtgtgagccactgtgcctggccccaaaatttaaaaattagctgggtggtggcacatggcttgtagtcccagtacccaggaggctgaggtgggaggattgcttgagcccagtggatggaggctgcagaaagctatgattgtgccactgcactcaagcctgggtaacagagcaagaccttgtctctctctctctcataaaaaggtttatgttaagtttttttgttagttttgttttttgcttatctagaaaatatactttaaaaggactgggaccacctatgttttgctcaccaagctgacctcatcatatcatgcctggcacataaatactcaataaatacttgttgaataaacacatgaaagtccctgtcagagtagcctgtgcaaacatgtgtcctgaaagatgtggataagaatatcaatcacatagtctgccttgtgaatattacttaaaatctcgttaaaagccttcccaacttggtttataaaaataaaataaagctaatggatgccattatttctatgctgttgtgtatattttagctaatagaattgaggtattttaatattatgttaaaatcaaatgataaagaatactcaacataagtaaaagtgaaagttaacggtacttaaaattgtatgcatttcatgatttctgggaatgattctgcatggatactgatagtctattcacaagagaacaaattacattattctttagctacagaattttctgcagttttggacatataaaaagatatctactgattcccatgataaacattaccagtatcactgcaaacatgcagcatctcttttatccaaattagaagctcacatatgagggaaaattaaaattctgttggtattaaaagatgtttaagatttttttcaatacctgtagatgttgattctatatagctttattttattttatttttcattttttgagacagagttttgctcttattgcctaggctggagtgcagtggcacaatctcggctcactgcaacctccatctcatgggtacaagtgattctcctgcttcagcatcccaagtagctgggattacaggcacctgccactatgcctgggtaattttttttttatttttagtagagttgcggtttcaccatgttggccaggctagtctcaaactcctgacctcaggtgatccgcctgcctcggcctcccaaagtgctgggattacaggtgtgaaccaccatgcccagcctatatagcttaaaaagagcacagttgctacatggaacagtttcaattggggtaaatgtgtaagaaatttgatctacgactactttttagttggttttgttttgcagggagatattggttatttgtcttctttgacaggtgtaatgcaatatattcactttgaagaaaaattttcttggccgggcgcggtggctcacgcctgtaatcccagcactttgggaggctgaggcgggcagatcacctgaggttgggagtttgagaccaacctgaccaacatggagaaaccccgtctctactaaaaaatacaaaattagcggggcgtggtggtgcatgtctgtaatcccagctactcgggagactgaggcaggagaattgcttgaacccgggaggcggaggttgcggtgagcagagatcgcgccattgcactccagcctgggcaacaagaacgaaactctgtctcaaaaaaaaaaagaaaaacaaaaaagaaaaattttctttacaataagtgagtttgttttcttagctccttttatatagtgagtacaaagcacctaactcttgtcttcctgaagtttgagctgaatagagcattaatatgctgtaacttgagttataggagtaatataaaaactaataatagaatcattctttggttttatagaatcattttagatcgtatcatctgcacatgcttccaaaggagtggtacttatagtatcttcaataagctacctgataaattaactgattatggatggtagtagttcaaaatactaactcctaagactgtgtttgtaaaatactttaaagttaacaaagtgctctcatgtacataacttacgtaacttaacaatcaaaaagtaacctttgtgaggtaagtagagttattaccattttacagatgaggaaatgacagatgttaattgtcttgctcaacttctcgcagctagagatggaaatgggaataagccctcgcttaccaggccaagtaccctttctcctacatggcatttgcttttcaaatgatattagcagccgtaggagtatctaccctttgcttcttgtttggaaatagtacttttaaggcttctgtctgttagatgaagaacaagatcttttcactgcgtgttcttgaatctaactgaaaaacctaacacaatctaccaccactaacaatgaaaccttattaattggtggtgggggtgaggggaatacagcttacctttctgagacacttatgaagaagagatgttcaacgtatatgtaatgcattaaaattgttaatttgttcccaaaagaaaacctagccactaattttataaacattaagtcttaaagacatcagtcctcagattggcttagatgcttcaagattttcacaatctctgggacgtgtggaattggggtaaccaccttgaggttcttaaacatgaaagcacacatgaggattttcttgcattctaaaatttccttttcttttgcaagtttccctcagtcttcctttctttctgtttcttttcttttctttcctttttttttttttttttttgagaaagagtctcactctgcggcccagctggagtgcagtggtgtgatctcagcccactgcaacctctgcctcccaggttcaagcaattcttctgcctcagcctcccaagtagctgggactacaggcatgtgccaccacaccctgctaatttttgtatttttagtagacccgggatttcaccacgttggccaggctggtctcaaactcctgacctgatgtgatccgcccgccttggcctcccaaagtgctgggattacagccatgagccacagtgcctggccccaccttccccctttcccccttcccttccctcccctcccctcccctctccttcccttcccttccttttgtctacctctctctttctttctttttacctgacttcacctgcacaaaaattttgttgatggaaagtacagtgtgacttgccctgtggccctgcatctctgagggatgcccctgggaagaagaaaccccagagagctcctgtagttttccagggaaacaaactaaatttcacagtaacaggattggttcttctgaacactgtctcttaagtgttggcaaccttctggtatagaaaagaatctggaagaatatgtattatattttatcattggttattttatagaattagtatatatagttgtattagatgatggaaaattgttacttttcatgttaaacaattctgtcttatttgatttattattacaagttgagtatttcttatctgaaatgcttggtactagaagtgttttggatttcagatttttttggattttggaatatttgcatatacatcatgagatatcttggggataagacccaaatctaaacacgaaatttatgtttcatatatacctatacacatagcctgaagataattgtatacaatgtttttaataatattgtgcatgacaaagtttatgtacattgaaccatcagaaaacaaaggtgtcactatctcaggcacccacgtggacaatctgtgcttgcttggtatcaccatcattcctgactctgaatttacatgctgctgataagcaatcacttctcctttttttcatttcttttttattttctttttttgagacaagatcttgctctgttgctcaggttaaagtgcagtggcacgatcacagctcactgaagccttaacctcctgggctcaggtgatcatcccatctcagcctcccaagcagctgggaatacaggtgtacaccactgctctcggctaattattgtagtttgttgtagaggtggggtttcaccatgttatccatggctggtcttgaactccttgactcaaacagcctgcctgcctaagcctcccaaagtgctaggattacaggtgtgaaccaccatgcctcactacagtcatgttcttagacttattcacacataagtacttatggtaaaaaaaataacataccattaatacagtgaaaaaaataatgtgttcagggcaactaagcccagtagcatcaccaaatacctatacccactgttaacagcaacaacaatggcaggctttcagtctgtatgtgcaaattatgtattctgattaaaaagttactgtacactgtattttttgtaggtgagaagaaacatcagtaatagttgagggaccagaaagtgggtcctctgaggatgaggaggcattctgctggatggccttttcaaatatttcctccagagtcatctgcctcattaacaatggtgtttgtcttagaagtctctttgattttataaactgacatcatttcttattctgttatacatgcacgctgctctagtccttcaataagctcatcacacatccactatgtcatctataggcactttttctgcagtgttaatggtatcttccttgtcactattatcacaatcattttcattgacaaccatttcagctttttcatcagcagtcaatgaatgaagaactgtagcctctttgttgatgttaaaaaaaacttcattgatgtcttccagcttactgactctgaaggtatattttttgcatatgtaaggaggtcatacatcattttttctctcatctgatatacggaatccttcaaagtcaccacgttgttcatcatcatcactgaacccaccagagcttgtgccaggtatgcacaactgtatctttagtcatgtgttctaaacattggcaacagcatatatggcatccctcatgctaaactccttttgaaaatcttctacacttatgcctctcttcactgctgctagcatgctgtttaagaaagcattatttaatcctcattgatctaaggataccttgtcacatgggtgaagtagagtagtcacattttagggaaagtacgtggcataaacattatttttgatgagaatttccactggaggatgagcaggacagatgtgaaggaataacaaattcttgcaactgtcatccagtgcaacttccctgcagtgaacacaagctcctggtaccaagtgcttatgaaactaatcagaaaagacacccctggtgatctaagcctttttattagcataatggattggtaagaaattcactccttggaaacagcaaagacacaagcttttgcctgtcatagccagattacacttatgcatgcctgctgcatcagcacatccctgcacagttgttctgtccttggcatccttaattcctgtagaggctgtctcagctctagtcagtgtctttccggggcaataacaccaaaacggtgatgttttatcagcattgcaaacttgttgtggagtcaaattttcatcagcaatgaccttggcaaattcatcaattaatttctctgctgctttgtgatcagcagatgcttcatcaccacacatctttgaaaatttgatgctgtgtcttttctaaaatttccgtaaccagccttttgattatttacagtttccttcaattttcagttcactgtgatagatctagcatgtttatggccagcataccattaaatggcatgtgttcagtgtaaggctgatggatccaccctttcaatacatgatcaagatcttcatttctagctttatacagtgttttcctccctcctccccttccttttttctctccttttcttttccctccctccctcccttccttccttccttccttccttctttctttccttcctacctatgaggtcttgctctgtcacccaggctggagtgcagtggcacaatcatagctcactgcagcctcaaactcctgggctcaagtgatactctgacctcatcctcttgagtagctaggactacaggcacacaccaccacacctggcttttgtttgttttttgtagagccatagtctcactatgttgctagtattgaactcctgggctcaagtgatcctcctgccttggcctcccaacacactgagattacaggtgtgagccaccatgcatggagtgtttactattttttaacttaacttctgttcatcattttcaggatggaacttcaacaatttatctttttgtttcttcaggtcatataaggtggtcattccaacaccatatttttctgtctggtttctccaatagcttgattttctttgctacagataaacataaacgcttcccctttttcttgtcactgttactcatagaagtatctgcaggcctttttgaaattttcaaaaatgtcagagcagagtataagcaaagagtcatagtgattaatacctgaagttcttggtgctatgtggagcatggtggagaatctgctattggtgcatccagcctgctgcacacatgccattttattaccttttgtctgtgtgtgtgcgtgggaaggggaatctggacatgtgcagaaaagatgtattgcagctgaagggggatgggagggtcttttttgccttggggacactgagtaaattgtgtgttatgtacttgtgttttgactgcgacttgtcacaggaggtcaagtgtggaatagtccccttgtggccaatgctcaaaaagttttagattttggagcatttcagatttcagattttcagattaggaatgctcaatctgtattattattattatattttacaaagagcatgggttgctttcataatcagaaggagatattttacaataaaatagttggaagaaagatatttaaaacctcaagtaattgagtaatgcacaggtattagtgttcacttatgatcatagatgagacagaaaataaactgttagtagtgtaattaacaaatggcatcatttatacaaatagttactgaatctacattagttatttgagggaatttaaatcacaggaatacatgaccataggtaacatatacaaagtgctcactctctgccaggtgctagtcttaagagctttacatggcttacctcatttaatcccctctactatcctatgaggtaattatttatacatggagaagaccaggtatagagaagatggcctacaacaatacagaacatagcagaggcttgaaaagcactcttcgattaagaattgcactcatctgttcagaattgccctaactgctgagaaccctgaaaccagtgaggaaacccaggcaagacccagtagcgggagagctgagatctggatatgtctccacataattccccaggcttgaacacttagcccccctcctatacgtccctgagtagatgtggagttctaaactgattctacagctctgaaaagaagtgtcctgattgccattaacattttgaagggggtcagtaaggccataataagcttctgaaattccttagaaacctagttcacatcccactaatttttgctctttttagcatggcatcaggaaacttctctggtccagtctttgatgatgaaggaaactttgggatgtggcagtggagttgtgttttttgggaagttgcactgtgcctacatactgtttattttggtgagctgaatgatagacttgtgatacacttcaaactatccacttccatttaaaaactggctcttcaagttctcaaaacctcttatcagactgaaactcagccaaggttaaaactgccaagtatctctctactttcctgaccccactgctcaaggactcctatttagcacactgtattatcgaacagcttttgcagagtctttgtgtggaagctgtgtgtgtgtgagataatcttttttttagcatcttttttttttctcctcaccgtaagtatgaccacagtcttcaaaaaacaaacaaacaaaaaagaagcgctgtcttcagacatgttaagaaacatgtgcttttaaaaaatgtgtacgctttatattaacttttacatacaatatgagtagaatatcacaaaggtctactgaattaaaatcaagatattaatatataccttaagtcacaattattggataggtgacatacttcataaggacaactgtttggttcacgttgcttatgtttgtgttttaaaatcataacaataaacttttgttttaaatgcacgagaatttactttccagaaattataatttatccatgattcacagcagcctccatgtcttctttaaagaagaatacaccttaaggagcatggagaaacccaaggagaggtgtatcaggtagctttgtcagtataacaagccacccccaaataacaattttctatttctcatgggtgcaaggattaaatgagataatccatgtaaaccttccacaacagtctctggcagatagtaagcacctgtgattcttctacggatctcacctggactcagtcatgcagctgtagaggtgggtcagctgggggctggcctagctctccgtgcggtcttcaccctccaggaggctagtctgagctttctcacataatggtttcagtgttcccagagcagataagccccaaggtgctagtgctgttgaagcctctgcttgctccatgtttcctcccatcctcttggtcaaagcaagtctcatggccaagggtagagaaactgattcaaagggtagagagaccgacaccacttcttgatgggacgtgctgctaagaatttgttgccatttgttgtaatcaagtatagtctgtctctgacaaaaattattcacatttcttttgcaagaaaaatatgctccctcccatcccaggattccccgaagtctcatcagattatagtattagcctcgaagtctagagacttatgcctgatctgcatgagatctagatacagttcagactcctcagagatagctcttcttatgctgatcctcttgatcccaagacaatgaacaggctgtctttcccatacacatccaacatataatgatgagataggaaaaggataacaaaagtagacaccccatttaaaaaaaaaaaagagccattaacaggatacatatgacaaccactggtccatagcagttctgtccaagcacatgttaccaggtgcccctgatcctgggctaggccatgttccttgattaggacccagctctgcttttcagaagtggtttcttggtttatattcctccactgctcttggctctaccctctgaaactcttcttttcccacaacaaatggcttatttttgctcctaaatagcttcattggcctagatcctgatcataaaaagttggggacccagaggcctcttttcctttgaaaagtctttgtatttttaggccaaggttgtgtgtgtgctttttagtaaaattctcttaaaaactttgtggatttccaaatactctaattaggctccatgcccctaaaacctatgttcataattgttttcatgttagacctctgtctacttcaggctgaggatcaggttgtttgagacaacacacttagagtcttagagctcactttgtctagctgagaaggtctgcgaggcagcttattcaattttaccgaggtctaaggccatttcttacttagaattgtttcttccagttgaagagactggagagataaaaagtttttattttcctatcttgtgagttctggtttctctctattttctctaaataatgcttgcaaactagatgattcaatttttagtttgtctctatcgtgcagaacttctatgtagttatagacacactcaaaacactttcaacattgtctggagatctttgcagcgagatgcaaaattcataccaacattttcagcctttggagctgccataggcaacagtgttgccaagtgtttggctgcctatgatatgggctgccttttcccctgactgctctcgcagtttcctcaccacttccaccctcctctgacagtctgcatgccatctttccagttttacttaacagttacatcactgcttttcacctgctatctggtgccaaagccaaggtggaatgttttaggtttctgttctggcagcatgccacttctaggtaccaatttttctgtcatttagcttatgctatgtaagaagctgctacccgttttggtggtttcaaacacaacgatttattatttctcactatcctgttgattggctgagcagtcttctgttgggctctccgcggctccttcattttcagtcttttgttaggttagctggtggttgtgctcagcctcgagtactgctcagctgggcatcatcttcctgcaggctagcccaggcttcgtcatatagtggaattaagctacccaatagcaagcccttttgcacaaatgcttttcaaacctctgcttgcatcatatttgctaatgtctcaatggtcaaagcaaatctcagtctcatagccaccctcagactcaaggagttgagaaatagtctgtacctcttgatcagagaagctgcaaagaatttgtagtaagaagatttttatttttattttatttttattttgagacagggtcacgctgtcatccaggctggagtgcagtggtgtgatcttagcttactgcaacctctgcatcccaggttcaagcgatcttccagccttagcctcccgagtagctgggactgcaggtgtgcaccaccacacccggctaatttttgtgtttttgtagagctggattttgccctgttacccaggctggtcttgaactcctgggcacaagcgatccacccgccttggcctcccaagccaggattacagatatgagtccctgtgcctggccagaaaagttttttttgcaccctttcacaaagagtatgtacaaattcaaggggaaagaatggggccacctaggaggtcagatcaagaatgtgggatgagaacagatgctcaccacgtcatggaaataatctaattggttgatgtattcatggttctgatactatctggtactacaatactaacattaggccaggcacagtggcacacatctgtaattacagcactttgggaggttgaggcagaggggatcacttgtgctccagagtttgagaccagcctgggcaacaggcaaaaccccatctctacaaaagatataaaaattagcccgcagtcccagctactcgggaggctgaggcgggtggatcacttgaggccaagagttcgagaccaacctggccaatgtaatgaaaccctgtctctactaacaatgccagacattagctgagcatggtgacacatgcctgtagtttcagctactcaggaggcttaggcattgctaaacataggaggcagaggctgcagtgagccatgattgtgccactgtactccagcctgggcaacagagcgagaccctgtgtcaaacaataataataatgataatatagtaaaattagtagttatcatttgttgaagtctcaatatatgctactctcatgaaaatgctttatacatgttagaattttattgctgtaaatggaaatggcaattacataagagtttttttccactttgctaataacattgttttttcttctgcctcatcctcccgagtagctgggactacaggtatatgccaccacgcccagctgatttttgtattttcagtagagatggggtttcaccatgttgaccaggctggtcttgaactcctgaacttaggtgatccacacacttcggcctctcaaagtgctgggattacaggcatgagccaccgcgcccagccttaataacactcttttaatcattatttgtatgtgaatacaatgagcctctctttcctcatctttacagtgaaggcactgtgcaagctagtcattacaggctttttctgctctcaccttctttgattttacttaacatggtggttgggttgattaaggaaggaacacagtaagtagctgctccttacccacctgacttccacacccgtggagaaataagaaaggaaaagcagtcagaggccaaagggtctcgttagtgaccgataaagacaaggttggaagatgtggcttacatctgtgggactgtgcattctgatcttgaagccagcattagctggatttaccctccctggccacagctgatttcacccaccccacccaggggtagtgcagagacaacacaggttctctgctaaacccacttttaggaaaaagaaagaagtggctgggctactgcagacaggttcttcttttagattcactaattagataagcaactccatgcccctttgcaggaggaggtggagagggatgccagagaagggaagaaacagagcagagaatattgctccttaacaacactagcgcctcccgacctagtacctccccacactagcgcctcccaccctaactcccccaacagcttcagtgcatgattaagtggaaagggcatgaactcaggacctggacagatgtgagtttaaatcccagacttctctcttactcactgggtgaacttaacttctccgagacccagttattagtaaatcgaaaatgatgttaccctcctcccaaggttattgtgaggattgtggtggattttatatcagttctcaagcacaatgactggtttggggtgcacacagtctgtcactgagattcgtttttccttccttgctttacggagtgggcttgattctagagggctgcagacacacgcagaaagttactattatagaatgtttgcttctcgaatgtctttgcttgccacagtctctaaagggagtgagaagactgtcagtggtgagtggagataactgaggaagggtttgctattttaactcccaggaaagagaaacattttaaatcaaatcaagctgatctttgaacacatggttgaaagatgttaataatggccatttgagtcatcaataaattgtgtctaatgccctgttttttaaaaagcaaggaagtgtgtccaggcattttagaagaggatttccaacaaagataagtagatgcctttgacatttgaagggagaaacttcagttactgtaaaggttacttacatggaaaaccctcatgcattgatgatgttggataactcagatatttccgtaccttgtgtaaaagatatcagccatatataagaatattttttctgggagaatttaacaggagtaaccaggcaatgagactagaataagtggcccaaaggacactgtttacaagaaagaggaacagataaaggaatgtaaaaattcttaactggtgttacgagttggaaaagaaaaggtcattgatgattctggaaactccatggatttctccctttcaaagatacttcatggaatagttacaaaatataaaggaattacttaaaggcatatatgttttccaactggactcaaaatctattccccatcattttttaaacatagatctttgctgtattttccaggcaaagttttgcttcacattctagggccaaagggaaatcagatgtaagagttacaacaactgttttagtttgtaaatactaatagagatacaagtggaaaaatttgcacagatgacttgagccttgaggccttgacccttgagtgctcctgtctttactttctcccttagctcatctactggctgggagcggtggctcacgcctgtaatcccagcactttgggaggctgaggcaggcggatcacaaggtcaggagtttgagaccaacctggccaatatagtgaaaccccatctctactaaaaacacacaaaaaattagccgggtgtggtggtgcacacctgtaatcccagctactcaggaggctgaggcaggagaattgcttgaacccgggaggcaaaggttgcggtgagccaagattgcaccactgcactccagcctgggtgacagagggagactccgtctcaaaaaaaagaagaaagaaagctcatctactgtcctttcctgctgtggcttctatgcacctgactgtaaaatttacatctccaagtgtctgtattctgttatttcagagagttaataattttatggattttttttaaagttgtggtgacttactccctgtttttaggactgtaacaactgaagtgttgcaatgttggggaaactctgatatgaagaaatttgtgtgggaaagaaagtagtgattctaatggtgacagtatttccatgtgttaatccagttctaagaattagatgctaataattgttcctaatagaaaagctcaattagggaatacgtttcctattagactaacgattttaaaagaagccttcttgtggggagtttaggaaaaagaagctagtgtagctttgtggattacggatggattctcaagtagtcacacttttgggatttatatctcaactccataactgtatgactttaggcaaactgcttaaactcattaggcctcaaacctgtagactggggatgatgataatacctcataaggaataaatgggttaatacctgcccattgctgagtaccgcatttggcattttacaaatgcttaataaatgttcactgtagagcagaatgtatgaaacctacacaggagtagctgctttgatttcccgtgcatttctacagaaagcatctgaaagcatattgctaaaagtgaaatcccagctacccactggctgtttatcaactgtgcatatcaaactgcctttttctcttcacacactggcagaaaattctgattgaggaaactgaaaagcgaattatgtcagagggcatcaaatgagtaaagtgattgaaaagtagaggctgtctcctccagcagtggtttgaataactcctacctgctttctgctttagagcaaagagaaaacaagagacatttaaaaattatttcttctagcctcagacttttatcgttataaaccatttcaattaatactcttcagcctttcaaattttgctttgaatgagccctaagacaatattaaatgcgttcttgcccaatgcactttaagatacgatacaagcttttttttttttaaattaacttcggagcagcaagaaaattagagctattcattaggaactttttagttttaacctgtaatgttttgatgttcaaagaatagtgtttccctctgtattagtctgttttcatgctgctgataaagacatatctgagactgggcaatttacaaaagaaagaggtttaatggacttacagttccacgtggctggggagaacttacaatcatggtgaggcaatggtgaggcatggtgaatgcaaggaggggcaagtcacatcttatgtggatggtggcagacaaaaagagaatgaagaggatgcaaaagcagaaacctctaataaaaccatcagatctcatgacacttattcactaccaccagaacagcatgggggaaaccgcccccatgattcagttatctcccaccggatccctcgcacaacgtgtgggaattatgggagtaccattcaagatgagatttgggtggggacatagagccaaaccatatcaccctcttagatgtgtcattttaaaaatcaagaaacagaacactggttttactcagttgagtgaaattattgtttatgaacctgttggggaaagtccatttgttgttctttaagggctgtgttactatggggtatgctagaaaggaactgctaaattacagtgacactctacctgtggaatttctaggtgcctctggtagcggggatgtgtgggcaggagggactggatgaggtggttgagaaaggggtacacagggtgaccccatggggctgtgcaggttgtgatctcaccacagatgagagagactggcaatccaaccatgctcagctcaccaggatgcatgcccttgggcagggctttatccacccagagaaagggccctttcctagctttcacaaagatactatataagcccaacacaaaacctcattaaggcaccctatagaccaatagtggaccttctgatttgtaataatcactttaatcatatgtttacaattggtataaaattaggacataggaggtatgtcatagaatctgaaaatcagaacttgggtactgtgcgtaagtcctgtatggagtgtatatcttggggacagggtctgttttgcttctgaaatagccgaattccatttgcaaagactctctttttctttctctttctctttctgtgtgtgtgtgtatctacaagctgatctccataataagcttcacaaggtttgctgtgtgccttgagctgctctgtattgcatattcccatgtctgaaaatttctcactacttgtaaaaatactttaacatcttgctgtgaaacaggaaaaggttttgtttcctggttttggcaaaatttgcttaatgcatatattagtcttttggggctgcctaataaagcttctcctttattatcagagagatactatgtatgtcactttaaataattcccttagaggcatgttgggaacaatgactttcacaattgttctttgtagcatccagtgtcttggttatttatgtgtgatatggtttggctgtgtccccaccaaatctcaacttgaattgtatctcccagaattcccatgtgttgtgggagggacccaggggaaggtaattgaatcctggggattggtcttccctgtgctattctcgtgatagtgaataagtctcatgagatctgatgggtttatcaggggtttctgcttttgctccttcctcattttctcttgccaccacaatgtaagaagtgcctttcacctcccactatgactctggggcctccccagccatgtggtactataagtccaattaaacctcttttcttcccagtcttgggtatgtctttatcagcagtgtgaaaatggactaatacaatgtgattgtcacctccactctttggtctgctgaggtaggtggaaacctgctttctgaattgttccttcctgatatgacagaaaattttaagattctatgtgccaaatatagtaggctattcaaagcaggatctaggtctcaatggctagaatatttaactaatagaatatcaccatccttccttgttccctgtgaatgctatcagagtatttattcatgtacctgagggtgcctcatcatagtaagctcagtcttcaattttattcatactcccatgcctgcaacaattataattttccatcataaaatgaagggatcagaataaactatttcaaacattcttgattccttttccttttgagcttcagagattgtttttatgaaagtgagttttcagctgactttcttatttagcctccataccagggagccagaaggcagtgcttatgaaagccaccatctttccagtgggggagagaggccagtagctaccccttttccttctctatcaggtttttgctcatcgagattgcccccaagctaggaattattataagttctccagaattgcatgataattatgaataaaaagctgacatgggccaggtgcagtggctcatgcctgtaatcccagaactttgggaggctgaggcaggtggatcacctgagatcaagagtttgagaccagcttggccaacatggtgaaaccccatctctactaaaaatacaaaacttagctgggcgtggtggtgcatgcctgtaattcaagctacatgggaggctgaggcaggagaatcacttgaacccgggaggcagaggttacagtgagccgagatagtaccactgcactccagcctgggcaacagagcaagaccacctcaaaaaaaaaaaaaaaaaaaaaaaaagctgacatggtaggtatctatggaatgggtcacaaatttgagtatgcattataatcacctggagatcatcctaggcctaccgaatcagaaactctaggtgcccaggcatctgtaatctttgaagctctccagaagattctgtcacctcttgcagaccgaggaccactgagctaccatcatctctttgttcctttgttttctcttacacaaaactttattgctcaatgaaaaaaggcttaagcaatacccccttccttccttattggatctggttttcagtacagattatatgcatgcctgaaaagaaaattagaaagcagaagcagatttttggtagttggttgtcaattttcttttgaattcttcacctccatgcaaattgaagcaggacttatttttagcaacttgatgaatgcaatttaccaaagtttattacattatcttttattacaataagacaggaaggtcagtggaattgtctgatttttctttctcatttaccatagttctctttctaggaactcatagtacagaatcaagctatgggatatataggttattttgattctctatttgtgcccacttctatatttttgtataacttcagtagtgtatacacttttaacctttttggagacattcttaggaatagcagtctcttcgttgactttctgttgtagttttcctaatgtttgctccctggtgaccaggagaccttctatgtcagtggagacaactcatccaaggctggctgagccaagagaggtgggcaggaaggccaggtgaaggcccccttccctcctttaccacacctcaatagagaatctttatgtctcctgtaccctttctttttctcttattagcacattatggacttgcgccttcacatgagcttgggcccttacctgatttataatttgctatctatgactttatggttgttcaatcttgagaaggaatgactgtccctggacatcttccaaaaccattttctatatgattgaattgtacttgactcttcttattgtgatgagatgatttcccccaatagctttttaatggctgtaggagagcaatacagagcacaggacctgtctaggataagcaggatacatacaaatgatccctagtgtcccagggcgtggtacagtcccttatctacccatttccttccattgaagtgccttgtaaggcttggccaacatgtaaggaaggaaggcatctctcacctattcttgccttgttcatcaaaatgcatccattccatctcatccacttgttgcatggtagactatattgggtactaacttaagcagatgggtacagctcaactctacgcaaactagctaatgtgctttccccaggtagcataaaatgttaacttgattgccatgcatagacttttaaaagttgctaaggagttagtcctttaaacgaatagtatttattgttttatgggggtttttaaattatgaaatgtgtgtggacattataaaaattttggaaaatacagaaaagcaaaaggaagcaatttaaaccatgtataattccacaactcaaagaaaactataattaacactttgatgtgtattactcaagtttctgtttcagaatgctgcacattctctttctccataactactttttatgcctaacagagtatatatgcttttcatgccattagatagccttctaaactctgtgacttatgtagaagccaggacctcattattgtgcatttaacttatttctgaatttctgcaaaaacaaggtggtgatgaaaatattttgagcaatgagtttcatacacttttgcattatatctttagaataaatgcacatatgtcaaaacaaatgcacacttgaaaagcttttgatacatattactaaactgacttccagaaagattctatcaattaccaattttttaaaataatgaatagactttgtttgcaaaatcattaagttgcaaaaacaaagacaccacaggagttttaaattagacttttttttaatctagaaaaaaaatttaatgtacttgcttagttcagcagaagctgagagaggtctcaagaccctgaacaataatactgattttattattttatcttattttatgtttttaagttccggggtacacgtgcaagatgcgcaggtttgttacagaggtaaacatgtgccatggtggtttgctgcacagatcatcccatcacctaggttttaagctcagcatgcatcagctcttttccctaatgctctcccctcccccgcacttccccgacaggccccactgtgcattattcccctccctgtgtccaggtgttctcattgttcacctcccacttataagtgagaacatgcagtgtttggttttctgttcctgcattagtttgctgaggataatggcttccagcttcatccatgtccctgcaaagaacatgatctcattcctctttatggctgtatagtacagtctaacattgatgggcatttgggttggttccgtgtctttgctattgtgaatagggctgcagtgaacattgacatgcatgtgtctttataatagaatgatttatattcctttgggtatatacccagtaatgggatcgctggctcaaatggtgtttccagttctaaatctttgaggaattgccacactgtcttccacaatggttgaactaattcacattcccaccaacagtgtaaaagcattcctatttcttcacaaccaccatcagcatctgttgtttcttgacattttaatagtcaccattctgactggcatgagatggaattaccagtatgttttgagagttcccagaatccttacccatttgaaaaagtattgtttttaaaaaattcctgctaactttatgggcaagaaaattctcagcagtttaatttgcatttccttgtttaatacagaagtcttttgtgactatatttttatacttttgctaaagattatttagtgcattggttaagtggtgctattctaacgcctgagtgttcacttactgatgaccttgagtaaattccttgatctccctatgctcacaccaactctgataatggcagtacctactcatagaatctgtatgaagactaaagagggtatcacatgaaagatgcctagaaaatatcaggcatatataacatacgtttatgttctctgtcatttacatcttctctgaattgcttcactgtctttgggtaagtagattttttggtagcttagaaatatatatattaagtatcttaacctcttgtctgtcatatattataatttctccccagttggtggtttgtctttcaattttgttcaaagtgaggaaacagttgaatatcaagaaattcagaccaggtgaaggcatagttttggtccagggtggatcttttttctgcctgtcaaccatactgctaggagaatcaccttccccatccgtgagaaggtctggtattgattatagccaccagatatcagaaatggcactttaagcagcttacattgttacattaaaaatcaccatcatagaataaaacttctgcttaatttatgtaaataatgatcatggtagatgaaaggccgtggttaatatttcaccattttccatttaccaccaaatccaacttgtcagcattccattagtggtgatataaaattaattacttcaacttgaaagaagcttttaatttgagaccaagaaccctgatagattgcgtaaccattaagtgttactacttttcccctctttgctgcaaattgtgtagtagaaaaagaatctttctcatcatgaagtcttgtgtataaacacaagatattccctatattagcatatatacatgctactaaaaatgaaagtttttcacttcactgaaaagcaatatgaacatagagactattactttgccttactaagcagaggaattaccagaaccatccttgtaaaaacatgaacattctgcttgagctgccaacttgtttcaaaaagctattaaaagtgggcaaacattgctgctacatgatgaatgaatgggagtgtgttgtagtattgctactaggccacgtatgattggaattttccacataaaagcattttaaaaagcagtgttatttacgatgcttatcattagggaatgatattgagaagaggagtaaggaaacctcaacttctaaattttacacttagatttctgtattttgttgtcattttacttcaagcatgttttacttttacaacatcttcaagagaaaaaaatttaaatcatgatttgcatggtaactgttttaagagttgttagtgtgtacaggaggggatgcttcccagtgccgaaatagacacaaaataggcaacatttagatgttggccccaaagccttgtagattatcctcaattaaaaatacttaagtttgcaagtctttcttcttcttttttctttttttttttttctgtgtctgttttaatttgcaatgattggaaaacataaagcaatgaaaagagatggtttcccaatgcaatctaaaattttcacacaccagggcctgttgtggggtggggggaggggggagggatagcattaggagatatacctaatgtaaatgatgagttaatgggtgcagcacaccaacatggcacaggtatacatatgtaacaaacctgcacgttgtgcacatgtaccctagaacttaaagtataataaaatatatataaataaataaataaataaataaaattttaaattgctcattgagttctgcgcggctatgatattgaactgcaggtgcctataggccttaaaacacaactgtttcatgttgttcagtcatcttatttctttccttgtaagcaaaatgtcagaacatttagctcctttagtgcacttattgcccacaccgaggaatacaaaattgggactgctgagtaaaatgtttaagtttcaatcccttgaaggcaaatatttgactctcaatagagaaatttaacttcattatctctacttgcaggcaaaatgaaagaccggctagcagaacttctggacttgtccaagcaatatgaccagcagttcccagacggggacgatgagtttgactcgccccacgaggacatcgtgttcgagacggaccacatcctggagtccctgtaccgagacatccgggacattcaggatgaaaaccagctgctggtggccgacgtgaagcggctgggaaagcagaacgcccgcttcctcacgtccatgcggcgcctcagcagcatcaagcgcgacaccaactccatcgccaaggccatcaaggcccggggcgaggtcatccactgcaagctgcgcgccatgaaggagctgagcgaggcggctgaggcccagcacggcccgcactcggcagtggcgcgcatttcgcgggcgcagtacaacgcgctcaccctcaccttccagcgcgccatgcacgactacaaccaggccgagatgaagcagcgcgacaactgcaagatccgcatccagcgccagctggagatcatgggcaaggaagtctcgggcgaccagatcgaggacatgttcgagcagggtaagtgggacgtgttttccgagaacttgctggccgacgtgaagggcgcgcgggccgccctcaacgagatcgagagccgccaccgcgaactgctgcgcctggagagccgcatccgcgacgtacacgagctcttcttgcagatggcggtgctggtggagaagcaggccgacaccctgaacgtcatcgagctcaacgtacaaaagacggtcgactacaccggccaggccaaggcgcaggtgcggaaggccgtgcagtacgaggagaagaacccctgccggaccctctgctgcttctgctgtccctgcctcaagtagcaggccggcccgggccgccaccgcccatcccagaccatggagcgcgctgggaaggacgcaccaaagccgggagctctgccctgcagggagttgccccaaccctttccggaactcagtctttagaaaagaaacgccaggttcaagaattgcaaaccagcctgtgcttggaaagatggttagttgataccgtccgatgattcttcagtaaagatagattcccacaaagttgtgcaatgtcattatatgacaccttgcactcttaccgtcttgacagaagccaagtaaggaactgaagttgtatctgactgtagggtgaatgtctgaggcctgcctcctaataaagactcaaggaggaagtcaattgggcatctgctaatagaatgaactcatgatggaaacttcagttcatttactttgtcctgaaaattccctggttctgttccattttgagcgaaattggccttgggaaaaaccacgttcttcctttccgattcttcatccggtctacgctatgcaattcctccccaaatatagatcttatttctgctcatttcccctacttattaaaatcacaccaaacacttactattttcttatctctttcactttttaaatatctttcaccaggttatattttggtattatttttccaaacatttttaagcactgaatatcgaacaagcactcaaattgaagtatcagtcatgttttgtgtatttttcgctgataaaaattatttaacatttatatttttacttgattacatatgcacatgtatgtaaatgtaaaatactaatattcactaatatatgtacataatgatcaattggtttaacttcttttatgtaagtatggtatataaatttcaagacgaacacttttctggctcttggtattggtttgcttgttttgagtttgtttcactccagtttgccccttcctagtccagtttgggtcaaacttcatgttaaacaactctgcattggttatggcggtagacatatggcggtagaaaatgtatacggagctagagacaactaacattcttggaaatactgcttttgttttactgtggaccattccttccatgcattgaaatggagaaattcaaagtaaaagaattctgtttttcaagcaagcttaataaacattacattatacacatatttttatacatttctggcttgaccatttagtttactttctcaattattgttaaaatttttctttttcctttttttttttttttttttgagatggagtctcactgtgttgcccaggctggagtgcagtggcaggatcttggctcattgcaacctctgtctcccaggttcgagcgattctcctgactcagcctcctgagaagttgggactctgggcgcgtgccacaatgtctggctaattttttatgtttttagtaaagacggtgtttcaccgtgttagccaggatggtcttgatctcctgacctcgtgatccgcccgcctcagcctcccatagtgctgggattacaggtgtgagccaccatgcctggccttttttccccccttttgagacagggtctccctttgtcacccaggctgaagtgcagtggcataatcatggcttactgcagccttaaactcccaggctcaagtgatcctcccacctcagcctacaaatagctgagactacagatatgtgccaccatgcccggctaatttttgtattttctgtagagacagggtttgccatgtggcccaggctggtctcaaacttgtgagcttgagcaatccgcccaccttggcctcccaaagtgctgagattacaggcctgagccactgaccctggccaaattttttttctactagctactgaggctgccacatctggatggaactgagtggagggggaaaagaatgaaaaactcaaaagaattcccatgagggtgtcttgctttctctcctgagttacaatactttagcaaaatcatgaggctttagagatatggtgtagtctgcaaacttcttaatgcccttacccacatttaccatgtttcctggccttcctctgtgtcaactcttagctcttcctaatcattatttaatacatgagtgagtttagtagtgatcatatttctcaggtcctttagaagctggaattttaaaagaattagaaggaggagtatgtgaattctttggagctcactgcctgacttgcttatgaccaggaaaatctatcccctgtatctaattttaatttcatggttaaatttgagaattgtggaaaccaagttccacaaggctattctcatatttctcccaatttctttttcagccaactccaaggatatgtatcacctttgacttaatttgctttctctaagggaaaggggaaaaaatgttcacatagctccactgcaatgttttttataatagaggagagatattgtaaatagagactgccagccagtttccacaaaaaaacgaagagttcataaatttgacatgtttgaacccataaagcattttctttgcttggaaccattataaaagtaagtgagttttcaggctctatatacattttaattcctcacgttttatattggagagttcggtacagactgtccattactgcaccaaaagaatgagtgaactgttacctatagggaaagaacacttcttcttcctgctgtttgggaaccatctcagtgtggcgtaatggttaggagtacagattccagatcctgtttcttagatttaaatcttgactctgccacatactagctgtctgactgaaccttggtttttctgtgcttcagtttcctcatctgtaaaacggagataacagtacttacctcatagagctgttgtgaaaagtgatgactgaatatgtaaaagcacctagaacagtgcctggcacatgctaagtgctttgttcattattgttgttattatgtaattttctctcagactgagagcactgttagtgacccaagtaaatttatagtttttaagtacagaggaaaaataaagcctattttttgttaacagtcttaataaataataaaatggaataaagaaaccaagaccccatcttctgtgaatattagggcttttttttttttgacagtcataaagatgttttcactatggcatttctatccctgtgtatatccaaacatgtcctgaagaagaaatgagatgttccaccaaaaacacgtaagcaggaagcagctgttctgctcagcttggcaggtgttctttcctaattcttcccaagctgtgagtcagaaagtcctggaaggagttgtaggaagttgtagaggctgggtcactgacctaagagaaggcatcatttggcccactgcacgtcctggcctattcaccaaagcccttcctggctctgactgccacaccaggcagtgggtgaaatgctggctttttccttaagaaattgtgttctagtgccaccaagagatgctgtagagctggctttaccaatctcatgatgcttgcttggcaactctgaaaggtgactttggccaagaagaccttgtggcaattctgcaaattttatacactcatatcttttagggtacaaaatgaaagaacaaatcacaaagaacaatagatccttcaggagctgaaggtaagaatcttttatagctattttaacatatacagtgactactttctactagccaaatatcaaattttacaactaccaccaagccacagattataggtggtaacaactccagaaatgtcctaactaggaaaggtgctcatctagtatgcatcggtatccaggataatatgagttagaattttaaaaatgtcagtcattcaaaaatatttgaactgtgacatcacagaagtaattttatggccttttaaggtaacaacttaaaaagagaacagtactctttttatatcaatgcctttacatttatttaaaaacagtcctaatgctttatagttaaatgtcatatgcagatatgttcaggctctaacatataaagttcctaacttgacaggaaactactgaagattgtgtacagcttaaaaaaaaaaatagggtaactatagtcttgatttttatgtataaattctatcattctatattttaccatcagacatatttctactcctttctttgaagtatgcgaagtatctccaactgcagcatgcaactcattcatttgtaatcaagacgatagtttgaaacacccaattgtaatcagagcaacagttgacttccttttgatagcggagttgaaaatcattgcaattaataaaatggggctattagaaatggaaaacgaataggatctagaatgtaacttcatcatataaatgatgagtgtctttgttatcaacacgttattaagaatgggcaagatgtccttatatactagaagcttttgtaaagtcatgtgtctattgataataaagattttcggaactga

SEQ ID NO: 2058 - DNA, 10774 bp, Homo sapiens
  source 1..10774: mol_type = genomic DNA
ccccaccttgggacacacccggaagcggcggcggcgcccctcggggaagatggcgccctcggggctgaaggcggtggtgggggaaagtgagtgcctctccggggccgggctctggcgtccggtgtgggacgggggtcggggacgcacgggctctgggatcctgggtttcatggcggctgggagttgggggccgggctgggcgtccgagcacctgaccctcgagggggcgggcggggacgggttcccagctggacgcccctgctctccggtgccagaacagaacaaaattggggggccggactccggggacccaaaggggacgggtagagtgtggcggaggctggggcccggactcctgggcctcctagggtgcctgccgggggaggagggcacagctggatgcccacactctaggatctcttaagccgggcaaagttcaggggctggattcttggggcctcctagggctctggtcagcgaccctaggtgctgtgagcgctcaggggacgtgtccaggccccacaggggtggtgtaggggatgtcttcctccttgccccatttccaggagcgccttgcagctggaggacgcaggcgtccaggcctcaccggccccggttcttgggggaagggtggagggcgcctcttcctccaccccggggagttccggcctcagctgctccttccgccctggccgtcttgataacagtggacatgacacagtggacgtggctgggcggggccaccccgttacttctctccactctctcctctaggcagggcggtctgtagctcaaacccctttaattgggggagattagaaaaaagtgattccattttacagatgaggaaactgagaccggaggtcagtgggatagcctcagctaggcatgcctcagagctgggaaccaggggtcctacattttagaccaggttggggggactggctgaaaccctcacagcaggaatacttgaggtagcaggtggggaagccgagagcctggcgctagaggcagatagagctgtagatgatcccggttctcctcttttcattcacctaaaacatgtttatcgagtggcaccttttgccccagcactctgccacttagacactcaggatgcgtaggtgagttacatgttgcctaagaatctgtttccctgtctgtaaattgggggtgaccccagaagccaatttgcagaactgggggctaaaaataaatgattcctgtgccgtgtctcacacctgtaatcccagcactttgggaggccgaggcaggaggactgcttgaggccaaaagtttgagaccagcttgggcaacatagcgagaccccatctatacagaaataaaaataaattagctgtgggtggtacatgcacctgtagtcccagctactcgggaggctgaggcaagaggatcgctggagcccaggagttggaggccgcagtgagttatgatcacaccactgcactttagcctaggtgacagagtgagatcctcctctcttaaaaaaaaaaaaaaagtaaatgggaattaagatgggggttcagccccaaggctgagaaggcttggggcagtggtgggaccagagaaccagcattctgacccctcccctcccttccctgcagaaattctgagcggagttattcggagtgtcaagaaggatggggagtggaaggtaggggtgaggcagatggctgggtacccagaggcagctcatcatcaggcctatggggaagaccctgaatgtgggacccccaagaactgcctgtccacatgggtggagttgggtgaatgggttctgggtcctcccacccagccagcccttgaaactgcccctcccactgccttggccccttctggggccagctgtggcctcttccgcctgctcctccatccatctgtccatccatctggacaggtgcttatcatggatcacccaagcatgcgcatcttgtcttcctgctgcaaaatgtcagatatcctggctgagggcatcaccagtgagtgaacgcgtccccagtgagatgggacctgagcgtgggaacccctgactgtgcccctctcccagggttcagcccttgagtgtaggatcccctcaaatcgtccagaactcccaagtacgcagctccctgcacggacagcccggatcatgtgaccaaatccattcttaaaccttgcaagctgactgcgggagcccatggattgcaggcctcccctgcagcactccctggctgcagccccttcctgaccgtgcagctccctcgtggagccctgtgtgggactcccagggtggactctggatgtggggtcccaagaatgcagagccttctatgggtgaccccaggtggtgtcccagtcactttgccattgagggataggtgctgagggagcctgtcctctcagaacctcagtctccctgtctgtaaatttggggaacccagttggctgcacaacccctgcagaaccctgtcgtgtggctcttagctggtggtccctaagtgggtttctcctgcagtccctcctaagcatccacccctcctccccaagcctccaaccccccacacctgagactccccacgtggccctgcctggatgccacccacctgtgtcccttcctctgttcctactagttgttgaagacatcaacaaacggcgggaacccattcccagtctggaggccatttatttgctgagccccacggagaaggtgcctacatgagtgagcgtgtgtgtatgcgcgtgcatgcgtgtacatgtgcatgtgtgtgtatgtctgcatgcatgtgattgcatgtgtgcatgtgtatacgtgtgcatgtgtccatgtgtatgtgtgtgcatgtgtgtgcatgtgtgtgtgcatctgtgtatgcatgtgtgtgcgtgtttgcatgtgtgtctatgtatgtgtctgtgtgcatgtgcatgtgtgtgcgtctgtgtgtgcatttgtgtgtatgtgtgtatgcgtgtgtgtctgtgggtctgtgtgtgcatttgtgtctgtgcatgtgtgtatgcgtgtgtatgtatgtgtgtgtgcatctgtgtgcatctgtatgtgtgtgtgtgcgtctgtctgtgtgcatgtgtgtatgcgtgtgtatgtatgtgtctgcgtctgtgtgtgcgtctgtgtgtatctgtgtgtgcatgtgtgtatgcgtgtatatgtatgtgcatctgtgtgcatgtgtctatgtatgtgtgtgcatctgtgtgtgcgtgtgtatgcgtgtgtgtatgcgtctgtgcatgtgtgtatgcgtgtgtgtgcgcatcagtgtctgcatgtgtgtatatgtgtgtatgtatgtgtgcgcgcgcatctgtgtgtgtgcatgtgtgtatgtatgtgtgtgcatctctgtgtgtgcatgtgtgtatgtgtgtgtgcatctgtgtgtgtgtgcatgtgtgcatgcgtgtgtatgtgtgtgtgcgtgcgtgcatctgtgtgtgtgcgcgtgtgcccatgtgggtgcgacactagtgtgcatttgcacatatacatgtccccgtccgtccatgtttgcacatggtggcagatggggggtggctgggaggcctaggcagccaatgagcctaggtgtgcaggctcaggcccagagagtgatccaccttccccagtcggttcaggccctgatcaaagacttccaggggaccccgactttcacctacaaagcggcccatatcttcttcaccgacagtgagtgaggagagcctagggtgttggtgggtggggcaaggaggtgtgggggctgctctggcctgatgccccactcctgcctcaccccagcctgccccgagcccctgttcagtgagctaggccgctctcgtctggcaaaggtggtgaagacgttgaaggagattcaccttgccttcctcccctacgaggcccaggtacggcccgggctcatcctgggcagggggtgggggtttgtgaccaaatgtcccctgttccctcagaaacagacactgaggctgggcgcagtggctcatacctgtaatcccagcgctgtgggaggccagggcaggaggatcacttggggccaggagtttgagaccagcctgggtacagagcaagaccccgtctcttaaaaaaagaaaaagaaagaaattagcttggcgtggtggcgtgcacctgtagtcctagctactcatggggctggggtgggagagtcgcttgagcccgggaggtcgaggctgcagtgagctatgattgcactgctgccctccagcctgggcgacagagcgagatcctgtctcaaaaacatacataaagtaaaattttaaaaaggggaggtacccacagagtccaaggagctcttgccttgagttctatcccactaggcccttgcagggggcagcgtagagcgcaccgcggggttgtccagccagcttaagggacacgggctggggtatttatccactgactcctgcaggcatgggtttagggttgacctgggcctgcctccaattcggcaaagcaggcttcagggaccagggacggctcccaggaggtgcaggtggcggcagcgggaagcggggcaggtgtgcacctgcagcggcaaccctggtgcttctgtcccctcctcgcccaggtgttctccctcgatgctccccacagcacctacaacctctactgccccttccgggcagaggagcgcacgcggcagctcgaggtgctggcccagcagattgccacgctgtgcgccaccctgcaggagtacccggccatccgctaccgcaagtggggaccccacccagccccaccccgatgccgacccccccttaaccgcgtgcaacacctaacctttaacctctcttgtgaccccagccccggccctaccctggcccctgactctcaccttcaaacccatccttgaccccatcccctgatgatgtcccccgtgtctgacctccccgccaggggcccagaggacacagcccagttggcccacgccgtcctggccaagctgaacgccttcaaggcagacactcccagtctgggcgaggtgagggggcgtgcttgggaggtgaggggcagccccaaccggctcagggtcagtgcctcattcctgccctaaaccccaccccagggcccagagaaaacccgctcccagctgctgataatggaccgggcagctgaccccgtgtccccactactgcatgagctcacgttccaggccatggcgtatgatctgctggacatagagcaggacacatacaggtctgcagacttggaacccgtccccacccttgccactgacctggttccccagtcctcagctcccctgacccccaggctccctccttcctccccaggtatgagaccaccgggctgagcgaggcgcgggagaaggccgtcttgctggacgaggacgatgacttgtgggtggagcttcgccacatgcatatcgcagatgtgtccaagtgcgtgcacacggggaccggatcccccccccaccgcccactgtgggcctggtagcggccttgggatccctggctgctgccaagtctttggccctcatgagcacccctcgtgtgactccagactggcctccaatttcaccccacctctccctgtcccccctgagtgggctcacccatggcctgtggctcctctcccctcactctcacccccgcccaccctcatggccaggaaggtcacggagctcctgaggaccttctgtgagagcaagaggctgaccacggacaaggtaggggcggacccaggtcaccaaaggcgctggtggaaggaagcccccctccccatgggcgcagggccacagcctggatttcgagcctggactgagacccaggtgggcactgcctggcttcgccccccaatccctaccctcttccccctacttccccaggcgaacatcaaagacctatcccagatcctgaaaaagatgccgcagtaccagaaggagctgaataaggtgtgctcgggtgggcagggagcggggacacctcggcccctcaaccccatgctctgtctgcgttctgccttgactcagcctttgttatcccccaacccccaccctgcaccctgcagtattctacgcacctgcatctagcagatgattgtatgaagcacttcaagggctcggtggagaagctgtgtagtgtggagcaggtggggcagggcttgcggggggcaggggtgatggtcctgccaaggcggggtattggggaggggctgaactgtagagatggggggttctgggggaggggcagggcttgtggagaggtggaggggccttggagagaggtgggacctggtggggaaggagtgggtcttgtggagaaacggtcctaggatgagggtgtggcctgtgcataggtggatggggcttggagaggtcagacttgggtgaggggcagagccttggacaggtggtcccaggacaggaatgtggcctattcataggtgggtgggaccttggagaggtaggcagggccttggagaggtgcgacctgggagaggaatggagccttggagaggtgggacctgggtgaggggcagagccttggagaggtgggacctgggagaggaatggagccttggagaggtgggccctgggagaggggcggagccttggagaggtgggacctgggtgaggggcggagccttggagaggtgggacctgggtgaggggtggaaccttggagaggtgggacctggatgaggggtggaaccttggaggggtgggacctgggagaggggtggagccttaagagaggtgggacctgggagaggggcggagccttggagaggtgggacctgagtgaggggtggggccttggagaggtaggagctgggagacaggtagagccatggagaggtgggatctgggtgaggcacggggccttggagaggtgggacctgggtgaggggtggaacctcggagaggtgggacctgggtgaggggtggagccttggagaggtgggacctgggtgaggggtggagccttggagagctgggacctgggtgaggggtggagccttggagaggtgggacttgggtgaggggtggagccttggagaggtgggacctgggtgaggggtggagcctcggagaggtgggacctgggtgaggtgtggaacctcggagaggtgggacctgggtgaggggtggaacctcggagaggtgggacctgggtgaggggtggagcctcggagagctgggacctgggtgaggggtggagccttggagagctgggacctgggtgaggggtggagccttggagaggtagtctcaggatagtggtgtgacctgtgtgtaggtgggtggggcactggaaaggtgggacctgggtgaggagcagggcctgtggagagactgtccctggacaggggtgggaccttgagagacctggtgctgagatgaggtaggacccaaatgtcctcttgccgaggatcctggggatgtccttggcccgcctctcccatccccttccctgacacatagcggccggtggacggctgaccccatgcccgcaggacctggccatgggctccgacgcagagggggagaagatcaaggactccatgaagctgatcgttccggtgctgctggacgcggcggtgcccgcctacgacaagatccgggtcctgctgctctacatcctccttcggaatggtgggtgggggctgcagggagttggaacgtccccatttgccagcgtctcccacgatcctgggaactgctgaaccccacagctctccttgggtcatttgcactcaccgggctcaccaacccccacagctacccctctggacccgggaaccctcctccattggcttggggattcctccactgaggtgagggctccctgctaacgtagaaaccctcacatctgtgattcctatagatgtggggctccctcagctcatctggaggagcccctgatctaccccctccaggtttcccactcttgctcacactagcacagggtactgaggccctccccactgcaaggttctctcatcagagtcctgggagctcctcagcccaccccaaactcccctaaacctgggagctcacctggccgccgcctccaccctgcccattcccgtcccccaggtgtgagtgaggagaacctggccaagctgatccagcatgccaatgtacaggcgcacagcagcctcatccgtaacctggagcagctgggaggcactgtcaccaaccccggggtacgccaggagcgggcatggggggaccctgggagagggtgcggatcacagccggggctctgcaaggcagagggccattggtgcacaggcacggtgtggttcctggcgtggtgtggttgctgggaggccaaaagcagtgtttcgggtctggtctggggcccagaggacactggggcctctcccagtcccagcttacacaataggcaggggaagtgagacatggtcgctgccaggctggtcctggcagtggtgcagttgggagcgggtggtctgagtgctagaggcagggagtagggtccccagcatgggggctacaccacattgtctatctgggctcccaggggtctctgagggtcccccgcacccatccagcacccacacacagccatgtgtgtgcttgactcttgggtcagcctctcctgtctctctctggccctgtgcgtccccctccagggtgccctcaccccgtccccatctctcccccatccctcatccatctcgctgtgcactgtttctccatatctctctctctcacccttctctctgccttcccctttctctctgttctctgtcttgctcccctcccctctccgtcccccttctgtccccatcttcctctctctgtttcctgcttcatctcttgtctctctctttgccttcatactttgtctcactgcttcttatctctttgcctatctctgcctctgtctttgtctttctctggctcgctctctctccctttggctttctctctccgtctctctctggctcactgtttctctctctcgctttcttgctgtctctcgctctctctcgctctctgttccacttccccatctttgcctgccatcccccaccctaccagccacaccaggcgcagcccctctgtgaccagcctccttcccctcaatccccctgctgccctccctgccctgcctgtagggctcggggacctccagccggctggagccgagagaacgcatggagcccacctatcagctgtcccgctggaccccggtcatcaaggatgtaatggaggtactgggtggcaggtcagggtgggggccagccctccgcatcggctggcggctcagcctccctcctgctgaggtgctaagcctcagggcttaggggaaaatgctcattgctggcattcccttggcaccgatctgctctgctgaggggggcacgccaagcccgcagctgaggaattggggtgacagcggggcctgtgctggggagcctcacttcctccccacctgccggctgcctccgctatatctctctagtctgttcccctgtcccgcaggagtgcccctgagccccagccctggccttcccaggatcccagggcagcaccatccaatggcaatgggcctggggcggcttcctggcttcctccttgtccctctaagagccccggcccctctttctgcgtgggggccagagacctgggcctcctcatccccatggaccttgaatacctggacttctggggctctgaggggctgagagcccagacactgggttccccaaagggctgggggtattgactgatggtccccaagggcctggaggcccagactactgggttgccgaggaactgtgggtttagacttctgggtacccaaggagttatggaattagattcgtgggtccccagtgagttatggatctagatttctaggtccccaatggactagaggcctagactcctgggtcccccagaggcaggaggtggagatgctggttcctgtctgccaggatcttggcccctgaataccccgtggggggcactcctgaccccggaccccatgcctggggttcctcccctaacctgcctctcggccgccaggacgccgtggaggaccggctggacaggaacctgtggcccttcgtatccgaccccgcccccacggccagctcccaggccgctgtcaggtgaggccccggggccgcccccgcccacgcctgggtctgtgttaggtgggcggcctggcggcggtgagggcctcctgcctggactttctgcccctgccctgcacagtgcccgcttcggtcactggcacaagaacaaggctggcatagaagcccgggcgggcccccggctcatcgtgtatgtcatgggcggtgtggccatgtcagagatgagggccgcctacgaggtgaccagggccaccgagggcaagtgggaggtgctcattggtaagtcaccaggactgggaccctggggtctggggcttgggttcccggggcctgggcttgtaccttctaggtgtctggactccagagtccttggagtcagggacctggtttgctgagggacagggacagccccacaccagccgggaccgggagcctgtcaaagacgaaggcagcgccccccaacatcttccccaaacctctgcccctgcacaggctcctcacacatcctcaccccgacccgcttcctggatgacctgaaggcactggacaagaagctggaggacattgccctgccctgacccctggccccgccccctacccctccctttccagagaaataaactcttcccgtcgctctgccag

SEQ ID NO: 2059 - DNA, 10774 bp, Homo sapiens; identical to SEQ ID NO: 2058
  source 1..10774: mol_type = genomic DNA

SEQ ID NO: 2060 - DNA, 10774 bp, Homo sapiens; identical to SEQ ID NO: 2058
  source 1..10774: mol_type = genomic DNA

SEQ ID NO: 2061 - DNA, 10774 bp, Homo sapiens; identical to SEQ ID NO: 2058
  source 1..10774: mol_type = genomic DNA

SEQ ID NO: 2062 - DNA, 35139 bp, Homo sapiens
  source 1..35139: mol_type = genomic DNA
taatttccaaaatggtttattaggacttctcccacactcaaagtcaaacttccaggactgttctgaaatgatgaaagcttcttttcgataatcaatataaatgttgttaatccaaaatagaaactaaaacctgcactaagtgacctaaaaagtcttgtcctgatggaagtggccaaaactgctcgtcccgcaaccaagaaatcctaggggtataagctaaaacccacaaatatattggcaagtccccgattctttccaaattaccactaactttatcaaatccaatggcaagtacgggacaacagaatatttccatcaaaaattaagaccagcctaatacatttattctattcatcttccagtaatgtgattgcaactgaggatatcttgaggaatttttcaccattggctagttacttcgaatgtatggataatcaaagggcgacagacctctaaagattccaagtgtctacttaaaagctgttaagtgaagagtgatgaattggaggacacccacaataattcttggactcctggagatcctaagacatgctacaaaaataggtctttattcttaggaaaatatagtcagagctagcttccttatgctatacataaaatcttaacatcagaggcagtacagatagtacagatagtttttgaactgatctccaaacaagcacaaacccactacgttgaaaagaacaggtaatttgaggtttttggcaaaagacagtacttcacacatctaatccaaatcaaagggcctgcagacagttttcagtgagatgaaaggaatgaaataaatataaattctacggataaataaaacacaatttaaataagctaacagaactaatttttttaaataaaaatactagtcaggtacaagcttttgtttctcaatgccagacttctaaatatttaccagactactgttaatattaaaaacctaatctttgacccagagcgttagtaataatactggtttgcatctgcaaattttcaaactgaatgcttctggtcctgaaaaatattttaggtgtattactgaaggcagactgtggtgctaatagaatttaagtcttaaatacttttaaaaagtgacagaccccaaaagtccatctactaatttgctagttaaaaaatgcctgtgagcactgcttcataattagcatcttaagaaaagtagtggcatgccctattgagtggtatcatcactgagtaattaatacaccttaaaacaatatccccacaagtctgtttcttttatgtatttgtcacttaatttctttagtcattaattttacacccaccagtgaattcctatggccagatgaaaattttgtggtatacataattagagagaaaatgatcatggtgggtattcctgtaagtttgacgaacttgagaagttttagcaccctcccctaaatgcatgaagcccttctatttaatttctctccttaaaatagagactacgtaaaatactctgtaataataagggatcttttgctgtttctgacaacttttggcttcgcagtcaaaaaagctgttctgaatgtgtcaatttttgcctatctagcttgatgttcattctattctttaaaaacttttatatacaataactcagatcaccccatcaatccatttctatgttgttcctattttatcatgaggaaactttacattttaagtcagattcacagtaactggtagaaaagtttcttaagctaaaaactgcaatcatgagtgtacaacagttgtgtgtgtgcacactcaattttcccttcatttttaacatctgattcagtggcaatggctgaaaaccttccacaaaaagcatgcttgggagaatatatctaacaaaattttctcacaaagcaactttctgaaaactgataacctaaatttatgatcacttttgattgccaagtagtctgcagaaacaaaatcttgcgtctgttttggttagataacttaagttttctttttaacatcagaatgctttaagaatacattttttaccccaaggaagggacttgactcggatttaagaccctttccttgacaatatacaaaatttcttttaacttatcactgtccattctttgaagctgtcaaagccaagaacccataaacaaatcacaaatagcaataacctacattagttaacattccccctttaacatgttgacatttttactaaaggattagttatttttgcatttccatttctcatatcccatgacattccatataaattgcattattgctttataggccacacaacattcaaaagtatgtttatatgcattgcctgtttttccttgatctgataagactttgatactgattttactacagaaatttaagtttgaaaataccacagttagtatttcttctcagaacgttaattgttcacatcactaatcactacatgcatatttagctctgattatattgctcaaaaactgcacccattatcagaacagtgcaaatgatatttaattttaaaagtaattataatggcttgaattcaaagtcattcaaatgaacactgtcaagtaatttcacttgatgtgtatatatttcatcaccactgtttacattacccttctttaagtataaccatcaattcttcaatttctttttatcagtttccctcccaagtccccaaattaagaatgccaaatagtcttgaaaacccagagctccatattttaatgttttcttaagaacacatttgtgaactcacaaaagtgttcctctttcaactttgacaatgcagttcttactttaagtaaacaaacctgtcctaaaatcccaacaagtaattctgagaacttaaacaccttgacagtgtcccttaaaaatgctatgacagtaaagtgccaataggcatggcaatgacctcttagatgggatcatttaactcctcggaactgagaaatgccagcaccaaggattacactgagattcaattttactgaaggctacatttagtttacccactttccacaacctattatattcattatgttagaatgaaatgtaaatgttttgtgtagccctcaaacttacactaagttttgagagagatgtactttaaaaaagcacggggtaatatataaaatcagtggcagaaagtttcattaagcaccaggaactaatttttgtcaccccatactcattttgtagataagtttcaataaccggcaaggcacatttacatatattccaatgaatacttattgacaaattttaaattacactctatgtcccagctatcccagtaactgacatacaacatactaaaatgatttatttagataacaaaaaaccaattaatgtgaaacatacaggctattggcaaccactattctaaaattatgtaagtacaaataaacatactgaaatgtgtgcaattctaagtttttaaaccagaagatttctacactaacacacatttatattaatgacacataaaaaaaataaaaactttattacaaaaataagttacactcgcctccagcttacagtataaaacaattttatttgcaggaatgcaaaatgattgtttgccatgagcattttgaacatatgacatgtctgattttcttgttaaatttgcatttactggggaactggtgtgtataaaaccttaattaagtataagctctgatcttcatcgtggtgcctattgggtatgtgatataactgcagtatccctttggggaaggggggaggggatttctttacaccaagtcctaatgaaactataattttcactttttactttaagctatcaacttaggacttggcaaaaaaatttttgagggtggttcaatagaggatgcttcaccactggacactcactgtcatcaaggtgctttagaaaattaaaaacatagcacaaatgattgtactctactctacaagttatcatgacctgcataagaaatggaaagctgattcacatgtttacagtgatcagcaggaagaaatgcactaatgaaacataccttttacctaaaaagctaaactacagccatatactaatttctatgatttatgaaaaaacttcaaaatatccaaatgtcaggcttcgctgtacaattgtcagttttagtctgactttttataaagggacactgcagtatttagtacaagttcggatgcacttttttgaacatctgatgtcttacaaaagtaacatcttgctaaactattatacatccaaataactacaatatctgaagaagcaaggctgctttttcagccacaaaatacgacaaaagcaaggcctgttatgatggtcatgaggaagtcttacaagcctctgaaactaaaggcaactaagaatgttacatttggtatattaaaatcttaccctcatatcatatttaacaagccttgcttttatctacaaagattttctatgtacagtacagacagggtatagttcaatcctctgctactgaggtagttaaccaacccttttaaaaaggttctgaaaagaaccactatctggaatgcctgactaaccagctctgatgattacacctgaaactgcatatctgaacacaattcaaaagtgatcactataaaaaagatatagacaatcatgattaaccttggtgagcagaaataaaatttaaggataccatcagtggcattcatctataccactgcaataaaatttaaatgcacaaattcaagagaatatttcaaaataccactgttgggatccttaatttaaaaaaggggaaaaatctacttagagcagatttttaaaagaactttattctttattaagataccatgctaggagttatgaaggatttctgttggaacacattttgaaaatagagtagctttagtttaataacttgcactgcagagaaaattgttaaagaaattcatatcaaagtccaagtattagttcaatgtcccgtatttgattccatgatcttcataggaaggtcttctgcaatagaatatgctcctatacagccgacatatttaaggttgcttgatttccttaccattactccactgcaagcttctggtgtaatcccacatagcaagtcagtcttcattgtaacaggtcaggaccggcctcgaccccttttccctgctagccaggtaacaaaaggaatcagttagataaatcatcttaaattaataatgtgtacatacataatgataacattaaaaagacaagccttaacatggtaattctaaatatactgtctagccaaaaaagttgcctttaataactatgaacttctttttgcttgttttttacttgctttgaggtttttggttgcttttttgcccctttgagtgaggaggctggactgaggtttgaaaaccccattttgttcacaaactgattttatttaaaaaaaaaaaaagactaacaggaaacctaaatgaagtcacaccttaaagttacccattaacttgcaagtaattcccatttttgagacatgaagtaatcataaaatatgctgaaagcaaacatctcagacttgtttgaccttgagatttgaaatttagtgacatttttaagaaagtttgtctttcaagtcatgtatttttcacatgtaactttattgtcaggtataatacctttaaattcaagggtgatggaggttcagaagtggggagtggctgttaaaccttttcactgttgacctagagtctgtcccccaaaactctaacattttcccatcattactgttagaagtatagaccatatggccaaaacaagactaaaatgtgaaacaaaaatccaaactattagatctttaatacaaaccagtctgtgaggtaaattttatccttcagatatatatttgcttacccaaaactaactgtaaagctgttttatttttaattaggtaagtacagtgattatttagagtgcaactcacaaattacccaaacctattcccattgttttcacactagagtttctttgctgctttctagtcccatggtgtgcaaaacagtcaagagggcaatatactcaatctgagttttaggttagttaggataaactttaggcaactgaaagtggacttgtcagtgtgacctgcaaaccctttgagactacctgaatttgtccttttatacagttcattcatcacaattaagaactctaaaatacttaccaacttaaacttactacatgtattatctttttatttttgatgggaacatgaagtctgttgtaaaatagcactttaaaccagaagcagaaaactgcaataaatcagtgttgtgtaatgtgcagacatattccacacaagaattaacaaggcacaaaaccctttaattggccttgacatgctatacaatttgaaccaaatttgcaggaaattttgtgaaaaacgaattgtaaacacaattttagtaagtatacatttaggtgtgaattttttattgaaataaacaacagcataaagaatacaagtagccaaaatggttttgaaaacccaaattaggtcaaagttctaaattaaaaatagcagttgtgtatcaatttaccttattctagcaatttaagttggtaacatacaaagttattctgatacaagatattaaagacacacttggttttaatcaactacctttgaagacaccaaatctaaacactactggaaacatcgttgacactacagccaaatggacttgagccaaattttctcaagcacaaatgcaaactcattaactatttctttcagtatctaagaatatctttattgaaaaaaattaaaaataaaatcagttcgccagaagcagttagaagtgtggctttgttcgtgtccaagcggattgttaaaatatatacataaagggaaatcttgccagatgtcacaaattatagcggcacccgttcagatttagggtgagtttctgatcaacctatcagtctccaattttacagaggccctactgtttctacttccactgttgcccaaaagtatcctgataaaactcctggttttcagatttgtaaccatagttaccagaatgatcaccaccttggagcggttgctgagcaatgggttgggagccccagttctgattattggtctggcgccgcttggaatctggctggttgtacccatcagctttgcgctttcctcctacatttccaccgcggccacccctcgcaccacgtaccccgcggcctctttgttgttgggcacctcctctcgcacctcgaacgcctcttgctgatccaggacctcctctctgtgaataaccggctctaccgcggggaggagcagccccacgacctctggatggagcagcaccccttgctcctctaccaccccttcctctagctccaacttgaaaatcttcataaccatagtatggatcttcatatccaccacgatagttatggtaatcataaccataataatcataataatcttcatatccataataatctggaggatatccataaccacctctacctccacgccctcgacctcttgttggagggggcatatgaggtggaccataatagtagtaatcgtcatacctattaaaaaagagacagagattagagtttaaatcaaattacttagttaacaagtaggcatttagccatttgtaacagtttaaatccagagtttacttcgcataattcacataactttaatacagaattatttgtactagattaagttttagtagtagtaatgatcagaggatcaggatgacaatataggcatcccaaaataccacaaatctctagttatgaaccttatttatttcttcatgatcttcaaaatctcccaataaacctgttacagaatttttacaattgatttagctgtcaaatttgccactttagggctgggagcggtcatgcctgtaatcccagctatgcgggaggctgagtgaagcaggtgaatcgcttgaacccaggtggcggaggctgcagtaagccaaggtcacatcactgcactccagcctgggtgacagagcgagactctgactcaaaaaaaaatttgtcactttgaattgcatttctgctaagattctattccaatatacttgaagaacatttattacaaaagcaaaatggcaagtaggacaagcacacaaccaaaatgtgtgaagttcaaagtttactacagtaaattagcataaagaccttaaagttttcctgtttctacaataatgctatccaagtaaaatttaaaagatctgctactttcccaaaaataaactacaccgtaactatagtgctgaactttaaccactaaacaggtataactttagttgtcaaagtgattagaaagcaaccacacaaatcagcatatgcttacatactatgtaaaaggactaaacgaagttacaatattccaactcatgttccctacagtacaattttatacaattccttaaaacttagtgattattttgagcccaataatcccatgaaatatggaaattaatccctcttgaaggaataatttactcgtgttttttattccgtacctgttatgttattttatttatttatttatttgagacacagtcttgctctgtcacccaggctgcaatgcagtggcgcaatctcacctcactgcaacctccacctcctgggttcaagtgattctcctgccacagcctctcgagtagctgggactataggcatgtgccaccatacctagccaatttttatttttagtagagatggggtttcaccatgttggccaggctggtctcgaactcctaacctcgaatgatccacccacctcggcctagagtgatctgcccacctcagcctcccaaagtggtgggattacaggcatgagccaccacgcccggccttattttatcctgaattattaaaggcccctgttccaactgactaacgtaaaaatgttattccggttcactaggtccttagaccttttatgtgctctgctggtttattgttttgaggaaatgatggaaagatcatccttttctatttctaaatagttctcaccagggataattttgccaccacctctttccagggggacattttagacggtcataactgagaaagggggtgctactggcatctagcaggaagaggccaaggatgctgctaaaagtcctacaacgcacagggcagcccccaagaccaagaattatccagcccaaaatgtcaggaggacagagatgagaaatcctggtatagtggttaagagggaaaattatgggagactagactaccttagttcaaatccaactccactacttactatgtgaatgaccccaaggaagttgacttctgagcctcagtttcctcatttcaaactaagggatagagtacctaactcacaggaatacagtgagaattatgtaggaatacgtgcttagttaaaacttaaaaaaaaaaaaaaaaagactgtagcaagttaaagtacgaaagtaacatgcaatcatcccttttagtttgtactccttttcaaatattaacagatatactgacatcctccaccttctatttagtatctccctctatcaagtaccaaatgtaactgctctaatcacattatctaatataatctcctatacttacattctactttaataaattaaccatatatcgtcttctgaaagaaataaaaagaagttattttacactgtttagtatatccaggtgtttgaaatatagagcattaaaactaactctttttgtagtcttccttcatttacactatcatcaaacctacaaagtatattttctttggtcccagaacaagcatgggtcacttggataatcacataatccagagctattacataattttgtctgatcccattttagaactgaagaaattgaggttcagagcttgccaacttgtccaactggacaattaactgcagaaactagaacttgatcaattccctgattatgaagtaacagaaatatgtagaagcatcctcttcctttaaattccaaacagggcaatcaacagaaaattaaccttgaatagtattgacagtgattattgctctcacattcaagaacaattacccctcttctaggaaatcagtaactaactttttaggagctaacttcaattcttacccaactaagtttccttcagtcttaagcagatacctatttacagattctctaaaaaggtctccctaattagtataactcattacacacctacttgttttcttattgcactactgtgttataattttaatactcatttcattttcaaaatccatccatcgaacatgaaatttttggggtggcaatgagcactactggtgaagaaacagtctatcatgaatagagatttagtatttcctatctctcagagaaaaaactctccaccctttaacaaaatgtattaagatatttggacagctaatatttaagacattttcagaagaacattctgtaaaatacaaagaaaatatgtgagataggccaggcatggtggctcacagctgtaatcccagcactttgggaggcagaggtgggcggatcacctgaggtcaggagtttgagaccaacctggccaacatgacgaaaccccacccctactaaaaaaaaaaacacaaaaattaccaggcatggtggcgcctgtaacccagctactcagaagactgaggcaggagaatctcttgaacccgggaggtggaggttccagtgagccgaaagagtgccactgcactccagcctgagtgacaaagtgagactctgtcacccaatacaaaacaaaaaaaaagctagacagatttttcatcttgccaatttaccaaaattccagttatttacaattctgattattttcacaaatatggttcatagtaagagttcaataaacacttagatcactggtgtttccctatgactctcaaacgttcaagtcttctttaaagagatgttatgcatttaacaagtctgatcaacacctgttattttccaattagtgtataaatattaaaatttatacaatttttaagtatacaaatttcactcacatttgattttttgctgcttgcctctgagcttttctttctttccttttctgatctggtggcttggcaaaaacaatttcaatattttctccctccaagtctttgccattcatttcttccatagccttaaaaaattagataagtcaatataaaaataggactttcatacaattatgattcatttaaagttggaatatcatttatcattaatgtgggaaggacaagagaaagccccatgcaggcagtcaaataattttatttaaagatgcagatattcaattatttttcatttttacttagaaaactgccaacatcactaaaaccaaaaggttttagtttgaatggattccatggacttccaaagtctcctccaatttgtaaaactattttgagattctaaaatgactaaatttgttagtctgatttagatgcctgtaattccaccatatttaccttgacagcaccatctcgctcatcaaaatgaatgaacgcataatcttttaacttcttcactcgttccagtttcccaaactgactaaatgccttttctaaaatctcttctgttacagtattggcaaggttgcgtacaaacagcacttttacctagggggaagaaaatacccccctgtattatttccaaagagttccatttctaagataccaccaccccaccctacaaagttaactcaaatcacaatccattagaagaatgtcagaatataaaaaaaaaaaaagttttcaactccttgggtaaatatcaagcagcagaactgctggatcatgttgaaagacctgaaatagatgctttgccaaaaaagatatacagatggcaaagaatctcatgaagatgctcaatataatctgtcattcggaaaccgcaagtcaaaactattagaatggccaaaatccaacacactataaatgcaggtaagaatgcagagcaatagaaactctcattcattgctggtgggaatgcaaaagggtatagcccctttgaaagacagtttggcgatttcttacaaaactaaacacacacttccatatgacccagcaatcctgctccttatttacccagagttgaaaacttacatgcacacaaaaacttagagagagatgttaatagcagctttatttgtaactgccaaaaatttgccagacgcagtggctcacacccgtaatcccagcaatttgggaggctgaggcgggcagatcacctgaggtcaggagctcgagaccagcctggccaacacagtaacaccccgtctctacaaaaatacaaagattagccgggtgcgatggtacgcaactatggttccagctactcgggaggctgaagcatgagaaatggttgaacccaagaggcagaggttgcagtaagccgagatcgtgccactgcactccatcctgggtaacacagcgagactctgtctcaaaagaaaaacaaaaaaatttccaaaaattggaagaaaccaagatgttcttcaatgggagaatggacaattgtggcacatacagaaggaatattataactgatagaaactagttaaaagccacaaaatgacatagaagaactttaaatatgtattactaagagaaagaagccaatgtgaaggttacataatgtatggttccaactatgtaacattctgagaaggcaaaactatggagacagtgactgccagtggttgaatggggagggatgactaagcacaggacagaggatttttagggcagtgaaactattctgtataatactatgatggaaacacggttatacatttctccaaacccacagaacatacatctagagtgagacctcatgtaaactatggactttaggtaatcaatctacgtccatcaattttaacaaatgtactattccagtgcaggatactggtagtgaggaaggctgtgcctgtgtagggggcagaagtcatatggcaattctgtgctttctgctgtaaacctaaaactgctctaatgaagtctatgaaaaagaaaatgcagactacaggctacatcagtaataattaccaattagtaattattttgcaataaaaaagataatttttcctaacaaagtaaataccatgccctctaagagagttattgaatgtttaacacttaacaagagtggccaaaactaattaggacctgcttttgaaatcttaaagggggaaggactgttcaaaatattagtaagacaaactgttctcaatcctgaaagcttctcaaagtaaaattacaaaatttaacctcttcactaacattatcacttcctcctaaaataacttgaataccatctgaatgtgttaatctaaagtgctaacccaatgagaatttataggccagaggaaaaatgaatcctaactattttctcttctctaagaccacttatccttcaataatattcatagctccctggcagttcatattaccctcaatttaactcaactagtggtgtctgacacctaacctgtaagtaacaaagagggaattcttaaaagacaaaggataactggggcatggtggctcatgcctgtaatcccagcattttgggaagcaggattgcttaaggctaagaattgtaagaccggcctgggcagcacagggagattaactctgcctctacaaaattttttaaaaaaattagccaggtgtggtagtacacacctgtagttctagctacttgggaggctgaggtgagaagatctcttgagcttggggctacagtcagctatgatcatgcccctgaactctagccctgggccacagatctagaccctgtcacttaaaaaaaaaaaaaaaaaaagagaacaaaggatagaacaaataactgcaaattactgcaccagtgtgtaataaagtgttgactcaagggatgtttattcttatacaatgtctccactgactgctgaagtcaggatacctaataatggctaaatgtaactgcaagcacctctgctgcggccagtataatttactgtttttagtagtaagacttttaaccccaaaaccatgtaaactaatggtgccattctcaaaaactcaaattgctcttaaaaaacacacaaaatggaagtcaactgtctacagcatgtaggcgacttcattacaagattgtgatggctatacaattatggctaagtatccacgcatcaatttctattttcactttgcaggcacatggtatttccagtgcgcactgcctagtcccgtagtaaagaacatttctcccaactctaaaaatatggtttaaaaaaaaatgtgtccagggccaggtgcaatagcctcacgcctctaaatcccagcactttggaaggccgaggtaggtggatcccgaggtcaggagttcgagaccagtctgaccaacatggtgaaaccccagctctactaaaaaaaacacaaaaattagccaggtgtggtggtgggagcctgtaattccagctacttgggaggcaggagaatcacttgaacccgggaggcggaggttgcagtgaaccaagatggcaccatggcactccagcctgggaaacatgggaaacaagagactcttgtctcaaaaaataaaaaaatgtatactgttcattttatgttccccccaccccaaccccggcccttctcccattaatccctcaaaaaatatttttaacttgactatcattacctttgccataacctcaggatcaggatcttctataggatcagcccattcaacagttccaacattcccccagaccttgactttaccactcattaacctacgccttgcctgggcagctgttttgtgatcttcatattcaagaaagcaaaagcctctgttttttttcttgtcatccggttggtggtataaaatgacgtctgtaagaccctctgcaagtaagcaaccattccaggaaaattagatgaaataactagcaaatacaagtggatcaaaggatttatctaagatactacttaaatatcaaaatgaaaaatcatctctttccttcactagacatctttataaaagactatcaaaaactaggtccggattattttcctaatctgtttccaagtttttcaacacagaaatctccagaaaagaacatgtgctctttttagaggtaaggactacttttgttttcactaattagatcagagaggcagataaaaattttcatataattgttctaagaaaatggcagtatagatcaaatatggctatttttcttattatgcaaacactaaaattatttttaatggcacttttctggccttagatatcaatggctttatttcaaataaaatagaagttataagtactgcataaaaatttccaatgtcctgaaagttgataacaggctgataatttgttagacactgttggcagaccaaaatattttctaaaagcaacctgtcacttaaaagttgttacagttcaaaaaatttttttaccatgttgacaatatataaactctgtttatgggccaggcacggtggctcatacctgtaatcgcaacactctgggaggccgaggcaagcagatcacttgaggtcaggagtacaagaccagcctggccaatatggtgaaaccccacctctacaaaagacgcaaaaattagccaggtgtggtggtgcgcgcctgtaatcccagctactcaggaggctgaggcaagagaatcccttgaatctgggaggcagaggctgcagggagccaagatcacaccagcacactccagcctgggcaacaaagcaagactgtctccaaaaaaaaaaaaaaaaaaaaacactctgctacggcaatacttactactcctgtaatttcaagaacatcaaatcattattcaaacaattctactaagaacatcaactaacacctagagaaagaacacacaaagaaatacgatcttccaaaacataggaagaacaatgattttgcagaatgaattcaaaccctagctgtattccctactaacttgtacaacgtttggcaagttatttcccaaatccctgaatgcctgttcttcttatctgaaaaatggggttacctacacttcaaaagttgtagtgaggattcgatgagtcaataaatgtatttagaacaatgcatgacgcacagaaatatgctattaatcttcattattaaaagctgcacctcattccaaataaatccaacttacctgttactttgctaaattcttcaagaatctgttccttggttttactcttaggaatagagcccacaaaaagcctattgttggcaactgagatgcagacaccaatatgttttccagaacgaatttcatgattattatactgaaaggggaaaaagtgcatcatgtttttaaattacttatacaactagaacagttaattataaaagatacacaagagcaaatcatcctttaaaaagtagtttaccttaattcccatacaagggaattatgaggaacagattatattaacaagacccattggacaagttcatgaaccaatttaatgcaaataaaaggttattaaatcctttacttgattaattagaaatcagatctgcagcagcttaaattcaaaaactgccagttcctcaaaaacttaacttttacttaagttcatcccatcaaccagttattctcatacaaggaaaactgatcccaagatcagcaagatctctgccgttctgttaaccagcacctaaatctatttttccatcttcccttcctcttatcaaaagttgtaataagaaatttcaggcttcaaatatttaagcctaaaaaaacagcttttatttctaaatccaactgtactttttccccatttcattttcattatgcatataacaaattatgaaggagaaagagaagtagatttgtcatggcaaaaatatacagaaacaactttaaaactacagtaaaaagtaaattgaattttcgagtaaccatatcccagattatcagaaagcagaggcaaaaagcaacatgtcaaagtgacaaatccaccaattagtattatttacaaacccaagtgcaaaagtatccaagtaatctagaaaagtggattatatgggttagttaaaaccacacctcaaaatttgttactaataatggcggcagcagcggcaataattattgattaatcctcccacacctaacctcaaaatctattctacacgtggagctacacaaactaaagaaccaacatcaatttccatacaactttatagaaataccttacagcaaaagaaaccattcttctattatgcccatccttgctaggtacaccgggtataacagaagaaaacatgtaagtcagaaagttgagtcctccctgtcccttccccatctccagaaaatcaaaatttaataaagttcaaataccatacctccagttcagaaaaatttattgctttctaccccactattctgtacaggctattcaagtgtgtggccctcctgatcccaggtttacttctatttctctacatttatgccagagacacaacattaaaaaaagtaaaaagatgactcctgctactttctcctctctctctcaaatacctttttatatcaactcttaaacatacagggtttttttttttttgtcttttctgagacagagtcttgctctgtcccccaggcaggagtgcagcagtggcactatctcggctcactgcaacctccgcctcctgggttcaagcaattctcctccctctacctcccgagtagctgtgattacaggcgcctgccaccatgcccggctattttttgtatttttagtagagacggggtttcaccatgttggccaggctggtctcaaactcctgatcttgtgatccactcgcctcggcctcccaaagtgctgggattacaggtgtgacccaccatgctgggccacatgcaatttttatactcctatggctctgaagaaattgccttccttccctgaaacttctaccatacaagctcctctggatacctgtaaattaagttcaaccacccaatactacaatacataaatcctaaaagggtcaacaaaatactcctccatgttaacacagaccaacagttctcaacaggagtgattttgccccccagaagtcatttgacattcttgattgtcacaacttggaaagaagtggggacttgctgctggtatctactgggtagacagaaggatgctgatacacatctaacaattcagaagacagcctgtcacaaagaattatctagtctaaaagatcagcagtgctgaggttaaaaactcctgccatatactttgttttctcatatagcattcatgtctttctcttctaccagactaataatcttttaacagcagaaacatgttacctgaatgtagcagagctatggctgaatccatcattgcacagaattatggacaagtagattataatgccttattttgcaagtaaaattaaactaagaacacaataaattactttaaaatatgtacattccctggattcttataatctagcatcaagtagccagccttagcaacaaatcagtggttttcaaattggtcatgcaatcagtaattctagtaattaacaaaaacaattaaaataccagaaaaaggtggaaagaaataccaagtgtgtaaaggcaaaaacaggagtgattttgggggtgacagattttggtataatgagggggggaactggtattttccaaatgttctaaaatcaggagctattaactataagaaaatacctaattctaaaaaaacttctaacagaaacttgaattcttagttctaccaagaaaatacaccattgagaggaaccaaaatccttataagaaatgtaggaggcaaaggcaagacaacagagaatggaaacattccatcaaggcaacaataatcaaagaaatatagagaagacagctaatctgtaacataggcaacacttccattaaccatcaacattaacaatgctgcttcaaattattaataactgtttccattattatctacagaaacaccatttttttccttcttacccatcatcactagccctgatgctaatcaagttagccaaggcatggtaggtagaaagtacaaaggatggatgtggtctctgaacaacataaataacacaaagatttagcaggatctataaaataaactgctgattcctccctacccacattttttcaattaaaaaacttgggccaggcgcggtggctcatgcctgtactcctagcattttgggaggctgaggcgggcgaattgcctaagctcaggagttcgagaccagcctgggcaacacagtgaaacgccgtctctactaaaacacaaaagaaattagccgggagtggtggcaggcacctgtaatcccagctactcgggaggctgaggcaggagaatcacttgaaactgggcggcaggggttgcagtgagcccagatcgcgccactgcactccagcctgggcaacagagcaagactccatctctacaaaaaaaaaaaaaaaaaacttggaacaattgtattacaggtaacacagagagtcaactggctctccaatgaaaataagtcattaagcgaacaaagtaaggagactctgggtacaactataacaaaagtagtacctagaaattaacatttccggaagcaacaccccatctacggattacgcatgctttttttgtacgtgtatttgaattgcttaacctttcttacactaatgccactctatcacctaaaaaaaaacaaaaacaaaaaaacacttatcccagcaagatgggtaacagtgagttatatggtgaatggtgtaatacaaaaaacaaatgtgaataagagattctaatttaatactagtaaaccctaactcaagaagtgtatcaggacactacagtggtataaaaaaacgagcacacacacacaaaaagtcttatctttcctactctagaaaggttggccctgaatcttgttagttgtaaaaatctagccttcaagctcagtaccacagctgagatgaaccaaatagaaaatgaagattaattatgatcattaatcaatgtgaggtttcagtttttaagaacaccaaaacagtagtacagtctggaacgttcctgtcatcaagtctcaaaattttaagtcacttttaagtccttccctcatagtcaccaaattcccagaaattcagcaatgtcaaatttggaatctgatccagaagaggctgcttagtcctaactcttctcagcaaagcccctacctccaaagccttccacattgaagatttcttttttttttctttttgagaccgagtctcactctgacacccaggatggagtacagtgacgcgacttcagctaactgcaacctccacctcccggtttcaagtgattctcctgcctcagcctccctagtagctgggaccacaggcgtgtgccaccacacccggctaatttttgtatttttagtagagacagggtttcaccatgttggccaggctggtctcgaactcctggcctcgggtgatccgcccgcctcagcctcccaaaatgctgggatcacaggcatgatccaccgcacctggcctaaagatttcttaattataaagtcttctttacaataagccaaaatctacttccttaaataaacctatttctttcccccaaatgacagcatttcatatacctggcacacaagcacatgactcagttgttttctatgcttggctaatcattgcttccctgataatggcaaactaaagtacctccaagaaatactgacaagtgtcactgaagagtgacattctaacacaatactgtaaacgcagactgaaacaggagtctagaataaactggagcttattactaattttccacttctagacaccataccactcttacatattgtctgtgttaccctaggttatttggcaaccacacattactgacaccacagcttgttaaactagtgtaaatacttaactttagtcaattccatcttggtagatataaactttctatctcaggctatcaaaagtttttcagatcctgacggtcatccaaggcatttatcactgaatggagattcaagttaccaaacgtatcatgaacagtccaactacactttcaattcttgataaaaactagaatacaacctacagcataccactatggcctttcatttctctttccaaaatctccgatctttctcctttctattgctgccaccctcctcctggcctttattgtctttattcaaataatcttcattattcagccacttacaacatgccacccacatcagggctcaaaaagggggtggggggtgctatgcagcttagcccagtatgaactaactcctggcactgactttattacaagttttatttccacaaaacactgcttcaactagattcaccttttttcttcactgtgctgctcaaacctctttattgcaaagccttctctgacaaccctaatccagtctcccttcatccttcctttacgctttgcaccactggattccactgtaacagtagtctttcatgttctataaactctctaagaacctgtatatctgaagtaaaagttttcatgctaaacacactatttgctaaattattattaaaatatctctgaacctaccttgtcaactacattcatcaaaatggctgttcatgaggccgaagcaaatggatcactgaaggtttggagtttgagaccagcctggtcaacaaactaaaaatacaaaaaaaaaaaaaaaaaaaaaaaagggccgggtgcggtggctcatgcctgtaatcccagcattttgggaggccgatgtgggcggatcacgaggtcaagaatttgagaccagcctggccaatatggtgaaaccccatctctactaaaaacacaaaaattagccaggcgtggtggtgctcacctgtagtcccagctactcgggaggctgaggcagaagaatcgcttgaacctgggaggcggaggctgcagtgagccgagatcatgccactgcaatccagcctgggcaacaaggcgagattcatatcaaaacaaaacaaaattagtcaggcatggtggcgggctcctgtagtcccagctactcgggaggccgaggcagcagaatctcctgaacccaggagacagaggttgcagtgagctgagatagcgccgctgtgctccagcctcgttgagagtgaggatttgtctcaaaaaaaaaaaaaagctgtatacacatcatgacagtatacataaccaatctggtgactaaaaccatcagaaccatcagagctattaaaataacttgtgggccgggcactgtggctcacgtctgtaatcccagcactttgggaggctgagacaggcggatcacgaggtcaggagatagagaccatcctggctaacacggtgaaaccccgtctctactaaaaatacaaaaaaattagccgggtgtggtggcaggcgcctgtagtcccagctactcggaggctgagtcaggagaatggcgtgaacccaggaggtggagcttgcaatgagccgagatcgtgccactgcactccagcctgggcaacagagcgagactccatctcaaaaacaaacaaacaaacaaaaaaaatcgtaacgtgcaaacagatttcatctattccaatgcttgtacatagacattattagcatttcatcaggatatttccgttatttaagattgtcatggaattgcagcatcaccagccttgggctccaattccagcaacataccacacaaatacataaacacacctgcctgcccttcttcatggtctttaaatcaacatgtctatttccaaacaacccctaggtaggtaagggaagaaagcatcatcacctactaatttaccttaatcacagggcagtaagtagcacagaattgtaaatggaggctattaaaacagcaaatggtccatgagttacataagaatattagagagcactggtcagcaagtcaggttatttatccaacacctactacataatggggcacagttctaaatgttagggaaaaaggaaaaatatatacatattctaatgggaaaagacatgtaaataatttacaaagtcaaaaaataattacaagctcatccaagcaaaatctattttatcattcttagaatactgtcatgggggcaactgggtggtaaggtgctcaatgtcaccctacctgaaaagaaagcatcagtcataaatgggctgctttcaacccctacgaaagcagaacagcagaaggcagccttaaaatgataatggccatggcttggctgggcacggtggctcacgcctgtaatcccagtactttgggaggctgaggcgggcaaatcacttggggtcaggagttcgagaccagcctggccaacatggcaaaacgccatctctactaaaaatacaaaaatcagccaggcgtggtggcacacacctgtaatcccagctactcagtggctgaggcagaactgcttgaacccaggaggcagagggtgcagtgagctgtgatcgcaccactgccctccagcctgggtgacaaagcatgactgtgtctccaaaaaaaaaaaaaaaaggccatggcttaaagaaggcgaaacatggctaaaagggtaattaaaaggaagagtggggaaagaggtaagaaggaacttgtctggatagggccttgtttgtaagtcatttttcagcacaggaatgctgtgatctaattgatgttgccaaatataaagggcaacagaaggcagtgagactagctaagtttcttcagtagtctgaatggtacaaatggtaccttagactaactagggtagtagcagcgaagaagataaaaagtgttagatgctaaaatattttggcaacagataggacctacttccttaactcttttaacactacctaaaccactacataatttaaagttatcaggctacctggtgacgtaacttgtacagttggcttaaattgttatgtctaacaatagggacctcagctaaagaaacctggcatcaaactagggctgggatgtttagctgtatggcctcaggcaagtctatttctttctactacctggcagaaagggttgttgaggctgaatttaaaggtgataacgtagcatctaacaaagctcctgtcccttaacaagcactcaagtagtagctattaatcaccttttcacaagtttagatcatgcttccctagctagattatcatcatttacaaatggatttttttcattccccaaaatgaaggtagatgttggctagaatcagggtcatttaagaaacttgaagttgctttcaattaacttcatgcctcttcaactgttaacatcaattaacccatttttataagtccacatacaaatataaagtctacagtactatttaacctagagaaactattcattgctgtatcagtattaaaagacaatgccaaatacctaaaactatttcaacctaaggtattcctccagacactcaaaagagaaacagaggtgcttcaatcttgtctgatctataaataatgcaaaggaggcatgaggcactttcccaacatttagttatatataactagaatgacacttcaattaaaaactcactttggatagaactgtaacaagtagaatctcaaaatgtaacacagtagagatagcttccaaagtatgcgcccttgaggaacatacttaggaaaggggtattcatgtccgcaaatgaatacaaagtggcaaaaaacatccaaaaaaacttgagatttgtattttctctagaatgtttcaattacttcactttctctaaaatctagttctttgttgtgctaaagcaaatctaccagatcctacccacagtaaagcatccttttaaaaaaaaagtaaacaatggccaggcgcagtggctcatgcctgtaatcccagcaatttgggaagccaaggcagtaagactgcttgaggccaagagttcaagactagcctggacaacatagtgagacaccacctctacaagtttaaaaattagcctagcaaggtggtgccctcatagtcctagctgctgaggaagctgaggcaggaggatcacgtaagcccgggagttcaaggttagtgagcattgatcatgacactgcactccagcaagggcaacagagtgacaacctgtctccgaaaacagtaataataattaaaaccgtttacttaaggccgggcgcggtggctcacacctgtaatcccagcactttgggaagccaaggcgggtgaatcacaaggtcaagagatcgagaccatcctggctaacacggtgaaaccctgtctctactaaaaaaatacaaaaaaaattagctgggtgtggtggtgggtgcctgtagtaccagctactcaggaggctgaggcaggagaatggcgtgaacccgggaggcagagcttgcagtgagccgagattgcaccactgcactccagcctgggcaacagagtgagactccatctcaaaaacaaataaataaataaataaataaataaataaaataaacaatttacttaaaagtaggctgggtgtggtggctcacacctgtactcccagcactttgggaagccgaggccgagactggggtcaggagtttgagaccagcctggccaacagggtgaaaccccatctctactaaaaatacaaaaatcagtagggcatggtggtgtgcacctgtaatcccagctactcagggggctgaaacagaagaatcacttgaacccagaaggcagaggttgcagtgagttgagatcacaccactgcaccccagcctgggcaacagagggagactccgtttcaaaaaaacttactaaaaagtcaaaaaaagcaaatgatggtatgaccaatatatcctactggctgtataccaatacctaccattggaaattttttttttccccctttttggttttttgagacagggtctctgttgcccaggctggagtgcagtggcatgatcacaggtcattgcagccttgacctcctgggaccacaggtgcacgctgcctggctaatctgttactttttggtacagatggggtctatgtttcccaggctggtttcaatcaatccttgcacctcagcctaccaaagtgctgggactacaggtgtgagcaaccacaccctgccaaaagtatcttttaaaagacaacaaaatgcaaagtctcctattaattagatagtacaaaataattatgcccccagaaaaggattcaaatcacaacagagaaacccagaaagaaatgtagaaagttttaggacaagggttaattcctacgccaatcaaaaagaatgcttatctatagaagtttctccattatatttaaaaactatattaataagactatattctaagcaacctacagcaatgcaattttataatttaacgtatttattaaacaaggcaattgtacaaatggaaacatttcctagtgtctactggcactcgaaatcactgttactaatggattataaaccatcttcctctaatgatgtatctttactgtaaagtttctggaaaacatctataaataagttatagtggtcacctaccataattggtacattttgacggcaagaattaggtaacctacgatgtcagtttaatgattctttttcataatgttaaaaaatggatgacaccactagctaaattctgcagtggtccctcagcacatacgggggactgattccaggaacccataccaaaatccatgaatgctcaactctcttaaatagcatagtgtttgcacataacctacgaacattctctcatacactggtgtgttgttttttttttttattgggttttttgggagtatcttcaatcctcagctagctgaaactgtgaatgcaggacccacagtagagagagcccactgtattagctttctgtagttatgatacctcattgcttactggatcattctgcattttcacttactgctactttattgctacttggcaaaaatattctactcttttataggagattaaaggattttgggacaggcaaggtggctcatgccagtaatccttgcactttgggaagccgaggtaggaggactgcttgagaccatgagttcaagaccaacctgccaggcacagtggctcatgcctgtcatcccagcactttgggaggccaaggcgggcagattacttgaggtctggagttcaagaccggcctggccaacataaccccatctctaccaaatatacaaaaattagtcaggtgtggtggtacgcgcctattatcccagctactcgggtggctgaggcaggagaattgcctgagcccaggaggcagagattacagtgagccaagatcatgcccacacactccagcgtgggtgacagagactttgtctcaaaaaacaaatcataaaaacaaactaaaggatttctaaggtacctctttctagagctctaaaatgcccctcccctcaaattgaactgctgaaactaaaattttgacaactcaaaggttaccagtaaatctgaattccctctaaaacacaaagcactcttttatgaagagaaaaatcagacatgatttgaaaatatctaaattctcaaattctctttgtaaaggcttatattctttcaagtaacataattttgtactgtttaacttccatcatactcaattatgcaaaccagtggggaatattcacacaacatagaaaaggaagacttggccgggtgcagtggcacacgtctgcaatcccagcactttgcggggctgaggcaggcatatcttctgaggtcaagagttcatgaccagcctggccaacatggtgaaaccctgtctctactaaaaatacaaaatttagccaggtgtggtgataaatgcctgtaatcccagctaccggagaggctgaggcaggagaatcgcttgaacctgggaggcggaggttgcagtgagccaagatcgcaccatggcactcctgctgtctaggtgacagagtgagattctatctcccaaaaaaaaaaaaaaaaaaaaaaagaaaaggaagacttatgagttttatttttctctttaaggcttgcttaaagtgataaacctcatggtaaaggaaggggtaaaactcaggagggagggaaaaaaaaatgagtctgaagattttaagtttgtctggaattacccacaggatacgtaagccagataaagcaaatttaacaaacatggcatagtgagctatcttgtacaaaagttctccccagtcgtgttgcttgatacattctatgggtttaaattagcccccaactcttcaactataaaatgcagaaaccacttctgtcacagaacttaataaaactagtttaaaggacttacataaactataatttaaaatattaaaatttctttctagccaggcgtggtggctcacgtctaaaatcccaggactttgggaggccgaagcgagtggatcaccggaggtcaggagttcgagaccagcctggccaacatggcgaaaccccatctctactaaaaatataaaaattagcctgagcgtggtggcaggcgcctataatcctagctactcgggaggctgaggcaggagaatcacttgaacctgaggggtggaggttgcagtgagccgaaatcatgccacttcagcctgggcaagagagagaaacttggtctcaaaaaaaaaagaaaagaaaaaagaaaaatttcctttttaaaaaagttggaaagattaccaggtccttacctaacatctggtatttttaaatcaaacattgccactcaccataaaatcttttgtttcatcaactagaaatgtatcacaatgtcttttgtgaattatttaagaaaaagagatggctcaggtatggccaggaagtatgagagctcttaccacagttacttttcttaatcttttcacattcctataaatttaaacaaacacacaaaaacgtcactaagccagatgtttataagaaccaattgctaggaattctaccatgccgccttttagatgctgaatcctatcaactatacatgcaaagaataacactacaatgcttgcacagtgatgtgggaaaaaaaaaacctgcctaaatcagtacttcaaaaaatgtttggtaaactcttaggcacactaagaaaaaaacttgatattaaagacagtgaacgtgaaaactgaaggggaaaaaaggacaacttaccagtttaacagcctcctgagctgcttcttttgtacaaaaagtgacaaacgcataacctctattgagaccagtgagtggatccatcattagacgaagatcccatataggtccagctttctcaaataatggaacaagttcatcctcaaatagatctcttgggatctttcccacaaatatctgtaaattaaatattaagtaaaaaccatggagaattgctttaggaaaccagatacctgtgcttttactacaaaaggtacaagtttttagttgctttacctcagtgccaacagaaggctgctgacctgaataaacggaatctggaggtggtcctccatacttcctctgtccagtggtcacatcaagtgtgtagcctgttctttccaagagtgccttgaaaagttcaaacgtcattaatacatttaattcactagaccacacccatatatttagcagttaacatccatcttgctcaaatctttccaattatcttggcatgttcccttataaaaacaggtttgtgatgtctgttttaaaatttccccttaaatgtgtacttgttatactcctaaattattatcagaagtccagggtcctgttcaaattactttctagtctccacttaattactgaatagtgtgcttaatggacaacaaaaagttaagaccaatccatcagcaactttcaagacaggatgtattactatgttaataccatcttaaaaaatgattgtacctaatttggttgagcatctttcaaatctggatctctcacccaataaattccctataaaccccactcctaggtacatactgccattctgggcattgtgccaacctcagaagaaattacacttcccataccaagtctagaaacttgggagctacagggaaaaaaaatctcctattattatttgacatttacgtgccatatttcatgggatagcatgggtccttcagaaaaaagtaacagccaaaacgacttttaaaaactttatgaaactgcaacgttacataacctctacattttaactcccaaaaagtaactgttaaaatttacacaactcatatttactcagagcattaggtgtttattccttattctaggcaaagtatagaaagaagtataggctgggtgcagtggctcacacctgtaatcccagcactttgggaggccaaggcgggtggatcaggacatcaggagctcaagaccagcctggccaagatggtgaaaccctgtctctactaaaaatacaaaaaattagccaggcgtggtggcacgcgcctgtaatgccagctactcaggaggctgaggcagagaactgcttaaacgcttaaacctggaggggcggaggttgcagtgagcggagatcgcgccactgcactccagcctggatgacagagcaagaccccatctcaaaaaaaaaaaaaaaaaaaaaaaaaaaaaggtacactcctccattatctgaaggaaaaagtcaagaattattccccttctccactgtctcaaccacaaagcacaaaagtggttttctaaacaaaaccaattttattagctaggacattctgaaataaaaacagactaatcctagctatctgacaaaatttatcaaaatgcataatctagggtcacctcagtctctgaaaattactggacagatttttaacattttctactcaaaggacactaactgtttatgaaaaatactgtaattaataaaaacattcataaacttgctcacatctataacataaactaaatgagtaatagctcatctttccattttctcacatgtaatccctatgctataaacggattttttaaccttaatagttaagacccaaataacactttttgtcaatccataaaaacaaaaaggaaaaacttattccctctgtcaaacttcctctaaaaatgtctctatgcctttttaccacaacttagctctcattgaaactgtaagcagccaggcatggtggctcacacctgtaatctcaggactttgggaggccaaggtgggtgggtcacgaggtcaagagattgagaccatcccggtcaacatggtgaaacctcacctctgctaaaaatacaaaaatcagctgggcctggtggcacccaccggtagtcccagctactcgggaggctgaggcaggagaattgctcgaacccgcgaggtggaggttgcagtgagccaagatcacgccactgcactccagcctgggtgacagagtaagactctgtctcccaaaaacaaacaaacaaacaaacaaaaaattaagccacccccttgcaaaaaaaactgaaagctaaaagtcacaaactaaaagtttaaaaactttagttctagctcaccaatgcaaacttgattacaactgaattacaatggagacaactatactccacttttatggaaaaactagatttacagatcaaactcaattcactcacagctagatctgtgaaagcctccaattcatggttgtcttaaacagctaactccatataccaaccttttccatattctaggctttccctgtttccacaccactacaacaatgctcaaggcctatacccttaactgattttcttaaaccatacgcttggctcaagagcactggcacactacaaagcacaccaggttaaaaagtaatacaatcaccacattgtctataaattagaaaactcaccaatataaatatcaaaaccaagctgaatttgaagccattcaccatgattttaaaccaaaaaaaaagcctcctcctcctagcctcagtttctcatctacatacccacactaaacaatcttattgtcaaagctgctttgagaaatagtctaataatccatactgatggaagtggagggcagcagggttaacattctaaattcattggggtttgagactcctaaaaaaaaaagccagttgccaaatgtacattctccatcagtatttcaactgtcaataagctggctttgcagcttttcaaaaaatattctagaggtatcatgggtgtgtttctttatactaggactaccaatagaacagatttaaacatcagtagctggataacatgataaacttcacagcaaattgctttagaaacaaatagtttaaaaaaacttaaaaaaaggaattaggaaagattgatgaattatctcaacatctaacatacatccatttcatacccaaggaatatttaccaaaattaggaaacagttaaaatgactttaaaactaaagggagtatagaaagacataccttaatttttgcctcatctggtcctttactagaatctgctactttggtcccttgtttttctctctgcctgtaagtcttcatgactccacataaaaaggcacttttgttctgcaaaaaaatgttccattaatatttaacaataaccatatctgagtctaataaaattcagcagatagtatcaaaactactcaaattttttaattttcacattgacattaacattacctgaacatgagagagatcactgtctttaaactgttgaagaactgccaatgcaccgtcttcattgaattcttttaaagcttcaatagctctttcatctaaatcactatgtgcaactagccctgaaaaaaataaaagttatcagcttttaatatttttagaaaagattttttagagaagactatgttggcaatacaggtacatgtgtgcctttacaattcttctactcccctcatctatacctgaaaaaaaaaaaacacacacttcagccactctgaactgaatcctgaactaaatatgccctaccaaccacacttacaataatcagctaacttcttttacatcttttatctccaaagtctgataactctgaacactacggtatttttacagtatacagacttacgaatcctagaatcaaccaacaaagtaccaagcatgacaactgaacctctactcaatttcaaataccaccagaaaaagttaacagccgcaccagaaagacaagaaaacaagtctacagttaccaagttatttaagaagaatcctactataaaaatactcaaaaaagtcacatggcctgttcccaacatttagcagctgttgctactatcatatacttatccatcaggccagcatgcaagccagcctttagctcctaaccttctcttcttccctccctctatacatcttaacctctacttcaaacttaaattaaccaactatcacaacaagcaaaactccagtacccacacttattggaaaccacaaaaagttgctattttagctcaaagccagaaatccaatagaaaaatttcataatgtaattttgcaagtgttagttcttacctgcaacgtaaatttcatctagtttttcagcaactttctgtggtaaaccagcatcaagcaatgtctgaaaattttctgaatggataactgcagaagtagtatccatgggctcttcagtaccatttccattaacatgttctgtagccatgtttccagagatctgttcaaacgcaataagcaaaattaaactaggatcttcaaaaagaatacaagacaatatgagagccccatctttactttctctaccatttactacaccagctagcctatacctccctttaaaaaagccttacagtcactatcgcctgacaagccagatttggagcacagggcacagaaggaccgattcaccatattcttcctcagcaccacccctgactcacctgctaacactccctaggaaaaaccatattacaaatagagcccaatcagcacgggtacgagccagcgtgccacatgcagctgtgcccgttcggaaaatgaggtgtgtgtggagaaagcaaaactgggctcctctctctcaaagataaacccccaaagtgcgcgcttttcccgcctgccgcttatagatcggtaacaacagccagcgaagaacaaagcgctcatacaagccaccttcccaccacccaatttctccaccctttaaccccgcaccccaaagcccgcccctgactccgcacccagagcggcagtctcaccactgcggccgccaggagcccattagaaacacgtgctctgcgccttccaatgtcctacaacttccttcaacggcaacccaacgaatcccaaaccaagacgaccatcactggttcccaacatcaacccgaagccgcggtcggagcccccagaaagctgcagcagcacaatctctcccctgaacaccgaggcaccggcggcgccaggccacaggctctccccgccccccagcgccgccgtctccgccgtgacacatggctctccgcccctggcgctccccgggcgccgacgacccccggccgcccgcccggccgagacgtgacccgtggcgcgctgtgcaggtccccaccccttacccttccgtgcagtgactgcgacgcctgcccggcaacccagcagcgtgagggcgttcagcggacggctcaacgcccgcgggaccgtgagcaccgcccaagctcgccgcacggctgcaggacaagacccactcctctccgcccactcccgcgccgcggcgaccgccacgacagcaccaactctgaagccgctcgcggtccgtgcgggccacgggaccgtggaggcgcctcctcccaaagcgccgcagacaaagcccgaaccgcagcagcacatggaaaggaggaagtggcggcgcgggccgcggcctactcccaggcagccccagtcaacgtgctcttctccccattggaatccattttccagaaaagccggtttctacccgcgccaccctcccccagctcactccacaatgtcatggagctcccctcccacacccaggttctggcagtcgttacctccccgttgggctgaggcggagaaatcctgtccgatggtatcgggttgcgggaaacgcgtgctcgctgctccctgtgtccggcgcgagtggagctgttgtaaaatggcggccgaagctcacgccg

SEQ ID NO: 2063 - DNA, 35107 bp, Homo sapiens
  source 1..35107: mol_type = genomic DNA
taatttccaaaatggtttattaggacttctcccacactcaaagtcaaacttccaggactgttctgaaatgatgaaagcttcttttcgataatcaatataaatgttgttaatccaaaatagaaactaaaacctgcactaagtgacctaaaaagtcttgtcctgatggaagtggccaaaactgctcgtcccgcaaccaagaaatcctaggggtataagctaaaacccacaaatatattggcaagtccccgattctttccaaattaccactaactttatcaaatccaatggcaagtacgggacaacagaatatttccatcaaaaattaagaccagcctaatacatttattctattcatcttccagtaatgtgattgcaactgaggatatcttgaggaatttttcaccattggctagttacttcgaatgtatggataatcaaagggcgacagacctctaaagattccaagtgtctacttaaaagctgttaagtgaagagtgatgaattggaggacacccacaataattcttggactcctggagatcctaagacatgctacaaaaataggtctttattcttaggaaaatatagtcagagctagcttccttatgctatacataaaatcttaacatcagaggcagtacagatagtacagatagtttttgaactgatctccaaacaagcacaaacccactacgttgaaaagaacaggtaatttgaggtttttggcaaaagacagtacttcacacatctaatccaaatcaaagggcctgcagacagttttcagtgagatgaaaggaatgaaataaatataaattctacggataaataaaacacaatttaaataagctaacagaactaatttttttaaataaaaatactagtcaggtacaagcttttgtttctcaatgccagacttctaaatatttaccagactactgttaatattaaaaacctaatctttgacccagagcgttagtaataatactggtttgcatctgcaaattttcaaactgaatgcttctggtcctgaaaaatattttaggtgtattactgaaggcagactgtggtgctaatagaatttaagtcttaaatacttttaaaaagtgacagaccccaaaagtccatctactaatttgctagttaaaaaatgcctgtgagcactgcttcataattagcatcttaagaaaagtagtggcatgccctattgagtggtatcatcactgagtaattaatacaccttaaaacaatatccccacaagtctgtttcttttatgtatttgtcacttaatttctttagtcattaattttacacccaccagtgaattcctatggccagatgaaaattttgtggtatacataattagagagaaaatgatcatggtgggtattcctgtaagtttgacgaacttgagaagttttagcaccctcccctaaatgcatgaagcccttctatttaatttctctccttaaaatagagactacgtaaaatactctgtaataataagggatcttttgctgtttctgacaacttttggcttcgcagtcaaaaaagctgttctgaatgtgtcaatttttgcctatctagcttgatgttcattctattctttaaaaacttttatatacaataactcagatcaccccatcaatccatttctatgttgttcctattttatcatgaggaaactttacattttaagtcagattcacagtaactggtagaaaagtttcttaagctaaaaactgcaatcatgagtgtacaacagttgtgtgtgtgcacactcaattttcccttcatttttaacatctgattcagtggcaatggctgaaaaccttccacaaaaagcatgcttgggagaatatatctaacaaaattttctcacaaagcaactttctgaaaactgataacctaaatttatgatcacttttgattgccaagtagtctgcagaaacaaaatcttgcgtctgttttggttagataacttaagttttctttttaacatcagaatgctttaagaatacattttttaccccaaggaagggacttgactcggatttaagaccctttccttgacaatatacaaaatttcttttaacttatcactgtccattctttgaagctgtcaaagccaagaacccataaacaaatcacaaatagcaataacctacattagttaacattccccctttaacatgttgacatttttactaaaggattagttatttttgcatttccatttctcatatcccatgacattccatataaattgcattattgctttataggccacacaacattcaaaagtatgtttatatgcattgcctgtttttccttgatctgataagactttgatactgattttactacagaaatttaagtttgaaaataccacagttagtatttcttctcagaacgttaattgttcacatcactaatcactacatgcatatttagctctgattatattgctcaaaaactgcacccattatcagaacagtgcaaatgatatttaattttaaaagtaattataatggcttgaattcaaagtcattcaaatgaacactgtcaagtaatttcacttgatgtgtatatatttcatcaccactgtttacattacccttctttaagtataaccatcaattcttcaatttctttttatcagtttccctcccaagtccccaaattaagaatgccaaatagtcttgaaaacccagagctccatattttaatgttttcttaagaacacatttgtgaactcacaaaagtgttcctctttcaactttgacaatgcagttcttactttaagtaaacaaacctgtcctaaaatcccaacaagtaattctgagaacttaaacaccttgacagtgtcccttaaaaatgctatgacagtaaagtgccaataggcatggcaatgacctcttagatgggatcatttaactcctcggaactgagaaatgccagcaccaaggattacactgagattcaattttactgaaggctacatttagtttacccactttccacaacctattatattcattatgttagaatgaaatgtaaatgttttgtgtagccctcaaacttacactaagttttgagagagatgtactttaaaaaagcacggggtaatatataaaatcagtggcagaaagtttcattaagcaccaggaactaatttttgtcaccccatactcattttgtagataagtttcaataaccggcaaggcacatttacatatattccaatgaatacttattgacaaattttaaattacactctatgtcccagctatcccagtaactgacatacaacatactaaaatgatttatttagataacaaaaaaccaattaatgtgaaacatacaggctattggcaaccactattctaaaattatgtaagtacaaataaacatactgaaatgtgtgcaattctaagtttttaaaccagaagatttctacactaacacacatttatattaatgacacataaaaaaaataaaaactttattacaaaaataagttacactcgcctccagcttacagtataaaacaattttatttgcaggaatgcaaaatgattgtttgccatgagcattttgaacatatgacatgtctgattttcttgttaaatttgcatttactggggaactggtgtgtataaaaccttaattaagtataagctctgatcttcatcgtggtgcctattgggtatgtgatataactgcagtatccctttggggaaggggggaggggatttctttacaccaagtcctaatgaaactataattttcactttttactttaagctatcaacttaggacttggcaaaaaaatttttgagggtggttcaatagaggatgcttcaccactggacactcactgtcatcaaggtgctttagaaaattaaaaacatagcacaaatgattgtactctactctacaagttatcatgacctgcataagaaatggaaagctgattcacatgtttacagtgatcagcaggaagaaatgcactaatgaaacataccttttacctaaaaagctaaactacagccatatactaatttctatgatttatgaaaaaacttcaaaatatccaaatgtcaggcttcgctgtacaattgtcagttttagtctgactttttataaagggacactgcagtatttagtacaagttcggatgcacttttttgaacatctgatgtcttacaaaagtaacatcttgctaaactattatacatccaaataactacaatatctgaagaagcaaggctgctttttcagccacaaaatacgacaaaagcaaggcctgttatgatggtcatgaggaagtcttacaagcctctgaaactaaaggcaactaagaatgttacatttggtatattaaaatcttaccctcatatcatatttaacaagccttgcttttatctacaaagattttctatgtacagtacagacagggtatagttcaatcctctgctactgaggtagttaaccaacccttttaaaaaggttctgaaaagaaccactatctggaatgcctgactaaccagctctgatgattacacctgaaactgcatatctgaacacaattcaaaagtgatcactataaaaaagatatagacaatcatgattaaccttggtgagcagaaataaaatttaaggataccatcagtggcattcatctataccactgcaataaaatttaaatgcacaaattcaagagaatatttcaaaataccactgttgggatccttaatttaaaaaaggggaaaaatctacttagagcagatttttaaaagaactttattctttattaagataccatgctaggagttatgaaggatttctgttggaacacattttgaaaatagagtagctttagtttaataacttgcactgcagagaaaattgttaaagaaattcatatcaaagtccaagtattagttcaatgtcccgtatttgattccatgatcttcataggaaggtcttctgcaatagaatatgctcctatacagccgacatatttaaggttgcttgatttccttaccattactccactgcaagcttctggtgtaatcccacatagcaagtcagtcttcattgtaacaggtcaggaccggcctcgaccccttttccctgctagccaggtaacaaaaggaatcagttagataaatcatcttaaattaataatgtgtacatacataatgataacattaaaaagacaagccttaacatggtaattctaaatatactgtctagccaaaaaagttgcctttaataactatgaacttctttttgcttgttttttacttgctttgaggtttttggttgcttttttgcccctttgagtgaggaggctggactgaggtttgaaaaccccattttgttcacaaactgattttatttaaaaaaaaaaaaagactaacaggaaacctaaatgaagtcacaccttaaagttacccattaacttgcaagtaattcccatttttgagacatgaagtaatcataaaatatgctgaaagcaaacatctcagacttgtttgaccttgagatttgaaatttagtgacatttttaagaaagtttgtctttcaagtcatgtatttttcacatgtaactttattgtcaggtataatacctttaaattcaagggtgatggaggttcagaagtggggagtggctgttaaaccttttcactgttgacctagagtctgtcccccaaaactctaacattttcccatcattactgttagaagtatagaccatatggccaaaacaagactaaaatgtgaaacaaaaatccaaactattagatctttaatacaaaccagtctgtgaggtaaattttatccttcagatatatatttgcttacccaaaactaactgtaaagctgttttatttttaattaggtaagtacagtgattatttagagtgcaactcacaaattacccaaacctattcccattgttttcacactagagtttctttgctgctttctagtcccatggtgtgcaaaacagtcaagagggcaatatactcaatctgagttttaggttagttaggataaactttaggcaactgaaagtggacttgtcagtgtgacctgcaaaccctttgagactacctgaatttgtccttttatacagttcattcatcacaattaagaactctaaaatacttaccaacttaaacttactacatgtattatctttttatttttgatgggaacatgaagtctgttgtaaaatagcactttaaaccagaagcagaaaactgcaataaatcagtgttgtgtaatgtgcagacatattccacacaagaattaacaaggcacaaaaccctttaattggccttgacatgctatacaatttgaaccaaatttgcaggaaattttgtgaaaaacgaattgtaaacacaattttagtaagtatacatttaggtgtgaattttttattgaaataaacaacagcataaagaatacaagtagccaaaatggttttgaaaacccaaattaggtcaaagttctaaattaaaaatagcagttgtgtatcaatttaccttattctagcaatttaagttggtaacatacaaagttattctgatacaagatattaaagacacacttggttttaatcaactacctttgaagacaccaaatctaaacactactggaaacatcgttgacactacagccaaatggacttgagccaaattttctcaagcacaaatgcaaactcattaactatttctttcagtatctaagaatatctttattgaaaaaaattaaaaataaaatcagttcgccagaagcagttagaagtgtggctttgttcgtgtccaagcggattgttaaaatatatacataaagggaaatcttgccagatgtcacaaattatagcggcacccgttcagatttagggtgagtttctgatcaacctatcagtctccaattttacagaggccctactgtttctacttccactgttgcccaaaagtatcctgataaaactcctggttttcagatttgtaaccatagttaccagaatgatcaccaccttggagcggttgctgagcaatgggttgggagccccagttctgattattggtctggcgccgcttggaatctggctggttgtacccatcagctttgcgctttcctcctacatttccaccgcggccacccctcgcaccacgtaccccgcggcctctttgttgttgggcacctcctctcgcacctcgaacgcctcttgctgatccaggacctcctctctgtgaataaccggctctaccgcggggaggagcagccccacgacctctggatggagcagcaccccttgctcctctaccaccccttcctctagctccaacttgaaaatcttcataaccatagtatggatcttcatatccaccacgatagttatggtaatcataaccataataatcataataatcttcatatccataataatctggaggatatccataaccacctctacctccacgccctcgacctcttgttggagggggcatatgaggtggaccataatagtagtaatcgtcatacctattaaaaaagagacagagattagagtttaaatcaaattacttagttaacaagtaggcatttagccatttgtaacagtttaaatccagagtttacttcgcataattcacataactttaatacagaattatttgtactagattaagttttagtagtagtaatgatcagaggatcaggatgacaatataggcatcccaaaataccacaaatctctagttatgaaccttatttatttcttcatgatcttcaaaatctcccaataaacctgttacagaatttttacaattgatttagctgtcaaatttgccactttagggctgggagcggtcatgcctgtaatcccagctatgcgggaggctgagtgaagcaggtgaatcgcttgaacccaggtggcggaggctgcagtaagccaaggtcacatcactgcactccagcctgggtgacagagcgagactctgactcaaaaaaaaatttgtcactttgaattgcatttctgctaagattctattccaatatacttgaagaacatttattacaaaagcaaaatggcaagtaggacaagcacacaaccaaaatgtgtgaagttcaaagtttactacagtaaattagcataaagaccttaaagttttcctgtttctacaataatgctatccaagtaaaatttaaaagatctgctactttcccaaaaataaactacaccgtaactatagtgctgaactttaaccactaaacaggtataactttagttgtcaaagtgattagaaagcaaccacacaaatcagcatatgcttacatactatgtaaaaggactaaacgaagttacaatattccaactcatgttccctacagtacaattttatacaattccttaaaacttagtgattattttgagcccaataatcccatgaaatatggaaattaatccctcttgaaggaataatttactcgtgttttttattccgtacctgttatgttattttatttatttatttatttgagacacagtcttgctctgtcacccaggctgcaatgcagtggcgcaatctcacctcactgcaacctccacctcctgggttcaagtgattctcctgccacagcctctcgagtagctgggactataggcatgtgccaccatacctagccaatttttatttttagtagagatggggtttcaccatgttggccaggctggtctcgaactcctaacctcgaatgatccacccacctcggcctagagtgatctgcccacctcagcctcccaaagtggtgggattacaggcatgagccaccacgcccggccttattttatcctgaattattaaaggcccctgttccaactgactaacgtaaaaatgttattccggttcactaggtccttagaccttttatgtgctctgctggtttattgttttgaggaaatgatggaaagatcatccttttctatttctaaatagttctcaccagggataattttgccaccacctctttccagggggacattttagacggtcataactgagaaagggggtgctactggcatctagcaggaagaggccaaggatgctgctaaaagtcctacaacgcacagggcagcccccaagaccaagaattatccagcccaaaatgtcaggaggacagagatgagaaatcctggtatagtggttaagagggaaaattatgggagactagactaccttagttcaaatccaactccactacttactatgtgaatgaccccaaggaagttgacttctgagcctcagtttcctcatttcaaactaagggatagagtacctaactcacaggaatacagtgagaattatgtaggaatacgtgcttagttaaaacttaaaaaaaaaaaaaaaaagactgtagcaagttaaagtacgaaagtaacatgcaatcatcccttttagtttgtactccttttcaaatattaacagatatactgacatcctccaccttctatttagtatctccctctatcaagtaccaaatgtaactgctctaatcacattatctaatataatctcctatacttacattctactttaataaattaaccatatatcgtcttctgaaagaaataaaaagaagttattttacactgtttagtatatccaggtgtttgaaatatagagcattaaaactaactctttttgtagtcttccttcatttacactatcatcaaacctacaaagtatattttctttggtcccagaacaagcatgggtcacttggataatcacataatccagagctattacataattttgtctgatcccattttagaactgaagaaattgaggttcagagcttgccaacttgtccaactggacaattaactgcagaaactagaacttgatcaattccctgattatgaagtaacagaaatatgtagaagcatcctcttcctttaaattccaaacagggcaatcaacagaaaattaaccttgaatagtattgacagtgattattgctctcacattcaagaacaattacccctcttctaggaaatcagtaactaactttttaggagctaacttcaattcttacccaactaagtttccttcagtcttaagcagatacctatttacagattctctaaaaaggtctccctaattagtataactcattacacacctacttgttttcttattgcactactgtgttataattttaatactcatttcattttcaaaatccatccatcgaacatgaaatttttggggtggcaatgagcactactggtgaagaaacagtctatcatgaatagagatttagtatttcctatctctcagagaaaaaactctccaccctttaacaaaatgtattaagatatttggacagctaatatttaagacattttcagaagaacattctgtaaaatacaaagaaaatatgtgagataggccaggcatggtggctcacagctgtaatcccagcactttgggaggcagaggtgggcggatcacctgaggtcaggagtttgagaccaacctggccaacatgacgaaaccccacccctactaaaaaaaaaaacacaaaaattaccaggcatggtggcgcctgtaacccagctactcagaagactgaggcaggagaatctcttgaacccgggaggtggaggttccagtgagccgaaagagtgccactgcactccagcctgagtgacaaagtgagactctgtcacccaatacaaaacaaaaaaaaagctagacagatttttcatcttgccaatttaccaaaattccagttatttacaattctgattattttcacaaatatggttcatagtaagagttcaataaacacttagatcactggtgtttccctatgactctcaaacgttcaagtcttctttaaagagatgttatgcatttaacaagtctgatcaacacctgttattttccaattagtgtataaatattaaaatttatacaatttttaagtatacaaatttcactcacatttgattttttgctgcttgcctctgagcttttctttctttccttttctgatctggtggcttggcaaaaacaatttcaatattttctccctccaagtctttgccattcatttcttccatagccttaaaaaattagataagtcaatataaaaataggactttcatacaattatgattcatttaaagttggaatatcatttatcattaatgtgggaaggacaagagaaagccccatgcaggcagtcaaataattttatttaaagatgcagatattcaattatttttcatttttacttagaaaactgccaacatcactaaaaccaaaaggttttagtttgaatggattccatggacttccaaagtctcctccaatttgtaaaactattttgagattctaaaatgactaaatttgttagtctgatttagatgcctgtaattccaccatatttaccttgacagcaccatctcgctcatcaaaatgaatgaacgcataatcttttaacttcttcactcgttccagtttcccaaactgactaaatgccttttctaaaatctcttctgttacagtattggcaaggttgcgtacaaacagcacttttacctagggggaagaaaatacccccctgtattatttccaaagagttccatttctaagataccaccaccccaccctacaaagttaactcaaatcacaatccattagaagaatgtcagaatataaaaaaaaaaaaagttttcaactccttgggtaaatatcaagcagcagaactgctggatcatgttgaaagacctgaaatagatgctttgccaaaaaagatatacagatggcaaagaatctcatgaagatgctcaatataatctgtcattcggaaaccgcaagtcaaaactattagaatggccaaaatccaacacactataaatgcaggtaagaatgcagagcaatagaaactctcattcattgctggtgggaatgcaaaagggtatagcccctttgaaagacagtttggcgatttcttacaaaactaaacacacacttccatatgacccagcaatcctgctccttatttacccagagttgaaaacttacatgcacacaaaaacttagagagagatgttaatagcagctttatttgtaactgccaaaaatttgccagacgcagtggctcacacccgtaatcccagcaatttgggaggctgaggcgggcagatcacctgaggtcaggagctcgagaccagcctggccaacacagtaacaccccgtctctacaaaaatacaaagattagccgggtgcgatggtacgcaactatggttccagctactcgggaggctgaagcatgagaaatggttgaacccaagaggcagaggttgcagtaagccgagatcgtgccactgcactccatcctgggtaacacagcgagactctgtctcaaaagaaaaacaaaaaaatttccaaaaattggaagaaaccaagatgttcttcaatgggagaatggacaattgtggcacatacagaaggaatattataactgatagaaactagttaaaagccacaaaatgacatagaagaactttaaatatgtattactaagagaaagaagccaatgtgaaggttacataatgtatggttccaactatgtaacattctgagaaggcaaaactatggagacagtgactgccagtggttgaatggggagggatgactaagcacaggacagaggatttttagggcagtgaaactattctgtataatactatgatggaaacacggttatacatttctccaaacccacagaacatacatctagagtgagacctcatgtaaactatggactttaggtaatcaatctacgtccatcaattttaacaaatgtactattccagtgcaggatactggtagtgaggaaggctgtgcctgtgtagggggcagaagtcatatggcaattctgtgctttctgctgtaaacctaaaactgctctaatgaagtctatgaaaaagaaaatgcagactacaggctacatcagtaataattaccaattagtaattattttgcaataaaaaagataatttttcctaacaaagtaaataccatgccctctaagagagttattgaatgtttaacacttaacaagagtggccaaaactaattaggacctgcttttgaaatcttaaagggggaaggactgttcaaaatattagtaagacaaactgttctcaatcctgaaagcttctcaaagtaaaattacaaaatttaacctcttcactaacattatcacttcctcctaaaataacttgaataccatctgaatgtgttaatctaaagtgctaacccaatgagaatttataggccagaggaaaaatgaatcctaactattttctcttctctaagaccacttatccttcaataatattcatagctccctggcagttcatattaccctcaatttaactcaactagtggtgtctgacacctaacctgtaagtaacaaagagggaattcttaaaagacaaaggataactggggcatggtggctcatgcctgtaatcccagcattttgggaagcaggattgcttaaggctaagaattgtaagaccggcctgggcagcacagggagattaactctgcctctacaaaattttttaaaaaaattagccaggtgtggtagtacacacctgtagttctagctacttgggaggctgaggtgagaagatctcttgagcttggggctacagtcagctatgatcatgcccctgaactctagccctgggccacagatctagaccctgtcacttaaaaaaaaaaaaaaaaaaagagaacaaaggatagaacaaataactgcaaattactgcaccagtgtgtaataaagtgttgactcaagggatgtttattcttatacaatgtctccactgactgctgaagtcaggatacctaataatggctaaatgtaactgcaagcacctctgctgcggccagtataatttactgtttttagtagtaagacttttaaccccaaaaccatgtaaactaatggtgccattctcaaaaactcaaattgctcttaaaaaacacacaaaatggaagtcaactgtctacagcatgtaggcgacttcattacaagattgtgatggctatacaattatggctaagtatccacgcatcaatttctattttcactttgcaggcacatggtatttccagtgcgcactgcctagtcccgtagtaaagaacatttctcccaactctaaaaatatggtttaaaaaaaaatgtgtccagggccaggtgcaatagcctcacgcctctaaatcccagcactttggaaggccgaggtaggtggatcccgaggtcaggagttcgagaccagtctgaccaacatggtgaaaccccagctctactaaaaaaaacacaaaaattagccaggtgtggtggtgggagcctgtaattccagctacttgggaggcaggagaatcacttgaacccgggaggcggaggttgcagtgaaccaagatggcaccatggcactccagcctgggaaacatgggaaacaagagactcttgtctcaaaaaataaaaaaatgtatactgttcattttatgttccccccaccccaaccccggcccttctcccattaatccctcaaaaaatatttttaacttgactatcattacctttgccataacctcaggatcaggatcttctataggatcagcccattcaacagttccaacattcccccagaccttgactttaccactcattaacctacgccttgcctgggcagctgttttgtgatcttcatattcaagaaagcaaaagcctctgttttttttcttgtcatccggttggtggtataaaatgacgtctgtaagaccctctgcaagtaagcaaccattccaggaaaattagatgaaataactagcaaatacaagtggatcaaaggatttatctaagatactacttaaatatcaaaatgaaaaatcatctctttccttcactagacatctttataaaagactatcaaaaactaggtccggattattttcctaatctgtttccaagtttttcaacacagaaatctccagaaaagaacatgtgctctttttagaggtaaggactacttttgttttcactaattagatcagagaggcagataaaaattttcatataattgttctaagaaaatggcagtatagatcaaatatggctatttttcttattatgcaaacactaaaattatttttaatggcacttttctggccttagatatcaatggctttatttcaaataaaatagaagttataagtactgcataaaaatttccaatgtcctgaaagttgataacaggctgataatttgttagacactgttggcagaccaaaatattttctaaaagcaacctgtcacttaaaagttgttacagttcaaaaaatttttttaccatgttgacaatatataaactctgtttatgggccaggcacggtggctcatacctgtaatcgcaacactctgggaggccgaggcaagcagatcacttgaggtcaggagtacaagaccagcctggccaatatggtgaaaccccacctctacaaaagacgcaaaaattagccaggtgtggtggtgcgcgcctgtaatcccagctactcaggaggctgaggcaagagaatcccttgaatctgggaggcagaggctgcagggagccaagatcacaccagcacactccagcctgggcaacaaagcaagactgtctccaaaaaaaaaaaaaaaaaaaaacactctgctacggcaatacttactactcctgtaatttcaagaacatcaaatcattattcaaacaattctactaagaacatcaactaacacctagagaaagaacacacaaagaaatacgatcttccaaaacataggaagaacaatgattttgcagaatgaattcaaaccctagctgtattccctactaacttgtacaacgtttggcaagttatttcccaaatccctgaatgcctgttcttcttatctgaaaaatggggttacctacacttcaaaagttgtagtgaggattcgatgagtcaataaatgtatttagaacaatgcatgacgcacagaaatatgctattaatcttcattattaaaagctgcacctcattccaaataaatccaacttacctgttactttgctaaattcttcaagaatctgttccttggttttactcttaggaatagagcccacaaaaagcctattgttggcaactgagatgcagacaccaatatgttttccagaacgaatttcatgattattatactgaaaggggaaaaagtgcatcatgtttttaaattacttatacaactagaacagttaattataaaagatacacaagagcaaatcatcctttaaaaagtagtttaccttaattcccatacaagggaattatgaggaacagattatattaacaagacccattggacaagttcatgaaccaatttaatgcaaataaaaggttattaaatcctttacttgattaattagaaatcagatctgcagcagcttaaattcaaaaactgccagttcctcaaaaacttaacttttacttaagttcatcccatcaaccagttattctcatacaaggaaaactgatcccaagatcagcaagatctctgccgttctgttaaccagcacctaaatctatttttccatcttcccttcctcttatcaaaagttgtaataagaaatttcaggcttcaaatatttaagcctaaaaaaacagcttttatttctaaatccaactgtactttttccccatttcattttcattatgcatataacaaattatgaaggagaaagagaagtagatttgtcatggcaaaaatatacagaaacaactttaaaactacagtaaaaagtaaattgaattttcgagtaaccatatcccagattatcagaaagcagaggcaaaaagcaacatgtcaaagtgacaaatccaccaattagtattatttacaaacccaagtgcaaaagtatccaagtaatctagaaaagtggattatatgggttagttaaaaccacacctcaaaatttgttactaataatggcggcagcagcggcaataattattgattaatcctcccacacctaacctcaaaatctattctacacgtggagctacacaaactaaagaaccaacatcaatttccatacaactttatagaaataccttacagcaaaagaaaccattcttctattatgcccatccttgctaggtacaccgggtataacagaagaaaacatgtaagtcagaaagttgagtcctccctgtcccttccccatctccagaaaatcaaaatttaataaagttcaaataccatacctccagttcagaaaaatttattgctttctaccccactattctgtacaggctattcaagtgtgtggccctcctgatcccaggtttacttctatttctctacatttatgccagagacacaacattaaaaaaagtaaaaagatgactcctgctactttctcctctctctctcaaatacctttttatatcaactcttaaacatacagggtttttttttttttgtcttttctgagacagagtcttgctctgtcccccaggcaggagtgcagcagtggcactatctcggctcactgcaacctccgcctcctgggttcaagcaattctcctccctctacctcccgagtagctgtgattacaggcgcctgccaccatgcccggctattttttgtatttttagtagagacggggtttcaccatgttggccaggctggtctcaaactcctgatcttgtgatccactcgcctcggcctcccaaagtgctgggattacaggtgtgacccaccatgctgggccacatgcaatttttatactcctatggctctgaagaaattgccttccttccctgaaacttctaccatacaagctcctctggatacctgtaaattaagttcaaccacccaatactacaatacataaatcctaaaagggtcaacaaaatactcctccatgttaacacagaccaacagttctcaacaggagtgattttgccccccagaagtcatttgacattcttgattgtcacaacttggaaagaagtggggacttgctgctggtatctactgggtagacagaaggatgctgatacacatctaacaattcagaagacagcctgtcacaaagaattatctagtctaaaagatcagcagtgctgaggttaaaaactcctgccatatactttgttttctcatatagcattcatgtctttctcttctaccagactaataatcttttaacagcagaaacatgttacctgaatgtagcagagctatggctgaatccatcattgcacagaattatggacaagtagattataatgccttattttgcaagtaaaattaaactaagaacacaataaattactttaaaatatgtacattccctggattcttataatctagcatcaagtagccagccttagcaacaaatcagtggttttcaaattggtcatgcaatcagtaattctagtaattaacaaaaacaattaaaataccagaaaaaggtggaaagaaataccaagtgtgtaaaggcaaaaacaggagtgattttgggggtgacagattttggtataatgagggggggaactggtattttccaaatgttctaaaatcaggagctattaactataagaaaatacctaattctaaaaaaacttctaacagaaacttgaattcttagttctaccaagaaaatacaccattgagaggaaccaaaatccttataagaaatgtaggaggcaaaggcaagacaacagagaatggaaacattccatcaaggcaacaataatcaaagaaatatagagaagacagctaatctgtaacataggcaacacttccattaaccatcaacattaacaatgctgcttcaaattattaataactgtttccattattatctacagaaacaccatttttttccttcttacccatcatcactagccctgatgctaatcaagttagccaaggcatggtaggtagaaagtacaaaggatggatgtggtctctgaacaacataaataacacaaagatttagcaggatctataaaataaactgctgattcctccctacccacattttttcaattaaaaaacttgggccaggcgcggtggctcatgcctgtactcctagcattttgggaggctgaggcgggcgaattgcctaagctcaggagttcgagaccagcctgggcaacacagtgaaacgccgtctctactaaaacacaaaagaaattagccgggagtggtggcaggcacctgtaatcccagctactcgggaggctgaggcaggagaatcacttgaaactgggcggcaggggttgcagtgagcccagatcgcgccactgcactccagcctgggcaacagagcaagactccatctctacaaaaaaaaaaaaaaaaaacttggaacaattgtattacaggtaacacagagagtcaactggctctccaatgaaaataagtcattaagcgaacaaagtaaggagactctgggtacaactataacaaaagtagtacctagaaattaacatttccggaagcaacaccccatctacggattacgcatgctttttttgtacgtgtatttgaattgcttaacctttcttacactaatgccactctatcacctaaaaaaaaacaaaaacaaaaaaacacttatcccagcaagatgggtaacagtgagttatatggtgaatggtgtaatacaaaaaacaaatgtgaataagagattctaatttaatactagtaaaccctaactcaagaagtgtatcaggacactacagtggtataaaaaaacgagcacacacacacaaaaagtcttatctttcctactctagaaaggttggccctgaatcttgttagttgtaaaaatctagccttcaagctcagtaccacagctgagatgaaccaaatagaaaatgaagattaattatgatcattaatcaatgtgaggtttcagtttttaagaacaccaaaacagtagtacagtctggaacgttcctgtcatcaagtctcaaaattttaagtcacttttaagtccttccctcatagtcaccaaattcccagaaattcagcaatgtcaaatttggaatctgatccagaagaggctgcttagtcctaactcttctcagcaaagcccctacctccaaagccttccacattgaagatttcttttttttttctttttgagaccgagtctcactctgacacccaggatggagtacagtgacgcgacttcagctaactgcaacctccacctcccggtttcaagtgattctcctgcctcagcctccctagtagctgggaccacaggcgtgtgccaccacacccggctaatttttgtatttttagtagagacagggtttcaccatgttggccaggctggtctcgaactcctggcctcgggtgatccgcccgcctcagcctcccaaaatgctgggatcacaggcatgatccaccgcacctggcctaaagatttcttaattataaagtcttctttacaataagccaaaatctacttccttaaataaacctatttctttcccccaaatgacagcatttcatatacctggcacacaagcacatgactcagttgttttctatgcttggctaatcattgcttccctgataatggcaaactaaagtacctccaagaaatactgacaagtgtcactgaagagtgacattctaacacaatactgtaaacgcagactgaaacaggagtctagaataaactggagcttattactaattttccacttctagacaccataccactcttacatattgtctgtgttaccctaggttatttggcaaccacacattactgacaccacagcttgttaaactagtgtaaatacttaactttagtcaattccatcttggtagatataaactttctatctcaggctatcaaaagtttttcagatcctgacggtcatccaaggcatttatcactgaatggagattcaagttaccaaacgtatcatgaacagtccaactacactttcaattcttgataaaaactagaatacaacctacagcataccactatggcctttcatttctctttccaaaatctccgatctttctcctttctattgctgccaccctcctcctggcctttattgtctttattcaaataatcttcattattcagccacttacaacatgccacccacatcagggctcaaaaagggggtggggggtgctatgcagcttagcccagtatgaactaactcctggcactgactttattacaagttttatttccacaaaacactgcttcaactagattcaccttttttcttcactgtgctgctcaaacctctttattgcaaagccttctctgacaaccctaatccagtctcccttcatccttcctttacgctttgcaccactggattccactgtaacagtagtctttcatgttctataaactctctaagaacctgtatatctgaagtaaaagttttcatgctaaacacactatttgctaaattattattaaaatatctctgaacctaccttgtcaactacattcatcaaaatggctgttcatgaggccgaagcaaatggatcactgaaggtttggagtttgagaccagcctggtcaacaaactaaaaatacaaaaaaaaaaaaaaaaaaaaaaaagggccgggtgcggtggctcatgcctgtaatcccagcattttgggaggccgatgtgggcggatcacgaggtcaagaatttgagaccagcctggccaatatggtgaaaccccatctctactaaaaacacaaaaattagccaggcgtggtggtgctcacctgtagtcccagctactcgggaggctgaggcagaagaatcgcttgaacctgggaggcggaggctgcagtgagccgagatcatgccactgcaatccagcctgggcaacaaggcgagattcatatcaaaacaaaacaaaattagtcaggcatggtggcgggctcctgtagtcccagctactcgggaggccgaggcagcagaatctcctgaacccaggagacagaggttgcagtgagctgagatagcgccgctgtgctccagcctcgttgagagtgaggatttgtctcaaaaaaaaaaaaaagctgtatacacatcatgacagtatacataaccaatctggtgactaaaaccatcagaaccatcagagctattaaaataacttgtgggccgggcactgtggctcacgtctgtaatcccagcactttgggaggctgagacaggcggatcacgaggtcaggagatagagaccatcctggctaacacggtgaaaccccgtctctactaaaaatacaaaaaaattagccgggtgtggtggcaggcgcctgtagtcccagctactcggaggctgagtcaggagaatggcgtgaacccaggaggtggagcttgcaatgagccgagatcgtgccactgcactccagcctgggcaacagagcgagactccatctcaaaaacaaacaaacaaacaaaaaaaatcgtaacgtgcaaacagatttcatctattccaatgcttgtacatagacattattagcatttcatcaggatatttccgttatttaagattgtcatggaattgcagcatcaccagccttgggctccaattccagcaacataccacacaaatacataaacacacctgcctgcccttcttcatggtctttaaatcaacatgtctatttccaaacaacccctaggtaggtaagggaagaaagcatcatcacctactaatttaccttaatcacagggcagtaagtagcacagaattgtaaatggaggctattaaaacagcaaatggtccatgagttacataagaatattagagagcactggtcagcaagtcaggttatttatccaacacctactacataatggggcacagttctaaatgttagggaaaaaggaaaaatatatacatattctaatgggaaaagacatgtaaataatttacaaagtcaaaaaataattacaagctcatccaagcaaaatctattttatcattcttagaatactgtcatgggggcaactgggtggtaaggtgctcaatgtcaccctacctgaaaagaaagcatcagtcataaatgggctgctttcaacccctacgaaagcagaacagcagaaggcagccttaaaatgataatggccatggcttggctgggcacggtggctcacgcctgtaatcccagtactttgggaggctgaggcgggcaaatcacttggggtcaggagttcgagaccagcctggccaacatggcaaaacgccatctctactaaaaatacaaaaatcagccaggcgtggtggcacacacctgtaatcccagctactcagtggctgaggcagaactgcttgaacccaggaggcagagggtgcagtgagctgtgatcgcaccactgccctccagcctgggtgacaaagcatgactgtgtctccaaaaaaaaaaaaaaaaggccatggcttaaagaaggcgaaacatggctaaaagggtaattaaaaggaagagtggggaaagaggtaagaaggaacttgtctggatagggccttgtttgtaagtcatttttcagcacaggaatgctgtgatctaattgatgttgccaaatataaagggcaacagaaggcagtgagactagctaagtttcttcagtagtctgaatggtacaaatggtaccttagactaactagggtagtagcagcgaagaagataaaaagtgttagatgctaaaatattttggcaacagataggacctacttccttaactcttttaacactacctaaaccactacataatttaaagttatcaggctacctggtgacgtaacttgtacagttggcttaaattgttatgtctaacaatagggacctcagctaaagaaacctggcatcaaactagggctgggatgtttagctgtatggcctcaggcaagtctatttctttctactacctggcagaaagggttgttgaggctgaatttaaaggtgataacgtagcatctaacaaagctcctgtcccttaacaagcactcaagtagtagctattaatcaccttttcacaagtttagatcatgcttccctagctagattatcatcatttacaaatggatttttttcattccccaaaatgaaggtagatgttggctagaatcagggtcatttaagaaacttgaagttgctttcaattaacttcatgcctcttcaactgttaacatcaattaacccatttttataagtccacatacaaatataaagtctacagtactatttaacctagagaaactattcattgctgtatcagtattaaaagacaatgccaaatacctaaaactatttcaacctaaggtattcctccagacactcaaaagagaaacagaggtgcttcaatcttgtctgatctataaataatgcaaaggaggcatgaggcactttcccaacatttagttatatataactagaatgacacttcaattaaaaactcactttggatagaactgtaacaagtagaatctcaaaatgtaacacagtagagatagcttccaaagtatgcgcccttgaggaacatacttaggaaaggggtattcatgtccgcaaatgaatacaaagtggcaaaaaacatccaaaaaaacttgagatttgtattttctctagaatgtttcaattacttcactttctctaaaatctagttctttgttgtgctaaagcaaatctaccagatcctacccacagtaaagcatccttttaaaaaaaaagtaaacaatggccaggcgcagtggctcatgcctgtaatcccagcaatttgggaagccaaggcagtaagactgcttgaggccaagagttcaagactagcctggacaacatagtgagacaccacctctacaagtttaaaaattagcctagcaaggtggtgccctcatagtcctagctgctgaggaagctgaggcaggaggatcacgtaagcccgggagttcaaggttagtgagcattgatcatgacactgcactccagcaagggcaacagagtgacaacctgtctccgaaaacagtaataataattaaaaccgtttacttaaggccgggcgcggtggctcacacctgtaatcccagcactttgggaagccaaggcgggtgaatcacaaggtcaagagatcgagaccatcctggctaacacggtgaaaccctgtctctactaaaaaaatacaaaaaaaattagctgggtgtggtggtgggtgcctgtagtaccagctactcaggaggctgaggcaggagaatggcgtgaacccgggaggcagagcttgcagtgagccgagattgcaccactgcactccagcctgggcaacagagtgagactccatctcaaaaacaaataaataaataaataaataaataaataaaataaacaatttacttaaaagtaggctgggtgtggtggctcacacctgtactcccagcactttgggaagccgaggccgagactggggtcaggagtttgagaccagcctggccaacagggtgaaaccccatctctactaaaaatacaaaaatcagtagggcatggtggtgtgcacctgtaatcccagctactcagggggctgaaacagaagaatcacttgaacccagaaggcagaggttgcagtgagttgagatcacaccactgcaccccagcctgggcaacagagggagactccgtttcaaaaaaacttactaaaaagtcaaaaaaagcaaatgatggtatgaccaatatatcctactggctgtataccaatacctaccattggaaattttttttttccccctttttggttttttgagacagggtctctgttgcccaggctggagtgcagtggcatgatcacaggtcattgcagccttgacctcctgggaccacaggtgcacgctgcctggctaatctgttactttttggtacagatggggtctatgtttcccaggctggtttcaatcaatccttgcacctcagcctaccaaagtgctgggactacaggtgtgagcaaccacaccctgccaaaagtatcttttaaaagacaacaaaatgcaaagtctcctattaattagatagtacaaaataattatgcccccagaaaaggattcaaatcacaacagagaaacccagaaagaaatgtagaaagttttaggacaagggttaattcctacgccaatcaaaaagaatgcttatctatagaagtttctccattatatttaaaaactatattaataagactatattctaagcaacctacagcaatgcaattttataatttaacgtatttattaaacaaggcaattgtacaaatggaaacatttcctagtgtctactggcactcgaaatcactgttactaatggattataaaccatcttcctctaatgatgtatctttactgtaaagtttctggaaaacatctataaataagttatagtggtcacctaccataattggtacattttgacggcaagaattaggtaacctacgatgtcagtttaatgattctttttcataatgttaaaaaatggatgacaccactagctaaattctgcagtggtccctcagcacatacgggggactgattccaggaacccataccaaaatccatgaatgctcaactctcttaaatagcatagtgtttgcacataacctacgaacattctctcatacactggtgtgttgttttttttttttattgggttttttgggagtatcttcaatcctcagctagctgaaactgtgaatgcaggacccacagtagagagagcccactgtattagctttctgtagttatgatacctcattgcttactggatcattctgcattttcacttactgctactttattgctacttggcaaaaatattctactcttttataggagattaaaggattttgggacaggcaaggtggctcatgccagtaatccttgcactttgggaagccgaggtaggaggactgcttgagaccatgagttcaagaccaacctgccaggcacagtggctcatgcctgtcatcccagcactttgggaggccaaggcgggcagattacttgaggtctggagttcaagaccggcctggccaacataaccccatctctaccaaatatacaaaaattagtcaggtgtggtggtacgcgcctattatcccagctactcgggtggctgaggcaggagaattgcctgagcccaggaggcagagattacagtgagccaagatcatgcccacacactccagcgtgggtgacagagactttgtctcaaaaaacaaatcataaaaacaaactaaaggatttctaaggtacctctttctagagctctaaaatgcccctcccctcaaattgaactgctgaaactaaaattttgacaactcaaaggttaccagtaaatctgaattccctctaaaacacaaagcactcttttatgaagagaaaaatcagacatgatttgaaaatatctaaattctcaaattctctttgtaaaggcttatattctttcaagtaacataattttgtactgtttaacttccatcatactcaattatgcaaaccagtggggaatattcacacaacatagaaaaggaagacttggccgggtgcagtggcacacgtctgcaatcccagcactttgcggggctgaggcaggcatatcttctgaggtcaagagttcatgaccagcctggccaacatggtgaaaccctgtctctactaaaaatacaaaatttagccaggtgtggtgataaatgcctgtaatcccagctaccggagaggctgaggcaggagaatcgcttgaacctgggaggcggaggttgcagtgagccaagatcgcaccatggcactcctgctgtctaggtgacagagtgagattctatctcccaaaaaaaaaaaaaaaaaaaaaaagaaaaggaagacttatgagttttatttttctctttaaggcttgcttaaagtgataaacctcatggtaaaggaaggggtaaaactcaggagggagggaaaaaaaaatgagtctgaagattttaagtttgtctggaattacccacaggatacgtaagccagataaagcaaatttaacaaacatggcatagtgagctatcttgtacaaaagttctccccagtcgtgttgcttgatacattctatgggtttaaattagcccccaactcttcaactataaaatgcagaaaccacttctgtcacagaacttaataaaactagtttaaaggacttacataaactataatttaaaatattaaaatttctttctagccaggcgtggtggctcacgtctaaaatcccaggactttgggaggccgaagcgagtggatcaccggaggtcaggagttcgagaccagcctggccaacatggcgaaaccccatctctactaaaaatataaaaattagcctgagcgtggtggcaggcgcctataatcctagctactcgggaggctgaggcaggagaatcacttgaacctgaggggtggaggttgcagtgagccgaaatcatgccacttcagcctgggcaagagagagaaacttggtctcaaaaaaaaaagaaaagaaaaaagaaaaatttcctttttaaaaaagttggaaagattaccaggtccttacctaacatctggtatttttaaatcaaacattgccactcaccataaaatcttttgtttcatcaactagaaatgtatcacaatgtcttttgtgaattatttaagaaaaagagatggctcaggtatggccaggaagtatgagagctcttaccacagttacttttcttaatcttttcacattcctataaatttaaacaaacacacaaaaacgtcactaagccagatgtttataagaaccaattgctaggaattctaccatgccgccttttagatgctgaatcctatcaactatacatgcaaagaataacactacaatgcttgcacagtgatgtgggaaaaaaaaaacctgcctaaatcagtacttcaaaaaatgtttggtaaactcttaggcacactaagaaaaaaacttgatattaaagacagtgaacgtgaaaactgaaggggaaaaaaggacaacttaccagtttaacagcctcctgagctgcttcttttgtacaaaaagtgacaaacgcataacctctattgagaccagtgagtggatccatcattagacgaagatcccatataggtccagctttctcaaataatggaacaagttcatcctcaaatagatctcttgggatctttcccacaaatatctgtaaattaaatattaagtaaaaaccatggagaattgctttaggaaaccagatacctgtgcttttactacaaaaggtacaagtttttagttgctttacctcagtgccaacagaaggctgctgacctgaataaacggaatctggaggtggtcctccatacttcctctgtccagtggtcacatcaagtgtgtagcctgttctttccaagagtgccttgaaaagttcaaacgtcattaatacatttaattcactagaccacacccatatatttagcagttaacatccatcttgctcaaatctttccaattatcttggcatgttcccttataaaaacaggtttgtgatgtctgttttaaaatttccccttaaatgtgtacttgttatactcctaaattattatcagaagtccagggtcctgttcaaattactttctagtctccacttaattactgaatagtgtgcttaatggacaacaaaaagttaagaccaatccatcagcaactttcaagacaggatgtattactatgttaataccatcttaaaaaatgattgtacctaatttggttgagcatctttcaaatctggatctctcacccaataaattccctataaaccccactcctaggtacatactgccattctgggcattgtgccaacctcagaagaaattacacttcccataccaagtctagaaacttgggagctacagggaaaaaaaatctcctattattatttgacatttacgtgccatatttcatgggatagcatgggtccttcagaaaaaagtaacagccaaaacgacttttaaaaactttatgaaactgcaacgttacataacctctacattttaactcccaaaaagtaactgttaaaatttacacaactcatatttactcagagcattaggtgtttattccttattctaggcaaagtatagaaagaagtataggctgggtgcagtggctcacacctgtaatcccagcactttgggaggccaaggcgggtggatcaggacatcaggagctcaagaccagcctggccaagatggtgaaaccctgtctctactaaaaatacaaaaaattagccaggcgtggtggcacgcgcctgtaatgccagctactcaggaggctgaggcagagaactgcttaaacgcttaaacctggaggggcggaggttgcagtgagcggagatcgcgccactgcactccagcctggatgacagagcaagaccccatctcaaaaaaaaaaaaaaaaaaaaaaaaaaaaaggtacactcctccattatctgaaggaaaaagtcaagaattattccccttctccactgtctcaaccacaaagcacaaaagtggttttctaaacaaaaccaattttattagctaggacattctgaaataaaaacagactaatcctagctatctgacaaaatttatcaaaatgcataatctagggtcacctcagtctctgaaaattactggacagatttttaacattttctactcaaaggacactaactgtttatgaaaaatactgtaattaataaaaacattcataaacttgctcacatctataacataaactaaatgagtaatagctcatctttccattttctcacatgtaatccctatgctataaacggattttttaaccttaatagttaagacccaaataacactttttgtcaatccataaaaacaaaaaggaaaaacttattccctctgtcaaacttcctctaaaaatgtctctatgcctttttaccacaacttagctctcattgaaactgtaagcagccaggcatggtggctcacacctgtaatctcaggactttgggaggccaaggtgggtgggtcacgaggtcaagagattgagaccatcccggtcaacatggtgaaacctcacctctgctaaaaatacaaaaatcagctgggcctggtggcacccaccggtagtcccagctactcgggaggctgaggcaggagaattgctcgaacccgcgaggtggaggttgcagtgagccaagatcacgccactgcactccagcctgggtgacagagtaagactctgtctcccaaaaacaaacaaacaaacaaacaaaaaattaagccacccccttgcaaaaaaaactgaaagctaaaagtcacaaactaaaagtttaaaaactttagttctagctcaccaatgcaaacttgattacaactgaattacaatggagacaactatactccacttttatggaaaaactagatttacagatcaaactcaattcactcacagctagatctgtgaaagcctccaattcatggttgtcttaaacagctaactccatataccaaccttttccatattctaggctttccctgtttccacaccactacaacaatgctcaaggcctatacccttaactgattttcttaaaccatacgcttggctcaagagcactggcacactacaaagcacaccaggttaaaaagtaatacaatcaccacattgtctataaattagaaaactcaccaatataaatatcaaaaccaagctgaatttgaagccattcaccatgattttaaaccaaaaaaaaagcctcctcctcctagcctcagtttctcatctacatacccacactaaacaatcttattgtcaaagctgctttgagaaatagtctaataatccatactgatggaagtggagggcagcagggttaacattctaaattcattggggtttgagactcctaaaaaaaaaagccagttgccaaatgtacattctccatcagtatttcaactgtcaataagctggctttgcagcttttcaaaaaatattctagaggtatcatgggtgtgtttctttatactaggactaccaatagaacagatttaaacatcagtagctggataacatgataaacttcacagcaaattgctttagaaacaaatagtttaaaaaaacttaaaaaaaggaattaggaaagattgatgaattatctcaacatctaacatacatccatttcatacccaaggaatatttaccaaaattaggaaacagttaaaatgactttaaaactaaagggagtatagaaagacataccttaatttttgcctcatctggtcctttactagaatctgctactttggtcccttgtttttctctctgcctgtaagtcttcatgactccacataaaaaggcacttttgttctgcaaaaaaatgttccattaatatttaacaataaccatatctgagtctaataaaattcagcagatagtatcaaaactactcaaattttttaattttcacattgacattaacattacctgaacatgagagagatcactgtctttaaactgttgaagaactgccaatgcaccgtcttcattgaattcttttaaagcttcaatagctctttcatctaaatcactatgtgcaactagccctgaaaaaaataaaagttatcagcttttaatatttttagaaaagattttttagagaagactatgttggcaatacaggtacatgtgtgcctttacaattcttctactcccctcatctatacctgaaaaaaaaaaaacacacacttcagccactctgaactgaatcctgaactaaatatgccctaccaaccacacttacaataatcagctaacttcttttacatcttttatctccaaagtctgataactctgaacactacggtatttttacagtatacagacttacgaatcctagaatcaaccaacaaagtaccaagcatgacaactgaacctctactcaatttcaaataccaccagaaaaagttaacagccgcaccagaaagacaagaaaacaagtctacagttaccaagttatttaagaagaatcctactataaaaatactcaaaaaagtcacatggcctgttcccaacatttagcagctgttgctactatcatatacttatccatcaggccagcatgcaagccagcctttagctcctaaccttctcttcttccctccctctatacatcttaacctctacttcaaacttaaattaaccaactatcacaacaagcaaaactccagtacccacacttattggaaaccacaaaaagttgctattttagctcaaagccagaaatccaatagaaaaatttcataatgtaattttgcaagtgttagttcttacctgcaacgtaaatttcatctagtttttcagcaactttctgtggtaaaccagcatcaagcaatgtctgaaaattttctgaatggataactgcagaagtagtatccatgggctcttcagtaccatttccattaacatgttctgtagccatgtttccagagatctgttcaaacgcaataagcaaaattaaactaggatcttcaaaaagaatacaagacaatatgagagccccatctttactttctctaccatttactacaccagctagcctatacctccctttaaaaaagccttacagtcactatcgcctgacaagccagatttggagcacagggcacagaaggaccgattcaccatattcttcctcagcaccacccctgactcacctgctaacactccctaggaaaaaccatattacaaatagagcccaatcagcacgggtacgagccagcgtgccacatgcagctgtgcccgttcggaaaatgaggtgtgtgtggagaaagcaaaactgggctcctctctctcaaagataaacccccaaagtgcgcgcttttcccgcctgccgcttatagatcggtaacaacagccagcgaagaacaaagcgctcatacaagccaccttcccaccacccaatttctccaccctttaaccccgcaccccaaagcccgcccctgactccgcacccagagcggcagtctcaccactgcggccgccaggagcccattagaaacacgtgctctgcgccttccaatgtcctacaacttccttcaacggcaacccaacgaatcccaaaccaagacgaccatcactggttcccaacatcaacccgaagccgcggtcggagcccccagaaagctgcagcagcacaatctctcccctgaacaccgaggcaccggcggcgccaggccacaggctctccccgccccccagcgccgccgtctccgccgtgacacatggctctccgcccctggcgctccccgggcgccgacgacccccggccgcccgcccggccgagacgtgacccgtggcgcgctgtgcaggtccccaccccttacccttccgtgcagtgactgcgacgcctgcccggcaacccagcagcgtgagggcgttcagcggacggctcaacgcccgcgggaccgtgagcaccgcccaagctcgccgcacggctgcaggacaagacccactcctctccgcccactcccgcgccgcggcgaccgccacgacagcaccaactctgaagccgctcgcggtccgtgcgggccacgggaccgtggaggcgcctcctcccaaagcgccgcagacaaagcccgaaccgcagcagcacatggaaaggaggaagtggcggcgcgggccgcggcctactcccaggcagccccagtcaacgtgctcttctccccattggaatccattttccagaaaagccggtttctacccgcgccaccctcccccagctcactccacaatgtcatggagctcccctcccacacccaggttctggcagtcgttacctccccgttgggctgaggcggagaaatcctgtccgatggtatcgggttgcgggaaacgcgtgctcgctgctccctgtgtccggcgcgagtggag

SEQ ID NO: 2064 - DNA, 33668 bp, Homo sapiens
  source 1..33668: mol_type = genomic DNA
taatttccaaaatggtttattaggacttctcccacactcaaagtcaaacttccaggactgttctgaaatgatgaaagcttcttttcgataatcaatataaatgttgttaatccaaaatagaaactaaaacctgcactaagtgacctaaaaagtcttgtcctgatggaagtggccaaaactgctcgtcccgcaaccaagaaatcctaggggtataagctaaaacccacaaatatattggcaagtccccgattctttccaaattaccactaactttatcaaatccaatggcaagtacgggacaacagaatatttccatcaaaaattaagaccagcctaatacatttattctattcatcttccagtaatgtgattgcaactgaggatatcttgaggaatttttcaccattggctagttacttcgaatgtatggataatcaaagggcgacagacctctaaagattccaagtgtctacttaaaagctgttaagtgaagagtgatgaattggaggacacccacaataattcttggactcctggagatcctaagacatgctacaaaaataggtctttattcttaggaaaatatagtcagagctagcttccttatgctatacataaaatcttaacatcagaggcagtacagatagtacagatagtttttgaactgatctccaaacaagcacaaacccactacgttgaaaagaacaggtaatttgaggtttttggcaaaagacagtacttcacacatctaatccaaatcaaagggcctgcagacagttttcagtgagatgaaaggaatgaaataaatataaattctacggataaataaaacacaatttaaataagctaacagaactaatttttttaaataaaaatactagtcaggtacaagcttttgtttctcaatgccagacttctaaatatttaccagactactgttaatattaaaaacctaatctttgacccagagcgttagtaataatactggtttgcatctgcaaattttcaaactgaatgcttctggtcctgaaaaatattttaggtgtattactgaaggcagactgtggtgctaatagaatttaagtcttaaatacttttaaaaagtgacagaccccaaaagtccatctactaatttgctagttaaaaaatgcctgtgagcactgcttcataattagcatcttaagaaaagtagtggcatgccctattgagtggtatcatcactgagtaattaatacaccttaaaacaatatccccacaagtctgtttcttttatgtatttgtcacttaatttctttagtcattaattttacacccaccagtgaattcctatggccagatgaaaattttgtggtatacataattagagagaaaatgatcatggtgggtattcctgtaagtttgacgaacttgagaagttttagcaccctcccctaaatgcatgaagcccttctatttaatttctctccttaaaatagagactacgtaaaatactctgtaataataagggatcttttgctgtttctgacaacttttggcttcgcagtcaaaaaagctgttctgaatgtgtcaatttttgcctatctagcttgatgttcattctattctttaaaaacttttatatacaataactcagatcaccccatcaatccatttctatgttgttcctattttatcatgaggaaactttacattttaagtcagattcacagtaactggtagaaaagtttcttaagctaaaaactgcaatcatgagtgtacaacagttgtgtgtgtgcacactcaattttcccttcatttttaacatctgattcagtggcaatggctgaaaaccttccacaaaaagcatgcttgggagaatatatctaacaaaattttctcacaaagcaactttctgaaaactgataacctaaatttatgatcacttttgattgccaagtagtctgcagaaacaaaatcttgcgtctgttttggttagataacttaagttttctttttaacatcagaatgctttaagaatacattttttaccccaaggaagggacttgactcggatttaagaccctttccttgacaatatacaaaatttcttttaacttatcactgtccattctttgaagctgtcaaagccaagaacccataaacaaatcacaaatagcaataacctacattagttaacattccccctttaacatgttgacatttttactaaaggattagttatttttgcatttccatttctcatatcccatgacattccatataaattgcattattgctttataggccacacaacattcaaaagtatgtttatatgcattgcctgtttttccttgatctgataagactttgatactgattttactacagaaatttaagtttgaaaataccacagttagtatttcttctcagaacgttaattgttcacatcactaatcactacatgcatatttagctctgattatattgctcaaaaactgcacccattatcagaacagtgcaaatgatatttaattttaaaagtaattataatggcttgaattcaaagtcattcaaatgaacactgtcaagtaatttcacttgatgtgtatatatttcatcaccactgtttacattacccttctttaagtataaccatcaattcttcaatttctttttatcagtttccctcccaagtccccaaattaagaatgccaaatagtcttgaaaacccagagctccatattttaatgttttcttaagaacacatttgtgaactcacaaaagtgttcctctttcaactttgacaatgcagttcttactttaagtaaacaaacctgtcctaaaatcccaacaagtaattctgagaacttaaacaccttgacagtgtcccttaaaaatgctatgacagtaaagtgccaataggcatggcaatgacctcttagatgggatcatttaactcctcggaactgagaaatgccagcaccaaggattacactgagattcaattttactgaaggctacatttagtttacccactttccacaacctattatattcattatgttagaatgaaatgtaaatgttttgtgtagccctcaaacttacactaagttttgagagagatgtactttaaaaaagcacggggtaatatataaaatcagtggcagaaagtttcattaagcaccaggaactaatttttgtcaccccatactcattttgtagataagtttcaataaccggcaaggcacatttacatatattccaatgaatacttattgacaaattttaaattacactctatgtcccagctatcccagtaactgacatacaacatactaaaatgatttatttagataacaaaaaaccaattaatgtgaaacatacaggctattggcaaccactattctaaaattatgtaagtacaaataaacatactgaaatgtgtgcaattctaagtttttaaaccagaagatttctacactaacacacatttatattaatgacacataaaaaaaataaaaactttattacaaaaataagttacactcgcctccagcttacagtataaaacaattttatttgcaggaatgcaaaatgattgtttgccatgagcattttgaacatatgacatgtctgattttcttgttaaatttgcatttactggggaactggtgtgtataaaaccttaattaagtataagctctgatcttcatcgtggtgcctattgggtatgtgatataactgcagtatccctttggggaaggggggaggggatttctttacaccaagtcctaatgaaactataattttcactttttactttaagctatcaacttaggacttggcaaaaaaatttttgagggtggttcaatagaggatgcttcaccactggacactcactgtcatcaaggtgctttagaaaattaaaaacatagcacaaatgattgtactctactctacaagttatcatgacctgcataagaaatggaaagctgattcacatgtttacagtgatcagcaggaagaaatgcactaatgaaacataccttttacctaaaaagctaaactacagccatatactaatttctatgatttatgaaaaaacttcaaaatatccaaatgtcaggcttcgctgtacaattgtcagttttagtctgactttttataaagggacactgcagtatttagtacaagttcggatgcacttttttgaacatctgatgtcttacaaaagtaacatcttgctaaactattatacatccaaataactacaatatctgaagaagcaaggctgctttttcagccacaaaatacgacaaaagcaaggcctgttatgatggtcatgaggaagtcttacaagcctctgaaactaaaggcaactaagaatgttacatttggtatattaaaatcttaccctcatatcatatttaacaagccttgcttttatctacaaagattttctatgtacagtacagacagggtatagttcaatcctctgctactgaggtagttaaccaacccttttaaaaaggttctgaaaagaaccactatctggaatgcctgactaaccagctctgatgattacacctgaaactgcatatctgaacacaattcaaaagtgatcactataaaaaagatatagacaatcatgattaaccttggtgagcagaaataaaatttaaggataccatcagtggcattcatctataccactgcaataaaatttaaatgcacaaattcaagagaatatttcaaaataccactgttgggatccttaatttaaaaaaggggaaaaatctacttagagcagatttttaaaagaactttattctttattaagataccatgctaggagttatgaaggatttctgttggaacacattttgaaaatagagtagctttagtttaataacttgcactgcagagaaaattgttaaagaaattcatatcaaagtccaagtattagttcaatgtcccgtatttgattccatgatcttcataggaaggtcttctgcaatagaatatgctcctatacagccgacatatttaaggttgcttgatttccttaccattactccactgcaagcttctggtgtaatcccacatagcaagtcagtcttcattgtaacaggtcaggaccggcctcgaccccttttccctgctagccaggtaacaaaaggaatcagttagataaatcatcttaaattaataatgtgtacatacataatgataacattaaaaagacaagccttaacatggtaattctaaatatactgtctagccaaaaaagttgcctttaataactatgaacttctttttgcttgttttttacttgctttgaggtttttggttgcttttttgcccctttgagtgaggaggctggactgaggtttgaaaaccccattttgttcacaaactgattttatttaaaaaaaaaaaaagactaacaggaaacctaaatgaagtcacaccttaaagttacccattaacttgcaagtaattcccatttttgagacatgaagtaatcataaaatatgctgaaagcaaacatctcagacttgtttgaccttgagatttgaaatttagtgacatttttaagaaagtttgtctttcaagtcatgtatttttcacatgtaactttattgtcaggtataatacctttaaattcaagggtgatggaggttcagaagtggggagtggctgttaaaccttttcactgttgacctagagtctgtcccccaaaactctaacattttcccatcattactgttagaagtatagaccatatggccaaaacaagactaaaatgtgaaacaaaaatccaaactattagatctttaatacaaaccagtctgtgaggtaaattttatccttcagatatatatttgcttacccaaaactaactgtaaagctgttttatttttaattaggtaagtacagtgattatttagagtgcaactcacaaattacccaaacctattcccattgttttcacactagagtttctttgctgctttctagtcccatggtgtgcaaaacagtcaagagggcaatatactcaatctgagttttaggttagttaggataaactttaggcaactgaaagtggacttgtcagtgtgacctgcaaaccctttgagactacctgaatttgtccttttatacagttcattcatcacaattaagaactctaaaatacttaccaacttaaacttactacatgtattatctttttatttttgatgggaacatgaagtctgttgtaaaatagcactttaaaccagaagcagaaaactgcaataaatcagtgttgtgtaatgtgcagacatattccacacaagaattaacaaggcacaaaaccctttaattggccttgacatgctatacaatttgaaccaaatttgcaggaaattttgtgaaaaacgaattgtaaacacaattttagtaagtatacatttaggtgtgaattttttattgaaataaacaacagcataaagaatacaagtagccaaaatggttttgaaaacccaaattaggtcaaagttctaaattaaaaatagcagttgtgtatcaatttaccttattctagcaatttaagttggtaacatacaaagttattctgatacaagatattaaagacacacttggttttaatcaactacctttgaagacaccaaatctaaacactactggaaacatcgttgacactacagccaaatggacttgagccaaattttctcaagcacaaatgcaaactcattaactatttctttcagtatctaagaatatctttattgaaaaaaattaaaaataaaatcagttcgccagaagcagttagaagtgtggctttgttcgtgtccaagcggattgttaaaatatatacataaagggaaatcttgccagatgtcacaaattatagcggcacccgttcagatttagggtgagtttctgatcaacctatcagtctccaattttacagaggccctactgtttctacttccactgttgcccaaaagtatcctgataaaactcctggttttcagatttgtaaccatagttaccagaatgatcaccaccttggagcggttgctgagcaatgggttgggagccccagttctgattattggtctggcgccgcttggaatctggctggttgtacccatcagctttgcgctttcctcctacatttccaccgcggccacccctcgcaccacgtaccccgcggcctctttgttgttgggcacctcctctcgcacctcgaacgcctcttgctgatccaggacctcctctctgtgaataaccggctctaccgcggggaggagcagccccacgacctctggatggagcagcaccccttgctcctctaccaccccttcctctagctccaacttgaaaatcttcataaccatagtatggatcttcatatccaccacgatagttatggtaatcataaccataataatcataataatcttcatatccataataatctggaggatatccataaccacctctacctccacgccctcgacctcttgttggagggggcatatgaggtggaccataatagtagtaatcgtcatacctattaaaaaagagacagagattagagtttaaatcaaattacttagttaacaagtaggcatttagccatttgtaacagtttaaatccagagtttacttcgcataattcacataactttaatacagaattatttgtactagattaagttttagtagtagtaatgatcagaggatcaggatgacaatataggcatcccaaaataccacaaatctctagttatgaaccttatttatttcttcatgatcttcaaaatctcccaataaacctgttacagaatttttacaattgatttagctgtcaaatttgccactttagggctgggagcggtcatgcctgtaatcccagctatgcgggaggctgagtgaagcaggtgaatcgcttgaacccaggtggcggaggctgcagtaagccaaggtcacatcactgcactccagcctgggtgacagagcgagactctgactcaaaaaaaaatttgtcactttgaattgcatttctgctaagattctattccaatatacttgaagaacatttattacaaaagcaaaatggcaagtaggacaagcacacaaccaaaatgtgtgaagttcaaagtttactacagtaaattagcataaagaccttaaagttttcctgtttctacaataatgctatccaagtaaaatttaaaagatctgctactttcccaaaaataaactacaccgtaactatagtgctgaactttaaccactaaacaggtataactttagttgtcaaagtgattagaaagcaaccacacaaatcagcatatgcttacatactatgtaaaaggactaaacgaagttacaatattccaactcatgttccctacagtacaattttatacaattccttaaaacttagtgattattttgagcccaataatcccatgaaatatggaaattaatccctcttgaaggaataatttactcgtgttttttattccgtacctgttatgttattttatttatttatttatttgagacacagtcttgctctgtcacccaggctgcaatgcagtggcgcaatctcacctcactgcaacctccacctcctgggttcaagtgattctcctgccacagcctctcgagtagctgggactataggcatgtgccaccatacctagccaatttttatttttagtagagatggggtttcaccatgttggccaggctggtctcgaactcctaacctcgaatgatccacccacctcggcctagagtgatctgcccacctcagcctcccaaagtggtgggattacaggcatgagccaccacgcccggccttattttatcctgaattattaaaggcccctgttccaactgactaacgtaaaaatgttattccggttcactaggtccttagaccttttatgtgctctgctggtttattgttttgaggaaatgatggaaagatcatccttttctatttctaaatagttctcaccagggataattttgccaccacctctttccagggggacattttagacggtcataactgagaaagggggtgctactggcatctagcaggaagaggccaaggatgctgctaaaagtcctacaacgcacagggcagcccccaagaccaagaattatccagcccaaaatgtcaggaggacagagatgagaaatcctggtatagtggttaagagggaaaattatgggagactagactaccttagttcaaatccaactccactacttactatgtgaatgaccccaaggaagttgacttctgagcctcagtttcctcatttcaaactaagggatagagtacctaactcacaggaatacagtgagaattatgtaggaatacgtgcttagttaaaacttaaaaaaaaaaaaaaaaagactgtagcaagttaaagtacgaaagtaacatgcaatcatcccttttagtttgtactccttttcaaatattaacagatatactgacatcctccaccttctatttagtatctccctctatcaagtaccaaatgtaactgctctaatcacattatctaatataatctcctatacttacattctactttaataaattaaccatatatcgtcttctgaaagaaataaaaagaagttattttacactgtttagtatatccaggtgtttgaaatatagagcattaaaactaactctttttgtagtcttccttcatttacactatcatcaaacctacaaagtatattttctttggtcccagaacaagcatgggtcacttggataatcacataatccagagctattacataattttgtctgatcccattttagaactgaagaaattgaggttcagagcttgccaacttgtccaactggacaattaactgcagaaactagaacttgatcaattccctgattatgaagtaacagaaatatgtagaagcatcctcttcctttaaattccaaacagggcaatcaacagaaaattaaccttgaatagtattgacagtgattattgctctcacattcaagaacaattacccctcttctaggaaatcagtaactaactttttaggagctaacttcaattcttacccaactaagtttccttcagtcttaagcagatacctatttacagattctctaaaaaggtctccctaattagtataactcattacacacctacttgttttcttattgcactactgtgttataattttaatactcatttcattttcaaaatccatccatcgaacatgaaatttttggggtggcaatgagcactactggtgaagaaacagtctatcatgaatagagatttagtatttcctatctctcagagaaaaaactctccaccctttaacaaaatgtattaagatatttggacagctaatatttaagacattttcagaagaacattctgtaaaatacaaagaaaatatgtgagataggccaggcatggtggctcacagctgtaatcccagcactttgggaggcagaggtgggcggatcacctgaggtcaggagtttgagaccaacctggccaacatgacgaaaccccacccctactaaaaaaaaaaacacaaaaattaccaggcatggtggcgcctgtaacccagctactcagaagactgaggcaggagaatctcttgaacccgggaggtggaggttccagtgagccgaaagagtgccactgcactccagcctgagtgacaaagtgagactctgtcacccaatacaaaacaaaaaaaaagctagacagatttttcatcttgccaatttaccaaaattccagttatttacaattctgattattttcacaaatatggttcatagtaagagttcaataaacacttagatcactggtgtttccctatgactctcaaacgttcaagtcttctttaaagagatgttatgcatttaacaagtctgatcaacacctgttattttccaattagtgtataaatattaaaatttatacaatttttaagtatacaaatttcactcacatttgattttttgctgcttgcctctgagcttttctttctttccttttctgatctggtggcttggcaaaaacaatttcaatattttctccctccaagtctttgccattcatttcttccatagccttaaaaaattagataagtcaatataaaaataggactttcatacaattatgattcatttaaagttggaatatcatttatcattaatgtgggaaggacaagagaaagccccatgcaggcagtcaaataattttatttaaagatgcagatattcaattatttttcatttttacttagaaaactgccaacatcactaaaaccaaaaggttttagtttgaatggattccatggacttccaaagtctcctccaatttgtaaaactattttgagattctaaaatgactaaatttgttagtctgatttagatgcctgtaattccaccatatttaccttgacagcaccatctcgctcatcaaaatgaatgaacgcataatcttttaacttcttcactcgttccagtttcccaaactgactaaatgccttttctaaaatctcttctgttacagtattggcaaggttgcgtacaaacagcacttttacctagggggaagaaaatacccccctgtattatttccaaagagttccatttctaagataccaccaccccaccctacaaagttaactcaaatcacaatccattagaagaatgtcagaatataaaaaaaaaaaaagttttcaactccttgggtaaatatcaagcagcagaactgctggatcatgttgaaagacctgaaatagatgctttgccaaaaaagatatacagatggcaaagaatctcatgaagatgctcaatataatctgtcattcggaaaccgcaagtcaaaactattagaatggccaaaatccaacacactataaatgcaggtaagaatgcagagcaatagaaactctcattcattgctggtgggaatgcaaaagggtatagcccctttgaaagacagtttggcgatttcttacaaaactaaacacacacttccatatgacccagcaatcctgctccttatttacccagagttgaaaacttacatgcacacaaaaacttagagagagatgttaatagcagctttatttgtaactgccaaaaatttgccagacgcagtggctcacacccgtaatcccagcaatttgggaggctgaggcgggcagatcacctgaggtcaggagctcgagaccagcctggccaacacagtaacaccccgtctctacaaaaatacaaagattagccgggtgcgatggtacgcaactatggttccagctactcgggaggctgaagcatgagaaatggttgaacccaagaggcagaggttgcagtaagccgagatcgtgccactgcactccatcctgggtaacacagcgagactctgtctcaaaagaaaaacaaaaaaatttccaaaaattggaagaaaccaagatgttcttcaatgggagaatggacaattgtggcacatacagaaggaatattataactgatagaaactagttaaaagccacaaaatgacatagaagaactttaaatatgtattactaagagaaagaagccaatgtgaaggttacataatgtatggttccaactatgtaacattctgagaaggcaaaactatggagacagtgactgccagtggttgaatggggagggatgactaagcacaggacagaggatttttagggcagtgaaactattctgtataatactatgatggaaacacggttatacatttctccaaacccacagaacatacatctagagtgagacctcatgtaaactatggactttaggtaatcaatctacgtccatcaattttaacaaatgtactattccagtgcaggatactggtagtgaggaaggctgtgcctgtgtagggggcagaagtcatatggcaattctgtgctttctgctgtaaacctaaaactgctctaatgaagtctatgaaaaagaaaatgcagactacaggctacatcagtaataattaccaattagtaattattttgcaataaaaaagataatttttcctaacaaagtaaataccatgccctctaagagagttattgaatgtttaacacttaacaagagtggccaaaactaattaggacctgcttttgaaatcttaaagggggaaggactgttcaaaatattagtaagacaaactgttctcaatcctgaaagcttctcaaagtaaaattacaaaatttaacctcttcactaacattatcacttcctcctaaaataacttgaataccatctgaatgtgttaatctaaagtgctaacccaatgagaatttataggccagaggaaaaatgaatcctaactattttctcttctctaagaccacttatccttcaataatattcatagctccctggcagttcatattaccctcaatttaactcaactagtggtgtctgacacctaacctgtaagtaacaaagagggaattcttaaaagacaaaggataactggggcatggtggctcatgcctgtaatcccagcattttgggaagcaggattgcttaaggctaagaattgtaagaccggcctgggcagcacagggagattaactctgcctctacaaaattttttaaaaaaattagccaggtgtggtagtacacacctgtagttctagctacttgggaggctgaggtgagaagatctcttgagcttggggctacagtcagctatgatcatgcccctgaactctagccctgggccacagatctagaccctgtcacttaaaaaaaaaaaaaaaaaaagagaacaaaggatagaacaaataactgcaaattactgcaccagtgtgtaataaagtgttgactcaagggatgtttattcttatacaatgtctccactgactgctgaagtcaggatacctaataatggctaaatgtaactgcaagcacctctgctgcggccagtataatttactgtttttagtagtaagacttttaaccccaaaaccatgtaaactaatggtgccattctcaaaaactcaaattgctcttaaaaaacacacaaaatggaagtcaactgtctacagcatgtaggcgacttcattacaagattgtgatggctatacaattatggctaagtatccacgcatcaatttctattttcactttgcaggcacatggtatttccagtgcgcactgcctagtcccgtagtaaagaacatttctcccaactctaaaaatatggtttaaaaaaaaatgtgtccagggccaggtgcaatagcctcacgcctctaaatcccagcactttggaaggccgaggtaggtggatcccgaggtcaggagttcgagaccagtctgaccaacatggtgaaaccccagctctactaaaaaaaacacaaaaattagccaggtgtggtggtgggagcctgtaattccagctacttgggaggcaggagaatcacttgaacccgggaggcggaggttgcagtgaaccaagatggcaccatggcactccagcctgggaaacatgggaaacaagagactcttgtctcaaaaaataaaaaaatgtatactgttcattttatgttccccccaccccaaccccggcccttctcccattaatccctcaaaaaatatttttaacttgactatcattacctttgccataacctcaggatcaggatcttctataggatcagcccattcaacagttccaacattcccccagaccttgactttaccactcattaacctacgccttgcctgggcagctgttttgtgatcttcatattcaagaaagcaaaagcctctgttttttttcttgtcatccggttggtggtataaaatgacgtctgtaagaccctctgcaagtaagcaaccattccaggaaaattagatgaaataactagcaaatacaagtggatcaaaggatttatctaagatactacttaaatatcaaaatgaaaaatcatctctttccttcactagacatctttataaaagactatcaaaaactaggtccggattattttcctaatctgtttccaagtttttcaacacagaaatctccagaaaagaacatgtgctctttttagaggtaaggactacttttgttttcactaattagatcagagaggcagataaaaattttcatataattgttctaagaaaatggcagtatagatcaaatatggctatttttcttattatgcaaacactaaaattatttttaatggcacttttctggccttagatatcaatggctttatttcaaataaaatagaagttataagtactgcataaaaatttccaatgtcctgaaagttgataacaggctgataatttgttagacactgttggcagaccaaaatattttctaaaagcaacctgtcacttaaaagttgttacagttcaaaaaatttttttaccatgttgacaatatataaactctgtttatgggccaggcacggtggctcatacctgtaatcgcaacactctgggaggccgaggcaagcagatcacttgaggtcaggagtacaagaccagcctggccaatatggtgaaaccccacctctacaaaagacgcaaaaattagccaggtgtggtggtgcgcgcctgtaatcccagctactcaggaggctgaggcaagagaatcccttgaatctgggaggcagaggctgcagggagccaagatcacaccagcacactccagcctgggcaacaaagcaagactgtctccaaaaaaaaaaaaaaaaaaaaacactctgctacggcaatacttactactcctgtaatttcaagaacatcaaatcattattcaaacaattctactaagaacatcaactaacacctagagaaagaacacacaaagaaatacgatcttccaaaacataggaagaacaatgattttgcagaatgaattcaaaccctagctgtattccctactaacttgtacaacgtttggcaagttatttcccaaatccctgaatgcctgttcttcttatctgaaaaatggggttacctacacttcaaaagttgtagtgaggattcgatgagtcaataaatgtatttagaacaatgcatgacgcacagaaatatgctattaatcttcattattaaaagctgcacctcattccaaataaatccaacttacctgttactttgctaaattcttcaagaatctgttccttggttttactcttaggaatagagcccacaaaaagcctattgttggcaactgagatgcagacaccaatatgttttccagaacgaatttcatgattattatactgaaaggggaaaaagtgcatcatgtttttaaattacttatacaactagaacagttaattataaaagatacacaagagcaaatcatcctttaaaaagtagtttaccttaattcccatacaagggaattatgaggaacagattatattaacaagacccattggacaagttcatgaaccaatttaatgcaaataaaaggttattaaatcctttacttgattaattagaaatcagatctgcagcagcttaaattcaaaaactgccagttcctcaaaaacttaacttttacttaagttcatcccatcaaccagttattctcatacaaggaaaactgatcccaagatcagcaagatctctgccgttctgttaaccagcacctaaatctatttttccatcttcccttcctcttatcaaaagttgtaataagaaatttcaggcttcaaatatttaagcctaaaaaaacagcttttatttctaaatccaactgtactttttccccatttcattttcattatgcatataacaaattatgaaggagaaagagaagtagatttgtcatggcaaaaatatacagaaacaactttaaaactacagtaaaaagtaaattgaattttcgagtaaccatatcccagattatcagaaagcagaggcaaaaagcaacatgtcaaagtgacaaatccaccaattagtattatttacaaacccaagtgcaaaagtatccaagtaatctagaaaagtggattatatgggttagttaaaaccacacctcaaaatttgttactaataatggcggcagcagcggcaataattattgattaatcctcccacacctaacctcaaaatctattctacacgtggagctacacaaactaaagaaccaacatcaatttccatacaactttatagaaataccttacagcaaaagaaaccattcttctattatgcccatccttgctaggtacaccgggtataacagaagaaaacatgtaagtcagaaagttgagtcctccctgtcccttccccatctccagaaaatcaaaatttaataaagttcaaataccatacctccagttcagaaaaatttattgctttctaccccactattctgtacaggctattcaagtgtgtggccctcctgatcccaggtttacttctatttctctacatttatgccagagacacaacattaaaaaaagtaaaaagatgactcctgctactttctcctctctctctcaaatacctttttatatcaactcttaaacatacagggtttttttttttttgtcttttctgagacagagtcttgctctgtcccccaggcaggagtgcagcagtggcactatctcggctcactgcaacctccgcctcctgggttcaagcaattctcctccctctacctcccgagtagctgtgattacaggcgcctgccaccatgcccggctattttttgtatttttagtagagacggggtttcaccatgttggccaggctggtctcaaactcctgatcttgtgatccactcgcctcggcctcccaaagtgctgggattacaggtgtgacccaccatgctgggccacatgcaatttttatactcctatggctctgaagaaattgccttccttccctgaaacttctaccatacaagctcctctggatacctgtaaattaagttcaaccacccaatactacaatacataaatcctaaaagggtcaacaaaatactcctccatgttaacacagaccaacagttctcaacaggagtgattttgccccccagaagtcatttgacattcttgattgtcacaacttggaaagaagtggggacttgctgctggtatctactgggtagacagaaggatgctgatacacatctaacaattcagaagacagcctgtcacaaagaattatctagtctaaaagatcagcagtgctgaggttaaaaactcctgccatatactttgttttctcatatagcattcatgtctttctcttctaccagactaataatcttttaacagcagaaacatgttacctgaatgtagcagagctatggctgaatccatcattgcacagaattatggacaagtagattataatgccttattttgcaagtaaaattaaactaagaacacaataaattactttaaaatatgtacattccctggattcttataatctagcatcaagtagccagccttagcaacaaatcagtggttttcaaattggtcatgcaatcagtaattctagtaattaacaaaaacaattaaaataccagaaaaaggtggaaagaaataccaagtgtgtaaaggcaaaaacaggagtgattttgggggtgacagattttggtataatgagggggggaactggtattttccaaatgttctaaaatcaggagctattaactataagaaaatacctaattctaaaaaaacttctaacagaaacttgaattcttagttctaccaagaaaatacaccattgagaggaaccaaaatccttataagaaatgtaggaggcaaaggcaagacaacagagaatggaaacattccatcaaggcaacaataatcaaagaaatatagagaagacagctaatctgtaacataggcaacacttccattaaccatcaacattaacaatgctgcttcaaattattaataactgtttccattattatctacagaaacaccatttttttccttcttacccatcatcactagccctgatgctaatcaagttagccaaggcatggtaggtagaaagtacaaaggatggatgtggtctctgaacaacataaataacacaaagatttagcaggatctataaaataaactgctgattcctccctacccacattttttcaattaaaaaacttgggccaggcgcggtggctcatgcctgtactcctagcattttgggaggctgaggcgggcgaattgcctaagctcaggagttcgagaccagcctgggcaacacagtgaaacgccgtctctactaaaacacaaaagaaattagccgggagtggtggcaggcacctgtaatcccagctactcgggaggctgaggcaggagaatcacttgaaactgggcggcaggggttgcagtgagcccagatcgcgccactgcactccagcctgggcaacagagcaagactccatctctacaaaaaaaaaaaaaaaaaacttggaacaattgtattacaggtaacacagagagtcaactggctctccaatgaaaataagtcattaagcgaacaaagtaaggagactctgggtacaactataacaaaagtagtacctagaaattaacatttccggaagcaacaccccatctacggattacgcatgctttttttgtacgtgtatttgaattgcttaacctttcttacactaatgccactctatcacctaaaaaaaaacaaaaacaaaaaaacacttatcccagcaagatgggtaacagtgagttatatggtgaatggtgtaatacaaaaaacaaatgtgaataagagattctaatttaatactagtaaaccctaactcaagaagtgtatcaggacactacagtggtataaaaaaacgagcacacacacacaaaaagtcttatctttcctactctagaaaggttggccctgaatcttgttagttgtaaaaatctagccttcaagctcagtaccacagctgagatgaaccaaatagaaaatgaagattaattatgatcattaatcaatgtgaggtttcagtttttaagaacaccaaaacagtagtacagtctggaacgttcctgtcatcaagtctcaaaattttaagtcacttttaagtccttccctcatagtcaccaaattcccagaaattcagcaatgtcaaatttggaatctgatccagaagaggctgcttagtcctaactcttctcagcaaagcccctacctccaaagccttccacattgaagatttcttttttttttctttttgagaccgagtctcactctgacacccaggatggagtacagtgacgcgacttcagctaactgcaacctccacctcccggtttcaagtgattctcctgcctcagcctccctagtagctgggaccacaggcgtgtgccaccacacccggctaatttttgtatttttagtagagacagggtttcaccatgttggccaggctggtctcgaactcctggcctcgggtgatccgcccgcctcagcctcccaaaatgctgggatcacaggcatgatccaccgcacctggcctaaagatttcttaattataaagtcttctttacaataagccaaaatctacttccttaaataaacctatttctttcccccaaatgacagcatttcatatacctggcacacaagcacatgactcagttgttttctatgcttggctaatcattgcttccctgataatggcaaactaaagtacctccaagaaatactgacaagtgtcactgaagagtgacattctaacacaatactgtaaacgcagactgaaacaggagtctagaataaactggagcttattactaattttccacttctagacaccataccactcttacatattgtctgtgttaccctaggttatttggcaaccacacattactgacaccacagcttgttaaactagtgtaaatacttaactttagtcaattccatcttggtagatataaactttctatctcaggctatcaaaagtttttcagatcctgacggtcatccaaggcatttatcactgaatggagattcaagttaccaaacgtatcatgaacagtccaactacactttcaattcttgataaaaactagaatacaacctacagcataccactatggcctttcatttctctttccaaaatctccgatctttctcctttctattgctgccaccctcctcctggcctttattgtctttattcaaataatcttcattattcagccacttacaacatgccacccacatcagggctcaaaaagggggtggggggtgctatgcagcttagcccagtatgaactaactcctggcactgactttattacaagttttatttccacaaaacactgcttcaactagattcaccttttttcttcactgtgctgctcaaacctctttattgcaaagccttctctgacaaccctaatccagtctcccttcatccttcctttacgctttgcaccactggattccactgtaacagtagtctttcatgttctataaactctctaagaacctgtatatctgaagtaaaagttttcatgctaaacacactatttgctaaattattattaaaatatctctgaacctaccttgtcaactacattcatcaaaatggctgttcatgaggccgaagcaaatggatcactgaaggtttggagtttgagaccagcctggtcaacaaactaaaaatacaaaaaaaaaaaaaaaaaaaaaaaagggccgggtgcggtggctcatgcctgtaatcccagcattttgggaggccgatgtgggcggatcacgaggtcaagaatttgagaccagcctggccaatatggtgaaaccccatctctactaaaaacacaaaaattagccaggcgtggtggtgctcacctgtagtcccagctactcgggaggctgaggcagaagaatcgcttgaacctgggaggcggaggctgcagtgagccgagatcatgccactgcaatccagcctgggcaacaaggcgagattcatatcaaaacaaaacaaaattagtcaggcatggtggcgggctcctgtagtcccagctactcgggaggccgaggcagcagaatctcctgaacccaggagacagaggttgcagtgagctgagatagcgccgctgtgctccagcctcgttgagagtgaggatttgtctcaaaaaaaaaaaaaagctgtatacacatcatgacagtatacataaccaatctggtgactaaaaccatcagaaccatcagagctattaaaataacttgtgggccgggcactgtggctcacgtctgtaatcccagcactttgggaggctgagacaggcggatcacgaggtcaggagatagagaccatcctggctaacacggtgaaaccccgtctctactaaaaatacaaaaaaattagccgggtgtggtggcaggcgcctgtagtcccagctactcggaggctgagtcaggagaatggcgtgaacccaggaggtggagcttgcaatgagccgagatcgtgccactgcactccagcctgggcaacagagcgagactccatctcaaaaacaaacaaacaaacaaaaaaaatcgtaacgtgcaaacagatttcatctattccaatgcttgtacatagacattattagcatttcatcaggatatttccgttatttaagattgtcatggaattgcagcatcaccagccttgggctccaattccagcaacataccacacaaatacataaacacacctgcctgcccttcttcatggtctttaaatcaacatgtctatttccaaacaacccctaggtaggtaagggaagaaagcatcatcacctactaatttaccttaatcacagggcagtaagtagcacagaattgtaaatggaggctattaaaacagcaaatggtccatgagttacataagaatattagagagcactggtcagcaagtcaggttatttatccaacacctactacataatggggcacagttctaaatgttagggaaaaaggaaaaatatatacatattctaatgggaaaagacatgtaaataatttacaaagtcaaaaaataattacaagctcatccaagcaaaatctattttatcattcttagaatactgtcatgggggcaactgggtggtaaggtgctcaatgtcaccctacctgaaaagaaagcatcagtcataaatgggctgctttcaacccctacgaaagcagaacagcagaaggcagccttaaaatgataatggccatggcttggctgggcacggtggctcacgcctgtaatcccagtactttgggaggctgaggcgggcaaatcacttggggtcaggagttcgagaccagcctggccaacatggcaaaacgccatctctactaaaaatacaaaaatcagccaggcgtggtggcacacacctgtaatcccagctactcagtggctgaggcagaactgcttgaacccaggaggcagagggtgcagtgagctgtgatcgcaccactgccctccagcctgggtgacaaagcatgactgtgtctccaaaaaaaaaaaaaaaaggccatggcttaaagaaggcgaaacatggctaaaagggtaattaaaaggaagagtggggaaagaggtaagaaggaacttgtctggatagggccttgtttgtaagtcatttttcagcacaggaatgctgtgatctaattgatgttgccaaatataaagggcaacagaaggcagtgagactagctaagtttcttcagtagtctgaatggtacaaatggtaccttagactaactagggtagtagcagcgaagaagataaaaagtgttagatgctaaaatattttggcaacagataggacctacttccttaactcttttaacactacctaaaccactacataatttaaagttatcaggctacctggtgacgtaacttgtacagttggcttaaattgttatgtctaacaatagggacctcagctaaagaaacctggcatcaaactagggctgggatgtttagctgtatggcctcaggcaagtctatttctttctactacctggcagaaagggttgttgaggctgaatttaaaggtgataacgtagcatctaacaaagctcctgtcccttaacaagcactcaagtagtagctattaatcaccttttcacaagtttagatcatgcttccctagctagattatcatcatttacaaatggatttttttcattccccaaaatgaaggtagatgttggctagaatcagggtcatttaagaaacttgaagttgctttcaattaacttcatgcctcttcaactgttaacatcaattaacccatttttataagtccacatacaaatataaagtctacagtactatttaacctagagaaactattcattgctgtatcagtattaaaagacaatgccaaatacctaaaactatttcaacctaaggtattcctccagacactcaaaagagaaacagaggtgcttcaatcttgtctgatctataaataatgcaaaggaggcatgaggcactttcccaacatttagttatatataactagaatgacacttcaattaaaaactcactttggatagaactgtaacaagtagaatctcaaaatgtaacacagtagagatagcttccaaagtatgcgcccttgaggaacatacttaggaaaggggtattcatgtccgcaaatgaatacaaagtggcaaaaaacatccaaaaaaacttgagatttgtattttctctagaatgtttcaattacttcactttctctaaaatctagttctttgttgtgctaaagcaaatctaccagatcctacccacagtaaagcatccttttaaaaaaaaagtaaacaatggccaggcgcagtggctcatgcctgtaatcccagcaatttgggaagccaaggcagtaagactgcttgaggccaagagttcaagactagcctggacaacatagtgagacaccacctctacaagtttaaaaattagcctagcaaggtggtgccctcatagtcctagctgctgaggaagctgaggcaggaggatcacgtaagcccgggagttcaaggttagtgagcattgatcatgacactgcactccagcaagggcaacagagtgacaacctgtctccgaaaacagtaataataattaaaaccgtttacttaaggccgggcgcggtggctcacacctgtaatcccagcactttgggaagccaaggcgggtgaatcacaaggtcaagagatcgagaccatcctggctaacacggtgaaaccctgtctctactaaaaaaatacaaaaaaaattagctgggtgtggtggtgggtgcctgtagtaccagctactcaggaggctgaggcaggagaatggcgtgaacccgggaggcagagcttgcagtgagccgagattgcaccactgcactccagcctgggcaacagagtgagactccatctcaaaaacaaataaataaataaataaataaataaataaaataaacaatttacttaaaagtaggctgggtgtggtggctcacacctgtactcccagcactttgggaagccgaggccgagactggggtcaggagtttgagaccagcctggccaacagggtgaaaccccatctctactaaaaatacaaaaatcagtagggcatggtggtgtgcacctgtaatcccagctactcagggggctgaaacagaagaatcacttgaacccagaaggcagaggttgcagtgagttgagatcacaccactgcaccccagcctgggcaacagagggagactccgtttcaaaaaaacttactaaaaagtcaaaaaaagcaaatgatggtatgaccaatatatcctactggctgtataccaatacctaccattggaaattttttttttccccctttttggttttttgagacagggtctctgttgcccaggctggagtgcagtggcatgatcacaggtcattgcagccttgacctcctgggaccacaggtgcacgctgcctggctaatctgttactttttggtacagatggggtctatgtttcccaggctggtttcaatcaatccttgcacctcagcctaccaaagtgctgggactacaggtgtgagcaaccacaccctgccaaaagtatcttttaaaagacaacaaaatgcaaagtctcctattaattagatagtacaaaataattatgcccccagaaaaggattcaaatcacaacagagaaacccagaaagaaatgtagaaagttttaggacaagggttaattcctacgccaatcaaaaagaatgcttatctatagaagtttctccattatatttaaaaactatattaataagactatattctaagcaacctacagcaatgcaattttataatttaacgtatttattaaacaaggcaattgtacaaatggaaacatttcctagtgtctactggcactcgaaatcactgttactaatggattataaaccatcttcctctaatgatgtatctttactgtaaagtttctggaaaacatctataaataagttatagtggtcacctaccataattggtacattttgacggcaagaattaggtaacctacgatgtcagtttaatgattctttttcataatgttaaaaaatggatgacaccactagctaaattctgcagtggtccctcagcacatacgggggactgattccaggaacccataccaaaatccatgaatgctcaactctcttaaatagcatagtgtttgcacataacctacgaacattctctcatacactggtgtgttgttttttttttttattgggttttttgggagtatcttcaatcctcagctagctgaaactgtgaatgcaggacccacagtagagagagcccactgtattagctttctgtagttatgatacctcattgcttactggatcattctgcattttcacttactgctactttattgctacttggcaaaaatattctactcttttataggagattaaaggattttgggacaggcaaggtggctcatgccagtaatccttgcactttgggaagccgaggtaggaggactgcttgagaccatgagttcaagaccaacctgccaggcacagtggctcatgcctgtcatcccagcactttgggaggccaaggcgggcagattacttgaggtctggagttcaagaccggcctggccaacataaccccatctctaccaaatatacaaaaattagtcaggtgtggtggtacgcgcctattatcccagctactcgggtggctgaggcaggagaattgcctgagcccaggaggcagagattacagtgagccaagatcatgcccacacactccagcgtgggtgacagagactttgtctcaaaaaacaaatcataaaaacaaactaaaggatttctaaggtacctctttctagagctctaaaatgcccctcccctcaaattgaactgctgaaactaaaattttgacaactcaaaggttaccagtaaatctgaattccctctaaaacacaaagcactcttttatgaagagaaaaatcagacatgatttgaaaatatctaaattctcaaattctctttgtaaaggcttatattctttcaagtaacataattttgtactgtttaacttccatcatactcaattatgcaaaccagtggggaatattcacacaacatagaaaaggaagacttggccgggtgcagtggcacacgtctgcaatcccagcactttgcggggctgaggcaggcatatcttctgaggtcaagagttcatgaccagcctggccaacatggtgaaaccctgtctctactaaaaatacaaaatttagccaggtgtggtgataaatgcctgtaatcccagctaccggagaggctgaggcaggagaatcgcttgaacctgggaggcggaggttgcagtgagccaagatcgcaccatggcactcctgctgtctaggtgacagagtgagattctatctcccaaaaaaaaaaaaaaaaaaaaaaagaaaaggaagacttatgagttttatttttctctttaaggcttgcttaaagtgataaacctcatggtaaaggaaggggtaaaactcaggagggagggaaaaaaaaatgagtctgaagattttaagtttgtctggaattacccacaggatacgtaagccagataaagcaaatttaacaaacatggcatagtgagctatcttgtacaaaagttctccccagtcgtgttgcttgatacattctatgggtttaaattagcccccaactcttcaactataaaatgcagaaaccacttctgtcacagaacttaataaaactagtttaaaggacttacataaactataatttaaaatattaaaatttctttctagccaggcgtggtggctcacgtctaaaatcccaggactttgggaggccgaagcgagtggatcaccggaggtcaggagttcgagaccagcctggccaacatggcgaaaccccatctctactaaaaatataaaaattagcctgagcgtggtggcaggcgcctataatcctagctactcgggaggctgaggcaggagaatcacttgaacctgaggggtggaggttgcagtgagccgaaatcatgccacttcagcctgggcaagagagagaaacttggtctcaaaaaaaaaagaaaagaaaaaagaaaaatttcctttttaaaaaagttggaaagattaccaggtccttacctaacatctggtatttttaaatcaaacattgccactcaccataaaatcttttgtttcatcaactagaaatgtatcacaatgtcttttgtgaattatttaagaaaaagagatggctcaggtatggccaggaagtatgagagctcttaccacagttacttttcttaatcttttcacattcctataaatttaaacaaacacacaaaaacgtcactaagccagatgtttataagaaccaattgctaggaattctaccatgccgccttttagatgctgaatcctatcaactatacatgcaaagaataacactacaatgcttgcacagtgatgtgggaaaaaaaaaacctgcctaaatcagtacttcaaaaaatgtttggtaaactcttaggcacactaagaaaaaaacttgatattaaagacagtgaacgtgaaaactgaaggggaaaaaaggacaacttaccagtttaacagcctcctgagctgcttcttttgtacaaaaagtgacaaacgcataacctctattgagaccagtgagtggatccatcattagacgaagatcccatataggtccagctttctcaaataatggaacaagttcatcctcaaatagatctcttgggatctttcccacaaatatctgtaaattaaatattaagtaaaaaccatggagaattgctttaggaaaccagatacctgtgcttttactacaaaaggtacaagtttttagttgctttacctcagtgccaacagaaggctgctgacctgaataaacggaatctggaggtggtcctccatacttcctctgtccagtggtcacatcaagtgtgtagcctgttctttccaagagtgccttgaaaagttcaaacgtcattaatacatttaattcactagaccacacccatatatttagcagttaacatccatcttgctcaaatctttccaattatcttggcatgttcccttataaaaacaggtttgtgatgtctgttttaaaatttccccttaaatgtgtacttgttatactcctaaattattatcagaagtccagggtcctgttcaaattactttctagtctccacttaattactgaatagtgtgcttaatggacaacaaaaagttaagaccaatccatcagcaactttcaagacaggatgtattactatgttaataccatcttaaaaaatgattgtacctaatttggttgagcatctttcaaatctggatctctcacccaataaattccctataaaccccactcctaggtacatactgccattctgggcattgtgccaacctcagaagaaattacacttcccataccaagtctagaaacttgggagctacagggaaaaaaaatctcctattattatttgacatttacgtgccatatttcatgggatagcatgggtccttcagaaaaaagtaacagccaaaacgacttttaaaaactttatgaaactgcaacgttacataacctctacattttaactcccaaaaagtaactgttaaaatttacacaactcatatttactcagagcattaggtgtttattccttattctaggcaaagtatagaaagaagtataggctgggtgcagtggctcacacctgtaatcccagcactttgggaggccaaggcgggtggatcaggacatcaggagctcaagaccagcctggccaagatggtgaaaccctgtctctactaaaaatacaaaaaattagccaggcgtggtggcacgcgcctgtaatgccagctactcaggaggctgaggcagagaactgcttaaacgcttaaacctggaggggcggaggttgcagtgagcggagatcgcgccactgcactccagcctggatgacagagcaagaccccatctcaaaaaaaaaaaaaaaaaaaaaaaaaaaaaggtacactcctccattatctgaaggaaaaagtcaagaattattccccttctccactgtctcaaccacaaagcacaaaagtggttttctaaacaaaaccaattttattagctaggacattctgaaataaaaacagactaatcctagctatctgacaaaatttatcaaaatgcataatctagggtcacctcagtctctgaaaattactggacagatttttaacattttctactcaaaggacactaactgtttatgaaaaatactgtaattaataaaaacattcataaacttgctcacatctataacataaactaaatgagtaatagctcatctttccattttctcacatgtaatccctatgctataaacggattttttaaccttaatagttaagacccaaataacactttttgtcaatccataaaaacaaaaaggaaaaacttattccctctgtcaaacttcctctaaaaatgtctctatgcctttttaccacaacttagctctcattgaaactgtaagcagccaggcatggtggctcacacctgtaatctcaggactttgggaggccaaggtgggtgggtcacgaggtcaagagattgagaccatcccggtcaacatggtgaaacctcacctctgctaaaaatacaaaaatcagctgggcctggtggcacccaccggtagtcccagctactcgggaggctgaggcaggagaattgctcgaacccgcgaggtggaggttgcagtgagccaagatcacgccactgcactccagcctgggtgacagagtaagactctgtctcccaaaaacaaacaaacaaacaaacaaaaaattaagccacccccttgcaaaaaaaactgaaagctaaaagtcacaaactaaaagtttaaaaactttagttctagctcaccaatgcaaacttgattacaactgaattacaatggagacaactatactccacttttatggaaaaactagatttacagatcaaactcaattcactcacagctagatctgtgaaagcctccaattcatggttgtcttaaacagctaactccatataccaaccttttccatattctaggctttccctgtttccacaccactacaacaatgctcaaggcctatacccttaactgattttcttaaaccatacgcttggctcaagagcactggcacactacaaagcacaccaggttaaaaagtaatacaatcaccacattgtctataaattagaaaactcaccaatataaatatcaaaaccaagctgaatttgaagccattcaccatgattttaaaccaaaaaaaaagcctcctcctcctagcctcagtttctcatctacatacccacactaaacaatcttattgtcaaagctgctttgagaaatagtctaataatccatactgatggaagtggagggcagcagggttaacattctaaattcattggggtttgagactcctaaaaaaaaaagccagttgccaaatgtacattctccatcagtatttcaactgtcaataagctggctttgcagcttttcaaaaaatattctagaggtatcatgggtgtgtttctttatactaggactaccaatagaacagatttaaacatcagtagctggataacatgataaacttcacagcaaattgctttagaaacaaatagtttaaaaaaacttaaaaaaaggaattaggaaagattgatgaattatctcaacatctaacatacatccatttcatacccaaggaatatttaccaaaattaggaaacagttaaaatgactttaaaactaaagggagtatagaaagacataccttaatttttgcctcatctggtcctttactagaatctgctactttggtcccttgtttttctctctgcctgtaagtcttcatgactccacataaaaaggcacttttgttctgcaaaaaaatgttccattaatatttaacaataaccatatctgagtctaataaaattcagcagatagtatcaaaactactcaaattttttaattttcacattgacattaacattacctgaacatgagagagatcactgtctttaaactgttgaagaactgccaatgcaccgtcttcattgaattcttttaaagcttcaatagctctttcatctaaatcactatgtgcaactagccctgaaaaaaataaaagttatcagcttttaatatttttagaaaagattttttagagaagactatgttggcaatacaggtacatgtgtgcctttacaattcttctactcccctcatctatacctgaaaaaaaaaaaacacacacttcagccactctgaactgaatcctgaactaaatatgccctaccaaccacacttacaataatcagctaacttcttttacatcttttatctccaaagtctgataactctgaacactacggtatttttacagtatacagacttacgaatcctagaatcaaccaacaaagtaccaagcatgacaactgaacctctactcaatttcaaataccaccagaaaaagttaacagccgcaccagaaagacaagaaaacaagtctacagttaccaagttatttaagaagaatcctactataaaaatactcaaaaaagtcacatggcctgttcccaacatttagcagctgttgctactatcatatacttatccatcaggccagcatgcaagccagcctttagctcctaaccttctcttcttccctccctctatacatcttaacctctacttcaaacttaaattaaccaactatcacaacaagcaaaactccagtacccacacttattggaaaccacaaaaagttgctattttagctcaaagccagaaatccaatagaaaaatttcataatgtaattttgcaagtgttagttcttacctgcaacgtaaatttcatctagtttttcagcaactttctgtggtaaaccagcatcaagcaatgtctgaaaattttctgaatggataactgcagaagtagtatccatgggctcttcagtaccatttccattaacatgttctgtagccatgtttccagagat

SEQ ID NO: 2065 - DNA, 35542 bp, Homo sapiens
  source 1..35542: mol_type = genomic DNA
taatttccaaaatggtttattaggacttctcccacactcaaagtcaaacttccaggactgttctgaaatgatgaaagcttcttttcgataatcaatataaatgttgttaatccaaaatagaaactaaaacctgcactaagtgacctaaaaagtcttgtcctgatggaagtggccaaaactgctcgtcccgcaaccaagaaatcctaggggtataagctaaaacccacaaatatattggcaagtccccgattctttccaaattaccactaactttatcaaatccaatggcaagtacgggacaacagaatatttccatcaaaaattaagaccagcctaatacatttattctattcatcttccagtaatgtgattgcaactgaggatatcttgaggaatttttcaccattggctagttacttcgaatgtatggataatcaaagggcgacagacctctaaagattccaagtgtctacttaaaagctgttaagtgaagagtgatgaattggaggacacccacaataattcttggactcctggagatcctaagacatgctacaaaaataggtctttattcttaggaaaatatagtcagagctagcttccttatgctatacataaaatcttaacatcagaggcagtacagatagtacagatagtttttgaactgatctccaaacaagcacaaacccactacgttgaaaagaacaggtaatttgaggtttttggcaaaagacagtacttcacacatctaatccaaatcaaagggcctgcagacagttttcagtgagatgaaaggaatgaaataaatataaattctacggataaataaaacacaatttaaataagctaacagaactaatttttttaaataaaaatactagtcaggtacaagcttttgtttctcaatgccagacttctaaatatttaccagactactgttaatattaaaaacctaatctttgacccagagcgttagtaataatactggtttgcatctgcaaattttcaaactgaatgcttctggtcctgaaaaatattttaggtgtattactgaaggcagactgtggtgctaatagaatttaagtcttaaatacttttaaaaagtgacagaccccaaaagtccatctactaatttgctagttaaaaaatgcctgtgagcactgcttcataattagcatcttaagaaaagtagtggcatgccctattgagtggtatcatcactgagtaattaatacaccttaaaacaatatccccacaagtctgtttcttttatgtatttgtcacttaatttctttagtcattaattttacacccaccagtgaattcctatggccagatgaaaattttgtggtatacataattagagagaaaatgatcatggtgggtattcctgtaagtttgacgaacttgagaagttttagcaccctcccctaaatgcatgaagcccttctatttaatttctctccttaaaatagagactacgtaaaatactctgtaataataagggatcttttgctgtttctgacaacttttggcttcgcagtcaaaaaagctgttctgaatgtgtcaatttttgcctatctagcttgatgttcattctattctttaaaaacttttatatacaataactcagatcaccccatcaatccatttctatgttgttcctattttatcatgaggaaactttacattttaagtcagattcacagtaactggtagaaaagtttcttaagctaaaaactgcaatcatgagtgtacaacagttgtgtgtgtgcacactcaattttcccttcatttttaacatctgattcagtggcaatggctgaaaaccttccacaaaaagcatgcttgggagaatatatctaacaaaattttctcacaaagcaactttctgaaaactgataacctaaatttatgatcacttttgattgccaagtagtctgcagaaacaaaatcttgcgtctgttttggttagataacttaagttttctttttaacatcagaatgctttaagaatacattttttaccccaaggaagggacttgactcggatttaagaccctttccttgacaatatacaaaatttcttttaacttatcactgtccattctttgaagctgtcaaagccaagaacccataaacaaatcacaaatagcaataacctacattagttaacattccccctttaacatgttgacatttttactaaaggattagttatttttgcatttccatttctcatatcccatgacattccatataaattgcattattgctttataggccacacaacattcaaaagtatgtttatatgcattgcctgtttttccttgatctgataagactttgatactgattttactacagaaatttaagtttgaaaataccacagttagtatttcttctcagaacgttaattgttcacatcactaatcactacatgcatatttagctctgattatattgctcaaaaactgcacccattatcagaacagtgcaaatgatatttaattttaaaagtaattataatggcttgaattcaaagtcattcaaatgaacactgtcaagtaatttcacttgatgtgtatatatttcatcaccactgtttacattacccttctttaagtataaccatcaattcttcaatttctttttatcagtttccctcccaagtccccaaattaagaatgccaaatagtcttgaaaacccagagctccatattttaatgttttcttaagaacacatttgtgaactcacaaaagtgttcctctttcaactttgacaatgcagttcttactttaagtaaacaaacctgtcctaaaatcccaacaagtaattctgagaacttaaacaccttgacagtgtcccttaaaaatgctatgacagtaaagtgccaataggcatggcaatgacctcttagatgggatcatttaactcctcggaactgagaaatgccagcaccaaggattacactgagattcaattttactgaaggctacatttagtttacccactttccacaacctattatattcattatgttagaatgaaatgtaaatgttttgtgtagccctcaaacttacactaagttttgagagagatgtactttaaaaaagcacggggtaatatataaaatcagtggcagaaagtttcattaagcaccaggaactaatttttgtcaccccatactcattttgtagataagtttcaataaccggcaaggcacatttacatatattccaatgaatacttattgacaaattttaaattacactctatgtcccagctatcccagtaactgacatacaacatactaaaatgatttatttagataacaaaaaaccaattaatgtgaaacatacaggctattggcaaccactattctaaaattatgtaagtacaaataaacatactgaaatgtgtgcaattctaagtttttaaaccagaagatttctacactaacacacatttatattaatgacacataaaaaaaataaaaactttattacaaaaataagttacactcgcctccagcttacagtataaaacaattttatttgcaggaatgcaaaatgattgtttgccatgagcattttgaacatatgacatgtctgattttcttgttaaatttgcatttactggggaactggtgtgtataaaaccttaattaagtataagctctgatcttcatcgtggtgcctattgggtatgtgatataactgcagtatccctttggggaaggggggaggggatttctttacaccaagtcctaatgaaactataattttcactttttactttaagctatcaacttaggacttggcaaaaaaatttttgagggtggttcaatagaggatgcttcaccactggacactcactgtcatcaaggtgctttagaaaattaaaaacatagcacaaatgattgtactctactctacaagttatcatgacctgcataagaaatggaaagctgattcacatgtttacagtgatcagcaggaagaaatgcactaatgaaacataccttttacctaaaaagctaaactacagccatatactaatttctatgatttatgaaaaaacttcaaaatatccaaatgtcaggcttcgctgtacaattgtcagttttagtctgactttttataaagggacactgcagtatttagtacaagttcggatgcacttttttgaacatctgatgtcttacaaaagtaacatcttgctaaactattatacatccaaataactacaatatctgaagaagcaaggctgctttttcagccacaaaatacgacaaaagcaaggcctgttatgatggtcatgaggaagtcttacaagcctctgaaactaaaggcaactaagaatgttacatttggtatattaaaatcttaccctcatatcatatttaacaagccttgcttttatctacaaagattttctatgtacagtacagacagggtatagttcaatcctctgctactgaggtagttaaccaacccttttaaaaaggttctgaaaagaaccactatctggaatgcctgactaaccagctctgatgattacacctgaaactgcatatctgaacacaattcaaaagtgatcactataaaaaagatatagacaatcatgattaaccttggtgagcagaaataaaatttaaggataccatcagtggcattcatctataccactgcaataaaatttaaatgcacaaattcaagagaatatttcaaaataccactgttgggatccttaatttaaaaaaggggaaaaatctacttagagcagatttttaaaagaactttattctttattaagataccatgctaggagttatgaaggatttctgttggaacacattttgaaaatagagtagctttagtttaataacttgcactgcagagaaaattgttaaagaaattcatatcaaagtccaagtattagttcaatgtcccgtatttgattccatgatcttcataggaaggtcttctgcaatagaatatgctcctatacagccgacatatttaaggttgcttgatttccttaccattactccactgcaagcttctggtgtaatcccacatagcaagtcagtcttcattgtaacaggtcaggaccggcctcgaccccttttccctgctagccaggtaacaaaaggaatcagttagataaatcatcttaaattaataatgtgtacatacataatgataacattaaaaagacaagccttaacatggtaattctaaatatactgtctagccaaaaaagttgcctttaataactatgaacttctttttgcttgttttttacttgctttgaggtttttggttgcttttttgcccctttgagtgaggaggctggactgaggtttgaaaaccccattttgttcacaaactgattttatttaaaaaaaaaaaaagactaacaggaaacctaaatgaagtcacaccttaaagttacccattaacttgcaagtaattcccatttttgagacatgaagtaatcataaaatatgctgaaagcaaacatctcagacttgtttgaccttgagatttgaaatttagtgacatttttaagaaagtttgtctttcaagtcatgtatttttcacatgtaactttattgtcaggtataatacctttaaattcaagggtgatggaggttcagaagtggggagtggctgttaaaccttttcactgttgacctagagtctgtcccccaaaactctaacattttcccatcattactgttagaagtatagaccatatggccaaaacaagactaaaatgtgaaacaaaaatccaaactattagatctttaatacaaaccagtctgtgaggtaaattttatccttcagatatatatttgcttacccaaaactaactgtaaagctgttttatttttaattaggtaagtacagtgattatttagagtgcaactcacaaattacccaaacctattcccattgttttcacactagagtttctttgctgctttctagtcccatggtgtgcaaaacagtcaagagggcaatatactcaatctgagttttaggttagttaggataaactttaggcaactgaaagtggacttgtcagtgtgacctgcaaaccctttgagactacctgaatttgtccttttatacagttcattcatcacaattaagaactctaaaatacttaccaacttaaacttactacatgtattatctttttatttttgatgggaacatgaagtctgttgtaaaatagcactttaaaccagaagcagaaaactgcaataaatcagtgttgtgtaatgtgcagacatattccacacaagaattaacaaggcacaaaaccctttaattggccttgacatgctatacaatttgaaccaaatttgcaggaaattttgtgaaaaacgaattgtaaacacaattttagtaagtatacatttaggtgtgaattttttattgaaataaacaacagcataaagaatacaagtagccaaaatggttttgaaaacccaaattaggtcaaagttctaaattaaaaatagcagttgtgtatcaatttaccttattctagcaatttaagttggtaacatacaaagttattctgatacaagatattaaagacacacttggttttaatcaactacctttgaagacaccaaatctaaacactactggaaacatcgttgacactacagccaaatggacttgagccaaattttctcaagcacaaatgcaaactcattaactatttctttcagtatctaagaatatctttattgaaaaaaattaaaaataaaatcagttcgccagaagcagttagaagtgtggctttgttcgtgtccaagcggattgttaaaatatatacataaagggaaatcttgccagatgtcacaaattatagcggcacccgttcagatttagggtgagtttctgatcaacctatcagtctccaattttacagaggccctactgtttctacttccactgttgcccaaaagtatcctgataaaactcctggttttcagatttgtaaccatagttaccagaatgatcaccaccttggagcggttgctgagcaatgggttgggagccccagttctgattattggtctggcgccgcttggaatctggctggttgtacccatcagctttgcgctttcctcctacatttccaccgcggccacccctcgcaccacgtaccccgcggcctctttgttgttgggcacctcctctcgcacctcgaacgcctcttgctgatccaggacctcctctctgtgaataaccggctctaccgcggggaggagcagccccacgacctctggatggagcagcaccccttgctcctctaccaccccttcctctagctccaacttgaaaatcttcataaccatagtatggatcttcatatccaccacgatagttatggtaatcataaccataataatcataataatcttcatatccataataatctggaggatatccataaccacctctacctccacgccctcgacctcttgttggagggggcatatgaggtggaccataatagtagtaatcgtcatacctattaaaaaagagacagagattagagtttaaatcaaattacttagttaacaagtaggcatttagccatttgtaacagtttaaatccagagtttacttcgcataattcacataactttaatacagaattatttgtactagattaagttttagtagtagtaatgatcagaggatcaggatgacaatataggcatcccaaaataccacaaatctctagttatgaaccttatttatttcttcatgatcttcaaaatctcccaataaacctgttacagaatttttacaattgatttagctgtcaaatttgccactttagggctgggagcggtcatgcctgtaatcccagctatgcgggaggctgagtgaagcaggtgaatcgcttgaacccaggtggcggaggctgcagtaagccaaggtcacatcactgcactccagcctgggtgacagagcgagactctgactcaaaaaaaaatttgtcactttgaattgcatttctgctaagattctattccaatatacttgaagaacatttattacaaaagcaaaatggcaagtaggacaagcacacaaccaaaatgtgtgaagttcaaagtttactacagtaaattagcataaagaccttaaagttttcctgtttctacaataatgctatccaagtaaaatttaaaagatctgctactttcccaaaaataaactacaccgtaactatagtgctgaactttaaccactaaacaggtataactttagttgtcaaagtgattagaaagcaaccacacaaatcagcatatgcttacatactatgtaaaaggactaaacgaagttacaatattccaactcatgttccctacagtacaattttatacaattccttaaaacttagtgattattttgagcccaataatcccatgaaatatggaaattaatccctcttgaaggaataatttactcgtgttttttattccgtacctgttatgttattttatttatttatttatttgagacacagtcttgctctgtcacccaggctgcaatgcagtggcgcaatctcacctcactgcaacctccacctcctgggttcaagtgattctcctgccacagcctctcgagtagctgggactataggcatgtgccaccatacctagccaatttttatttttagtagagatggggtttcaccatgttggccaggctggtctcgaactcctaacctcgaatgatccacccacctcggcctagagtgatctgcccacctcagcctcccaaagtggtgggattacaggcatgagccaccacgcccggccttattttatcctgaattattaaaggcccctgttccaactgactaacgtaaaaatgttattccggttcactaggtccttagaccttttatgtgctctgctggtttattgttttgaggaaatgatggaaagatcatccttttctatttctaaatagttctcaccagggataattttgccaccacctctttccagggggacattttagacggtcataactgagaaagggggtgctactggcatctagcaggaagaggccaaggatgctgctaaaagtcctacaacgcacagggcagcccccaagaccaagaattatccagcccaaaatgtcaggaggacagagatgagaaatcctggtatagtggttaagagggaaaattatgggagactagactaccttagttcaaatccaactccactacttactatgtgaatgaccccaaggaagttgacttctgagcctcagtttcctcatttcaaactaagggatagagtacctaactcacaggaatacagtgagaattatgtaggaatacgtgcttagttaaaacttaaaaaaaaaaaaaaaaagactgtagcaagttaaagtacgaaagtaacatgcaatcatcccttttagtttgtactccttttcaaatattaacagatatactgacatcctccaccttctatttagtatctccctctatcaagtaccaaatgtaactgctctaatcacattatctaatataatctcctatacttacattctactttaataaattaaccatatatcgtcttctgaaagaaataaaaagaagttattttacactgtttagtatatccaggtgtttgaaatatagagcattaaaactaactctttttgtagtcttccttcatttacactatcatcaaacctacaaagtatattttctttggtcccagaacaagcatgggtcacttggataatcacataatccagagctattacataattttgtctgatcccattttagaactgaagaaattgaggttcagagcttgccaacttgtccaactggacaattaactgcagaaactagaacttgatcaattccctgattatgaagtaacagaaatatgtagaagcatcctcttcctttaaattccaaacagggcaatcaacagaaaattaaccttgaatagtattgacagtgattattgctctcacattcaagaacaattacccctcttctaggaaatcagtaactaactttttaggagctaacttcaattcttacccaactaagtttccttcagtcttaagcagatacctatttacagattctctaaaaaggtctccctaattagtataactcattacacacctacttgttttcttattgcactactgtgttataattttaatactcatttcattttcaaaatccatccatcgaacatgaaatttttggggtggcaatgagcactactggtgaagaaacagtctatcatgaatagagatttagtatttcctatctctcagagaaaaaactctccaccctttaacaaaatgtattaagatatttggacagctaatatttaagacattttcagaagaacattctgtaaaatacaaagaaaatatgtgagataggccaggcatggtggctcacagctgtaatcccagcactttgggaggcagaggtgggcggatcacctgaggtcaggagtttgagaccaacctggccaacatgacgaaaccccacccctactaaaaaaaaaaacacaaaaattaccaggcatggtggcgcctgtaacccagctactcagaagactgaggcaggagaatctcttgaacccgggaggtggaggttccagtgagccgaaagagtgccactgcactccagcctgagtgacaaagtgagactctgtcacccaatacaaaacaaaaaaaaagctagacagatttttcatcttgccaatttaccaaaattccagttatttacaattctgattattttcacaaatatggttcatagtaagagttcaataaacacttagatcactggtgtttccctatgactctcaaacgttcaagtcttctttaaagagatgttatgcatttaacaagtctgatcaacacctgttattttccaattagtgtataaatattaaaatttatacaatttttaagtatacaaatttcactcacatttgattttttgctgcttgcctctgagcttttctttctttccttttctgatctggtggcttggcaaaaacaatttcaatattttctccctccaagtctttgccattcatttcttccatagccttaaaaaattagataagtcaatataaaaataggactttcatacaattatgattcatttaaagttggaatatcatttatcattaatgtgggaaggacaagagaaagccccatgcaggcagtcaaataattttatttaaagatgcagatattcaattatttttcatttttacttagaaaactgccaacatcactaaaaccaaaaggttttagtttgaatggattccatggacttccaaagtctcctccaatttgtaaaactattttgagattctaaaatgactaaatttgttagtctgatttagatgcctgtaattccaccatatttaccttgacagcaccatctcgctcatcaaaatgaatgaacgcataatcttttaacttcttcactcgttccagtttcccaaactgactaaatgccttttctaaaatctcttctgttacagtattggcaaggttgcgtacaaacagcacttttacctagggggaagaaaatacccccctgtattatttccaaagagttccatttctaagataccaccaccccaccctacaaagttaactcaaatcacaatccattagaagaatgtcagaatataaaaaaaaaaaaagttttcaactccttgggtaaatatcaagcagcagaactgctggatcatgttgaaagacctgaaatagatgctttgccaaaaaagatatacagatggcaaagaatctcatgaagatgctcaatataatctgtcattcggaaaccgcaagtcaaaactattagaatggccaaaatccaacacactataaatgcaggtaagaatgcagagcaatagaaactctcattcattgctggtgggaatgcaaaagggtatagcccctttgaaagacagtttggcgatttcttacaaaactaaacacacacttccatatgacccagcaatcctgctccttatttacccagagttgaaaacttacatgcacacaaaaacttagagagagatgttaatagcagctttatttgtaactgccaaaaatttgccagacgcagtggctcacacccgtaatcccagcaatttgggaggctgaggcgggcagatcacctgaggtcaggagctcgagaccagcctggccaacacagtaacaccccgtctctacaaaaatacaaagattagccgggtgcgatggtacgcaactatggttccagctactcgggaggctgaagcatgagaaatggttgaacccaagaggcagaggttgcagtaagccgagatcgtgccactgcactccatcctgggtaacacagcgagactctgtctcaaaagaaaaacaaaaaaatttccaaaaattggaagaaaccaagatgttcttcaatgggagaatggacaattgtggcacatacagaaggaatattataactgatagaaactagttaaaagccacaaaatgacatagaagaactttaaatatgtattactaagagaaagaagccaatgtgaaggttacataatgtatggttccaactatgtaacattctgagaaggcaaaactatggagacagtgactgccagtggttgaatggggagggatgactaagcacaggacagaggatttttagggcagtgaaactattctgtataatactatgatggaaacacggttatacatttctccaaacccacagaacatacatctagagtgagacctcatgtaaactatggactttaggtaatcaatctacgtccatcaattttaacaaatgtactattccagtgcaggatactggtagtgaggaaggctgtgcctgtgtagggggcagaagtcatatggcaattctgtgctttctgctgtaaacctaaaactgctctaatgaagtctatgaaaaagaaaatgcagactacaggctacatcagtaataattaccaattagtaattattttgcaataaaaaagataatttttcctaacaaagtaaataccatgccctctaagagagttattgaatgtttaacacttaacaagagtggccaaaactaattaggacctgcttttgaaatcttaaagggggaaggactgttcaaaatattagtaagacaaactgttctcaatcctgaaagcttctcaaagtaaaattacaaaatttaacctcttcactaacattatcacttcctcctaaaataacttgaataccatctgaatgtgttaatctaaagtgctaacccaatgagaatttataggccagaggaaaaatgaatcctaactattttctcttctctaagaccacttatccttcaataatattcatagctccctggcagttcatattaccctcaatttaactcaactagtggtgtctgacacctaacctgtaagtaacaaagagggaattcttaaaagacaaaggataactggggcatggtggctcatgcctgtaatcccagcattttgggaagcaggattgcttaaggctaagaattgtaagaccggcctgggcagcacagggagattaactctgcctctacaaaattttttaaaaaaattagccaggtgtggtagtacacacctgtagttctagctacttgggaggctgaggtgagaagatctcttgagcttggggctacagtcagctatgatcatgcccctgaactctagccctgggccacagatctagaccctgtcacttaaaaaaaaaaaaaaaaaaagagaacaaaggatagaacaaataactgcaaattactgcaccagtgtgtaataaagtgttgactcaagggatgtttattcttatacaatgtctccactgactgctgaagtcaggatacctaataatggctaaatgtaactgcaagcacctctgctgcggccagtataatttactgtttttagtagtaagacttttaaccccaaaaccatgtaaactaatggtgccattctcaaaaactcaaattgctcttaaaaaacacacaaaatggaagtcaactgtctacagcatgtaggcgacttcattacaagattgtgatggctatacaattatggctaagtatccacgcatcaatttctattttcactttgcaggcacatggtatttccagtgcgcactgcctagtcccgtagtaaagaacatttctcccaactctaaaaatatggtttaaaaaaaaatgtgtccagggccaggtgcaatagcctcacgcctctaaatcccagcactttggaaggccgaggtaggtggatcccgaggtcaggagttcgagaccagtctgaccaacatggtgaaaccccagctctactaaaaaaaacacaaaaattagccaggtgtggtggtgggagcctgtaattccagctacttgggaggcaggagaatcacttgaacccgggaggcggaggttgcagtgaaccaagatggcaccatggcactccagcctgggaaacatgggaaacaagagactcttgtctcaaaaaataaaaaaatgtatactgttcattttatgttccccccaccccaaccccggcccttctcccattaatccctcaaaaaatatttttaacttgactatcattacctttgccataacctcaggatcaggatcttctataggatcagcccattcaacagttccaacattcccccagaccttgactttaccactcattaacctacgccttgcctgggcagctgttttgtgatcttcatattcaagaaagcaaaagcctctgttttttttcttgtcatccggttggtggtataaaatgacgtctgtaagaccctctgcaagtaagcaaccattccaggaaaattagatgaaataactagcaaatacaagtggatcaaaggatttatctaagatactacttaaatatcaaaatgaaaaatcatctctttccttcactagacatctttataaaagactatcaaaaactaggtccggattattttcctaatctgtttccaagtttttcaacacagaaatctccagaaaagaacatgtgctctttttagaggtaaggactacttttgttttcactaattagatcagagaggcagataaaaattttcatataattgttctaagaaaatggcagtatagatcaaatatggctatttttcttattatgcaaacactaaaattatttttaatggcacttttctggccttagatatcaatggctttatttcaaataaaatagaagttataagtactgcataaaaatttccaatgtcctgaaagttgataacaggctgataatttgttagacactgttggcagaccaaaatattttctaaaagcaacctgtcacttaaaagttgttacagttcaaaaaatttttttaccatgttgacaatatataaactctgtttatgggccaggcacggtggctcatacctgtaatcgcaacactctgggaggccgaggcaagcagatcacttgaggtcaggagtacaagaccagcctggccaatatggtgaaaccccacctctacaaaagacgcaaaaattagccaggtgtggtggtgcgcgcctgtaatcccagctactcaggaggctgaggcaagagaatcccttgaatctgggaggcagaggctgcagggagccaagatcacaccagcacactccagcctgggcaacaaagcaagactgtctccaaaaaaaaaaaaaaaaaaaaacactctgctacggcaatacttactactcctgtaatttcaagaacatcaaatcattattcaaacaattctactaagaacatcaactaacacctagagaaagaacacacaaagaaatacgatcttccaaaacataggaagaacaatgattttgcagaatgaattcaaaccctagctgtattccctactaacttgtacaacgtttggcaagttatttcccaaatccctgaatgcctgttcttcttatctgaaaaatggggttacctacacttcaaaagttgtagtgaggattcgatgagtcaataaatgtatttagaacaatgcatgacgcacagaaatatgctattaatcttcattattaaaagctgcacctcattccaaataaatccaacttacctgttactttgctaaattcttcaagaatctgttccttggttttactcttaggaatagagcccacaaaaagcctattgttggcaactgagatgcagacaccaatatgttttccagaacgaatttcatgattattatactgaaaggggaaaaagtgcatcatgtttttaaattacttatacaactagaacagttaattataaaagatacacaagagcaaatcatcctttaaaaagtagtttaccttaattcccatacaagggaattatgaggaacagattatattaacaagacccattggacaagttcatgaaccaatttaatgcaaataaaaggttattaaatcctttacttgattaattagaaatcagatctgcagcagcttaaattcaaaaactgccagttcctcaaaaacttaacttttacttaagttcatcccatcaaccagttattctcatacaaggaaaactgatcccaagatcagcaagatctctgccgttctgttaaccagcacctaaatctatttttccatcttcccttcctcttatcaaaagttgtaataagaaatttcaggcttcaaatatttaagcctaaaaaaacagcttttatttctaaatccaactgtactttttccccatttcattttcattatgcatataacaaattatgaaggagaaagagaagtagatttgtcatggcaaaaatatacagaaacaactttaaaactacagtaaaaagtaaattgaattttcgagtaaccatatcccagattatcagaaagcagaggcaaaaagcaacatgtcaaagtgacaaatccaccaattagtattatttacaaacccaagtgcaaaagtatccaagtaatctagaaaagtggattatatgggttagttaaaaccacacctcaaaatttgttactaataatggcggcagcagcggcaataattattgattaatcctcccacacctaacctcaaaatctattctacacgtggagctacacaaactaaagaaccaacatcaatttccatacaactttatagaaataccttacagcaaaagaaaccattcttctattatgcccatccttgctaggtacaccgggtataacagaagaaaacatgtaagtcagaaagttgagtcctccctgtcccttccccatctccagaaaatcaaaatttaataaagttcaaataccatacctccagttcagaaaaatttattgctttctaccccactattctgtacaggctattcaagtgtgtggccctcctgatcccaggtttacttctatttctctacatttatgccagagacacaacattaaaaaaagtaaaaagatgactcctgctactttctcctctctctctcaaatacctttttatatcaactcttaaacatacagggtttttttttttttgtcttttctgagacagagtcttgctctgtcccccaggcaggagtgcagcagtggcactatctcggctcactgcaacctccgcctcctgggttcaagcaattctcctccctctacctcccgagtagctgtgattacaggcgcctgccaccatgcccggctattttttgtatttttagtagagacggggtttcaccatgttggccaggctggtctcaaactcctgatcttgtgatccactcgcctcggcctcccaaagtgctgggattacaggtgtgacccaccatgctgggccacatgcaatttttatactcctatggctctgaagaaattgccttccttccctgaaacttctaccatacaagctcctctggatacctgtaaattaagttcaaccacccaatactacaatacataaatcctaaaagggtcaacaaaatactcctccatgttaacacagaccaacagttctcaacaggagtgattttgccccccagaagtcatttgacattcttgattgtcacaacttggaaagaagtggggacttgctgctggtatctactgggtagacagaaggatgctgatacacatctaacaattcagaagacagcctgtcacaaagaattatctagtctaaaagatcagcagtgctgaggttaaaaactcctgccatatactttgttttctcatatagcattcatgtctttctcttctaccagactaataatcttttaacagcagaaacatgttacctgaatgtagcagagctatggctgaatccatcattgcacagaattatggacaagtagattataatgccttattttgcaagtaaaattaaactaagaacacaataaattactttaaaatatgtacattccctggattcttataatctagcatcaagtagccagccttagcaacaaatcagtggttttcaaattggtcatgcaatcagtaattctagtaattaacaaaaacaattaaaataccagaaaaaggtggaaagaaataccaagtgtgtaaaggcaaaaacaggagtgattttgggggtgacagattttggtataatgagggggggaactggtattttccaaatgttctaaaatcaggagctattaactataagaaaatacctaattctaaaaaaacttctaacagaaacttgaattcttagttctaccaagaaaatacaccattgagaggaaccaaaatccttataagaaatgtaggaggcaaaggcaagacaacagagaatggaaacattccatcaaggcaacaataatcaaagaaatatagagaagacagctaatctgtaacataggcaacacttccattaaccatcaacattaacaatgctgcttcaaattattaataactgtttccattattatctacagaaacaccatttttttccttcttacccatcatcactagccctgatgctaatcaagttagccaaggcatggtaggtagaaagtacaaaggatggatgtggtctctgaacaacataaataacacaaagatttagcaggatctataaaataaactgctgattcctccctacccacattttttcaattaaaaaacttgggccaggcgcggtggctcatgcctgtactcctagcattttgggaggctgaggcgggcgaattgcctaagctcaggagttcgagaccagcctgggcaacacagtgaaacgccgtctctactaaaacacaaaagaaattagccgggagtggtggcaggcacctgtaatcccagctactcgggaggctgaggcaggagaatcacttgaaactgggcggcaggggttgcagtgagcccagatcgcgccactgcactccagcctgggcaacagagcaagactccatctctacaaaaaaaaaaaaaaaaaacttggaacaattgtattacaggtaacacagagagtcaactggctctccaatgaaaataagtcattaagcgaacaaagtaaggagactctgggtacaactataacaaaagtagtacctagaaattaacatttccggaagcaacaccccatctacggattacgcatgctttttttgtacgtgtatttgaattgcttaacctttcttacactaatgccactctatcacctaaaaaaaaacaaaaacaaaaaaacacttatcccagcaagatgggtaacagtgagttatatggtgaatggtgtaatacaaaaaacaaatgtgaataagagattctaatttaatactagtaaaccctaactcaagaagtgtatcaggacactacagtggtataaaaaaacgagcacacacacacaaaaagtcttatctttcctactctagaaaggttggccctgaatcttgttagttgtaaaaatctagccttcaagctcagtaccacagctgagatgaaccaaatagaaaatgaagattaattatgatcattaatcaatgtgaggtttcagtttttaagaacaccaaaacagtagtacagtctggaacgttcctgtcatcaagtctcaaaattttaagtcacttttaagtccttccctcatagtcaccaaattcccagaaattcagcaatgtcaaatttggaatctgatccagaagaggctgcttagtcctaactcttctcagcaaagcccctacctccaaagccttccacattgaagatttcttttttttttctttttgagaccgagtctcactctgacacccaggatggagtacagtgacgcgacttcagctaactgcaacctccacctcccggtttcaagtgattctcctgcctcagcctccctagtagctgggaccacaggcgtgtgccaccacacccggctaatttttgtatttttagtagagacagggtttcaccatgttggccaggctggtctcgaactcctggcctcgggtgatccgcccgcctcagcctcccaaaatgctgggatcacaggcatgatccaccgcacctggcctaaagatttcttaattataaagtcttctttacaataagccaaaatctacttccttaaataaacctatttctttcccccaaatgacagcatttcatatacctggcacacaagcacatgactcagttgttttctatgcttggctaatcattgcttccctgataatggcaaactaaagtacctccaagaaatactgacaagtgtcactgaagagtgacattctaacacaatactgtaaacgcagactgaaacaggagtctagaataaactggagcttattactaattttccacttctagacaccataccactcttacatattgtctgtgttaccctaggttatttggcaaccacacattactgacaccacagcttgttaaactagtgtaaatacttaactttagtcaattccatcttggtagatataaactttctatctcaggctatcaaaagtttttcagatcctgacggtcatccaaggcatttatcactgaatggagattcaagttaccaaacgtatcatgaacagtccaactacactttcaattcttgataaaaactagaatacaacctacagcataccactatggcctttcatttctctttccaaaatctccgatctttctcctttctattgctgccaccctcctcctggcctttattgtctttattcaaataatcttcattattcagccacttacaacatgccacccacatcagggctcaaaaagggggtggggggtgctatgcagcttagcccagtatgaactaactcctggcactgactttattacaagttttatttccacaaaacactgcttcaactagattcaccttttttcttcactgtgctgctcaaacctctttattgcaaagccttctctgacaaccctaatccagtctcccttcatccttcctttacgctttgcaccactggattccactgtaacagtagtctttcatgttctataaactctctaagaacctgtatatctgaagtaaaagttttcatgctaaacacactatttgctaaattattattaaaatatctctgaacctaccttgtcaactacattcatcaaaatggctgttcatgaggccgaagcaaatggatcactgaaggtttggagtttgagaccagcctggtcaacaaactaaaaatacaaaaaaaaaaaaaaaaaaaaaaaagggccgggtgcggtggctcatgcctgtaatcccagcattttgggaggccgatgtgggcggatcacgaggtcaagaatttgagaccagcctggccaatatggtgaaaccccatctctactaaaaacacaaaaattagccaggcgtggtggtgctcacctgtagtcccagctactcgggaggctgaggcagaagaatcgcttgaacctgggaggcggaggctgcagtgagccgagatcatgccactgcaatccagcctgggcaacaaggcgagattcatatcaaaacaaaacaaaattagtcaggcatggtggcgggctcctgtagtcccagctactcgggaggccgaggcagcagaatctcctgaacccaggagacagaggttgcagtgagctgagatagcgccgctgtgctccagcctcgttgagagtgaggatttgtctcaaaaaaaaaaaaaagctgtatacacatcatgacagtatacataaccaatctggtgactaaaaccatcagaaccatcagagctattaaaataacttgtgggccgggcactgtggctcacgtctgtaatcccagcactttgggaggctgagacaggcggatcacgaggtcaggagatagagaccatcctggctaacacggtgaaaccccgtctctactaaaaatacaaaaaaattagccgggtgtggtggcaggcgcctgtagtcccagctactcggaggctgagtcaggagaatggcgtgaacccaggaggtggagcttgcaatgagccgagatcgtgccactgcactccagcctgggcaacagagcgagactccatctcaaaaacaaacaaacaaacaaaaaaaatcgtaacgtgcaaacagatttcatctattccaatgcttgtacatagacattattagcatttcatcaggatatttccgttatttaagattgtcatggaattgcagcatcaccagccttgggctccaattccagcaacataccacacaaatacataaacacacctgcctgcccttcttcatggtctttaaatcaacatgtctatttccaaacaacccctaggtaggtaagggaagaaagcatcatcacctactaatttaccttaatcacagggcagtaagtagcacagaattgtaaatggaggctattaaaacagcaaatggtccatgagttacataagaatattagagagcactggtcagcaagtcaggttatttatccaacacctactacataatggggcacagttctaaatgttagggaaaaaggaaaaatatatacatattctaatgggaaaagacatgtaaataatttacaaagtcaaaaaataattacaagctcatccaagcaaaatctattttatcattcttagaatactgtcatgggggcaactgggtggtaaggtgctcaatgtcaccctacctgaaaagaaagcatcagtcataaatgggctgctttcaacccctacgaaagcagaacagcagaaggcagccttaaaatgataatggccatggcttggctgggcacggtggctcacgcctgtaatcccagtactttgggaggctgaggcgggcaaatcacttggggtcaggagttcgagaccagcctggccaacatggcaaaacgccatctctactaaaaatacaaaaatcagccaggcgtggtggcacacacctgtaatcccagctactcagtggctgaggcagaactgcttgaacccaggaggcagagggtgcagtgagctgtgatcgcaccactgccctccagcctgggtgacaaagcatgactgtgtctccaaaaaaaaaaaaaaaaggccatggcttaaagaaggcgaaacatggctaaaagggtaattaaaaggaagagtggggaaagaggtaagaaggaacttgtctggatagggccttgtttgtaagtcatttttcagcacaggaatgctgtgatctaattgatgttgccaaatataaagggcaacagaaggcagtgagactagctaagtttcttcagtagtctgaatggtacaaatggtaccttagactaactagggtagtagcagcgaagaagataaaaagtgttagatgctaaaatattttggcaacagataggacctacttccttaactcttttaacactacctaaaccactacataatttaaagttatcaggctacctggtgacgtaacttgtacagttggcttaaattgttatgtctaacaatagggacctcagctaaagaaacctggcatcaaactagggctgggatgtttagctgtatggcctcaggcaagtctatttctttctactacctggcagaaagggttgttgaggctgaatttaaaggtgataacgtagcatctaacaaagctcctgtcccttaacaagcactcaagtagtagctattaatcaccttttcacaagtttagatcatgcttccctagctagattatcatcatttacaaatggatttttttcattccccaaaatgaaggtagatgttggctagaatcagggtcatttaagaaacttgaagttgctttcaattaacttcatgcctcttcaactgttaacatcaattaacccatttttataagtccacatacaaatataaagtctacagtactatttaacctagagaaactattcattgctgtatcagtattaaaagacaatgccaaatacctaaaactatttcaacctaaggtattcctccagacactcaaaagagaaacagaggtgcttcaatcttgtctgatctataaataatgcaaaggaggcatgaggcactttcccaacatttagttatatataactagaatgacacttcaattaaaaactcactttggatagaactgtaacaagtagaatctcaaaatgtaacacagtagagatagcttccaaagtatgcgcccttgaggaacatacttaggaaaggggtattcatgtccgcaaatgaatacaaagtggcaaaaaacatccaaaaaaacttgagatttgtattttctctagaatgtttcaattacttcactttctctaaaatctagttctttgttgtgctaaagcaaatctaccagatcctacccacagtaaagcatccttttaaaaaaaaagtaaacaatggccaggcgcagtggctcatgcctgtaatcccagcaatttgggaagccaaggcagtaagactgcttgaggccaagagttcaagactagcctggacaacatagtgagacaccacctctacaagtttaaaaattagcctagcaaggtggtgccctcatagtcctagctgctgaggaagctgaggcaggaggatcacgtaagcccgggagttcaaggttagtgagcattgatcatgacactgcactccagcaagggcaacagagtgacaacctgtctccgaaaacagtaataataattaaaaccgtttacttaaggccgggcgcggtggctcacacctgtaatcccagcactttgggaagccaaggcgggtgaatcacaaggtcaagagatcgagaccatcctggctaacacggtgaaaccctgtctctactaaaaaaatacaaaaaaaattagctgggtgtggtggtgggtgcctgtagtaccagctactcaggaggctgaggcaggagaatggcgtgaacccgggaggcagagcttgcagtgagccgagattgcaccactgcactccagcctgggcaacagagtgagactccatctcaaaaacaaataaataaataaataaataaataaataaaataaacaatttacttaaaagtaggctgggtgtggtggctcacacctgtactcccagcactttgggaagccgaggccgagactggggtcaggagtttgagaccagcctggccaacagggtgaaaccccatctctactaaaaatacaaaaatcagtagggcatggtggtgtgcacctgtaatcccagctactcagggggctgaaacagaagaatcacttgaacccagaaggcagaggttgcagtgagttgagatcacaccactgcaccccagcctgggcaacagagggagactccgtttcaaaaaaacttactaaaaagtcaaaaaaagcaaatgatggtatgaccaatatatcctactggctgtataccaatacctaccattggaaattttttttttccccctttttggttttttgagacagggtctctgttgcccaggctggagtgcagtggcatgatcacaggtcattgcagccttgacctcctgggaccacaggtgcacgctgcctggctaatctgttactttttggtacagatggggtctatgtttcccaggctggtttcaatcaatccttgcacctcagcctaccaaagtgctgggactacaggtgtgagcaaccacaccctgccaaaagtatcttttaaaagacaacaaaatgcaaagtctcctattaattagatagtacaaaataattatgcccccagaaaaggattcaaatcacaacagagaaacccagaaagaaatgtagaaagttttaggacaagggttaattcctacgccaatcaaaaagaatgcttatctatagaagtttctccattatatttaaaaactatattaataagactatattctaagcaacctacagcaatgcaattttataatttaacgtatttattaaacaaggcaattgtacaaatggaaacatttcctagtgtctactggcactcgaaatcactgttactaatggattataaaccatcttcctctaatgatgtatctttactgtaaagtttctggaaaacatctataaataagttatagtggtcacctaccataattggtacattttgacggcaagaattaggtaacctacgatgtcagtttaatgattctttttcataatgttaaaaaatggatgacaccactagctaaattctgcagtggtccctcagcacatacgggggactgattccaggaacccataccaaaatccatgaatgctcaactctcttaaatagcatagtgtttgcacataacctacgaacattctctcatacactggtgtgttgttttttttttttattgggttttttgggagtatcttcaatcctcagctagctgaaactgtgaatgcaggacccacagtagagagagcccactgtattagctttctgtagttatgatacctcattgcttactggatcattctgcattttcacttactgctactttattgctacttggcaaaaatattctactcttttataggagattaaaggattttgggacaggcaaggtggctcatgccagtaatccttgcactttgggaagccgaggtaggaggactgcttgagaccatgagttcaagaccaacctgccaggcacagtggctcatgcctgtcatcccagcactttgggaggccaaggcgggcagattacttgaggtctggagttcaagaccggcctggccaacataaccccatctctaccaaatatacaaaaattagtcaggtgtggtggtacgcgcctattatcccagctactcgggtggctgaggcaggagaattgcctgagcccaggaggcagagattacagtgagccaagatcatgcccacacactccagcgtgggtgacagagactttgtctcaaaaaacaaatcataaaaacaaactaaaggatttctaaggtacctctttctagagctctaaaatgcccctcccctcaaattgaactgctgaaactaaaattttgacaactcaaaggttaccagtaaatctgaattccctctaaaacacaaagcactcttttatgaagagaaaaatcagacatgatttgaaaatatctaaattctcaaattctctttgtaaaggcttatattctttcaagtaacataattttgtactgtttaacttccatcatactcaattatgcaaaccagtggggaatattcacacaacatagaaaaggaagacttggccgggtgcagtggcacacgtctgcaatcccagcactttgcggggctgaggcaggcatatcttctgaggtcaagagttcatgaccagcctggccaacatggtgaaaccctgtctctactaaaaatacaaaatttagccaggtgtggtgataaatgcctgtaatcccagctaccggagaggctgaggcaggagaatcgcttgaacctgggaggcggaggttgcagtgagccaagatcgcaccatggcactcctgctgtctaggtgacagagtgagattctatctcccaaaaaaaaaaaaaaaaaaaaaaagaaaaggaagacttatgagttttatttttctctttaaggcttgcttaaagtgataaacctcatggtaaaggaaggggtaaaactcaggagggagggaaaaaaaaatgagtctgaagattttaagtttgtctggaattacccacaggatacgtaagccagataaagcaaatttaacaaacatggcatagtgagctatcttgtacaaaagttctccccagtcgtgttgcttgatacattctatgggtttaaattagcccccaactcttcaactataaaatgcagaaaccacttctgtcacagaacttaataaaactagtttaaaggacttacataaactataatttaaaatattaaaatttctttctagccaggcgtggtggctcacgtctaaaatcccaggactttgggaggccgaagcgagtggatcaccggaggtcaggagttcgagaccagcctggccaacatggcgaaaccccatctctactaaaaatataaaaattagcctgagcgtggtggcaggcgcctataatcctagctactcgggaggctgaggcaggagaatcacttgaacctgaggggtggaggttgcagtgagccgaaatcatgccacttcagcctgggcaagagagagaaacttggtctcaaaaaaaaaagaaaagaaaaaagaaaaatttcctttttaaaaaagttggaaagattaccaggtccttacctaacatctggtatttttaaatcaaacattgccactcaccataaaatcttttgtttcatcaactagaaatgtatcacaatgtcttttgtgaattatttaagaaaaagagatggctcaggtatggccaggaagtatgagagctcttaccacagttacttttcttaatcttttcacattcctataaatttaaacaaacacacaaaaacgtcactaagccagatgtttataagaaccaattgctaggaattctaccatgccgccttttagatgctgaatcctatcaactatacatgcaaagaataacactacaatgcttgcacagtgatgtgggaaaaaaaaaacctgcctaaatcagtacttcaaaaaatgtttggtaaactcttaggcacactaagaaaaaaacttgatattaaagacagtgaacgtgaaaactgaaggggaaaaaaggacaacttaccagtttaacagcctcctgagctgcttcttttgtacaaaaagtgacaaacgcataacctctattgagaccagtgagtggatccatcattagacgaagatcccatataggtccagctttctcaaataatggaacaagttcatcctcaaatagatctcttgggatctttcccacaaatatctgtaaattaaatattaagtaaaaaccatggagaattgctttaggaaaccagatacctgtgcttttactacaaaaggtacaagtttttagttgctttacctcagtgccaacagaaggctgctgacctgaataaacggaatctggaggtggtcctccatacttcctctgtccagtggtcacatcaagtgtgtagcctgttctttccaagagtgccttgaaaagttcaaacgtcattaatacatttaattcactagaccacacccatatatttagcagttaacatccatcttgctcaaatctttccaattatcttggcatgttcccttataaaaacaggtttgtgatgtctgttttaaaatttccccttaaatgtgtacttgttatactcctaaattattatcagaagtccagggtcctgttcaaattactttctagtctccacttaattactgaatagtgtgcttaatggacaacaaaaagttaagaccaatccatcagcaactttcaagacaggatgtattactatgttaataccatcttaaaaaatgattgtacctaatttggttgagcatctttcaaatctggatctctcacccaataaattccctataaaccccactcctaggtacatactgccattctgggcattgtgccaacctcagaagaaattacacttcccataccaagtctagaaacttgggagctacagggaaaaaaaatctcctattattatttgacatttacgtgccatatttcatgggatagcatgggtccttcagaaaaaagtaacagccaaaacgacttttaaaaactttatgaaactgcaacgttacataacctctacattttaactcccaaaaagtaactgttaaaatttacacaactcatatttactcagagcattaggtgtttattccttattctaggcaaagtatagaaagaagtataggctgggtgcagtggctcacacctgtaatcccagcactttgggaggccaaggcgggtggatcaggacatcaggagctcaagaccagcctggccaagatggtgaaaccctgtctctactaaaaatacaaaaaattagccaggcgtggtggcacgcgcctgtaatgccagctactcaggaggctgaggcagagaactgcttaaacgcttaaacctggaggggcggaggttgcagtgagcggagatcgcgccactgcactccagcctggatgacagagcaagaccccatctcaaaaaaaaaaaaaaaaaaaaaaaaaaaaaggtacactcctccattatctgaaggaaaaagtcaagaattattccccttctccactgtctcaaccacaaagcacaaaagtggttttctaaacaaaaccaattttattagctaggacattctgaaataaaaacagactaatcctagctatctgacaaaatttatcaaaatgcataatctagggtcacctcagtctctgaaaattactggacagatttttaacattttctactcaaaggacactaactgtttatgaaaaatactgtaattaataaaaacattcataaacttgctcacatctataacataaactaaatgagtaatagctcatctttccattttctcacatgtaatccctatgctataaacggattttttaaccttaatagttaagacccaaataacactttttgtcaatccataaaaacaaaaaggaaaaacttattccctctgtcaaacttcctctaaaaatgtctctatgcctttttaccacaacttagctctcattgaaactgtaagcagccaggcatggtggctcacacctgtaatctcaggactttgggaggccaaggtgggtgggtcacgaggtcaagagattgagaccatcccggtcaacatggtgaaacctcacctctgctaaaaatacaaaaatcagctgggcctggtggcacccaccggtagtcccagctactcgggaggctgaggcaggagaattgctcgaacccgcgaggtggaggttgcagtgagccaagatcacgccactgcactccagcctgggtgacagagtaagactctgtctcccaaaaacaaacaaacaaacaaacaaaaaattaagccacccccttgcaaaaaaaactgaaagctaaaagtcacaaactaaaagtttaaaaactttagttctagctcaccaatgcaaacttgattacaactgaattacaatggagacaactatactccacttttatggaaaaactagatttacagatcaaactcaattcactcacagctagatctgtgaaagcctccaattcatggttgtcttaaacagctaactccatataccaaccttttccatattctaggctttccctgtttccacaccactacaacaatgctcaaggcctatacccttaactgattttcttaaaccatacgcttggctcaagagcactggcacactacaaagcacaccaggttaaaaagtaatacaatcaccacattgtctataaattagaaaactcaccaatataaatatcaaaaccaagctgaatttgaagccattcaccatgattttaaaccaaaaaaaaagcctcctcctcctagcctcagtttctcatctacatacccacactaaacaatcttattgtcaaagctgctttgagaaatagtctaataatccatactgatggaagtggagggcagcagggttaacattctaaattcattggggtttgagactcctaaaaaaaaaagccagttgccaaatgtacattctccatcagtatttcaactgtcaataagctggctttgcagcttttcaaaaaatattctagaggtatcatgggtgtgtttctttatactaggactaccaatagaacagatttaaacatcagtagctggataacatgataaacttcacagcaaattgctttagaaacaaatagtttaaaaaaacttaaaaaaaggaattaggaaagattgatgaattatctcaacatctaacatacatccatttcatacccaaggaatatttaccaaaattaggaaacagttaaaatgactttaaaactaaagggagtatagaaagacataccttaatttttgcctcatctggtcctttactagaatctgctactttggtcccttgtttttctctctgcctgtaagtcttcatgactccacataaaaaggcacttttgttctgcaaaaaaatgttccattaatatttaacaataaccatatctgagtctaataaaattcagcagatagtatcaaaactactcaaattttttaattttcacattgacattaacattacctgaacatgagagagatcactgtctttaaactgttgaagaactgccaatgcaccgtcttcattgaattcttttaaagcttcaatagctctttcatctaaatcactatgtgcaactagccctgaaaaaaataaaagttatcagcttttaatatttttagaaaagattttttagagaagactatgttggcaatacaggtacatgtgtgcctttacaattcttctactcccctcatctatacctgaaaaaaaaaaaacacacacttcagccactctgaactgaatcctgaactaaatatgccctaccaaccacacttacaataatcagctaacttcttttacatcttttatctccaaagtctgataactctgaacactacggtatttttacagtatacagacttacgaatcctagaatcaaccaacaaagtaccaagcatgacaactgaacctctactcaatttcaaataccaccagaaaaagttaacagccgcaccagaaagacaagaaaacaagtctacagttaccaagttatttaagaagaatcctactataaaaatactcaaaaaagtcacatggcctgttcccaacatttagcagctgttgctactatcatatacttatccatcaggccagcatgcaagccagcctttagctcctaaccttctcttcttccctccctctatacatcttaacctctacttcaaacttaaattaaccaactatcacaacaagcaaaactccagtacccacacttattggaaaccacaaaaagttgctattttagctcaaagccagaaatccaatagaaaaatttcataatgtaattttgcaagtgttagttcttacctgcaacgtaaatttcatctagtttttcagcaactttctgtggtaaaccagcatcaagcaatgtctgaaaattttctgaatggataactgcagaagtagtatccatgggctcttcagtaccatttccattaacatgttctgtagccatgtttccagagatctgttcaaacgcaataagcaaaattaaactaggatcttcaaaaagaatacaagacaatatgagagccccatctttactttctctaccatttactacaccagctagcctatacctccctttaaaaaagccttacagtcactatcgcctgacaagccagatttggagcacagggcacagaaggaccgattcaccatattcttcctcagcaccacccctgactcacctgctaacactccctaggaaaaaccatattacaaatagagcccaatcagcacgggtacgagccagcgtgccacatgcagctgtgcccgttcggaaaatgaggtgtgtgtggagaaagcaaaactgggctcctctctctcaaagataaacccccaaagtgcgcgcttttcccgcctgccgcttatagatcggtaacaacagccagcgaagaacaaagcgctcatacaagccaccttcccaccacccaatttctccaccctttaaccccgcaccccaaagcccgcccctgactccgcacccagagcggcagtctcaccactgcggccgccaggagcccattagaaacacgtgctctgcgccttccaatgtcctacaacttccttcaacggcaacccaacgaatcccaaaccaagacgaccatcactggttcccaacatcaacccgaagccgcggtcggagcccccagaaagctgcagcagcacaatctctcccctgaacaccgaggcaccggcggcgccaggccacaggctctccccgccccccagcgccgccgtctccgccgtgacacatggctctccgcccctggcgctccccgggcgccgacgacccccggccgcccgcccggccgagacgtgacccgtggcgcgctgtgcaggtccccaccccttacccttccgtgcagtgactgcgacgcctgcccggcaacccagcagcgtgagggcgttcagcggacggctcaacgcccgcgggaccgtgagcaccgcccaagctcgccgcacggctgcaggacaagacccactcctctccgcccactcccgcgccgcggcgaccgccacgacagcaccaactctgaagccgctcgcggtccgtgcgggccacgggaccgtggaggcgcctcctcccaaagcgccgcagacaaagcccgaaccgcagcagcacatggaaaggaggaagtggcggcgcgggccgcggcctactcccaggcagccccagtcaacgtgctcttctccccattggaatccattttccagaaaagccggtttctacccgcgccaccctcccccagctcactccacaatgtcatggagctcccctcccacacccaggttctggcagtcgttacctccccgttgggctgaggcggagaaatcctgtccgatggtatcgggttgcgggaaacgcgtgctcgctgctccctgtgtccggcgcgagtggagctgttgtaaaatggcggccgaagctcacgccgctggcagcaaacccgatccagttccactcgcctccgagcgcgctcccggtgcgcgcgcgcgcccccgcgtgacccccccttcccttcccttcccttccctcccctccctcgcgcgtccgcttcactcactccctcagcccctgccctcctccagctcctccttctccccctaccaccaccaccaccactagcctctgtccgccttctctcggcctttcttattcccgccccccgctcctttaccccactgctcccactcccctctgcggtcgctcaggcacgagtggccgcctttccccttctggctcgcacgctccctcactccctccctcgctcgctcgcactctcggcccggtcccccagtccctgccgagtcggctcctctctttctctctcccgcgct

SEQ ID NO: 2066 - DNA, 35107 bp, Homo sapiens; identical to SEQ ID NO: 2063
  source 1..35107: mol_type = genomic DNA

SEQ ID NO: 2067 - DNA, 27477 bp, Homo sapiens
  source 1..27477: mol_type = genomic DNA
cttactacatgtattatctttttatttttgatgggaacatgaagtctgttgtaaaatagcactttaaaccagaagcagaaaactgcaataaatcagtgttgtgtaatgtgcagacatattccacacaagaattaacaaggcacaaaaccctttaattggccttgacatgctatacaatttgaaccaaatttgcaggaaattttgtgaaaaacgaattgtaaacacaattttagtaagtatacatttaggtgtgaattttttattgaaataaacaacagcataaagaatacaagtagccaaaatggttttgaaaacccaaattaggtcaaagttctaaattaaaaatagcagttgtgtatcaatttaccttattctagcaatttaagttggtaacatacaaagttattctgatacaagatattaaagacacacttggttttaatcaactacctttgaagacaccaaatctaaacactactggaaacatcgttgacactacagccaaatggacttgagccaaattttctcaagcacaaatgcaaactcattaactatttctttcagtatctaagaatatctttattgaaaaaaattaaaaataaaatcagttcgccagaagcagttagaagtgtggctttgttcgtgtccaagcggattgttaaaatatatacataaagggaaatcttgccagatgtcacaaattatagcggcacccgttcagatttagggtgagtttctgatcaacctatcagtctccaattttacagaggccctactgtttctacttccactgttgcccaaaagtatcctgataaaactcctggttttcagatttgtaaccatagttaccagaatgatcaccaccttggagcggttgctgagcaatgggttgggagccccagttctgattattggtctggcgccgcttggaatctggctggttgtacccatcagctttgcgctttcctcctacatttccaccgcggccacccctcgcaccacgtaccccgcggcctctttgttgttgggcacctcctctcgcacctcgaacgcctcttgctgatccaggacctcctctctgtgaataaccggctctaccgcggggaggagcagccccacgacctctggatggagcagcaccccttgctcctctaccaccccttcctctagctccaacttgaaaatcttcataaccatagtatggatcttcatatccaccacgatagttatggtaatcataaccataataatcataataatcttcatatccataataatctggaggatatccataaccacctctacctccacgccctcgacctcttgttggagggggcatatgaggtggaccataatagtagtaatcgtcatacctattaaaaaagagacagagattagagtttaaatcaaattacttagttaacaagtaggcatttagccatttgtaacagtttaaatccagagtttacttcgcataattcacataactttaatacagaattatttgtactagattaagttttagtagtagtaatgatcagaggatcaggatgacaatataggcatcccaaaataccacaaatctctagttatgaaccttatttatttcttcatgatcttcaaaatctcccaataaacctgttacagaatttttacaattgatttagctgtcaaatttgccactttagggctgggagcggtcatgcctgtaatcccagctatgcgggaggctgagtgaagcaggtgaatcgcttgaacccaggtggcggaggctgcagtaagccaaggtcacatcactgcactccagcctgggtgacagagcgagactctgactcaaaaaaaaatttgtcactttgaattgcatttctgctaagattctattccaatatacttgaagaacatttattacaaaagcaaaatggcaagtaggacaagcacacaaccaaaatgtgtgaagttcaaagtttactacagtaaattagcataaagaccttaaagttttcctgtttctacaataatgctatccaagtaaaatttaaaagatctgctactttcccaaaaataaactacaccgtaactatagtgctgaactttaaccactaaacaggtataactttagttgtcaaagtgattagaaagcaaccacacaaatcagcatatgcttacatactatgtaaaaggactaaacgaagttacaatattccaactcatgttccctacagtacaattttatacaattccttaaaacttagtgattattttgagcccaataatcccatgaaatatggaaattaatccctcttgaaggaataatttactcgtgttttttattccgtacctgttatgttattttatttatttatttatttgagacacagtcttgctctgtcacccaggctgcaatgcagtggcgcaatctcacctcactgcaacctccacctcctgggttcaagtgattctcctgccacagcctctcgagtagctgggactataggcatgtgccaccatacctagccaatttttatttttagtagagatggggtttcaccatgttggccaggctggtctcgaactcctaacctcgaatgatccacccacctcggcctagagtgatctgcccacctcagcctcccaaagtggtgggattacaggcatgagccaccacgcccggccttattttatcctgaattattaaaggcccctgttccaactgactaacgtaaaaatgttattccggttcactaggtccttagaccttttatgtgctctgctggtttattgttttgaggaaatgatggaaagatcatccttttctatttctaaatagttctcaccagggataattttgccaccacctctttccagggggacattttagacggtcataactgagaaagggggtgctactggcatctagcaggaagaggccaaggatgctgctaaaagtcctacaacgcacagggcagcccccaagaccaagaattatccagcccaaaatgtcaggaggacagagatgagaaatcctggtatagtggttaagagggaaaattatgggagactagactaccttagttcaaatccaactccactacttactatgtgaatgaccccaaggaagttgacttctgagcctcagtttcctcatttcaaactaagggatagagtacctaactcacaggaatacagtgagaattatgtaggaatacgtgcttagttaaaacttaaaaaaaaaaaaaaaaagactgtagcaagttaaagtacgaaagtaacatgcaatcatcccttttagtttgtactccttttcaaatattaacagatatactgacatcctccaccttctatttagtatctccctctatcaagtaccaaatgtaactgctctaatcacattatctaatataatctcctatacttacattctactttaataaattaaccatatatcgtcttctgaaagaaataaaaagaagttattttacactgtttagtatatccaggtgtttgaaatatagagcattaaaactaactctttttgtagtcttccttcatttacactatcatcaaacctacaaagtatattttctttggtcccagaacaagcatgggtcacttggataatcacataatccagagctattacataattttgtctgatcccattttagaactgaagaaattgaggttcagagcttgccaacttgtccaactggacaattaactgcagaaactagaacttgatcaattccctgattatgaagtaacagaaatatgtagaagcatcctcttcctttaaattccaaacagggcaatcaacagaaaattaaccttgaatagtattgacagtgattattgctctcacattcaagaacaattacccctcttctaggaaatcagtaactaactttttaggagctaacttcaattcttacccaactaagtttccttcagtcttaagcagatacctatttacagattctctaaaaaggtctccctaattagtataactcattacacacctacttgttttcttattgcactactgtgttataattttaatactcatttcattttcaaaatccatccatcgaacatgaaatttttggggtggcaatgagcactactggtgaagaaacagtctatcatgaatagagatttagtatttcctatctctcagagaaaaaactctccaccctttaacaaaatgtattaagatatttggacagctaatatttaagacattttcagaagaacattctgtaaaatacaaagaaaatatgtgagataggccaggcatggtggctcacagctgtaatcccagcactttgggaggcagaggtgggcggatcacctgaggtcaggagtttgagaccaacctggccaacatgacgaaaccccacccctactaaaaaaaaaaacacaaaaattaccaggcatggtggcgcctgtaacccagctactcagaagactgaggcaggagaatctcttgaacccgggaggtggaggttccagtgagccgaaagagtgccactgcactccagcctgagtgacaaagtgagactctgtcacccaatacaaaacaaaaaaaaagctagacagatttttcatcttgccaatttaccaaaattccagttatttacaattctgattattttcacaaatatggttcatagtaagagttcaataaacacttagatcactggtgtttccctatgactctcaaacgttcaagtcttctttaaagagatgttatgcatttaacaagtctgatcaacacctgttattttccaattagtgtataaatattaaaatttatacaatttttaagtatacaaatttcactcacatttgattttttgctgcttgcctctgagcttttctttctttccttttctgatctggtggcttggcaaaaacaatttcaatattttctccctccaagtctttgccattcatttcttccatagccttaaaaaattagataagtcaatataaaaataggactttcatacaattatgattcatttaaagttggaatatcatttatcattaatgtgggaaggacaagagaaagccccatgcaggcagtcaaataattttatttaaagatgcagatattcaattatttttcatttttacttagaaaactgccaacatcactaaaaccaaaaggttttagtttgaatggattccatggacttccaaagtctcctccaatttgtaaaactattttgagattctaaaatgactaaatttgttagtctgatttagatgcctgtaattccaccatatttaccttgacagcaccatctcgctcatcaaaatgaatgaacgcataatcttttaacttcttcactcgttccagtttcccaaactgactaaatgccttttctaaaatctcttctgttacagtattggcaaggttgcgtacaaacagcacttttacctagggggaagaaaatacccccctgtattatttccaaagagttccatttctaagataccaccaccccaccctacaaagttaactcaaatcacaatccattagaagaatgtcagaatataaaaaaaaaaaaagttttcaactccttgggtaaatatcaagcagcagaactgctggatcatgttgaaagacctgaaatagatgctttgccaaaaaagatatacagatggcaaagaatctcatgaagatgctcaatataatctgtcattcggaaaccgcaagtcaaaactattagaatggccaaaatccaacacactataaatgcaggtaagaatgcagagcaatagaaactctcattcattgctggtgggaatgcaaaagggtatagcccctttgaaagacagtttggcgatttcttacaaaactaaacacacacttccatatgacccagcaatcctgctccttatttacccagagttgaaaacttacatgcacacaaaaacttagagagagatgttaatagcagctttatttgtaactgccaaaaatttgccagacgcagtggctcacacccgtaatcccagcaatttgggaggctgaggcgggcagatcacctgaggtcaggagctcgagaccagcctggccaacacagtaacaccccgtctctacaaaaatacaaagattagccgggtgcgatggtacgcaactatggttccagctactcgggaggctgaagcatgagaaatggttgaacccaagaggcagaggttgcagtaagccgagatcgtgccactgcactccatcctgggtaacacagcgagactctgtctcaaaagaaaaacaaaaaaatttccaaaaattggaagaaaccaagatgttcttcaatgggagaatggacaattgtggcacatacagaaggaatattataactgatagaaactagttaaaagccacaaaatgacatagaagaactttaaatatgtattactaagagaaagaagccaatgtgaaggttacataatgtatggttccaactatgtaacattctgagaaggcaaaactatggagacagtgactgccagtggttgaatggggagggatgactaagcacaggacagaggatttttagggcagtgaaactattctgtataatactatgatggaaacacggttatacatttctccaaacccacagaacatacatctagagtgagacctcatgtaaactatggactttaggtaatcaatctacgtccatcaattttaacaaatgtactattccagtgcaggatactggtagtgaggaaggctgtgcctgtgtagggggcagaagtcatatggcaattctgtgctttctgctgtaaacctaaaactgctctaatgaagtctatgaaaaagaaaatgcagactacaggctacatcagtaataattaccaattagtaattattttgcaataaaaaagataatttttcctaacaaagtaaataccatgccctctaagagagttattgaatgtttaacacttaacaagagtggccaaaactaattaggacctgcttttgaaatcttaaagggggaaggactgttcaaaatattagtaagacaaactgttctcaatcctgaaagcttctcaaagtaaaattacaaaatttaacctcttcactaacattatcacttcctcctaaaataacttgaataccatctgaatgtgttaatctaaagtgctaacccaatgagaatttataggccagaggaaaaatgaatcctaactattttctcttctctaagaccacttatccttcaataatattcatagctccctggcagttcatattaccctcaatttaactcaactagtggtgtctgacacctaacctgtaagtaacaaagagggaattcttaaaagacaaaggataactggggcatggtggctcatgcctgtaatcccagcattttgggaagcaggattgcttaaggctaagaattgtaagaccggcctgggcagcacagggagattaactctgcctctacaaaattttttaaaaaaattagccaggtgtggtagtacacacctgtagttctagctacttgggaggctgaggtgagaagatctcttgagcttggggctacagtcagctatgatcatgcccctgaactctagccctgggccacagatctagaccctgtcacttaaaaaaaaaaaaaaaaaaagagaacaaaggatagaacaaataactgcaaattactgcaccagtgtgtaataaagtgttgactcaagggatgtttattcttatacaatgtctccactgactgctgaagtcaggatacctaataatggctaaatgtaactgcaagcacctctgctgcggccagtataatttactgtttttagtagtaagacttttaaccccaaaaccatgtaaactaatggtgccattctcaaaaactcaaattgctcttaaaaaacacacaaaatggaagtcaactgtctacagcatgtaggcgacttcattacaagattgtgatggctatacaattatggctaagtatccacgcatcaatttctattttcactttgcaggcacatggtatttccagtgcgcactgcctagtcccgtagtaaagaacatttctcccaactctaaaaatatggtttaaaaaaaaatgtgtccagggccaggtgcaatagcctcacgcctctaaatcccagcactttggaaggccgaggtaggtggatcccgaggtcaggagttcgagaccagtctgaccaacatggtgaaaccccagctctactaaaaaaaacacaaaaattagccaggtgtggtggtgggagcctgtaattccagctacttgggaggcaggagaatcacttgaacccgggaggcggaggttgcagtgaaccaagatggcaccatggcactccagcctgggaaacatgggaaacaagagactcttgtctcaaaaaataaaaaaatgtatactgttcattttatgttccccccaccccaaccccggcccttctcccattaatccctcaaaaaatatttttaacttgactatcattacctttgccataacctcaggatcaggatcttctataggatcagcccattcaacagttccaacattcccccagaccttgactttaccactcattaacctacgccttgcctgggcagctgttttgtgatcttcatattcaagaaagcaaaagcctctgttttttttcttgtcatccggttggtggtataaaatgacgtctgtaagaccctctgcaagtaagcaaccattccaggaaaattagatgaaataactagcaaatacaagtggatcaaaggatttatctaagatactacttaaatatcaaaatgaaaaatcatctctttccttcactagacatctttataaaagactatcaaaaactaggtccggattattttcctaatctgtttccaagtttttcaacacagaaatctccagaaaagaacatgtgctctttttagaggtaaggactacttttgttttcactaattagatcagagaggcagataaaaattttcatataattgttctaagaaaatggcagtatagatcaaatatggctatttttcttattatgcaaacactaaaattatttttaatggcacttttctggccttagatatcaatggctttatttcaaataaaatagaagttataagtactgcataaaaatttccaatgtcctgaaagttgataacaggctgataatttgttagacactgttggcagaccaaaatattttctaaaagcaacctgtcacttaaaagttgttacagttcaaaaaatttttttaccatgttgacaatatataaactctgtttatgggccaggcacggtggctcatacctgtaatcgcaacactctgggaggccgaggcaagcagatcacttgaggtcaggagtacaagaccagcctggccaatatggtgaaaccccacctctacaaaagacgcaaaaattagccaggtgtggtggtgcgcgcctgtaatcccagctactcaggaggctgaggcaagagaatcccttgaatctgggaggcagaggctgcagggagccaagatcacaccagcacactccagcctgggcaacaaagcaagactgtctccaaaaaaaaaaaaaaaaaaaaacactctgctacggcaatacttactactcctgtaatttcaagaacatcaaatcattattcaaacaattctactaagaacatcaactaacacctagagaaagaacacacaaagaaatacgatcttccaaaacataggaagaacaatgattttgcagaatgaattcaaaccctagctgtattccctactaacttgtacaacgtttggcaagttatttcccaaatccctgaatgcctgttcttcttatctgaaaaatggggttacctacacttcaaaagttgtagtgaggattcgatgagtcaataaatgtatttagaacaatgcatgacgcacagaaatatgctattaatcttcattattaaaagctgcacctcattccaaataaatccaacttacctgttactttgctaaattcttcaagaatctgttccttggttttactcttaggaatagagcccacaaaaagcctattgttggcaactgagatgcagacaccaatatgttttccagaacgaatttcatgattattatactgaaaggggaaaaagtgcatcatgtttttaaattacttatacaactagaacagttaattataaaagatacacaagagcaaatcatcctttaaaaagtagtttaccttaattcccatacaagggaattatgaggaacagattatattaacaagacccattggacaagttcatgaaccaatttaatgcaaataaaaggttattaaatcctttacttgattaattagaaatcagatctgcagcagcttaaattcaaaaactgccagttcctcaaaaacttaacttttacttaagttcatcccatcaaccagttattctcatacaaggaaaactgatcccaagatcagcaagatctctgccgttctgttaaccagcacctaaatctatttttccatcttcccttcctcttatcaaaagttgtaataagaaatttcaggcttcaaatatttaagcctaaaaaaacagcttttatttctaaatccaactgtactttttccccatttcattttcattatgcatataacaaattatgaaggagaaagagaagtagatttgtcatggcaaaaatatacagaaacaactttaaaactacagtaaaaagtaaattgaattttcgagtaaccatatcccagattatcagaaagcagaggcaaaaagcaacatgtcaaagtgacaaatccaccaattagtattatttacaaacccaagtgcaaaagtatccaagtaatctagaaaagtggattatatgggttagttaaaaccacacctcaaaatttgttactaataatggcggcagcagcggcaataattattgattaatcctcccacacctaacctcaaaatctattctacacgtggagctacacaaactaaagaaccaacatcaatttccatacaactttatagaaataccttacagcaaaagaaaccattcttctattatgcccatccttgctaggtacaccgggtataacagaagaaaacatgtaagtcagaaagttgagtcctccctgtcccttccccatctccagaaaatcaaaatttaataaagttcaaataccatacctccagttcagaaaaatttattgctttctaccccactattctgtacaggctattcaagtgtgtggccctcctgatcccaggtttacttctatttctctacatttatgccagagacacaacattaaaaaaagtaaaaagatgactcctgctactttctcctctctctctcaaatacctttttatatcaactcttaaacatacagggtttttttttttttgtcttttctgagacagagtcttgctctgtcccccaggcaggagtgcagcagtggcactatctcggctcactgcaacctccgcctcctgggttcaagcaattctcctccctctacctcccgagtagctgtgattacaggcgcctgccaccatgcccggctattttttgtatttttagtagagacggggtttcaccatgttggccaggctggtctcaaactcctgatcttgtgatccactcgcctcggcctcccaaagtgctgggattacaggtgtgacccaccatgctgggccacatgcaatttttatactcctatggctctgaagaaattgccttccttccctgaaacttctaccatacaagctcctctggatacctgtaaattaagttcaaccacccaatactacaatacataaatcctaaaagggtcaacaaaatactcctccatgttaacacagaccaacagttctcaacaggagtgattttgccccccagaagtcatttgacattcttgattgtcacaacttggaaagaagtggggacttgctgctggtatctactgggtagacagaaggatgctgatacacatctaacaattcagaagacagcctgtcacaaagaattatctagtctaaaagatcagcagtgctgaggttaaaaactcctgccatatactttgttttctcatatagcattcatgtctttctcttctaccagactaataatcttttaacagcagaaacatgttacctgaatgtagcagagctatggctgaatccatcattgcacagaattatggacaagtagattataatgccttattttgcaagtaaaattaaactaagaacacaataaattactttaaaatatgtacattccctggattcttataatctagcatcaagtagccagccttagcaacaaatcagtggttttcaaattggtcatgcaatcagtaattctagtaattaacaaaaacaattaaaataccagaaaaaggtggaaagaaataccaagtgtgtaaaggcaaaaacaggagtgattttgggggtgacagattttggtataatgagggggggaactggtattttccaaatgttctaaaatcaggagctattaactataagaaaatacctaattctaaaaaaacttctaacagaaacttgaattcttagttctaccaagaaaatacaccattgagaggaaccaaaatccttataagaaatgtaggaggcaaaggcaagacaacagagaatggaaacattccatcaaggcaacaataatcaaagaaatatagagaagacagctaatctgtaacataggcaacacttccattaaccatcaacattaacaatgctgcttcaaattattaataactgtttccattattatctacagaaacaccatttttttccttcttacccatcatcactagccctgatgctaatcaagttagccaaggcatggtaggtagaaagtacaaaggatggatgtggtctctgaacaacataaataacacaaagatttagcaggatctataaaataaactgctgattcctccctacccacattttttcaattaaaaaacttgggccaggcgcggtggctcatgcctgtactcctagcattttgggaggctgaggcgggcgaattgcctaagctcaggagttcgagaccagcctgggcaacacagtgaaacgccgtctctactaaaacacaaaagaaattagccgggagtggtggcaggcacctgtaatcccagctactcgggaggctgaggcaggagaatcacttgaaactgggcggcaggggttgcagtgagcccagatcgcgccactgcactccagcctgggcaacagagcaagactccatctctacaaaaaaaaaaaaaaaaaacttggaacaattgtattacaggtaacacagagagtcaactggctctccaatgaaaataagtcattaagcgaacaaagtaaggagactctgggtacaactataacaaaagtagtacctagaaattaacatttccggaagcaacaccccatctacggattacgcatgctttttttgtacgtgtatttgaattgcttaacctttcttacactaatgccactctatcacctaaaaaaaaacaaaaacaaaaaaacacttatcccagcaagatgggtaacagtgagttatatggtgaatggtgtaatacaaaaaacaaatgtgaataagagattctaatttaatactagtaaaccctaactcaagaagtgtatcaggacactacagtggtataaaaaaacgagcacacacacacaaaaagtcttatctttcctactctagaaaggttggccctgaatcttgttagttgtaaaaatctagccttcaagctcagtaccacagctgagatgaaccaaatagaaaatgaagattaattatgatcattaatcaatgtgaggtttcagtttttaagaacaccaaaacagtagtacagtctggaacgttcctgtcatcaagtctcaaaattttaagtcacttttaagtccttccctcatagtcaccaaattcccagaaattcagcaatgtcaaatttggaatctgatccagaagaggctgcttagtcctaactcttctcagcaaagcccctacctccaaagccttccacattgaagatttcttttttttttctttttgagaccgagtctcactctgacacccaggatggagtacagtgacgcgacttcagctaactgcaacctccacctcccggtttcaagtgattctcctgcctcagcctccctagtagctgggaccacaggcgtgtgccaccacacccggctaatttttgtatttttagtagagacagggtttcaccatgttggccaggctggtctcgaactcctggcctcgggtgatccgcccgcctcagcctcccaaaatgctgggatcacaggcatgatccaccgcacctggcctaaagatttcttaattataaagtcttctttacaataagccaaaatctacttccttaaataaacctatttctttcccccaaatgacagcatttcatatacctggcacacaagcacatgactcagttgttttctatgcttggctaatcattgcttccctgataatggcaaactaaagtacctccaagaaatactgacaagtgtcactgaagagtgacattctaacacaatactgtaaacgcagactgaaacaggagtctagaataaactggagcttattactaattttccacttctagacaccataccactcttacatattgtctgtgttaccctaggttatttggcaaccacacattactgacaccacagcttgttaaactagtgtaaatacttaactttagtcaattccatcttggtagatataaactttctatctcaggctatcaaaagtttttcagatcctgacggtcatccaaggcatttatcactgaatggagattcaagttaccaaacgtatcatgaacagtccaactacactttcaattcttgataaaaactagaatacaacctacagcataccactatggcctttcatttctctttccaaaatctccgatctttctcctttctattgctgccaccctcctcctggcctttattgtctttattcaaataatcttcattattcagccacttacaacatgccacccacatcagggctcaaaaagggggtggggggtgctatgcagcttagcccagtatgaactaactcctggcactgactttattacaagttttatttccacaaaacactgcttcaactagattcaccttttttcttcactgtgctgctcaaacctctttattgcaaagccttctctgacaaccctaatccagtctcccttcatccttcctttacgctttgcaccactggattccactgtaacagtagtctttcatgttctataaactctctaagaacctgtatatctgaagtaaaagttttcatgctaaacacactatttgctaaattattattaaaatatctctgaacctaccttgtcaactacattcatcaaaatggctgttcatgaggccgaagcaaatggatcactgaaggtttggagtttgagaccagcctggtcaacaaactaaaaatacaaaaaaaaaaaaaaaaaaaaaaaagggccgggtgcggtggctcatgcctgtaatcccagcattttgggaggccgatgtgggcggatcacgaggtcaagaatttgagaccagcctggccaatatggtgaaaccccatctctactaaaaacacaaaaattagccaggcgtggtggtgctcacctgtagtcccagctactcgggaggctgaggcagaagaatcgcttgaacctgggaggcggaggctgcagtgagccgagatcatgccactgcaatccagcctgggcaacaaggcgagattcatatcaaaacaaaacaaaattagtcaggcatggtggcgggctcctgtagtcccagctactcgggaggccgaggcagcagaatctcctgaacccaggagacagaggttgcagtgagctgagatagcgccgctgtgctccagcctcgttgagagtgaggatttgtctcaaaaaaaaaaaaaagctgtatacacatcatgacagtatacataaccaatctggtgactaaaaccatcagaaccatcagagctattaaaataacttgtgggccgggcactgtggctcacgtctgtaatcccagcactttgggaggctgagacaggcggatcacgaggtcaggagatagagaccatcctggctaacacggtgaaaccccgtctctactaaaaatacaaaaaaattagccgggtgtggtggcaggcgcctgtagtcccagctactcggaggctgagtcaggagaatggcgtgaacccaggaggtggagcttgcaatgagccgagatcgtgccactgcactccagcctgggcaacagagcgagactccatctcaaaaacaaacaaacaaacaaaaaaaatcgtaacgtgcaaacagatttcatctattccaatgcttgtacatagacattattagcatttcatcaggatatttccgttatttaagattgtcatggaattgcagcatcaccagccttgggctccaattccagcaacataccacacaaatacataaacacacctgcctgcccttcttcatggtctttaaatcaacatgtctatttccaaacaacccctaggtaggtaagggaagaaagcatcatcacctactaatttaccttaatcacagggcagtaagtagcacagaattgtaaatggaggctattaaaacagcaaatggtccatgagttacataagaatattagagagcactggtcagcaagtcaggttatttatccaacacctactacataatggggcacagttctaaatgttagggaaaaaggaaaaatatatacatattctaatgggaaaagacatgtaaataatttacaaagtcaaaaaataattacaagctcatccaagcaaaatctattttatcattcttagaatactgtcatgggggcaactgggtggtaaggtgctcaatgtcaccctacctgaaaagaaagcatcagtcataaatgggctgctttcaacccctacgaaagcagaacagcagaaggcagccttaaaatgataatggccatggcttggctgggcacggtggctcacgcctgtaatcccagtactttgggaggctgaggcgggcaaatcacttggggtcaggagttcgagaccagcctggccaacatggcaaaacgccatctctactaaaaatacaaaaatcagccaggcgtggtggcacacacctgtaatcccagctactcagtggctgaggcagaactgcttgaacccaggaggcagagggtgcagtgagctgtgatcgcaccactgccctccagcctgggtgacaaagcatgactgtgtctccaaaaaaaaaaaaaaaaggccatggcttaaagaaggcgaaacatggctaaaagggtaattaaaaggaagagtggggaaagaggtaagaaggaacttgtctggatagggccttgtttgtaagtcatttttcagcacaggaatgctgtgatctaattgatgttgccaaatataaagggcaacagaaggcagtgagactagctaagtttcttcagtagtctgaatggtacaaatggtaccttagactaactagggtagtagcagcgaagaagataaaaagtgttagatgctaaaatattttggcaacagataggacctacttccttaactcttttaacactacctaaaccactacataatttaaagttatcaggctacctggtgacgtaacttgtacagttggcttaaattgttatgtctaacaatagggacctcagctaaagaaacctggcatcaaactagggctgggatgtttagctgtatggcctcaggcaagtctatttctttctactacctggcagaaagggttgttgaggctgaatttaaaggtgataacgtagcatctaacaaagctcctgtcccttaacaagcactcaagtagtagctattaatcaccttttcacaagtttagatcatgcttccctagctagattatcatcatttacaaatggatttttttcattccccaaaatgaaggtagatgttggctagaatcagggtcatttaagaaacttgaagttgctttcaattaacttcatgcctcttcaactgttaacatcaattaacccatttttataagtccacatacaaatataaagtctacagtactatttaacctagagaaactattcattgctgtatcagtattaaaagacaatgccaaatacctaaaactatttcaacctaaggtattcctccagacactcaaaagagaaacagaggtgcttcaatcttgtctgatctataaataatgcaaaggaggcatgaggcactttcccaacatttagttatatataactagaatgacacttcaattaaaaactcactttggatagaactgtaacaagtagaatctcaaaatgtaacacagtagagatagcttccaaagtatgcgcccttgaggaacatacttaggaaaggggtattcatgtccgcaaatgaatacaaagtggcaaaaaacatccaaaaaaacttgagatttgtattttctctagaatgtttcaattacttcactttctctaaaatctagttctttgttgtgctaaagcaaatctaccagatcctacccacagtaaagcatccttttaaaaaaaaagtaaacaatggccaggcgcagtggctcatgcctgtaatcccagcaatttgggaagccaaggcagtaagactgcttgaggccaagagttcaagactagcctggacaacatagtgagacaccacctctacaagtttaaaaattagcctagcaaggtggtgccctcatagtcctagctgctgaggaagctgaggcaggaggatcacgtaagcccgggagttcaaggttagtgagcattgatcatgacactgcactccagcaagggcaacagagtgacaacctgtctccgaaaacagtaataataattaaaaccgtttacttaaggccgggcgcggtggctcacacctgtaatcccagcactttgggaagccaaggcgggtgaatcacaaggtcaagagatcgagaccatcctggctaacacggtgaaaccctgtctctactaaaaaaatacaaaaaaaattagctgggtgtggtggtgggtgcctgtagtaccagctactcaggaggctgaggcaggagaatggcgtgaacccgggaggcagagcttgcagtgagccgagattgcaccactgcactccagcctgggcaacagagtgagactccatctcaaaaacaaataaataaataaataaataaataaataaaataaacaatttacttaaaagtaggctgggtgtggtggctcacacctgtactcccagcactttgggaagccgaggccgagactggggtcaggagtttgagaccagcctggccaacagggtgaaaccccatctctactaaaaatacaaaaatcagtagggcatggtggtgtgcacctgtaatcccagctactcagggggctgaaacagaagaatcacttgaacccagaaggcagaggttgcagtgagttgagatcacaccactgcaccccagcctgggcaacagagggagactccgtttcaaaaaaacttactaaaaagtcaaaaaaagcaaatgatggtatgaccaatatatcctactggctgtataccaatacctaccattggaaattttttttttccccctttttggttttttgagacagggtctctgttgcccaggctggagtgcagtggcatgatcacaggtcattgcagccttgacctcctgggaccacaggtgcacgctgcctggctaatctgttactttttggtacagatggggtctatgtttcccaggctggtttcaatcaatccttgcacctcagcctaccaaagtgctgggactacaggtgtgagcaaccacaccctgccaaaagtatcttttaaaagacaacaaaatgcaaagtctcctattaattagatagtacaaaataattatgcccccagaaaaggattcaaatcacaacagagaaacccagaaagaaatgtagaaagttttaggacaagggttaattcctacgccaatcaaaaagaatgcttatctatagaagtttctccattatatttaaaaactatattaataagactatattctaagcaacctacagcaatgcaattttataatttaacgtatttattaaacaaggcaattgtacaaatggaaacatttcctagtgtctactggcactcgaaatcactgttactaatggattataaaccatcttcctctaatgatgtatctttactgtaaagtttctggaaaacatctataaataagttatagtggtcacctaccataattggtacattttgacggcaagaattaggtaacctacgatgtcagtttaatgattctttttcataatgttaaaaaatggatgacaccactagctaaattctgcagtggtccctcagcacatacgggggactgattccaggaacccataccaaaatccatgaatgctcaactctcttaaatagcatagtgtttgcacataacctacgaacattctctcatacactggtgtgttgttttttttttttattgggttttttgggagtatcttcaatcctcagctagctgaaactgtgaatgcaggacccacagtagagagagcccactgtattagctttctgtagttatgatacctcattgcttactggatcattctgcattttcacttactgctactttattgctacttggcaaaaatattctactcttttataggagattaaaggattttgggacaggcaaggtggctcatgccagtaatccttgcactttgggaagccgaggtaggaggactgcttgagaccatgagttcaagaccaacctgccaggcacagtggctcatgcctgtcatcccagcactttgggaggccaaggcgggcagattacttgaggtctggagttcaagaccggcctggccaacataaccccatctctaccaaatatacaaaaattagtcaggtgtggtggtacgcgcctattatcccagctactcgggtggctgaggcaggagaattgcctgagcccaggaggcagagattacagtgagccaagatcatgcccacacactccagcgtgggtgacagagactttgtctcaaaaaacaaatcataaaaacaaactaaaggatttctaaggtacctctttctagagctctaaaatgcccctcccctcaaattgaactgctgaaactaaaattttgacaactcaaaggttaccagtaaatctgaattccctctaaaacacaaagcactcttttatgaagagaaaaatcagacatgatttgaaaatatctaaattctcaaattctctttgtaaaggcttatattctttcaagtaacataattttgtactgtttaacttccatcatactcaattatgcaaaccagtggggaatattcacacaacatagaaaaggaagacttggccgggtgcagtggcacacgtctgcaatcccagcactttgcggggctgaggcaggcatatcttctgaggtcaagagttcatgaccagcctggccaacatggtgaaaccctgtctctactaaaaatacaaaatttagccaggtgtggtgataaatgcctgtaatcccagctaccggagaggctgaggcaggagaatcgcttgaacctgggaggcggaggttgcagtgagccaagatcgcaccatggcactcctgctgtctaggtgacagagtgagattctatctcccaaaaaaaaaaaaaaaaaaaaaaagaaaaggaagacttatgagttttatttttctctttaaggcttgcttaaagtgataaacctcatggtaaaggaaggggtaaaactcaggagggagggaaaaaaaaatgagtctgaagattttaagtttgtctggaattacccacaggatacgtaagccagataaagcaaatttaacaaacatggcatagtgagctatcttgtacaaaagttctccccagtcgtgttgcttgatacattctatgggtttaaattagcccccaactcttcaactataaaatgcagaaaccacttctgtcacagaacttaataaaactagtttaaaggacttacataaactataatttaaaatattaaaatttctttctagccaggcgtggtggctcacgtctaaaatcccaggactttgggaggccgaagcgagtggatcaccggaggtcaggagttcgagaccagcctggccaacatggcgaaaccccatctctactaaaaatataaaaattagcctgagcgtggtggcaggcgcctataatcctagctactcgggaggctgaggcaggagaatcacttgaacctgaggggtggaggttgcagtgagccgaaatcatgccacttcagcctgggcaagagagagaaacttggtctcaaaaaaaaaagaaaagaaaaaagaaaaatttcctttttaaaaaagttggaaagattaccaggtccttacctaacatctggtatttttaaatcaaacattgccactcaccataaaatcttttgtttcatcaactagaaatgtatcacaatgtcttttgtgaattatttaagaaaaagagatggctcaggtatggccaggaagtatgagagctcttaccacagttacttttcttaatcttttcacattcctataaatttaaacaaacacacaaaaacgtcactaagccagatgtttataagaaccaattgctaggaattctaccatgccgccttttagatgctgaatcctatcaactatacatgcaaagaataacactacaatgcttgcacagtgatgtgggaaaaaaaaaacctgcctaaatcagtacttcaaaaaatgtttggtaaactcttaggcacactaagaaaaaaacttgatattaaagacagtgaacgtgaaaactgaaggggaaaaaaggacaacttaccagtttaacagcctcctgagctgcttcttttgtacaaaaagtgacaaacgcataacctctattgagaccagtgagtggatccatcattagacgaagatcccatataggtccagctttctcaaataatggaacaagttcatcctcaaatagatctcttgggatctttcccacaaatatctgtaaattaaatattaagtaaaaaccatggagaattgctttaggaaaccagatacctgtgcttttactacaaaaggtacaagtttttagttgctttacctcagtgccaacagaaggctgctgacctgaataaacggaatctggaggtggtcctccatacttcctctgtccagtggtcacatcaagtgtgtagcctgttctttccaagagtgccttgaaaagttcaaacgtcattaatacatttaattcactagaccacacccatatatttagcagttaacatccatcttgctcaaatctttccaattatcttggcatgttcccttataaaaacaggtttgtgatgtctgttttaaaatttccccttaaatgtgtacttgttatactcctaaattattatcagaagtccagggtcctgttcaaattactttctagtctccacttaattactgaatagtgtgcttaatggacaacaaaaagttaagaccaatccatcagcaactttcaagacaggatgtattactatgttaataccatcttaaaaaatgattgtacctaatttggttgagcatctttcaaatctggatctctcacccaataaattccctataaaccccactcctaggtacatactgccattctgggcattgtgccaacctcagaagaaattacacttcccataccaagtctagaaacttgggagctacagggaaaaaaaatctcctattattatttgacatttacgtgccatatttcatgggatagcatgggtccttcagaaaaaagtaacagccaaaacgacttttaaaaactttatgaaactgcaacgttacataacctctacattttaactcccaaaaagtaactgttaaaatttacacaactcatatttactcagagcattaggtgtttattccttattctaggcaaagtatagaaagaagtataggctgggtgcagtggctcacacctgtaatcccagcactttgggaggccaaggcgggtggatcaggacatcaggagctcaagaccagcctggccaagatggtgaaaccctgtctctactaaaaatacaaaaaattagccaggcgtggtggcacgcgcctgtaatgccagctactcaggaggctgaggcagagaactgcttaaacgcttaaacctggaggggcggaggttgcagtgagcggagatcgcgccactgcactccagcctggatgacagagcaagaccccatctcaaaaaaaaaaaaaaaaaaaaaaaaaaaaaggtacactcctccattatctgaaggaaaaagtcaagaattattccccttctccactgtctcaaccacaaagcacaaaagtggttttctaaacaaaaccaattttattagctaggacattctgaaataaaaacagactaatcctagctatctgacaaaatttatcaaaatgcataatctagggtcacctcagtctctgaaaattactggacagatttttaacattttctactcaaaggacactaactgtttatgaaaaatactgtaattaataaaaacattcataaacttgctcacatctataacataaactaaatgagtaatagctcatctttccattttctcacatgtaatccctatgctataaacggattttttaaccttaatagttaagacccaaataacactttttgtcaatccataaaaacaaaaaggaaaaacttattccctctgtcaaacttcctctaaaaatgtctctatgcctttttaccacaacttagctctcattgaaactgtaagcagccaggcatggtggctcacacctgtaatctcaggactttgggaggccaaggtgggtgggtcacgaggtcaagagattgagaccatcccggtcaacatggtgaaacctcacctctgctaaaaatacaaaaatcagctgggcctggtggcacccaccggtagtcccagctactcgggaggctgaggcaggagaattgctcgaacccgcgaggtggaggttgcagtgagccaagatcacgccactgcactccagcctgggtgacagagtaagactctgtctcccaaaaacaaacaaacaaacaaacaaaaaattaagccacccccttgcaaaaaaaactgaaagctaaaagtcacaaactaaaagtttaaaaactttagttctagctcaccaatgcaaacttgattacaactgaattacaatggagacaactatactccacttttatggaaaaactagatttacagatcaaactcaattcactcacagctagatctgtgaaagcctccaattcatggttgtcttaaacagctaactccatataccaaccttttccatattctaggctttccctgtttccacaccactacaacaatgctcaaggcctatacccttaactgattttcttaaaccatacgcttggctcaagagcactggcacactacaaagcacaccaggttaaaaagtaatacaatcaccacattgtctataaattagaaaactcaccaatataaatatcaaaaccaagctgaatttgaagccattcaccatgattttaaaccaaaaaaaaagcctcctcctcctagcctcagtttctcatctacatacccacactaaacaatcttattgtcaaagctgctttgagaaatagtctaataatccatactgatggaagtggagggcagcagggttaacattctaaattcattggggtttgagactcctaaaaaaaaaagccagttgccaaatgtacattctccatcagtatttcaactgtcaataagctggctttgcagcttttcaaaaaatattctagaggtatcatgggtgtgtttctttatactaggactaccaatagaacagatttaaacatcagtagctggataacatgataaacttcacagcaaattgctttagaaacaaatagtttaaaaaaacttaaaaaaaggaattaggaaagattgatgaattatctcaacatctaacatacatccatttcatacccaaggaatatttaccaaaattaggaaacagttaaaatgactttaaaactaaagggagtatagaaagacataccttaatttttgcctcatctggtcctttactagaatctgctactttggtcccttgtttttctctctgcctgtaagtcttcatgactccacataaaaaggcacttttgttctgcaaaaaaatgttccattaatatttaacaataaccatatctgagtctaataaaattcagcagatagtatcaaaactactcaaattttttaattttcacattgacattaacattacctgaacatgagagagatcactgtctttaaactgttgaagaactgccaatgcaccgtcttcattgaattcttttaaagcttcaatagctctttcatctaaatcactatgtgcaactagccctgaaaaaaataaaagttatcagcttttaatatttttagaaaagattttttagagaagactatgttggcaatacaggtacatgtgtgcctttacaattcttctactcccctcatctatacctgaaaaaaaaaaaacacacacttcagccactctgaactgaatcctgaactaaatatgccctaccaaccacacttacaataatcagctaacttcttttacatcttttatctccaaagtctgataactctgaacactacggtatttttacagtatacagacttacgaatcctagaatcaaccaacaaagtaccaagcatgacaactgaacctctactcaatttcaaataccaccagaaaaagttaacagccgcaccagaaagacaagaaaacaagtctacagttaccaagttatttaagaagaatcctactataaaaatactcaaaaaagtcacatggcctgttcccaacatttagcagctgttgctactatcatatacttatccatcaggccagcatgcaagccagcctttagctcctaaccttctcttcttccctccctctatacatcttaacctctacttcaaacttaaattaaccaactatcacaacaagcaaaactccagtacccacacttattggaaaccacaaaaagttgctattttagctcaaagccagaaatccaatagaaaaatttcataatgtaattttgcaagtgttagttcttacctgcaacgtaaatttcatctagtttttcagcaactttctgtggtaaaccagcatcaagcaatgtctgaaaattttctgaatggataactgcagaagtagtatccatgggctcttcagtaccatttccattaacatgttctgtagccatgtttccagagat

SEQ ID NO: 2068 - DNA, 29351 bp, Homo sapiens
  source 1..29351: mol_type = genomic DNA
cttactacatgtattatctttttatttttgatgggaacatgaagtctgttgtaaaatagcactttaaaccagaagcagaaaactgcaataaatcagtgttgtgtaatgtgcagacatattccacacaagaattaacaaggcacaaaaccctttaattggccttgacatgctatacaatttgaaccaaatttgcaggaaattttgtgaaaaacgaattgtaaacacaattttagtaagtatacatttaggtgtgaattttttattgaaataaacaacagcataaagaatacaagtagccaaaatggttttgaaaacccaaattaggtcaaagttctaaattaaaaatagcagttgtgtatcaatttaccttattctagcaatttaagttggtaacatacaaagttattctgatacaagatattaaagacacacttggttttaatcaactacctttgaagacaccaaatctaaacactactggaaacatcgttgacactacagccaaatggacttgagccaaattttctcaagcacaaatgcaaactcattaactatttctttcagtatctaagaatatctttattgaaaaaaattaaaaataaaatcagttcgccagaagcagttagaagtgtggctttgttcgtgtccaagcggattgttaaaatatatacataaagggaaatcttgccagatgtcacaaattatagcggcacccgttcagatttagggtgagtttctgatcaacctatcagtctccaattttacagaggccctactgtttctacttccactgttgcccaaaagtatcctgataaaactcctggttttcagatttgtaaccatagttaccagaatgatcaccaccttggagcggttgctgagcaatgggttgggagccccagttctgattattggtctggcgccgcttggaatctggctggttgtacccatcagctttgcgctttcctcctacatttccaccgcggccacccctcgcaccacgtaccccgcggcctctttgttgttgggcacctcctctcgcacctcgaacgcctcttgctgatccaggacctcctctctgtgaataaccggctctaccgcggggaggagcagccccacgacctctggatggagcagcaccccttgctcctctaccaccccttcctctagctccaacttgaaaatcttcataaccatagtatggatcttcatatccaccacgatagttatggtaatcataaccataataatcataataatcttcatatccataataatctggaggatatccataaccacctctacctccacgccctcgacctcttgttggagggggcatatgaggtggaccataatagtagtaatcgtcatacctattaaaaaagagacagagattagagtttaaatcaaattacttagttaacaagtaggcatttagccatttgtaacagtttaaatccagagtttacttcgcataattcacataactttaatacagaattatttgtactagattaagttttagtagtagtaatgatcagaggatcaggatgacaatataggcatcccaaaataccacaaatctctagttatgaaccttatttatttcttcatgatcttcaaaatctcccaataaacctgttacagaatttttacaattgatttagctgtcaaatttgccactttagggctgggagcggtcatgcctgtaatcccagctatgcgggaggctgagtgaagcaggtgaatcgcttgaacccaggtggcggaggctgcagtaagccaaggtcacatcactgcactccagcctgggtgacagagcgagactctgactcaaaaaaaaatttgtcactttgaattgcatttctgctaagattctattccaatatacttgaagaacatttattacaaaagcaaaatggcaagtaggacaagcacacaaccaaaatgtgtgaagttcaaagtttactacagtaaattagcataaagaccttaaagttttcctgtttctacaataatgctatccaagtaaaatttaaaagatctgctactttcccaaaaataaactacaccgtaactatagtgctgaactttaaccactaaacaggtataactttagttgtcaaagtgattagaaagcaaccacacaaatcagcatatgcttacatactatgtaaaaggactaaacgaagttacaatattccaactcatgttccctacagtacaattttatacaattccttaaaacttagtgattattttgagcccaataatcccatgaaatatggaaattaatccctcttgaaggaataatttactcgtgttttttattccgtacctgttatgttattttatttatttatttatttgagacacagtcttgctctgtcacccaggctgcaatgcagtggcgcaatctcacctcactgcaacctccacctcctgggttcaagtgattctcctgccacagcctctcgagtagctgggactataggcatgtgccaccatacctagccaatttttatttttagtagagatggggtttcaccatgttggccaggctggtctcgaactcctaacctcgaatgatccacccacctcggcctagagtgatctgcccacctcagcctcccaaagtggtgggattacaggcatgagccaccacgcccggccttattttatcctgaattattaaaggcccctgttccaactgactaacgtaaaaatgttattccggttcactaggtccttagaccttttatgtgctctgctggtttattgttttgaggaaatgatggaaagatcatccttttctatttctaaatagttctcaccagggataattttgccaccacctctttccagggggacattttagacggtcataactgagaaagggggtgctactggcatctagcaggaagaggccaaggatgctgctaaaagtcctacaacgcacagggcagcccccaagaccaagaattatccagcccaaaatgtcaggaggacagagatgagaaatcctggtatagtggttaagagggaaaattatgggagactagactaccttagttcaaatccaactccactacttactatgtgaatgaccccaaggaagttgacttctgagcctcagtttcctcatttcaaactaagggatagagtacctaactcacaggaatacagtgagaattatgtaggaatacgtgcttagttaaaacttaaaaaaaaaaaaaaaaagactgtagcaagttaaagtacgaaagtaacatgcaatcatcccttttagtttgtactccttttcaaatattaacagatatactgacatcctccaccttctatttagtatctccctctatcaagtaccaaatgtaactgctctaatcacattatctaatataatctcctatacttacattctactttaataaattaaccatatatcgtcttctgaaagaaataaaaagaagttattttacactgtttagtatatccaggtgtttgaaatatagagcattaaaactaactctttttgtagtcttccttcatttacactatcatcaaacctacaaagtatattttctttggtcccagaacaagcatgggtcacttggataatcacataatccagagctattacataattttgtctgatcccattttagaactgaagaaattgaggttcagagcttgccaacttgtccaactggacaattaactgcagaaactagaacttgatcaattccctgattatgaagtaacagaaatatgtagaagcatcctcttcctttaaattccaaacagggcaatcaacagaaaattaaccttgaatagtattgacagtgattattgctctcacattcaagaacaattacccctcttctaggaaatcagtaactaactttttaggagctaacttcaattcttacccaactaagtttccttcagtcttaagcagatacctatttacagattctctaaaaaggtctccctaattagtataactcattacacacctacttgttttcttattgcactactgtgttataattttaatactcatttcattttcaaaatccatccatcgaacatgaaatttttggggtggcaatgagcactactggtgaagaaacagtctatcatgaatagagatttagtatttcctatctctcagagaaaaaactctccaccctttaacaaaatgtattaagatatttggacagctaatatttaagacattttcagaagaacattctgtaaaatacaaagaaaatatgtgagataggccaggcatggtggctcacagctgtaatcccagcactttgggaggcagaggtgggcggatcacctgaggtcaggagtttgagaccaacctggccaacatgacgaaaccccacccctactaaaaaaaaaaacacaaaaattaccaggcatggtggcgcctgtaacccagctactcagaagactgaggcaggagaatctcttgaacccgggaggtggaggttccagtgagccgaaagagtgccactgcactccagcctgagtgacaaagtgagactctgtcacccaatacaaaacaaaaaaaaagctagacagatttttcatcttgccaatttaccaaaattccagttatttacaattctgattattttcacaaatatggttcatagtaagagttcaataaacacttagatcactggtgtttccctatgactctcaaacgttcaagtcttctttaaagagatgttatgcatttaacaagtctgatcaacacctgttattttccaattagtgtataaatattaaaatttatacaatttttaagtatacaaatttcactcacatttgattttttgctgcttgcctctgagcttttctttctttccttttctgatctggtggcttggcaaaaacaatttcaatattttctccctccaagtctttgccattcatttcttccatagccttaaaaaattagataagtcaatataaaaataggactttcatacaattatgattcatttaaagttggaatatcatttatcattaatgtgggaaggacaagagaaagccccatgcaggcagtcaaataattttatttaaagatgcagatattcaattatttttcatttttacttagaaaactgccaacatcactaaaaccaaaaggttttagtttgaatggattccatggacttccaaagtctcctccaatttgtaaaactattttgagattctaaaatgactaaatttgttagtctgatttagatgcctgtaattccaccatatttaccttgacagcaccatctcgctcatcaaaatgaatgaacgcataatcttttaacttcttcactcgttccagtttcccaaactgactaaatgccttttctaaaatctcttctgttacagtattggcaaggttgcgtacaaacagcacttttacctagggggaagaaaatacccccctgtattatttccaaagagttccatttctaagataccaccaccccaccctacaaagttaactcaaatcacaatccattagaagaatgtcagaatataaaaaaaaaaaaagttttcaactccttgggtaaatatcaagcagcagaactgctggatcatgttgaaagacctgaaatagatgctttgccaaaaaagatatacagatggcaaagaatctcatgaagatgctcaatataatctgtcattcggaaaccgcaagtcaaaactattagaatggccaaaatccaacacactataaatgcaggtaagaatgcagagcaatagaaactctcattcattgctggtgggaatgcaaaagggtatagcccctttgaaagacagtttggcgatttcttacaaaactaaacacacacttccatatgacccagcaatcctgctccttatttacccagagttgaaaacttacatgcacacaaaaacttagagagagatgttaatagcagctttatttgtaactgccaaaaatttgccagacgcagtggctcacacccgtaatcccagcaatttgggaggctgaggcgggcagatcacctgaggtcaggagctcgagaccagcctggccaacacagtaacaccccgtctctacaaaaatacaaagattagccgggtgcgatggtacgcaactatggttccagctactcgggaggctgaagcatgagaaatggttgaacccaagaggcagaggttgcagtaagccgagatcgtgccactgcactccatcctgggtaacacagcgagactctgtctcaaaagaaaaacaaaaaaatttccaaaaattggaagaaaccaagatgttcttcaatgggagaatggacaattgtggcacatacagaaggaatattataactgatagaaactagttaaaagccacaaaatgacatagaagaactttaaatatgtattactaagagaaagaagccaatgtgaaggttacataatgtatggttccaactatgtaacattctgagaaggcaaaactatggagacagtgactgccagtggttgaatggggagggatgactaagcacaggacagaggatttttagggcagtgaaactattctgtataatactatgatggaaacacggttatacatttctccaaacccacagaacatacatctagagtgagacctcatgtaaactatggactttaggtaatcaatctacgtccatcaattttaacaaatgtactattccagtgcaggatactggtagtgaggaaggctgtgcctgtgtagggggcagaagtcatatggcaattctgtgctttctgctgtaaacctaaaactgctctaatgaagtctatgaaaaagaaaatgcagactacaggctacatcagtaataattaccaattagtaattattttgcaataaaaaagataatttttcctaacaaagtaaataccatgccctctaagagagttattgaatgtttaacacttaacaagagtggccaaaactaattaggacctgcttttgaaatcttaaagggggaaggactgttcaaaatattagtaagacaaactgttctcaatcctgaaagcttctcaaagtaaaattacaaaatttaacctcttcactaacattatcacttcctcctaaaataacttgaataccatctgaatgtgttaatctaaagtgctaacccaatgagaatttataggccagaggaaaaatgaatcctaactattttctcttctctaagaccacttatccttcaataatattcatagctccctggcagttcatattaccctcaatttaactcaactagtggtgtctgacacctaacctgtaagtaacaaagagggaattcttaaaagacaaaggataactggggcatggtggctcatgcctgtaatcccagcattttgggaagcaggattgcttaaggctaagaattgtaagaccggcctgggcagcacagggagattaactctgcctctacaaaattttttaaaaaaattagccaggtgtggtagtacacacctgtagttctagctacttgggaggctgaggtgagaagatctcttgagcttggggctacagtcagctatgatcatgcccctgaactctagccctgggccacagatctagaccctgtcacttaaaaaaaaaaaaaaaaaaagagaacaaaggatagaacaaataactgcaaattactgcaccagtgtgtaataaagtgttgactcaagggatgtttattcttatacaatgtctccactgactgctgaagtcaggatacctaataatggctaaatgtaactgcaagcacctctgctgcggccagtataatttactgtttttagtagtaagacttttaaccccaaaaccatgtaaactaatggtgccattctcaaaaactcaaattgctcttaaaaaacacacaaaatggaagtcaactgtctacagcatgtaggcgacttcattacaagattgtgatggctatacaattatggctaagtatccacgcatcaatttctattttcactttgcaggcacatggtatttccagtgcgcactgcctagtcccgtagtaaagaacatttctcccaactctaaaaatatggtttaaaaaaaaatgtgtccagggccaggtgcaatagcctcacgcctctaaatcccagcactttggaaggccgaggtaggtggatcccgaggtcaggagttcgagaccagtctgaccaacatggtgaaaccccagctctactaaaaaaaacacaaaaattagccaggtgtggtggtgggagcctgtaattccagctacttgggaggcaggagaatcacttgaacccgggaggcggaggttgcagtgaaccaagatggcaccatggcactccagcctgggaaacatgggaaacaagagactcttgtctcaaaaaataaaaaaatgtatactgttcattttatgttccccccaccccaaccccggcccttctcccattaatccctcaaaaaatatttttaacttgactatcattacctttgccataacctcaggatcaggatcttctataggatcagcccattcaacagttccaacattcccccagaccttgactttaccactcattaacctacgccttgcctgggcagctgttttgtgatcttcatattcaagaaagcaaaagcctctgttttttttcttgtcatccggttggtggtataaaatgacgtctgtaagaccctctgcaagtaagcaaccattccaggaaaattagatgaaataactagcaaatacaagtggatcaaaggatttatctaagatactacttaaatatcaaaatgaaaaatcatctctttccttcactagacatctttataaaagactatcaaaaactaggtccggattattttcctaatctgtttccaagtttttcaacacagaaatctccagaaaagaacatgtgctctttttagaggtaaggactacttttgttttcactaattagatcagagaggcagataaaaattttcatataattgttctaagaaaatggcagtatagatcaaatatggctatttttcttattatgcaaacactaaaattatttttaatggcacttttctggccttagatatcaatggctttatttcaaataaaatagaagttataagtactgcataaaaatttccaatgtcctgaaagttgataacaggctgataatttgttagacactgttggcagaccaaaatattttctaaaagcaacctgtcacttaaaagttgttacagttcaaaaaatttttttaccatgttgacaatatataaactctgtttatgggccaggcacggtggctcatacctgtaatcgcaacactctgggaggccgaggcaagcagatcacttgaggtcaggagtacaagaccagcctggccaatatggtgaaaccccacctctacaaaagacgcaaaaattagccaggtgtggtggtgcgcgcctgtaatcccagctactcaggaggctgaggcaagagaatcccttgaatctgggaggcagaggctgcagggagccaagatcacaccagcacactccagcctgggcaacaaagcaagactgtctccaaaaaaaaaaaaaaaaaaaaacactctgctacggcaatacttactactcctgtaatttcaagaacatcaaatcattattcaaacaattctactaagaacatcaactaacacctagagaaagaacacacaaagaaatacgatcttccaaaacataggaagaacaatgattttgcagaatgaattcaaaccctagctgtattccctactaacttgtacaacgtttggcaagttatttcccaaatccctgaatgcctgttcttcttatctgaaaaatggggttacctacacttcaaaagttgtagtgaggattcgatgagtcaataaatgtatttagaacaatgcatgacgcacagaaatatgctattaatcttcattattaaaagctgcacctcattccaaataaatccaacttacctgttactttgctaaattcttcaagaatctgttccttggttttactcttaggaatagagcccacaaaaagcctattgttggcaactgagatgcagacaccaatatgttttccagaacgaatttcatgattattatactgaaaggggaaaaagtgcatcatgtttttaaattacttatacaactagaacagttaattataaaagatacacaagagcaaatcatcctttaaaaagtagtttaccttaattcccatacaagggaattatgaggaacagattatattaacaagacccattggacaagttcatgaaccaatttaatgcaaataaaaggttattaaatcctttacttgattaattagaaatcagatctgcagcagcttaaattcaaaaactgccagttcctcaaaaacttaacttttacttaagttcatcccatcaaccagttattctcatacaaggaaaactgatcccaagatcagcaagatctctgccgttctgttaaccagcacctaaatctatttttccatcttcccttcctcttatcaaaagttgtaataagaaatttcaggcttcaaatatttaagcctaaaaaaacagcttttatttctaaatccaactgtactttttccccatttcattttcattatgcatataacaaattatgaaggagaaagagaagtagatttgtcatggcaaaaatatacagaaacaactttaaaactacagtaaaaagtaaattgaattttcgagtaaccatatcccagattatcagaaagcagaggcaaaaagcaacatgtcaaagtgacaaatccaccaattagtattatttacaaacccaagtgcaaaagtatccaagtaatctagaaaagtggattatatgggttagttaaaaccacacctcaaaatttgttactaataatggcggcagcagcggcaataattattgattaatcctcccacacctaacctcaaaatctattctacacgtggagctacacaaactaaagaaccaacatcaatttccatacaactttatagaaataccttacagcaaaagaaaccattcttctattatgcccatccttgctaggtacaccgggtataacagaagaaaacatgtaagtcagaaagttgagtcctccctgtcccttccccatctccagaaaatcaaaatttaataaagttcaaataccatacctccagttcagaaaaatttattgctttctaccccactattctgtacaggctattcaagtgtgtggccctcctgatcccaggtttacttctatttctctacatttatgccagagacacaacattaaaaaaagtaaaaagatgactcctgctactttctcctctctctctcaaatacctttttatatcaactcttaaacatacagggtttttttttttttgtcttttctgagacagagtcttgctctgtcccccaggcaggagtgcagcagtggcactatctcggctcactgcaacctccgcctcctgggttcaagcaattctcctccctctacctcccgagtagctgtgattacaggcgcctgccaccatgcccggctattttttgtatttttagtagagacggggtttcaccatgttggccaggctggtctcaaactcctgatcttgtgatccactcgcctcggcctcccaaagtgctgggattacaggtgtgacccaccatgctgggccacatgcaatttttatactcctatggctctgaagaaattgccttccttccctgaaacttctaccatacaagctcctctggatacctgtaaattaagttcaaccacccaatactacaatacataaatcctaaaagggtcaacaaaatactcctccatgttaacacagaccaacagttctcaacaggagtgattttgccccccagaagtcatttgacattcttgattgtcacaacttggaaagaagtggggacttgctgctggtatctactgggtagacagaaggatgctgatacacatctaacaattcagaagacagcctgtcacaaagaattatctagtctaaaagatcagcagtgctgaggttaaaaactcctgccatatactttgttttctcatatagcattcatgtctttctcttctaccagactaataatcttttaacagcagaaacatgttacctgaatgtagcagagctatggctgaatccatcattgcacagaattatggacaagtagattataatgccttattttgcaagtaaaattaaactaagaacacaataaattactttaaaatatgtacattccctggattcttataatctagcatcaagtagccagccttagcaacaaatcagtggttttcaaattggtcatgcaatcagtaattctagtaattaacaaaaacaattaaaataccagaaaaaggtggaaagaaataccaagtgtgtaaaggcaaaaacaggagtgattttgggggtgacagattttggtataatgagggggggaactggtattttccaaatgttctaaaatcaggagctattaactataagaaaatacctaattctaaaaaaacttctaacagaaacttgaattcttagttctaccaagaaaatacaccattgagaggaaccaaaatccttataagaaatgtaggaggcaaaggcaagacaacagagaatggaaacattccatcaaggcaacaataatcaaagaaatatagagaagacagctaatctgtaacataggcaacacttccattaaccatcaacattaacaatgctgcttcaaattattaataactgtttccattattatctacagaaacaccatttttttccttcttacccatcatcactagccctgatgctaatcaagttagccaaggcatggtaggtagaaagtacaaaggatggatgtggtctctgaacaacataaataacacaaagatttagcaggatctataaaataaactgctgattcctccctacccacattttttcaattaaaaaacttgggccaggcgcggtggctcatgcctgtactcctagcattttgggaggctgaggcgggcgaattgcctaagctcaggagttcgagaccagcctgggcaacacagtgaaacgccgtctctactaaaacacaaaagaaattagccgggagtggtggcaggcacctgtaatcccagctactcgggaggctgaggcaggagaatcacttgaaactgggcggcaggggttgcagtgagcccagatcgcgccactgcactccagcctgggcaacagagcaagactccatctctacaaaaaaaaaaaaaaaaaacttggaacaattgtattacaggtaacacagagagtcaactggctctccaatgaaaataagtcattaagcgaacaaagtaaggagactctgggtacaactataacaaaagtagtacctagaaattaacatttccggaagcaacaccccatctacggattacgcatgctttttttgtacgtgtatttgaattgcttaacctttcttacactaatgccactctatcacctaaaaaaaaacaaaaacaaaaaaacacttatcccagcaagatgggtaacagtgagttatatggtgaatggtgtaatacaaaaaacaaatgtgaataagagattctaatttaatactagtaaaccctaactcaagaagtgtatcaggacactacagtggtataaaaaaacgagcacacacacacaaaaagtcttatctttcctactctagaaaggttggccctgaatcttgttagttgtaaaaatctagccttcaagctcagtaccacagctgagatgaaccaaatagaaaatgaagattaattatgatcattaatcaatgtgaggtttcagtttttaagaacaccaaaacagtagtacagtctggaacgttcctgtcatcaagtctcaaaattttaagtcacttttaagtccttccctcatagtcaccaaattcccagaaattcagcaatgtcaaatttggaatctgatccagaagaggctgcttagtcctaactcttctcagcaaagcccctacctccaaagccttccacattgaagatttcttttttttttctttttgagaccgagtctcactctgacacccaggatggagtacagtgacgcgacttcagctaactgcaacctccacctcccggtttcaagtgattctcctgcctcagcctccctagtagctgggaccacaggcgtgtgccaccacacccggctaatttttgtatttttagtagagacagggtttcaccatgttggccaggctggtctcgaactcctggcctcgggtgatccgcccgcctcagcctcccaaaatgctgggatcacaggcatgatccaccgcacctggcctaaagatttcttaattataaagtcttctttacaataagccaaaatctacttccttaaataaacctatttctttcccccaaatgacagcatttcatatacctggcacacaagcacatgactcagttgttttctatgcttggctaatcattgcttccctgataatggcaaactaaagtacctccaagaaatactgacaagtgtcactgaagagtgacattctaacacaatactgtaaacgcagactgaaacaggagtctagaataaactggagcttattactaattttccacttctagacaccataccactcttacatattgtctgtgttaccctaggttatttggcaaccacacattactgacaccacagcttgttaaactagtgtaaatacttaactttagtcaattccatcttggtagatataaactttctatctcaggctatcaaaagtttttcagatcctgacggtcatccaaggcatttatcactgaatggagattcaagttaccaaacgtatcatgaacagtccaactacactttcaattcttgataaaaactagaatacaacctacagcataccactatggcctttcatttctctttccaaaatctccgatctttctcctttctattgctgccaccctcctcctggcctttattgtctttattcaaataatcttcattattcagccacttacaacatgccacccacatcagggctcaaaaagggggtggggggtgctatgcagcttagcccagtatgaactaactcctggcactgactttattacaagttttatttccacaaaacactgcttcaactagattcaccttttttcttcactgtgctgctcaaacctctttattgcaaagccttctctgacaaccctaatccagtctcccttcatccttcctttacgctttgcaccactggattccactgtaacagtagtctttcatgttctataaactctctaagaacctgtatatctgaagtaaaagttttcatgctaaacacactatttgctaaattattattaaaatatctctgaacctaccttgtcaactacattcatcaaaatggctgttcatgaggccgaagcaaatggatcactgaaggtttggagtttgagaccagcctggtcaacaaactaaaaatacaaaaaaaaaaaaaaaaaaaaaaaagggccgggtgcggtggctcatgcctgtaatcccagcattttgggaggccgatgtgggcggatcacgaggtcaagaatttgagaccagcctggccaatatggtgaaaccccatctctactaaaaacacaaaaattagccaggcgtggtggtgctcacctgtagtcccagctactcgggaggctgaggcagaagaatcgcttgaacctgggaggcggaggctgcagtgagccgagatcatgccactgcaatccagcctgggcaacaaggcgagattcatatcaaaacaaaacaaaattagtcaggcatggtggcgggctcctgtagtcccagctactcgggaggccgaggcagcagaatctcctgaacccaggagacagaggttgcagtgagctgagatagcgccgctgtgctccagcctcgttgagagtgaggatttgtctcaaaaaaaaaaaaaagctgtatacacatcatgacagtatacataaccaatctggtgactaaaaccatcagaaccatcagagctattaaaataacttgtgggccgggcactgtggctcacgtctgtaatcccagcactttgggaggctgagacaggcggatcacgaggtcaggagatagagaccatcctggctaacacggtgaaaccccgtctctactaaaaatacaaaaaaattagccgggtgtggtggcaggcgcctgtagtcccagctactcggaggctgagtcaggagaatggcgtgaacccaggaggtggagcttgcaatgagccgagatcgtgccactgcactccagcctgggcaacagagcgagactccatctcaaaaacaaacaaacaaacaaaaaaaatcgtaacgtgcaaacagatttcatctattccaatgcttgtacatagacattattagcatttcatcaggatatttccgttatttaagattgtcatggaattgcagcatcaccagccttgggctccaattccagcaacataccacacaaatacataaacacacctgcctgcccttcttcatggtctttaaatcaacatgtctatttccaaacaacccctaggtaggtaagggaagaaagcatcatcacctactaatttaccttaatcacagggcagtaagtagcacagaattgtaaatggaggctattaaaacagcaaatggtccatgagttacataagaatattagagagcactggtcagcaagtcaggttatttatccaacacctactacataatggggcacagttctaaatgttagggaaaaaggaaaaatatatacatattctaatgggaaaagacatgtaaataatttacaaagtcaaaaaataattacaagctcatccaagcaaaatctattttatcattcttagaatactgtcatgggggcaactgggtggtaaggtgctcaatgtcaccctacctgaaaagaaagcatcagtcataaatgggctgctttcaacccctacgaaagcagaacagcagaaggcagccttaaaatgataatggccatggcttggctgggcacggtggctcacgcctgtaatcccagtactttgggaggctgaggcgggcaaatcacttggggtcaggagttcgagaccagcctggccaacatggcaaaacgccatctctactaaaaatacaaaaatcagccaggcgtggtggcacacacctgtaatcccagctactcagtggctgaggcagaactgcttgaacccaggaggcagagggtgcagtgagctgtgatcgcaccactgccctccagcctgggtgacaaagcatgactgtgtctccaaaaaaaaaaaaaaaaggccatggcttaaagaaggcgaaacatggctaaaagggtaattaaaaggaagagtggggaaagaggtaagaaggaacttgtctggatagggccttgtttgtaagtcatttttcagcacaggaatgctgtgatctaattgatgttgccaaatataaagggcaacagaaggcagtgagactagctaagtttcttcagtagtctgaatggtacaaatggtaccttagactaactagggtagtagcagcgaagaagataaaaagtgttagatgctaaaatattttggcaacagataggacctacttccttaactcttttaacactacctaaaccactacataatttaaagttatcaggctacctggtgacgtaacttgtacagttggcttaaattgttatgtctaacaatagggacctcagctaaagaaacctggcatcaaactagggctgggatgtttagctgtatggcctcaggcaagtctatttctttctactacctggcagaaagggttgttgaggctgaatttaaaggtgataacgtagcatctaacaaagctcctgtcccttaacaagcactcaagtagtagctattaatcaccttttcacaagtttagatcatgcttccctagctagattatcatcatttacaaatggatttttttcattccccaaaatgaaggtagatgttggctagaatcagggtcatttaagaaacttgaagttgctttcaattaacttcatgcctcttcaactgttaacatcaattaacccatttttataagtccacatacaaatataaagtctacagtactatttaacctagagaaactattcattgctgtatcagtattaaaagacaatgccaaatacctaaaactatttcaacctaaggtattcctccagacactcaaaagagaaacagaggtgcttcaatcttgtctgatctataaataatgcaaaggaggcatgaggcactttcccaacatttagttatatataactagaatgacacttcaattaaaaactcactttggatagaactgtaacaagtagaatctcaaaatgtaacacagtagagatagcttccaaagtatgcgcccttgaggaacatacttaggaaaggggtattcatgtccgcaaatgaatacaaagtggcaaaaaacatccaaaaaaacttgagatttgtattttctctagaatgtttcaattacttcactttctctaaaatctagttctttgttgtgctaaagcaaatctaccagatcctacccacagtaaagcatccttttaaaaaaaaagtaaacaatggccaggcgcagtggctcatgcctgtaatcccagcaatttgggaagccaaggcagtaagactgcttgaggccaagagttcaagactagcctggacaacatagtgagacaccacctctacaagtttaaaaattagcctagcaaggtggtgccctcatagtcctagctgctgaggaagctgaggcaggaggatcacgtaagcccgggagttcaaggttagtgagcattgatcatgacactgcactccagcaagggcaacagagtgacaacctgtctccgaaaacagtaataataattaaaaccgtttacttaaggccgggcgcggtggctcacacctgtaatcccagcactttgggaagccaaggcgggtgaatcacaaggtcaagagatcgagaccatcctggctaacacggtgaaaccctgtctctactaaaaaaatacaaaaaaaattagctgggtgtggtggtgggtgcctgtagtaccagctactcaggaggctgaggcaggagaatggcgtgaacccgggaggcagagcttgcagtgagccgagattgcaccactgcactccagcctgggcaacagagtgagactccatctcaaaaacaaataaataaataaataaataaataaataaaataaacaatttacttaaaagtaggctgggtgtggtggctcacacctgtactcccagcactttgggaagccgaggccgagactggggtcaggagtttgagaccagcctggccaacagggtgaaaccccatctctactaaaaatacaaaaatcagtagggcatggtggtgtgcacctgtaatcccagctactcagggggctgaaacagaagaatcacttgaacccagaaggcagaggttgcagtgagttgagatcacaccactgcaccccagcctgggcaacagagggagactccgtttcaaaaaaacttactaaaaagtcaaaaaaagcaaatgatggtatgaccaatatatcctactggctgtataccaatacctaccattggaaattttttttttccccctttttggttttttgagacagggtctctgttgcccaggctggagtgcagtggcatgatcacaggtcattgcagccttgacctcctgggaccacaggtgcacgctgcctggctaatctgttactttttggtacagatggggtctatgtttcccaggctggtttcaatcaatccttgcacctcagcctaccaaagtgctgggactacaggtgtgagcaaccacaccctgccaaaagtatcttttaaaagacaacaaaatgcaaagtctcctattaattagatagtacaaaataattatgcccccagaaaaggattcaaatcacaacagagaaacccagaaagaaatgtagaaagttttaggacaagggttaattcctacgccaatcaaaaagaatgcttatctatagaagtttctccattatatttaaaaactatattaataagactatattctaagcaacctacagcaatgcaattttataatttaacgtatttattaaacaaggcaattgtacaaatggaaacatttcctagtgtctactggcactcgaaatcactgttactaatggattataaaccatcttcctctaatgatgtatctttactgtaaagtttctggaaaacatctataaataagttatagtggtcacctaccataattggtacattttgacggcaagaattaggtaacctacgatgtcagtttaatgattctttttcataatgttaaaaaatggatgacaccactagctaaattctgcagtggtccctcagcacatacgggggactgattccaggaacccataccaaaatccatgaatgctcaactctcttaaatagcatagtgtttgcacataacctacgaacattctctcatacactggtgtgttgttttttttttttattgggttttttgggagtatcttcaatcctcagctagctgaaactgtgaatgcaggacccacagtagagagagcccactgtattagctttctgtagttatgatacctcattgcttactggatcattctgcattttcacttactgctactttattgctacttggcaaaaatattctactcttttataggagattaaaggattttgggacaggcaaggtggctcatgccagtaatccttgcactttgggaagccgaggtaggaggactgcttgagaccatgagttcaagaccaacctgccaggcacagtggctcatgcctgtcatcccagcactttgggaggccaaggcgggcagattacttgaggtctggagttcaagaccggcctggccaacataaccccatctctaccaaatatacaaaaattagtcaggtgtggtggtacgcgcctattatcccagctactcgggtggctgaggcaggagaattgcctgagcccaggaggcagagattacagtgagccaagatcatgcccacacactccagcgtgggtgacagagactttgtctcaaaaaacaaatcataaaaacaaactaaaggatttctaaggtacctctttctagagctctaaaatgcccctcccctcaaattgaactgctgaaactaaaattttgacaactcaaaggttaccagtaaatctgaattccctctaaaacacaaagcactcttttatgaagagaaaaatcagacatgatttgaaaatatctaaattctcaaattctctttgtaaaggcttatattctttcaagtaacataattttgtactgtttaacttccatcatactcaattatgcaaaccagtggggaatattcacacaacatagaaaaggaagacttggccgggtgcagtggcacacgtctgcaatcccagcactttgcggggctgaggcaggcatatcttctgaggtcaagagttcatgaccagcctggccaacatggtgaaaccctgtctctactaaaaatacaaaatttagccaggtgtggtgataaatgcctgtaatcccagctaccggagaggctgaggcaggagaatcgcttgaacctgggaggcggaggttgcagtgagccaagatcgcaccatggcactcctgctgtctaggtgacagagtgagattctatctcccaaaaaaaaaaaaaaaaaaaaaaagaaaaggaagacttatgagttttatttttctctttaaggcttgcttaaagtgataaacctcatggtaaaggaaggggtaaaactcaggagggagggaaaaaaaaatgagtctgaagattttaagtttgtctggaattacccacaggatacgtaagccagataaagcaaatttaacaaacatggcatagtgagctatcttgtacaaaagttctccccagtcgtgttgcttgatacattctatgggtttaaattagcccccaactcttcaactataaaatgcagaaaccacttctgtcacagaacttaataaaactagtttaaaggacttacataaactataatttaaaatattaaaatttctttctagccaggcgtggtggctcacgtctaaaatcccaggactttgggaggccgaagcgagtggatcaccggaggtcaggagttcgagaccagcctggccaacatggcgaaaccccatctctactaaaaatataaaaattagcctgagcgtggtggcaggcgcctataatcctagctactcgggaggctgaggcaggagaatcacttgaacctgaggggtggaggttgcagtgagccgaaatcatgccacttcagcctgggcaagagagagaaacttggtctcaaaaaaaaaagaaaagaaaaaagaaaaatttcctttttaaaaaagttggaaagattaccaggtccttacctaacatctggtatttttaaatcaaacattgccactcaccataaaatcttttgtttcatcaactagaaatgtatcacaatgtcttttgtgaattatttaagaaaaagagatggctcaggtatggccaggaagtatgagagctcttaccacagttacttttcttaatcttttcacattcctataaatttaaacaaacacacaaaaacgtcactaagccagatgtttataagaaccaattgctaggaattctaccatgccgccttttagatgctgaatcctatcaactatacatgcaaagaataacactacaatgcttgcacagtgatgtgggaaaaaaaaaacctgcctaaatcagtacttcaaaaaatgtttggtaaactcttaggcacactaagaaaaaaacttgatattaaagacagtgaacgtgaaaactgaaggggaaaaaaggacaacttaccagtttaacagcctcctgagctgcttcttttgtacaaaaagtgacaaacgcataacctctattgagaccagtgagtggatccatcattagacgaagatcccatataggtccagctttctcaaataatggaacaagttcatcctcaaatagatctcttgggatctttcccacaaatatctgtaaattaaatattaagtaaaaaccatggagaattgctttaggaaaccagatacctgtgcttttactacaaaaggtacaagtttttagttgctttacctcagtgccaacagaaggctgctgacctgaataaacggaatctggaggtggtcctccatacttcctctgtccagtggtcacatcaagtgtgtagcctgttctttccaagagtgccttgaaaagttcaaacgtcattaatacatttaattcactagaccacacccatatatttagcagttaacatccatcttgctcaaatctttccaattatcttggcatgttcccttataaaaacaggtttgtgatgtctgttttaaaatttccccttaaatgtgtacttgttatactcctaaattattatcagaagtccagggtcctgttcaaattactttctagtctccacttaattactgaatagtgtgcttaatggacaacaaaaagttaagaccaatccatcagcaactttcaagacaggatgtattactatgttaataccatcttaaaaaatgattgtacctaatttggttgagcatctttcaaatctggatctctcacccaataaattccctataaaccccactcctaggtacatactgccattctgggcattgtgccaacctcagaagaaattacacttcccataccaagtctagaaacttgggagctacagggaaaaaaaatctcctattattatttgacatttacgtgccatatttcatgggatagcatgggtccttcagaaaaaagtaacagccaaaacgacttttaaaaactttatgaaactgcaacgttacataacctctacattttaactcccaaaaagtaactgttaaaatttacacaactcatatttactcagagcattaggtgtttattccttattctaggcaaagtatagaaagaagtataggctgggtgcagtggctcacacctgtaatcccagcactttgggaggccaaggcgggtggatcaggacatcaggagctcaagaccagcctggccaagatggtgaaaccctgtctctactaaaaatacaaaaaattagccaggcgtggtggcacgcgcctgtaatgccagctactcaggaggctgaggcagagaactgcttaaacgcttaaacctggaggggcggaggttgcagtgagcggagatcgcgccactgcactccagcctggatgacagagcaagaccccatctcaaaaaaaaaaaaaaaaaaaaaaaaaaaaaggtacactcctccattatctgaaggaaaaagtcaagaattattccccttctccactgtctcaaccacaaagcacaaaagtggttttctaaacaaaaccaattttattagctaggacattctgaaataaaaacagactaatcctagctatctgacaaaatttatcaaaatgcataatctagggtcacctcagtctctgaaaattactggacagatttttaacattttctactcaaaggacactaactgtttatgaaaaatactgtaattaataaaaacattcataaacttgctcacatctataacataaactaaatgagtaatagctcatctttccattttctcacatgtaatccctatgctataaacggattttttaaccttaatagttaagacccaaataacactttttgtcaatccataaaaacaaaaaggaaaaacttattccctctgtcaaacttcctctaaaaatgtctctatgcctttttaccacaacttagctctcattgaaactgtaagcagccaggcatggtggctcacacctgtaatctcaggactttgggaggccaaggtgggtgggtcacgaggtcaagagattgagaccatcccggtcaacatggtgaaacctcacctctgctaaaaatacaaaaatcagctgggcctggtggcacccaccggtagtcccagctactcgggaggctgaggcaggagaattgctcgaacccgcgaggtggaggttgcagtgagccaagatcacgccactgcactccagcctgggtgacagagtaagactctgtctcccaaaaacaaacaaacaaacaaacaaaaaattaagccacccccttgcaaaaaaaactgaaagctaaaagtcacaaactaaaagtttaaaaactttagttctagctcaccaatgcaaacttgattacaactgaattacaatggagacaactatactccacttttatggaaaaactagatttacagatcaaactcaattcactcacagctagatctgtgaaagcctccaattcatggttgtcttaaacagctaactccatataccaaccttttccatattctaggctttccctgtttccacaccactacaacaatgctcaaggcctatacccttaactgattttcttaaaccatacgcttggctcaagagcactggcacactacaaagcacaccaggttaaaaagtaatacaatcaccacattgtctataaattagaaaactcaccaatataaatatcaaaaccaagctgaatttgaagccattcaccatgattttaaaccaaaaaaaaagcctcctcctcctagcctcagtttctcatctacatacccacactaaacaatcttattgtcaaagctgctttgagaaatagtctaataatccatactgatggaagtggagggcagcagggttaacattctaaattcattggggtttgagactcctaaaaaaaaaagccagttgccaaatgtacattctccatcagtatttcaactgtcaataagctggctttgcagcttttcaaaaaatattctagaggtatcatgggtgtgtttctttatactaggactaccaatagaacagatttaaacatcagtagctggataacatgataaacttcacagcaaattgctttagaaacaaatagtttaaaaaaacttaaaaaaaggaattaggaaagattgatgaattatctcaacatctaacatacatccatttcatacccaaggaatatttaccaaaattaggaaacagttaaaatgactttaaaactaaagggagtatagaaagacataccttaatttttgcctcatctggtcctttactagaatctgctactttggtcccttgtttttctctctgcctgtaagtcttcatgactccacataaaaaggcacttttgttctgcaaaaaaatgttccattaatatttaacaataaccatatctgagtctaataaaattcagcagatagtatcaaaactactcaaattttttaattttcacattgacattaacattacctgaacatgagagagatcactgtctttaaactgttgaagaactgccaatgcaccgtcttcattgaattcttttaaagcttcaatagctctttcatctaaatcactatgtgcaactagccctgaaaaaaataaaagttatcagcttttaatatttttagaaaagattttttagagaagactatgttggcaatacaggtacatgtgtgcctttacaattcttctactcccctcatctatacctgaaaaaaaaaaaacacacacttcagccactctgaactgaatcctgaactaaatatgccctaccaaccacacttacaataatcagctaacttcttttacatcttttatctccaaagtctgataactctgaacactacggtatttttacagtatacagacttacgaatcctagaatcaaccaacaaagtaccaagcatgacaactgaacctctactcaatttcaaataccaccagaaaaagttaacagccgcaccagaaagacaagaaaacaagtctacagttaccaagttatttaagaagaatcctactataaaaatactcaaaaaagtcacatggcctgttcccaacatttagcagctgttgctactatcatatacttatccatcaggccagcatgcaagccagcctttagctcctaaccttctcttcttccctccctctatacatcttaacctctacttcaaacttaaattaaccaactatcacaacaagcaaaactccagtacccacacttattggaaaccacaaaaagttgctattttagctcaaagccagaaatccaatagaaaaatttcataatgtaattttgcaagtgttagttcttacctgcaacgtaaatttcatctagtttttcagcaactttctgtggtaaaccagcatcaagcaatgtctgaaaattttctgaatggataactgcagaagtagtatccatgggctcttcagtaccatttccattaacatgttctgtagccatgtttccagagatctgttcaaacgcaataagcaaaattaaactaggatcttcaaaaagaatacaagacaatatgagagccccatctttactttctctaccatttactacaccagctagcctatacctccctttaaaaaagccttacagtcactatcgcctgacaagccagatttggagcacagggcacagaaggaccgattcaccatattcttcctcagcaccacccctgactcacctgctaacactccctaggaaaaaccatattacaaatagagcccaatcagcacgggtacgagccagcgtgccacatgcagctgtgcccgttcggaaaatgaggtgtgtgtggagaaagcaaaactgggctcctctctctcaaagataaacccccaaagtgcgcgcttttcccgcctgccgcttatagatcggtaacaacagccagcgaagaacaaagcgctcatacaagccaccttcccaccacccaatttctccaccctttaaccccgcaccccaaagcccgcccctgactccgcacccagagcggcagtctcaccactgcggccgccaggagcccattagaaacacgtgctctgcgccttccaatgtcctacaacttccttcaacggcaacccaacgaatcccaaaccaagacgaccatcactggttcccaacatcaacccgaagccgcggtcggagcccccagaaagctgcagcagcacaatctctcccctgaacaccgaggcaccggcggcgccaggccacaggctctccccgccccccagcgccgccgtctccgccgtgacacatggctctccgcccctggcgctccccgggcgccgacgacccccggccgcccgcccggccgagacgtgacccgtggcgcgctgtgcaggtccccaccccttacccttccgtgcagtgactgcgacgcctgcccggcaacccagcagcgtgagggcgttcagcggacggctcaacgcccgcgggaccgtgagcaccgcccaagctcgccgcacggctgcaggacaagacccactcctctccgcccactcccgcgccgcggcgaccgccacgacagcaccaactctgaagccgctcgcggtccgtgcgggccacgggaccgtggaggcgcctcctcccaaagcgccgcagacaaagcccgaaccgcagcagcacatggaaaggaggaagtggcggcgcgggccgcggcctactcccaggcagccccagtcaacgtgctcttctccccattggaatccattttccagaaaagccggtttctacccgcgccaccctcccccagctcactccacaatgtcatggagctcccctcccacacccaggttctggcagtcgttacctccccgttgggctgaggcggagaaatcctgtccgatggtatcgggttgcgggaaacgcgtgctcgctgctccctgtgtccggcgcgagtggagctgttgtaaaatggcggccgaagctcacgccgctggcagcaaacccgatccagttccactcgcctccgagcgcgctcccggtgcgcgcgcgcgcccccgcgtgacccccccttcccttcccttcccttccctcccctccctcgcgcgtccgcttcactcactccctcagcccctgccctcctccagctcctccttctccccctaccaccaccaccaccactagcctctgtccgccttctctcggcctttcttattcccgccccccgctcctttaccccactgctcccactcccctctgcggtcgctcaggcacgagtggccgcctttccccttctggctcgcacgctccctcactccctccctcgctcgctcgcactctcggcccggtcccccagtccctgccgagtcggctcctctctttctctctcccgcgct

SEQ ID NO: 2069 - DNA, 11012 bp, Homo sapiens
  source 1..11012: mol_type = genomic DNA
ttgcatattgcgtttattttgcagaaaatgctttctgctgattgtctttggctactttgtcaaaagaaaaatatgaaacagttatagtttaacaacacaagagattagctacatatgcttaaaatacacacattctagggggcagagcagtcaaattttcaattcaactaaaacctgctgtcctcaactatgattttattctgtccttaacagctcaactctaactacttgaaagcaacaaggaagaagattaagagtgtgctttttatctcactaaagtaggactggtggagtttacaaattctggtgtgccaaagttgccaatacactgtatgagaaataaaccaaaaaaagtttctggaccctggcaaacattttttcaccgtcagtgaggttgggccaactgcatcatctccacagttgggttcatctgtaagccacctgggacagcaccgctactgcaggtgtgagcaagggatgctggggctctggggaaaggtgccgtgtgctcctccactgctttgaaaaggaagttactgaggctgcatttccttcttaacctgagactgccactgggtacctagtaggtcaatccagtcaccactggctgccacgacaaaaagtcactgcatctttcgggacctgggccttgctgcttcacatggaaggtggcgacacaggtgtccatgaggctatgaggcggccttgggctgcggcgtcgtactggctgtccacgatgtctgtggccgcggccgccccttcgtacagtggggatcccgaggaagagggcgccgagaccggatgggtgaggggtgtgtagtgcgcgggggagccccggaagaactgggcccccagcccgttggacacggctgctgcctgggagcccggggtgacggcgccgttgctcacagaccacaggctggggtactgactgcaacagaaagacaccagtgagcagggcctgggcaggggctgcaggccagctaaggatggaaaaacacaccagaaatcccattcggagtgactgtgtaatatgacagttttcttctttcaaacaggtcattttctccaaattattaaaggactcacaagcacattctgtgatgtatagaagttattgtcgtatctattaataagaaacaaaatcatcaggaagatgactgaaaagattattcacatattcagagctcatgaaagagcgctgttaagtttcactgcgaaagactcataccaggccagccgcagtgggtgatgcctgtaatcccagtactttgggaggccaaggcaggtggatcagctgatgtcaggagttcaaggccagcctgactaacatggtgaaaccccgtctctactaaatacaaaaaattggctgggcatggtggcacatgcctgtaatcccagctacttgggaggctgaggcaggagaatcgcttgaacccgggaggcagatgttgcagtgagctgggattgcaccattgcactccagtctgggcaacaagagtgaaactccgtcaaacaaacacacaaaacagaaaagaaagactcagaccagtagttttgcactctcattcagaataaaacttttcagatagtctcaaccaaaagttactgaggatgggcttaagtacacatgtttttatctaggacaccccacccccaccaccgcagtgattctcacgatgaagaccagcctctcctcaaacactaagcagcagacattccttagagtaactccagtacagacacaattccctgcactttgtcctgttcagtacataggtgtgctagcatggtgcccagcagcaagaaaagcacctggcagtcagactaggaagccattcccagttccgcctttacctagctgtgtcacattacactttgcctgagactacttataggctgtgtttctcaaggcataaaatgaggaaggtggaaatgactattgaattctccagtctaagcacatggaagtggatagcattcaattatggtaagattttattttgggaaataaccttgtctttctacaagtgaataatgagaccttatgttgtatcaccatactgttttaaacaagtctgagttaatcaaggcagatttttatgccattttacaaatgaaagcttcaggttctaagatgcccaattagagccacactgagaccctcgggtggggcctctgtcaacagcttgcagtgtgcgggtcatctgatcgggtgcaggcttctggggcgatgctcttggagcccctgaaagcttcgcttgtttacgcattgttgctctgtttctaaccgcgggcaattgaattcttattatgaaggaactgttttctagacaagaattaagatcgcaggcatattttggtattctagaaaatgaagtgcattgcctttgaggtcaagatcacttaattccaggctcactctgctgtgagctggtccaatcatttaatatctctggccctccttcctccctagaaagtgagggttgacttctagctttggtattttaggtttttatattcatcctatgaagaaatgtaagacatttaccagcctgcttaatttgtaagcctttttccctctgcataacttgcaagttggtaacaaaatagtcatcattgtttaccagttacctagcacatatattaaagacttcgagcctgtatccatagaaaagccaataaactcatttccttcatttactagcttttgttggaaaaggttccgaaacgatctctttaagctctacctactgaccccaacaaccctgtaggagacaggccgaggctgggttatttttttaccaccttccttttatatgtgaggaaactgaggcccagagaggctaaaagacttgtccatcacgtgaaccagtaagtggcagaaccaggatggggaccctggtttcattcagggatgggatagcgcagctcccattccacacctgggttgtaaaggagcccagtccttccagcgaacagactgcaaacaggaactcggcagtcatgtcacctgcaatccctgggcatagctggctaataaagaattctaaataaagacccaaccacccacagggaccaaggagaataaggactaagggcctatgggaatggaaacagcgtgaagtcacaggcagagctcccaggatgctttgcaccaggtcctggacatacattacctggagctggtaggtgggctggcattgtggctcacggggagcatgctgggatgggcaggcattccaaggctggaccaattgtcatgggattgcagcatggataaacatgcaggtgagttgtcagaataggctaaggggggaaggtaacaaagtgcaattatagatggtgtcttccaagaacaacaaagtacagtgaaataccaccaataactgaagctacgtaacactgaaaacaaaatgtacatgggatattaactgtagaaaacaatccattagtctatttacatggttatcaggggcaagatttattgccaaatatatgtatttgaaaacataccctggtaaacccaagctttttcccttatcatcattatcagtagatgccctgtagacattgaatcttacttacaatcactgacttggaattacttatctttaaaaataaatataactttaccctgcctttttaccagtgattacttcataagaatgggcgatagaaaccattactccaggcaaaattagaaataagatcttcctgcctcagagtctagcctctggttgaacaagtcccagtgacttcctaacccaataaggtcctttcatttcaaatcagctttaattgcttaattgttttatggtattctttagctattttccttcttttggagccagacaaaattaagtctagacatatacagtgttatagagagaattaggccaggggatctttatggtctatcccagtgttcctaatattggagcatgcatcggaatggcctggaaggcttttaaaagcacactggccaggcgtggtggctcacgcctgtaatcccagcactttgggaggccgaggcgggtggatcacgaggtcagaagatcgagaccatcctggctaacacggtgaaaccccgtctctactaaaaatacaaaaaaattagccaggcctggtggcaggcacctgtagtcccagctccttgggaggctgaggcaggagaatggcgtgaacccgagaggcggagcttgcagtgagccgagatcgtgcgactgcactccagcctgggcgacagagcgagactccgtctcaaaaaaaagcacacattgccgggccccaccaagagctgctgcctgtcagtctggggtggggcctgagactgtgcccactctcgggtggtgctgaggctctggcctgggcaccgtatttggagaatcactggtgtagtcaggaattcttgagcctggctgcccatcattgtcactttagagaggttcatagaagactcaaacctgggctctcctcctaaggatcgaccatggttctgtggagaggcccaggaatctgtcattttcaaaacctggagcagcagctctgaggcctgtgcaaggatgcaagcctctgatctgggtgtccgtggttgttccgccagcagcggcagtggcggagacataaattgaagatcttctcttgagctactaaaaaactgggcttgggtatgtgttccagaaaaccgtctccatttttttagattctagactcctgcagaatgcctttcccaaagtggtcttgcagccacccaccaacccctggcagaatgaggctgaggactcacttggagaattgttccgatgagcataggggctggggtagggtgaggaccggtggctcctcagggttgggtacctgtcacagctgtgcgtggaggggagggagagggcacctccaaactgaggatgaggatttgcaggtggacacagggtgctggttccaggaagaagccacccccctgctgtgagaaaagacagtgctgagtaacctgcattagtgctccctccatctctccagagagcagagcccaggccagggactgtccctccatcactccagagagcagagcccaggccagggactctccctccatcactccagagagcagagcccaggccagggactctccctccatcactccagagagcagagcccaggccagggactgtccctccatcactccagagagcagagcccaggccagtgacttcccaccttcccctcaggggcccctgatgggggaagcaccctgagtgtctcatacttaggacacagtctgcctcacaagacatctgaggccatcagccccacactcactaccacaggtaacccaaggcttccaatcctgtgtgtacctgagtaaacccaggagcctggcctcaggcaacctaagctgtttcctcctgagaatcctctggattgctttgagatctactattccccaaggcaggtgagctttcctccactgagcatgaatacaatgtaaccacaggcagagagcaggtgagagatgctgagagaggtggggtggtgcttagacaagggtgccctccccttctcctcctgccacccacagagacgggaggtgccttcctagctgggggtagacccttttactgctcactctcctggtttaagctccccccattctccccaggagaatcagaaagttcttccaagactccccttccttcctctaaaactacaatttcttgtccactcatttttttctcctctgagactgggagtttcattctgtcacccaggctggagtgcagtggtgtgatcttggcttattgcaatctccgcctctcaggttcaagggattctcatgcctcagcctcccaagtagctgggattacaggcgcccaccatcatgcctgacaatttttgtatttttagtagagatgaggtttcaccatattggccaggctggtctctaactccctgatctcaaatgatccatccaacttggcctcccaaagtgttgggattacaggcgtgagccaccgtgcccgtcctcttctacactcttcaagctttgttgttttgattgagaaaaagcaacccctagcgggacaactactgtggcttcaatttccaaactactaacaattctccaggcagcactggaaggaagggtgcagacgtgccctggctgcccagccggccctggccagagcagtggctcactctactcaagtgactgcctttctggttgttcaatcagcctaggaaatgatgaaaaatctacagaatagaaaatgcctgtgtaaggaggagtgtgccctgttgattcatccagcctcttgaccagccagtgctaccgcgttcattgtttaatatctccaagtcccttccccgggtggagaggacggaccaggatgagagagagcgtttctcccaacaaatgctgccgtataatcctctatcctgcactctgactcctgaaagtcctagagggagctagacttaaatccaactctctcatcctcagagccacaggagctggtgagacattcctagaaccaaagggctaaggaaaaatttggttcctaagcatcattggaaagatggctcttcaaccattaatgaaagcctcaaagaggaggtaatgagctagattctcctgttgcctacctaatacaggagagtccaaacacccagctaggtctcaatgatccaccccaggcatggtggcagctgcctcacggcaaaacaaaagcacccaggagagtatccacagccccgattagagcagaggttagatgggcaacacagcttcaacatcacagggccaagagcctcgcatggcaaaaaggcaatcttacatcccaggcacacccagaaacacccttgtcttctccatctccacttcccagctctcagcaagtctagtcccgatgacgcagaatgacatgacagagtgcaacaaaccgtacattgggagtacccaggttgctggctgtctccgggttcctccatcatctctttgtgatcacttctatcaaaatgaaaaaaaaaaagtatatcgaattttcaaaaataaggaaattcagaaaagagtatgtgcagcaatatttcatctttctgcatacttctttgcccaagggtatttatagttagaattctctcacctttcctttgcatcaaggaaagcttttgcaaatggattgtacttaattttaagagctgtgatctgaaaaacaagaaattgcatttactagtatattccctattagccaggggatttaatttggcaccaagaaattgagaaatgccagtaccacttttaaatattcaaatataatcagacttctttccacatacagttttctatttggaactgaaaatagctgagtaattgtacagagtagcatgcttatgaaaaattttcaatgtcaatgttctgagtgggattcacaataaatttaacctactactaacaatgttccatgtgtataaatcagaaatggctgaaaacacagtctggggctgcttaggaaatagagacctggaagttctagttttcggtcaacgtcaacaccaacaaggtatccaactaatgtcgaatttgcagtactttggggttgggcttaggcatagatttacaggcacctatgcagtagcttgtatctagttgagtcttcacactgcagagatttgaggggttgcccccccaccctttggggaagatttccaaggaaggacatgcccctctctcactcaagtcttgttctcaagaaattctcacaccatttaacctgaatgctttttggatcttttcattttgagcattgagaagttgtttctagttttaaacacttgtatggagaattcaaggggaaaatgtttgaatggggacttaatttaaacagttctctcctgtgcttccatttcaagttccggaatattatttgaaagggcaggaagccttcctctcagtgcgggttagcgcgtctccccgctcctccagaatctccacggagcagcacaccacaccgcagcacaccgggaaagcgatccgcctctgtccttctcacctcctcgttctgataagcagtcaccgctatgaactgggtctcagggaagcagtggctggtgatcatgcgctgtggacccccaactctcactatgtggattcgaggctcatacttatgcaaggagttcagcatgatctgagggagacagatacaggattggtggcactgaaaggcctgcgttaaaacagcaaaacatccatttctccaggatgcagaaagtcctctggatcccaagaaagtgtctctgctgttgagggaagtggggttccaccaggggaggcttctccgcggtttatatgtgctattcccacagcttgtttggaaaagggatgtgagatgctacacaccattaaaagcaatgaatgctcatcacaaaatcctttcacctggtggaataaagtactaaggctttcaggaaggctatggtcatttttaaaagactgagcttgtttgcaacttgcctaacctggggtcttccaggaacaatccccgactaaagaatgttctttagaaaagcacgactttacaagtttgttccgactccacgcagtaagtactgtggcgcatgtttaaatttaaatgcgactttgccatcaaggctgatatcttttccacccccaggagagtttagggctagacaacggaagttccccaaaagctccagtccttcaaaggggagtgctcccgctccccgttcgccaggcgtggatgttatcagcttagtataaacagcgctaaaggccttattagagaaggctgtggcagtttctccagggcagacgtcgcctcccgttcaagcagcgtcccttcccacaacccccgtgcagaaggcgcagcgcggccccctcctcgctggtcccagacctggcgggctcctcacacctacctggccccctccgttgagcttgttggtgagcttgactttgctgaaggagacgggagccttcatccagtgggccccgaagttgggcgagtcggggtggatgtagacgcagctgggcgcctgcggctccggcttgccccccggcacccattccccgttcacgtacttccagcggtggttgtccgccgccacgaagtccagcaggaaggagtacatggcgttggggtccaggccagacacgttcaccttcagcaccggaaacatcctcctggaaaacacggggcgggcgcaggaggaccccgacactgaccaggtaggccggaggcagaagctgggcacagaggcctcagttatttcggggcacagaggagccccctggggaacgtccgagggtgactcccaagctcccccttccccgagccctgccaggtccaggtggcctcctcaccatctccacggcctcgggagggaggggaggagaggacctggcgaagggtttcagtgcaggaggccacatcccgcggggacaggcggggaccagggcgcgcctcgcgggtcccgggatgcctccgaggtcgggacaccgaagtgcgcgttcctcctccccaagcttccgcggagaaagccccagaagaggggcttgtagaaatgcactcgagggagttaaccagagcgggaacaaacacaaagccctcctccaggagaaaaagggttcgacctccgggaacttgccaggtcccccaggctgcccaggcgctggagagcgcggcgcgcgcgggctccggacgcgcacccacctgccgttcttggtcacgatcatctcattggtgagctccttgaagcgcagccacagctcgctctcctccaggcccacgcgcagttcgcgctctgtggggtcgcccttctcgctgcccgcctgcagctcattctccacggcgctcagcaggtggtccactcggtactgcaggctctttcccgcgctctcggtgccaggggagctcatcctcccgtccggctcccctccccgccgtccccgaagcccagactcgctacctgagatccaccttccctgctcttggccgccgcccttccgagaaaaggggccccttggaccgagacctgcgacggctcccgggtcccgggtcccggcacagacccgggaggagggcgcggaccaagacttggggggaggggacgggggcagaggggtggggagaagttattccacttgaactccccaaggctctactagtgtaggtctctggggaccgaaattcagtgccctccccataaatagagccgcggcggcagcgctggggtgctcggcggattgggccgcgcacgctttgaagtgccgggcagcctcccattggccgagagcggccatatcagacccagccgggcgggtctgggaggccgggggccaacaatgggctcccgcacgcctgtttcatgtaaatccggggccccagccctgcgagccccggcccagcccctacacccccgcccttctccaaatgtttgcacctccatcaaagcggcggggcaagccccggaggaaggtaagctggacgccccggcctgccccagcccgccccagcccgccccagcccgcacttccgcgaggggctgcccggcagcctgcgatgctccctgattcccgcgcggggtcctcctcgctttcccagcgcgcccggatcccgcagccgcgccaggctggaacgttcgcgcggcctcacctgtccccgctccaggcgcgcctccctcccctcccagggacgagcgcatttggccgggctttgggatgcgccgcgctcgtctcgccgcagtagtagtgctgttctcgcgcctccgatgcctcaactctccagtctggcagtttccggtgcacctgtccccacacgtccctcgcccacggagccccaggcggcgttacgcacacccaggatcgtggatcagcctgccccggcgtcgggtgtccccgcggctctcaccatctggaaaaggaaggtccgcgcgcagagagggaaatggacggaaataagcaaaagcaaaacaaccccttctgagaagtgtcctcc

SEQ ID NO: 2070 - DNA, 11012 bp, Homo sapiens; identical to SEQ ID NO: 2069
  source 1..11012: mol_type = genomic DNA

SEQ ID NO: 2071 - DNA, 8763 bp, Homo sapiens
  source 1..8763: mol_type = genomic DNA
tacaaaacaccaattttattataaatatcaagaacctacagggtgtttatgggccagcatatgccttcagttatgttgaaaatagctgatcatctttccgtacattctgaacatttctcagtttcagagtgctggccacaccaaagcatcagccctggctctaaactccgttacagtaaggaattacaaatcctgtgtttgtactccaggaagtctgcattatcacgaggagcttggaaaggaggtaacacactcaaggcaaatttcaagtaactcatcctggaggcagctgcctactctgcagctgtggttctccaccacagagagaagaaaagggagggagatggagtgcgcaggtctgagaaggctttcattctggagcatctgcaggagcctgcaccatggcccagtagcacccctttttctccatgagctgctggtgggttcccccctcccggatagcgcctccttccagaaagaggatgtggtcagcctgctccaccaggctgaggtgctgggtgatgagaagcactgagcgggagtaccgctcagggctttcgtacaggagctgctccacctgaggaaagacatcggaccgtcagagccggggactaccctcagcccagggagacacctgtgtttccagggctgggactgacctcacaggatcactgctggctctgctaacaaccccaaggacaccaacgtttcccattctgagtacttctccgcaaaccctttgtttcattaaggactgttttacatgaagggtgcaaaagtaggataaaaatgagaaccctagggtgaaacacgtgacagaagaataaagactattgaatagtcctcttctctacccatggacttggcatttttatattcgattttaaggaaatataacttagtagtaaagagatgagcattcaagtcaggcagacctgaatttgggtcaaggctgcgccactcaaaagctatatgacctctatatgagcagcttattcaacctcttttaacctccattttgtcatctgtagaatgatgataaatgcctagctcagaaggattcctaatgaataaatgagtgacagtgcatgtaaacagactagcttaattaatattaatatgattaggatgggctgggcccggtggctcatgcctataatcctagcactttgggaggtcaaggagggaggatcacttgggcccaggagttcaaggccagcctgggcaacatagcgggacgctgtctgtacaaaaaataatttttttaaataaacgatattatgaggatggtcttttccttatgtttcgctttagaaattcagtctataggactgggcgcagtggctcacacctataaccccagccctttgggaggctgaggggggcagattacctgagctcaggaattcaaggccagcctgggcaacatggtgaaacccatctctactaaaaatataaaagtcaaccaggcatagtggtgtacacctgtagtcccagctactcgggaggctgaggggagaatcgcttgagcccagcaggttgaagctgcagtgagccaagattgtgccactgcgctccagcctgggcaactgagtgagacactgtcttaaaaaaaaaaaaggaaagaaagaaagaaattcagtctgtagtttgtagatagtctcttttaactgattctaggtgtctttgcctcgtcttctatctctactccttggggaggcatccaatggaactggatttgggaactgagaactgcaaggactggtttgtataattatgatgttagtaaaactaacagaagatgtataaaagaagcaagattgggtgggatatagccattaagaagatgactgcctcacctgtaactggctgtttgcatccagggcactggtggcatcatccaggataagtacacacggtttccggatcaatgctcgggccaacgccactgcctgtcgctgaccccctgacagctggctcccagcctcgtctacctctgcagagcaaagggccaagatgagaacggtatagccacatgtgtgcacgcatgtacatgcacacagacacactcatgcattcacgcactcacacacaccaagatctgacggttgtagctggataggggagattctgggaagatgaacagaatcctgaggatgtcaggatgaagaagccataggagcatgatcttacaacttcaaattgatgtccatgagtaaggaggaactgaaggataaaggcaagactactggggtttcagcaaaggtaaagatggctgggtggtgagatgagtggagagagtacctgtgtcatagccctgagggagtccagagatgaaactatgggccccagactttactgcagcagctgtgatttcctccatagttggcttctgggtcaggccataggcaatattttcttgaagacttcttccaaatacctgtggctcttgtcccactgcagccacctgagatgaaatatgatgaagagtcatagaacaaggcacatgggagtatggttatctagagatcgaagactcaaaatctttattgagaacatgtcacaaaatcatactacctccctcctgactacaccaccatctccacccaaggtctcttatcattccctaacccctctttcagagtgctcagtaagaatgctcttcgtatttgatgctccctgccctccttcaagccacctgcttccatacctgcctgtgcaggtagcggtgctcatattggggaaggggcttcccatccaacagcagctgtcccccggtgggctggtacagattctgcagcagggcagccactgtgctcttcccagacccattgggtcccaccagcgccgtcacctcgccagggcgtagggtgaatgtcagcccctagaggccagagaagcacacgataagaggctaccaaggcctctaaccttgagagtgtcattgccttgttacatagcatgatgtcttaccccagaagaaaaacagggaaatatagaaactcctaccctcccacatgcacagatttctgggtgatgcctccccaaggagtagagatagaagaagcggcaaagacaagggcagagacccagcaccactatgccacacacttgatgtcagataccaccaggaaagggaaaaatcacattccaaattacaaaggaaaaggaaagatggaagaccgaagacacagattttgctgcagcaattccttggaacgtgagagcactctcttcgaaacctcttctctcattctctttggaagcccaaactgggttcttgagtttggggaagatttatggaacagatgatgcctaccattgcctttaaagggttagggaggatatatgcttggcagtaagcaggctgaaggcaggaagaaaatttaggatggcagaattgcagttggggccagtggaatacagggagtggtaggttgtacctgtagcactaagacatctgggcggtttgggtaggcaaaggagacatcttggaactggacaaggccctccaagtgtaagggagtcaacagaccactgggtgggcagcgaggggtgcggtccaggtactcaaatattttctctgaggagcccacagccttctgtactctggggtagatggagagcagtacctagagggaggtaagaatagtgaaagtgaggtagtctgcttgccagcattatgtgaagcaagaagggtaaagaatggaaggacatcacacagatggtgctgggccagaggaaggaatcacactggggagtgaaggtggagggacctcacctccacagcctgggtgaactgcatctggtagagaacaaatgtgacaaggttcccactgcttacagccccactggtcaccagctgcccaccaatgtagaggattcccactttcagcagcatacctgaaatctataaagagaccacaaaaaaagggactgaggtagagaaatctggaggggacacaaagaaccgcagtcattaacctgaaggaaatatcaagtccctgtctcctaagtgacatcggcaggctcaataggcagacaggagaatgaaccagagaccccatggagtctgactcaatgcacatcatgcaagtcacagttatcttcaccaccatcaccactatcaccttgtctggggagcattttactcttcacaaaaggctttcattcatgtgatgtcagctaatacatgaagagccttataaagaaggttatatcactccatttttgaaaaatgaggaaacaaccagtcgggcgcagtggctcatgcctgcaattccagcactttgggaggccgaagtgggcggatcacaaggtcaggagattgagaccatcctggctaacacggagaaacctcgtctctactaaaaatacaaaaaaaaaaaaaaaattagccgggcgtggtggcgggtgcctgtagtcccagctactcaggaggctgaggcgggagaacggcgtgaacccgggaggcggagcttgcagtgagcccagatcgcgccactgcactccagcctgggcgacaaagcgagactccagctcaaaaataataataataagtaaaaataaacaaacaaacaaacaaataaataaataaagaggaaacagtctcagagaaggtaaatttgttgtcatgatcacaagacaagtaaattgcatcatcaagccaggatcttcggatcactggcgtagctctctttccagtgcatcacagatgtccctcatccctggcttccactattcccatcactctcactaacaaatctacaaggtaccagcatgaagcagtcccaggtgcaagaatttatggcgccctgcacttcccctgagaggcaaaggaaggccctaggactggaagacacgcatctctccaatccacatggttgggtggattttatgtaccatactgaaaggaagccacctagcatctttaaagagagggagggggctagggacactgagtagagtcattgagcctcaggttgctaggacgaaaatactgaaccaaccatttcccagtaaaggaggagtgggagcagggtcataggaatgggaatggagtcacggcatcttaaggacaagggaatgggtattcatcttcaggtgctcacactagtggtccaggagttgactgcataggccacagcctccttctggttgagtgtctttatttcttgcagcttttccctaaacttctgggcttcgccctcctcgttggcaaagcttcgaactgtaggcatggccgacagagcctcaatggccacctggctggactttgccagagattcccgcacctgcacttccagcaactgtggatacatggacaagagatgtcacacgggttggcaaaccatcagggacactaatacctgagttacctatttggaaattaaaggtgagaagagacagaggaaaaggagaaaagagaaagagacacagctatgccccttggatgctaaagaaatacgaggaagaggaaaatgactcagaacgggttggggatcaaattcttaaagacagattgtggggagaagctagaaaagaagacccagagagtatggaggttaatgttgagcaacctgggaacatggaccacagggacagggtgttccatgaagatggagaatcagtaagggtgccaggaaagctggactgaaagcaatgtgagaggaactgagtctgccaagtctgggagatgagggtctgtgtagagcgggccaactccatgaacatacctggtaccattttcccaccttcttgggcagaaggaaaagcagaggcagggtgatcagggtgaccatggtgagggacactgatccccagagcatgatccccaagagacataggcctcgcaccaggtaccacagaaataagctcagattctcactcagagaatcactcagggtggacgtgtcctctgttacccgagacatgatgttacctgcagggttggggagaagagagtgaggtgaatcagacaggttccaagtgatgagacgaactaacaatgagccaggatgccagggtcaggggtgtcaacatggggttctaaggaggctgcaggaaacaaggttagggttctccagaggtctgcaaatctcagtgcagggaagatgagtgttaaagaggaaaggcctgaccttcattttaattataaagtcattaatgcacatgtgaatttccattttcctgaaagctttctgttccctagagaacctgtatgtcccatgctatacacacaggcaggaagagcttaaactggtcacataacagagatggaggaggagggtgctgctaggaagcatgccaaagtctgtggagcactcactgggactagggttctaaccccaggtctatctctagccatatgtaactgtacagcttctagtgctgctagaaagcatgccgaagtctgtggagcactcaagagaccagggttctaaccccaagtgtgtctctagccatatgtaactgtgcagtttcagcatttagggtcttggcctcagtttccttctctgtcagatgaggcagttggtctctatgagctcaaaatttccaggtttgaaattctatggtttctatctaaggatacataggaatagatttataagaaaatgctagatgaaaactctaggtttttcttaaggtaaggaggacaatattttgctcctgaggtatatcaagaatgagaaaaacaattgtgtgtgtgtgtgtgtgagagagagagagagagagacagagacagagagagagagacagggagagggtatatcaagaatgagaaggaacaatgtgtgtatgtgtgtgtgagagagagagagcggggaggggggagatcaaagcagatgtatgaggatatgaacagtacatggcgtataatgaaagagtttcaggagaaacctgtctggttctgttggaaaaactccgtctcctggcgcaggacagccccaaacacctctccctgcaagtggctgtgcacgtggcccatggtgttgttatagatcccgtcacccacgaactccagcactgcactataaagaacccggaaaaaaaggggatcagggtgtgttcagggaacagactgaaggtcccaggtatccccatataagtgcatttcggacagcagccccaacttccaactccctcatttgcagggtgccccattttcagcccccagacctggctatggtgagaatggacatgagagttaagtttcgagtgaaggtatcggctgagccatcttgtagaatccagtcagtgaggcggcccgtaaagaatggaatggccatctcccctggagaaagagaagagaggtcacgcacaaatattaagtctaagtaggtcagttccagtcagactggccccaccacgcctcctccccctcaccattatcctggagggcatcagcagaaaggaaacactgacgtctcaatcccgaacctaaataggctgccctggaactcactaccctgtggttgctctaccagaactttcaggattttattaggaaggctggagatcatgaagtagaaaagcctcctgttagagatgaggatgccccgcccttcggccccagagcaaaggatttccccgcttccggcgtggcccaaagaatcaagacccggtcagcaatggagcccagaacctctggcccccgccagtccagtgccgtttcttctacaccgaagtggtgttccaagacccacgctaggagtccttctcctgctccacatttcccagaacccacgctactctaccttactgacaattacctttgattcctgtcccagtccccttgtgtcctcccctcttgccctgcgttccccttaccaagagaggagaggaccaccaggaccaggaacagcgagaggcggcgcgtctccgagcccaggcagcctagaagccgacgcacagggtttccagagccgccctgaccgccgggcacccagaggctcccgagtttgtgccacagggctgctgcgggcagtgccgctgcataactgacaacgaaggcggtagggtgacttccccagtgcagtagcctggtgctatccgcggacccgggggctccccatgagatcagctctcggaacaaggcaagtcccggcagggccaagcccagtgccgcagctaatggcttcaaagcagccagccagccctgggcacctgcgttttcgctcttggagccaaccgttgccctgaggaccccgcaggcccccagccagagcacggcccagcggctcaggcccaccgcccagacccggagcagtggcagcgcggtgggcaccagcagggagaatatgcggggcagcgcggtccggagcagcacccagtcggcgagaagtagcagtactgtccccagccatgcgagagaagctccggggaggcagcggcacccgcggggagcgggacacctagagctagccattggcactcggacgccgtcccggtcccggccgggcctgggactctccgcgccccggtggggcctgaagctccgggtaccgccgagtcctcccctactggcggctgggggagggaacgagggcggggctctcggaaagtcccaggaacaggctgatcctgcgctggcgagaagctcagccatttaggggaaagcgaaatcgaaagcggccgcctgctcactagataacgcctacttccaaaagtggcctgcccagactattttggtagcaagcgtggaaatcagatctgagaatctcgggagcagccctggtgcccaattttctccatcacgcacac

SEQ ID NO: 2072 - DNA, 16938 bp, Homo sapiens
  source 1..16938: mol_type = genomic DNA
gttgagctacagtttaattgaaggaattgtactaggctaagaattttgccagctcaaaatactggtttaattctttctcagtggtgattgacgtctcaaaccagcaagaggtgtaacatgaggggaaggggctggggaagagggaaaggatgtaagaaacaaaagaaatagttagaatttggggtgtccaaagcaaactcatgatcccacctagtgagaatccatttggaaactgaggaaccaaaggctttgggctccaatctgcagccacttctttgatacgactttgggataggtggactcacccgaagtattgttttacatgtactatttgcctcaatttccctgtgatggttttgtccatcacctcatcctgaaaaaataaatgttggtgatgctttgttccacatattcgttcatttgaactcattattcccaggaaatatccattgaaattcaaaatatcatgaacttccaaagggttttctagaaaaaaaaaacaaaaaaaaccccttgatcttaatgggtgttttttaatctgtgctagaatctgtttgcaatgttttatttaggatttttgtgtcagtataataagtaaattcatctacaatttttatatttgtgcattgtcatagtttaacatcaatattatacttgcttcataaaaaaattttcttctatgccattgagccatttaatttttgtttgtttgtttgtttgttttagagacaaggcctcactctgttgcccaggctggagtgcagtggcacaatcatagctcactgcagccttgaactgggcccaagcgatcctcccacctcagccaagtagttgaaaccacaggcacgagccaccacatctggctaatttttgtattttttgtagagacgggttttcgctgttgcccacactggtcttgagctcctgagttcaagcaatccgactgcttaggcctcccaaagtgctgggattataggtgtgagccactgcacccggcctctattttcaattttaaaagtttgatatagatgtagcatatctatttttttattgatagtaatatcttctatcttctgtgttcatacttttttttttttttttttttgaggcagagtctcactgtgccgcccaggctggagtgcagtggtgcgatcttggctcgctacaacctttgcctcccagattcaagcaattctcctgcctcggcctcccaagtagctgggattacaggcgcccaccaccacacccagctaatttttgtatttttggtagagacagggtttcaccatgttggccaggctgccctcgaaatcctgacctcaggtgatccgcccgccttggcctaccaaagtgctgagattacaggcatgaatcaccaggcccagcctatttttttgtccacttaactggtctagtccagggaaagggaattaaagtgttctattggtagtacatttctgaatattttccttgtatctaccttaatttctgctttataagagctacctatttggtatttagaacttaaacacatgtctcatatattcatatgaattttatactttacattataaagtgcccttcttgtcacactcaattttttttttttttttttttttttggtgaggagtgtctgaatttcatcttgtttggtaagacgaatgtgacctctgcttcccttttgtttgccttctcttgttatgtctttgcccatcatcttatttgttgaaaataatgaatacatctttctgagtggctttatgttaggtgtcttttgcatattgcaaataatagagtttttatcttaatctaatttaaaaatattttcatttatttagttcagttaagaagcccatttataattattcatacagcaaatagattcagtctaattcagagatattaacttctgttaagtataatgtttacatgagtatttttaaaaatctttcactatgtctttattgtgcattttaaaaattttaccttttcagatattaaggaaggtgtatatttcaaggttgctttgataagtttatttgtatataatacacttagttccctcttcctttagataattcctattagttttaaataatgaacaatcacaaaactagctcatatcctctcccttcctctttctgtgtgtgtgtctacctttgtagtcttaaatgtgtaaatacgagcacttgatttattagttttaaagaatatattttgattcctagatgttacagacaagaacatcaacaggcttatttgatatccttattcatttttccacttattctataatcattgagaaatgtgtttcaatttctcaattaatttcttcctataattctcctatatttcttacatattttgtagttttattgctaggtgcaaactgattcagttttagtataatgttctggtgacttcattatcactatgtaatggctgtctttgtttttactaatgcctttggttttagactatatgtttagatatttctgtaattacataagctgtctttctgtcttctgttagtgtttgctttgtgtatcttatatctggttttgatttaacattttcatgtttttaggtttcttgtgatcttatgaagggcatataactggattttgcgatattgttaatctaatctgagaactttcctttaactcccatatttaagctatttatacttgtgatcactgtgctatttacattcgtttctgttacaatatatggtgctctgtatttgctatgtcttactttgcttcttttgttttccttgcatcacttatattaaatcaattacatttttatttaaagtattatttaatttccccttactgatttaggaattttaaattctaattatattagttaaaagtcagtcttatatttttaacatgtttaccaaatgtggcagcatctgaaggtaatcaatatctctaccctcctttcaaacaagacaaagactttaggtgctttaactttgtctgcctcattctcatgtcacttgtggttgctctgccttatttttaaatttaatagtcatttttattactgatttttatcgttacagtcatatttcatttctcattctgattttccaatattttagacagatttgttattgttgtttgtgtgtgtgtttatttttctcatctttgctcccttatccttctgggtttagtatctctgttacttacatgataatattaaaaagcaaatgataactacaatacaatgctactttcacccagaagattgtcaaaattttaaaaattaacactgtctgttggttatatacatatatatatatatggagaaacagataaactcatatgttgctgctggaactataaattaatatagcctctatgaaggcaattttgcaatatctatcaatatttgtaatgtatatattggactcagcaactcccctttaagattgtatcatacttgtatttttgcacatgtgcattacaatgtctatacaagactaactagcaacagcaaaagacttccaataacctaactagccatcagtagaaggaaacaggataaatgaaatatggaacttccataaaatagaatactacatagccatatatttttaatttaaaaaataaagttcagaacagtgaacttagacagctgctgtttgcgaaaatactgagcaagaataaagatatacatatttgcttaatacacagtaaacttctctggaaagataaacacaaagctggaagaacggattgcctatgcaagaggaattagcaaaccttgagaaggattgagagtgaggctttcctctgtatacttctttgtgtcttttgaatttcaaaccacattcatatattgcttatttaaataaataaataatatattttaaaaagaggatagtaggaagataagtggagtcagggagtataggcaactcttttgaggagttttatgcaaagctgggcaagtccacctcttccttagctatgtgacccaggcaagttagtaaatgtttctaaaactccattttctcactcttagaattgagatagtaatacctgccacatagaattatcttgaaaaataaggtaagaagacaggtttcagatacttggcacagcaatagcacatagtaagcaccagtgaatgcttagtagtagtagtagtctaattcctaagagtccatggaactctaggttcaaaacccagtttcttctgggaccattagatggcatcagactcaagcaggtgctcctctagctgacagctctaaaacacaaggaagatctttgttttccttattccctagtcctttccccacaaaattctgacaattacgcatttcctgcttgtttcacaattgccatgtggattacaagtggctatccctgggtggaggcataaaggacttgaaactcaatgctgtttccacatagggccgggcagacaggctatggaggtgttttggcatccaaggaaatctatcagtttcccaagctttcccctctccattcatactttcctttagaaagaataaggcatgcctgggtgggaaagatactgcaggtaagcgacaagaaggggaaattacagggtaaggagatcaatcaaatggtgatggggggtaggagtgaacaaaaagaactctggagcaaaccaggattagtgacatctgtggttcccagacaaaccacacttacaggaatttgtctgtctagcccgaatattttgactttcagggagcatttttctgtgtccctgacataaagcctacctgggagtttcccctgagataagaaactttcaggacatcttaaggtctactgcatcttcctgtactgcccatcaagataagttttccacccagctttatcatgattagctgcgtgatttcatgtcagtttctctgtaaaattaggtttgactgttgcattatttttaagatgccttccaggcttaaagtattatgatgcatgggtataactgtactgaggaaatcaaagaatttctcagatcatcttcttctgtgagggctgcagcttccatgtagttgggagatacaggaattattattcctgttttatgaataaaggacatttgtgggagagaaaggaatcaggccagagttctttctctccaaatgcctattttaccctctgtgaaatttgagagatggatgggtgtggagctgcaagtcagccccaggatgaaagaaaggcaaatctgcacaagaaactgcccactctcaccccatcctcactgcaccctgctcccaacagctgccaggcaagaaaaaatccaaaacagcagttctggggaattcattgccagcactggaaactacctgctgtttccaggaatatgaaggtttctctttcctagaatagcaactttccaaggtaagtccctcccaacaaccagtgatgtgtacaatgttgcattttcagtggtgggagtgggcagggaggattaagattagtacgatggtggagatatttattcatttattcaattgactatttattctccactatgaattaggccctcggccaggtagcagatataaagcttaataagatatatggctttccgcccaggtgctcatggtctagtggaaggtcaaaaaaggtgggaaagggaagatagaactttaaaagggctgtgaaagaggtaaccgcacagtgatagaagcacatggagagttccccagactgacgacataagtaaggcctcctggaagacctgaaccctgagttaagtcttgaacttgaaaatcaggggcgagtcgagcagaaaatgggcaagaaaacaccatatgcaaaggcacaaaggtgttggggaaggcagaagtttgtcgtggagctggatacaacaggagagggtgagacagatgggctggaacagtgtgtgctctgaaaaggatctctgcagcagggcttgagagcacctgaaggaatttccagaaatgccatcatcgtatgtgacacagaatttagaaaaatgactttgtgaagaatggccggaagagggaagctaatggtagagaaacctctctggtgatgggatcatcttaagtctatgagtgaagactataacaacgggactggagagaagagaatagattctgaattatttagagctaagagcagcagagcttttcttgatgggattatggattagggtttatggacccaagatgcaatataattgattgggtcagggtgtggactctagggtcaggcctgtgttcaaactccaactccaccactacgaccaccttgggaaagtcattgagcctctttgagcttcagtttcctcatctgtaaaatggggataataaccaacctcatagggttggggataatgattaaaaacgataatacatgaaaaacacttagcatagctcctactcccattaaaactctataaatggtagctgttaccaatgtcgctattaatactgttaatcagggaactgttctctgtccctccagaccctagcttcttcaaaatagcagacactggtaggaacaaggaaggatataggaaggcaatctcatgaatatttatgtcatttttggttaatttctatctcaaacaacagataaacgactgatgggacaggcagcaaaatagcaactatggttatctccaggaagtgaaacaatgggtacttttacttttcttctttgtacttttttatattgtctaaattttctatatgaatgtatacagttcatgtaagaaggaaaatattttaaaatatatgtattatgccacaaaatactcctcatcaccaggcaaagctctagtcaccagggaattaagtttcctggacacagacagcccccaccccaccccaccccacctctctaccccaccaaaagcacacagtgtccaaatctccatcgtgcctgcaactcaggaacagctatctggccgcacagctctagggaaactcaaagcaggaacagctctgggtcctggagacgcccctgagaagagggcccagtatccctggggcctcagtccatcagccgctgctgcaccaggcgggaatagaggtcctgtccctcctagagctgggcaagcttctgcagcttgccctcctggagcaccaggatctggtgggcgcgctgaactgtctgcagcctgtgagcaatcaccagcactgtgcgatccccacgggaattccagtcctgcagctgaaggggtgatcacagtgcctcagaaagacaggaatgagatggacaccacatccacctgggcaccatctcttatgatttagggtaaagaaggtgtgaaataaaagaaggtaggaaagggcagtagataaaggcctggactgcccttctctcccggctgtactgccacagctggaggaatggaagcccaggagggaactggggctgccctcacaccaccggattccattccccaaccccaagaaggcacagactgtttccactagtaggtccttcgtcctccctctgcccaattctgcacagtctgatcctcccagcatgcccctcccaggccccactgtcccctgccctctcacggtactcacggcctgctcgcactgcacatctagggcactagtagcctcatccaggatgaggacccgcgggtctcgtacaagggcccgggcaatggccagacgttgtttctgtcccgcagccagctggcttcccttctcccctacatctgaggaaatcagagaaattcccttcctcagatacaagtgacacagacaacacacaaggagggacaagtgcacagcaggtacttccagtaggacctcgggaggtgggagggcccagtgcggggagggcccagtgggaggagggccatggggtggggacctgacggggctgcccacggagggagcaccactgctgcattgctctctgcaaacaaagactcttgatcaagagggaggctgaagaattcagtgtgtggggaaggagacgtaggaatggaggaaagggcagaggaacagcaaacatcaagctacagggacacgaccttcaccactaagagtaagtctgattttctcttttttactgaaggagcaagcttacaatttgtagaagatacctgtgtatattccatgctccatttcctggatgaagtcatctgcgtgggcagcctgggcagccgccatcaccttatcatcttcgcagctctgcagcccataagcaatgttgttcctcacagaaccggagaacagcacaggctcctgcccaactgaaaccacctgtgcagcagggacaggggcagaggactatgtgtaaacccccaaggcaggggcccttttgtcctccccacctacctccctcagaatgaacacctggtgcgccttcccgtggatctcccatcctctctctgtacatgctcccctctcctgtcccctgtcttctccctcctcacccacctggctgtgcaggtagcagtgttcatactgtgagatgggcttttcatccagcagcacctgtccccctgtgggctggtacagattctgcagcagggcagccactgtgctcttcccagacccattgggtcccaccagcgccgtcacctcaccaggacgtagggtaaacgtcagcccctagaaaaccagaaaaagagttaagggcctgccccttctccctcaaaatccctccatttctcttcttagcagaggcaagaccaggttctcagaggcaaatgaactataggctgtgatgtccaattatgcattagcagcagagagcaagggtccaggtttcctccctctttcaggcaccttgagcacaggcctgtcagggcgattgggatatgcaaaggagacgtcttggaatttcacaaccccctgcagagtggtgggggcaagcgtgccaggtgaaggcagatttggctgtcggtccatgtaggagaaaaccttctctgcagctcccacgttgctgagcatatccccatatatgtataccagggtctggaaaacaggaatgggagagccggctaattaaacacacttctaccagaaaccaccctcccaactcctcacacactccactcacaactgcactgctcctcctccatactcaaaagagattctccacttttaaatgtacaatttggacggaatttaaaagtggcaccaataccccagtgttccaatttgcaatataaaggatatacagtcccttctcctaccatacagcattgcctctagccccagatcttttcagttactgcttcctattacttgtgcccagttctgtcttgcttgattagacggggagctccttaaatgcaggcactgtgcccaactcacctttgtagccgtcagagtgcccagcgcagttctctacacaaaaaagatgtttatcaagtgtctaggaaaatgtttaaataaagccctggatgaagtagctgtttttgagaactggtaaatgtaggaagagatctaaatgctcactctgcctttcctcatcaaactgtaccaccgggtaatgaaatggtagatgaggggaagtctcccttcatagactacttcagctaatacatgaagaatgatagagtatctcccttttgcagccctaattctgtcatggatgtaggtactgctcatcagtggctgatgttgccacaaatagagaaccagacattgtgtgcctcttggaggaagaatgcatcaccacctaaaaagtactgttgctggaaaaagaccaaaaaaaacccctcaatctcacaagcttctaggtttatctatcaatagacaggaagtacagaggcagaagagcatataataccacagggattcagtcaacaaaatccagaccctaagaaactccacaggacaaacaacctatttcttcaacaaataaactgtgcaagggaaacttttagacagatacatggattgatgggtggatggatggatagatggatggatagatagatagacagacagacttaaaagatgtatcaaccagtcacaatatgtggaccatttctggatcctgatttaagcaaagtataataaacacactcatacacatatactacatggataccacaagtggaaatttgacaattgactatttgataaattttaagaactactgttaattttttggtgtgataatggctttgttgttatacacttttaaagatgtttgtatttttaagaaacatactgaaatatttacagatgaaagtatacaatatcttggatttgcttcagaataatatgggtggggggaagtggctggggatacagatccaacaagattgggcatgagttgatcattgttaaagcacaggatgtatacatgtgagtttgtaatattattttgtctcatttttggcatatgtttaaaattctccatagcaaaattacttgcgggttttggttttgtattgtattgttaaaaagaacaaataaagcccaaggcccaggagtccacaaagaaaaagagagggaaaaaaggagagcaggcttggcttctcgctcacctgcacatagctccccacgctctcctggtagatcataaaggaaagcaggctgccctgggtgagctccccatcctgcatctgctgcagcccacagctcagcatcagcatctgcacccccaagtgcagcacctggaagaggagaagaaagagatgaggctgggaatcttcccattctttccccctctctgcctctatgagactgagctgcaaaggcctctagaaccagctgtagtttcctcttcccttgccctccccctttcctgggctcctttcacaaccactctggtatcttaccctccttacgagcaggtacaaggcgcgttccaggtctctccgccaatacagctgccgacattgttcaagggcctctttatagcgacagacttcatgctcctcggccccaaaactgcgaacggtctgcagccctccaacggcttcccgcaccacctgccccgccctggccactgcatcctggatctcccgaagcacttcctggaaaagagggccagcaaacaccagggctgatgtgcaaagacagcaggcccccacatcttactccagccagtgagatgctccctagtctacctaaaaataccaaactgtttctctccctcttccttactcttctttccagaaggaataagagtgaaggagcaagggaacaaaatattattgagctctcagtgttaggtagtataggagatacatgcaatttttttaaccttcatttgaggtaattttcccatccccagtgtctgaatcaggaaagaagggtagttttcccaaggagccacagatagttaagaaaggtggagatgtaattccaaatggatcagaggcctaaacataagagctaacactataaaactcctaggaaaatgtagaagaaaagcctcatgccactagatttggcagtgatttcttggatataacaccaaacgcacaggcaacaaaaaatagataaatcagacttcatcagaatttaaaacgtttgtgcatcaaagaactctagcaacagagtgaaaaagcaaccatgaaatacaagaaaatatttgtgaatcatatatctgataggaaattaataggcaaaacatatagtgaactcccacaacttaaaaaaaaatcagaaaatgggcaaagaacttgcagacattctttcaagaaagaaacataagtggccaaaatcacacgaaaagatgctcaatatttactaatcattagggaaatgcaaatcaaaaccacaatgagataatcctaatcacctaatcaccattagaatggctattaaaaaaaaagacaacagaaagtggtgttgatgaggatgtggagaaattggaaaccttatgcactgctggtgggaatttaaaatggtgctgccgctatggaaaactgtatggtggtttgatacgatctggctgtgtccctacccatatctgatcttgaattcccatgtgttgtgggagggactgggtaggaggtaattgaatcatgagggcaagtctttcccatgctgttcttgtgatattgaataagtctcacgagatataatggttttaaaaaggggaattcccctgcacaagctgtcttttctcttgtctgctgccatgtgaaatgtgtctttcaccttccgccatgatttgaggtcttcccagccacatggaactgtaagtccaataaacctctttcttttgtaaattgcccaatcttgggtatgtctttatcagcagcgtaaaaatggactaatacatggttcctcaaaaattgttaaatagaattgccatatgatccagcagctccacttctaagtatatacccaaaagaaccaaaagcagggtttcaaacaggtgtacactcatgtccacagcagcataattcacaacagccaaaaggtggaaacaacgcaaatgtccattgacagatgaatggataatcaaaatgtgatatatgcacacaacagaatattattcagccttaaaagggaggaaattctaacacatgctacaatatggatgaggcctgaagacattacgctaagtaaaatatgccagtcacaaaaagacaaatactgtatggttccacttacgtaccgcaccgggagtcatcacaattcatggagacagaaggtacaatggaggttgccagcggccaggggttgggggtagtaggcagttactatttagtgggtacagagtttcattttaggaagatgaaaaaagttctggagatggatggtgatgatggttacccaataacaatgtgggtttcctaaatgtcactgaactgtacacttcaaatggttgaaatggtaaattttatgttatgtatgttttaccacaatataagagaaaaagagaaggtggagctgacattcagacttaggacttcctgatgacgcctcctttccctatgctgcatccagacttcttctgctgattttaaagggaaaatctccctgcctaaaagcctctaagaaaccatttttaatcttcgcagtgggggcgggggatgtacagactcctttgagaagctaatgaaaagttatcatcgcctatcatctccccttcctattccctcccccataccttcacatacactttacatttttgtttacagttctggagaatcatgaatcttctgaagtcaaatatccattgttggatggctggacaaacaaaatgtagtatatactacaatataccttctcccctaatggctgagaagagaacatctctctctaggggatcctctagccacaaatgtggaagcctcctcacctgtcagttttattctccctttggggttcccttacatgcacgctcacctgatggcgggtgttgtacaccttctccgctgctattgtgaagggcatgtgcagcagagaaaggagggtgagtcgaggcgatatgctgagcatgaagccatacagccccaccactttcaccaggcttcgcaagagcacattggcatttaaaggaagccagttactcatcagggtggtatccgagctcagccgtgagttcagctcccctaagaaggacagagcaggtgaggaaaaaggaaaccatgtgtactgcagggcccccagaaactccctcctgaccgttccctctgacacagccccctcctctgaacatcctccttcacttgcagagggacagtggaggctgcttctccaccctgtcccaaacaagagaaaagcatccccaagtcctggcatacgggtgaaggcaggaggagaggctgtgggtggaaggtcactgaggggcaagggatgtccatgggaatctcagacctggactccaggccccacctgtcttagtctcctggaagaaaccgaggtcctggcgcagcagggaggagaaaagctgctcccggatccgcaagttgattcgagacatggtgtaggtgaagcagcctcctcggcagcctgcagacagtgagctgtggggtaggagaataagaggggagggagatgcagagaaggagcaagccagcgggtgaaacagaggagcaagccaggagtgcagagaagcgcaaagtcaggggaaagcatgccaggaggggcaaaagagaaagaaatgagagacagacacacagagagagaagaggtaaggaatacacagaggaagaagaaagaggagacatggtgagctagatgtgagaacaaaatcataacatgtacaaatttacaagtatttatggagtgcactctgtactagacacaatagaaaactacaatagaagggaaaagatattgtgaaaacaagtatcccagtgcttgcttctgtcccagcgtccctcaggcttgtccctctgtgcgtctcctccgccttggtctccttcctgccccatacccaaagcccttctctgtcatcatagatacttcatcatgggaactgcaataataaattccctgcccccacaattctctggagccccagagtcatgtgattcccatctttcatccttcgagttggaaaatccctcttagaccaactacatgctacagtaacacttagaggaaaaaatataaagcataaaagcatgtattttacaaaatatatgtttctaatacaaatttagttaccatattgaagaggcgtttgggagagtcagacatgatataatgagggtttgtactttaatgacagggatgtgttctgagaaatgtgtcgttagatggtttcatcgttgtatgaacatcatagagtgtacttacacaaacctagatgtcatagcctactgcacacctaggccatgtagtttagcctattgctcctaggctacaaatctgtacaacatataactgcacctaacactgtgggcgactgtaacacagaagtaagtatttgtgtatctaaacatagaaaaggtacagtaaaaatatggtattataatcttgtgggtccaccatcttatatgtggcccatcattgacctaaacttcgttatgcagtgcacgactgtagtttcagcagaaagcagccaggatggaatgaaggcacaatgaaatggttttcgagggtactctaaattaagtatgaccataaaaatagagacaatcaggccggctgggatttgggtaaggtgagtgcacacctccttaaactttgcaccccaggtgcctcgctcacctcatcccagtcccagccttatcaaacagtttgtttgtttgagtatgtctagaaagagaaaggaaagcaagtgaagggaaaagagtaatgattctggaaagaaaggtgataagcctcagagtaagatcttcagggactggcaagatgagctgggaaagaagagtgaaagggagaagcatacccatcctgagggagtgaccctggagagatactttggagacagacttaggggtaggaggtaggaggcagaaagaaatggaatttcatggacctaggaatgttgagagacaactgagagacattccatctgagacttaaattccttttgtactaccttcactcataacttgttcctataataagatcagataaactttgaagatattggatgaatatgaacgaaggaagaaatgaatggatagatgaaacagaatggtgactacattcaccatattttagtttaagtatttttgtgttttgcgcctgaaagggcctagaaatggagttagggaagtgaagacccctataaagatttggggctagcaaatggacccagctgcccaccacctacctgccaaaggagaagaggcacatgaagaagatggcactggcaaaggcatgggggtcaaaatcacctcccaggatgtcaatcacacgaccagaatagtgagggattaatgtctcacctgaaagaggcatgaaaaataacacaagaatgtgctggtgcccaggcccttttaccacctccaactcacaacgtcctctcctgactcacccaaaacagcaaggacaaggaagaagaaggcggcaacgaggagaggcaggtccggcctggagagcttcagcagcctccacatcaagactttgttgttcacctggtcctgctccttctcctgggctccaggagggctcagaacagcccacagtgaccagctgagccccgcagccccgtaccccaccagcagccagctccaaggggctgaagcgactctggctgggggagcacgtgaggcccccgcgaccagggctctcagggagacagtcaggggggtggccagacagagcgggagcagcagtgtccccacaaatcccagcagccctcttagctttagcagcccccacagccctcccagccgcagggtcccctccagccatagtcctggcagcccttgaggaagcaaagtccccagagggccctgaagcagccacagtaaagccgcgtccaccagcagcagggaggtccagggtctcaggtcagggagccgcatggctctgtcaacggatacgagatgagaaatcatgggggtggagtcccaatccttgtccctgccctcctacccgcccggctccgcctaacccgtccatcggcttctcattttatcctattcaaccctgagagctctcctgagtaaccggtgctcatccgtacacccctcctacgacagacagctttcggccttctggggagctggaagcatgaccatcaggagcctcgtgcttaaaaaaaaaaaaaaaaaatccccggacccccacccccacccccgcctgccgcggcgagctaagtggtccgggctccgctccctcctatcgccgggtgcagagggactgggaagcaggagcgtggagtgggtagtcacttgggctgcgtccctgttggcgctccaggttcccctccgcaccaactcaccagccgcggcggggagaccgcagctccggggacttctgcttcagcgctgaggtccgctccgtctctcccaacctcgctaccggctctggtccgccagctacgctcggccagggcgggc

SEQ ID NO: 2073 - DNA, 13361 bp, Homo sapiens
  source 1..13361: mol_type = genomic DNA
taaaatagaatactacatagccatatatttttaatttaaaaaataaagttcagaacagtgaacttagacagctgctgtttgcgaaaatactgagcaagaataaagatatacatatttgcttaatacacagtaaacttctctggaaagataaacacaaagctggaagaacggattgcctatgcaagaggaattagcaaaccttgagaaggattgagagtgaggctttcctctgtatacttctttgtgtcttttgaatttcaaaccacattcatatattgcttatttaaataaataaataatatattttaaaaagaggatagtaggaagataagtggagtcagggagtataggcaactcttttgaggagttttatgcaaagctgggcaagtccacctcttccttagctatgtgacccaggcaagttagtaaatgtttctaaaactccattttctcactcttagaattgagatagtaatacctgccacatagaattatcttgaaaaataaggtaagaagacaggtttcagatacttggcacagcaatagcacatagtaagcaccagtgaatgcttagtagtagtagtagtctaattcctaagagtccatggaactctaggttcaaaacccagtttcttctgggaccattagatggcatcagactcaagcaggtgctcctctagctgacagctctaaaacacaaggaagatctttgttttccttattccctagtcctttccccacaaaattctgacaattacgcatttcctgcttgtttcacaattgccatgtggattacaagtggctatccctgggtggaggcataaaggacttgaaactcaatgctgtttccacatagggccgggcagacaggctatggaggtgttttggcatccaaggaaatctatcagtttcccaagctttcccctctccattcatactttcctttagaaagaataaggcatgcctgggtgggaaagatactgcaggtaagcgacaagaaggggaaattacagggtaaggagatcaatcaaatggtgatggggggtaggagtgaacaaaaagaactctggagcaaaccaggattagtgacatctgtggttcccagacaaaccacacttacaggaatttgtctgtctagcccgaatattttgactttcagggagcatttttctgtgtccctgacataaagcctacctgggagtttcccctgagataagaaactttcaggacatcttaaggtctactgcatcttcctgtactgcccatcaagataagttttccacccagctttatcatgattagctgcgtgatttcatgtcagtttctctgtaaaattaggtttgactgttgcattatttttaagatgccttccaggcttaaagtattatgatgcatgggtataactgtactgaggaaatcaaagaatttctcagatcatcttcttctgtgagggctgcagcttccatgtagttgggagatacaggaattattattcctgttttatgaataaaggacatttgtgggagagaaaggaatcaggccagagttctttctctccaaatgcctattttaccctctgtgaaatttgagagatggatgggtgtggagctgcaagtcagccccaggatgaaagaaaggcaaatctgcacaagaaactgcccactctcaccccatcctcactgcaccctgctcccaacagctgccaggcaagaaaaaatccaaaacagcagttctggggaattcattgccagcactggaaactacctgctgtttccaggaatatgaaggtttctctttcctagaatagcaactttccaaggtaagtccctcccaacaaccagtgatgtgtacaatgttgcattttcagtggtgggagtgggcagggaggattaagattagtacgatggtggagatatttattcatttattcaattgactatttattctccactatgaattaggccctcggccaggtagcagatataaagcttaataagatatatggctttccgcccaggtgctcatggtctagtggaaggtcaaaaaaggtgggaaagggaagatagaactttaaaagggctgtgaaagaggtaaccgcacagtgatagaagcacatggagagttccccagactgacgacataagtaaggcctcctggaagacctgaaccctgagttaagtcttgaacttgaaaatcaggggcgagtcgagcagaaaatgggcaagaaaacaccatatgcaaaggcacaaaggtgttggggaaggcagaagtttgtcgtggagctggatacaacaggagagggtgagacagatgggctggaacagtgtgtgctctgaaaaggatctctgcagcagggcttgagagcacctgaaggaatttccagaaatgccatcatcgtatgtgacacagaatttagaaaaatgactttgtgaagaatggccggaagagggaagctaatggtagagaaacctctctggtgatgggatcatcttaagtctatgagtgaagactataacaacgggactggagagaagagaatagattctgaattatttagagctaagagcagcagagcttttcttgatgggattatggattagggtttatggacccaagatgcaatataattgattgggtcagggtgtggactctagggtcaggcctgtgttcaaactccaactccaccactacgaccaccttgggaaagtcattgagcctctttgagcttcagtttcctcatctgtaaaatggggataataaccaacctcatagggttggggataatgattaaaaacgataatacatgaaaaacacttagcatagctcctactcccattaaaactctataaatggtagctgttaccaatgtcgctattaatactgttaatcagggaactgttctctgtccctccagaccctagcttcttcaaaatagcagacactggtaggaacaaggaaggatataggaaggcaatctcatgaatatttatgtcatttttggttaatttctatctcaaacaacagataaacgactgatgggacaggcagcaaaatagcaactatggttatctccaggaagtgaaacaatgggtacttttacttttcttctttgtacttttttatattgtctaaattttctatatgaatgtatacagttcatgtaagaaggaaaatattttaaaatatatgtattatgccacaaaatactcctcatcaccaggcaaagctctagtcaccagggaattaagtttcctggacacagacagcccccaccccaccccaccccacctctctaccccaccaaaagcacacagtgtccaaatctccatcgtgcctgcaactcaggaacagctatctggccgcacagctctagggaaactcaaagcaggaacagctctgggtcctggagacgcccctgagaagagggcccagtatccctggggcctcagtccatcagccgctgctgcaccaggcgggaatagaggtcctgtccctcctagagctgggcaagcttctgcagcttgccctcctggagcaccaggatctggtgggcgcgctgaactgtctgcagcctgtgagcaatcaccagcactgtgcgatccccacgggaattccagtcctgcagctgaaggggtgatcacagtgcctcagaaagacaggaatgagatggacaccacatccacctgggcaccatctcttatgatttagggtaaagaaggtgtgaaataaaagaaggtaggaaagggcagtagataaaggcctggactgcccttctctcccggctgtactgccacagctggaggaatggaagcccaggagggaactggggctgccctcacaccaccggattccattccccaaccccaagaaggcacagactgtttccactagtaggtccttcgtcctccctctgcccaattctgcacagtctgatcctcccagcatgcccctcccaggccccactgtcccctgccctctcacggtactcacggcctgctcgcactgcacatctagggcactagtagcctcatccaggatgaggacccgcgggtctcgtacaagggcccgggcaatggccagacgttgtttctgtcccgcagccagctggcttcccttctcccctacatctgaggaaatcagagaaattcccttcctcagatacaagtgacacagacaacacacaaggagggacaagtgcacagcaggtacttccagtaggacctcgggaggtgggagggcccagtgcggggagggcccagtgggaggagggccatggggtggggacctgacggggctgcccacggagggagcaccactgctgcattgctctctgcaaacaaagactcttgatcaagagggaggctgaagaattcagtgtgtggggaaggagacgtaggaatggaggaaagggcagaggaacagcaaacatcaagctacagggacacgaccttcaccactaagagtaagtctgattttctcttttttactgaaggagcaagcttacaatttgtagaagatacctgtgtatattccatgctccatttcctggatgaagtcatctgcgtgggcagcctgggcagccgccatcaccttatcatcttcgcagctctgcagcccataagcaatgttgttcctcacagaaccggagaacagcacaggctcctgcccaactgaaaccacctgtgcagcagggacaggggcagaggactatgtgtaaacccccaaggcaggggcccttttgtcctccccacctacctccctcagaatgaacacctggtgcgccttcccgtggatctcccatcctctctctgtacatgctcccctctcctgtcccctgtcttctccctcctcacccacctggctgtgcaggtagcagtgttcatactgtgagatgggcttttcatccagcagcacctgtccccctgtgggctggtacagattctgcagcagggcagccactgtgctcttcccagacccattgggtcccaccagcgccgtcacctcaccaggacgtagggtaaacgtcagcccctagaaaaccagaaaaagagttaagggcctgccccttctccctcaaaatccctccatttctcttcttagcagaggcaagaccaggttctcagaggcaaatgaactataggctgtgatgtccaattatgcattagcagcagagagcaagggtccaggtttcctccctctttcaggcaccttgagcacaggcctgtcagggcgattgggatatgcaaaggagacgtcttggaatttcacaaccccctgcagagtggtgggggcaagcgtgccaggtgaaggcagatttggctgtcggtccatgtaggagaaaaccttctctgcagctcccacgttgctgagcatatccccatatatgtataccagggtctggaaaacaggaatgggagagccggctaattaaacacacttctaccagaaaccaccctcccaactcctcacacactccactcacaactgcactgctcctcctccatactcaaaagagattctccacttttaaatgtacaatttggacggaatttaaaagtggcaccaataccccagtgttccaatttgcaatataaaggatatacagtcccttctcctaccatacagcattgcctctagccccagatcttttcagttactgcttcctattacttgtgcccagttctgtcttgcttgattagacggggagctccttaaatgcaggcactgtgcccaactcacctttgtagccgtcagagtgcccagcgcagttctctacacaaaaaagatgtttatcaagtgtctaggaaaatgtttaaataaagccctggatgaagtagctgtttttgagaactggtaaatgtaggaagagatctaaatgctcactctgcctttcctcatcaaactgtaccaccgggtaatgaaatggtagatgaggggaagtctcccttcatagactacttcagctaatacatgaagaatgatagagtatctcccttttgcagccctaattctgtcatggatgtaggtactgctcatcagtggctgatgttgccacaaatagagaaccagacattgtgtgcctcttggaggaagaatgcatcaccacctaaaaagtactgttgctggaaaaagaccaaaaaaaacccctcaatctcacaagcttctaggtttatctatcaatagacaggaagtacagaggcagaagagcatataataccacagggattcagtcaacaaaatccagaccctaagaaactccacaggacaaacaacctatttcttcaacaaataaactgtgcaagggaaacttttagacagatacatggattgatgggtggatggatggatagatggatggatagatagatagacagacagacttaaaagatgtatcaaccagtcacaatatgtggaccatttctggatcctgatttaagcaaagtataataaacacactcatacacatatactacatggataccacaagtggaaatttgacaattgactatttgataaattttaagaactactgttaattttttggtgtgataatggctttgttgttatacacttttaaagatgtttgtatttttaagaaacatactgaaatatttacagatgaaagtatacaatatcttggatttgcttcagaataatatgggtggggggaagtggctggggatacagatccaacaagattgggcatgagttgatcattgttaaagcacaggatgtatacatgtgagtttgtaatattattttgtctcatttttggcatatgtttaaaattctccatagcaaaattacttgcgggttttggttttgtattgtattgttaaaaagaacaaataaagcccaaggcccaggagtccacaaagaaaaagagagggaaaaaaggagagcaggcttggcttctcgctcacctgcacatagctccccacgctctcctggtagatcataaaggaaagcaggctgccctgggtgagctccccatcctgcatctgctgcagcccacagctcagcatcagcatctgcacccccaagtgcagcacctggaagaggagaagaaagagatgaggctgggaatcttcccattctttccccctctctgcctctatgagactgagctgcaaaggcctctagaaccagctgtagtttcctcttcccttgccctccccctttcctgggctcctttcacaaccactctggtatcttaccctccttacgagcaggtacaaggcgcgttccaggtctctccgccaatacagctgccgacattgttcaagggcctctttatagcgacagacttcatgctcctcggccccaaaactgcgaacggtctgcagccctccaacggcttcccgcaccacctgccccgccctggccactgcatcctggatctcccgaagcacttcctggaaaagagggccagcaaacaccagggctgatgtgcaaagacagcaggcccccacatcttactccagccagtgagatgctccctagtctacctaaaaataccaaactgtttctctccctcttccttactcttctttccagaaggaataagagtgaaggagcaagggaacaaaatattattgagctctcagtgttaggtagtataggagatacatgcaatttttttaaccttcatttgaggtaattttcccatccccagtgtctgaatcaggaaagaagggtagttttcccaaggagccacagatagttaagaaaggtggagatgtaattccaaatggatcagaggcctaaacataagagctaacactataaaactcctaggaaaatgtagaagaaaagcctcatgccactagatttggcagtgatttcttggatataacaccaaacgcacaggcaacaaaaaatagataaatcagacttcatcagaatttaaaacgtttgtgcatcaaagaactctagcaacagagtgaaaaagcaaccatgaaatacaagaaaatatttgtgaatcatatatctgataggaaattaataggcaaaacatatagtgaactcccacaacttaaaaaaaaatcagaaaatgggcaaagaacttgcagacattctttcaagaaagaaacataagtggccaaaatcacacgaaaagatgctcaatatttactaatcattagggaaatgcaaatcaaaaccacaatgagataatcctaatcacctaatcaccattagaatggctattaaaaaaaaagacaacagaaagtggtgttgatgaggatgtggagaaattggaaaccttatgcactgctggtgggaatttaaaatggtgctgccgctatggaaaactgtatggtggtttgatacgatctggctgtgtccctacccatatctgatcttgaattcccatgtgttgtgggagggactgggtaggaggtaattgaatcatgagggcaagtctttcccatgctgttcttgtgatattgaataagtctcacgagatataatggttttaaaaaggggaattcccctgcacaagctgtcttttctcttgtctgctgccatgtgaaatgtgtctttcaccttccgccatgatttgaggtcttcccagccacatggaactgtaagtccaataaacctctttcttttgtaaattgcccaatcttgggtatgtctttatcagcagcgtaaaaatggactaatacatggttcctcaaaaattgttaaatagaattgccatatgatccagcagctccacttctaagtatatacccaaaagaaccaaaagcagggtttcaaacaggtgtacactcatgtccacagcagcataattcacaacagccaaaaggtggaaacaacgcaaatgtccattgacagatgaatggataatcaaaatgtgatatatgcacacaacagaatattattcagccttaaaagggaggaaattctaacacatgctacaatatggatgaggcctgaagacattacgctaagtaaaatatgccagtcacaaaaagacaaatactgtatggttccacttacgtaccgcaccgggagtcatcacaattcatggagacagaaggtacaatggaggttgccagcggccaggggttgggggtagtaggcagttactatttagtgggtacagagtttcattttaggaagatgaaaaaagttctggagatggatggtgatgatggttacccaataacaatgtgggtttcctaaatgtcactgaactgtacacttcaaatggttgaaatggtaaattttatgttatgtatgttttaccacaatataagagaaaaagagaaggtggagctgacattcagacttaggacttcctgatgacgcctcctttccctatgctgcatccagacttcttctgctgattttaaagggaaaatctccctgcctaaaagcctctaagaaaccatttttaatcttcgcagtgggggcgggggatgtacagactcctttgagaagctaatgaaaagttatcatcgcctatcatctccccttcctattccctcccccataccttcacatacactttacatttttgtttacagttctggagaatcatgaatcttctgaagtcaaatatccattgttggatggctggacaaacaaaatgtagtatatactacaatataccttctcccctaatggctgagaagagaacatctctctctaggggatcctctagccacaaatgtggaagcctcctcacctgtcagttttattctccctttggggttcccttacatgcacgctcacctgatggcgggtgttgtacaccttctccgctgctattgtgaagggcatgtgcagcagagaaaggagggtgagtcgaggcgatatgctgagcatgaagccatacagccccaccactttcaccaggcttcgcaagagcacattggcatttaaaggaagccagttactcatcagggtggtatccgagctcagccgtgagttcagctcccctaagaaggacagagcaggtgaggaaaaaggaaaccatgtgtactgcagggcccccagaaactccctcctgaccgttccctctgacacagccccctcctctgaacatcctccttcacttgcagagggacagtggaggctgcttctccaccctgtcccaaacaagagaaaagcatccccaagtcctggcatacgggtgaaggcaggaggagaggctgtgggtggaaggtcactgaggggcaagggatgtccatgggaatctcagacctggactccaggccccacctgtcttagtctcctggaagaaaccgaggtcctggcgcagcagggaggagaaaagctgctcccggatccgcaagttgattcgagacatggtgtaggtgaagcagcctcctcggcagcctgcagacagtgagctgtggggtaggagaataagaggggagggagatgcagagaaggagcaagccagcgggtgaaacagaggagcaagccaggagtgcagagaagcgcaaagtcaggggaaagcatgccaggaggggcaaaagagaaagaaatgagagacagacacacagagagagaagaggtaaggaatacacagaggaagaagaaagaggagacatggtgagctagatgtgagaacaaaatcataacatgtacaaatttacaagtatttatggagtgcactctgtactagacacaatagaaaactacaatagaagggaaaagatattgtgaaaacaagtatcccagtgcttgcttctgtcccagcgtccctcaggcttgtccctctgtgcgtctcctccgccttggtctccttcctgccccatacccaaagcccttctctgtcatcatagatacttcatcatgggaactgcaataataaattccctgcccccacaattctctggagccccagagtcatgtgattcccatctttcatccttcgagttggaaaatccctcttagaccaactacatgctacagtaacacttagaggaaaaaatataaagcataaaagcatgtattttacaaaatatatgtttctaatacaaatttagttaccatattgaagaggcgtttgggagagtcagacatgatataatgagggtttgtactttaatgacagggatgtgttctgagaaatgtgtcgttagatggtttcatcgttgtatgaacatcatagagtgtacttacacaaacctagatgtcatagcctactgcacacctaggccatgtagtttagcctattgctcctaggctacaaatctgtacaacatataactgcacctaacactgtgggcgactgtaacacagaagtaagtatttgtgtatctaaacatagaaaaggtacagtaaaaatatggtattataatcttgtgggtccaccatcttatatgtggcccatcattgacctaaacttcgttatgcagtgcacgactgtagtttcagcagaaagcagccaggatggaatgaaggcacaatgaaatggttttcgagggtactctaaattaagtatgaccataaaaatagagacaatcaggccggctgggatttgggtaaggtgagtgcacacctccttaaactttgcaccccaggtgcctcgctcacctcatcccagtcccagccttatcaaacagtttgtttgtttgagtatgtctagaaagagaaaggaaagcaagtgaagggaaaagagtaatgattctggaaagaaaggtgataagcctcagagtaagatcttcagggactggcaagatgagctgggaaagaagagtgaaagggagaagcatacccatcctgagggagtgaccctggagagatactttggagacagacttaggggtaggaggtaggaggcagaaagaaatggaatttcatggacctaggaatgttgagagacaactgagagacattccatctgagacttaaattccttttgtactaccttcactcataacttgttcctataataagatcagataaactttgaagatattggatgaatatgaacgaaggaagaaatgaatggatagatgaaacagaatggtgactacattcaccatattttagtttaagtatttttgtgttttgcgcctgaaagggcctagaaatggagttagggaagtgaagacccctataaagatttggggctagcaaatggacccagctgcccaccacctacctgccaaaggagaagaggcacatgaagaagatggcactggcaaaggcatgggggtcaaaatcacctcccaggatgtcaatcacacgaccagaatagtgagggattaatgtctcacctgaaagaggcatgaaaaataacacaagaatgtgctggtgcccaggcccttttaccacctccaactcacaacgtcctctcctgactcacccaaaacagcaaggacaaggaagaagaaggcggcaacgaggagaggcaggtccggcctggagagcttcagcagcctccacatcaagactttgttgttcacctggtcctgctccttctcctgggctccaggagggctcagaacagcccacagtgaccagctgagccccgcagccccgtaccccaccagcagccagctccaaggggctgaagcgactctggctgggggagcacgtgaggcccccgcgaccagggctctcagggagacagtcaggggggtggccagacagagcgggagcagcagtgtccccacaaatcccagcagccctcttagctttagcagcccccacagccctcccagccgcagggtcccctccagccatagtcctggcagcccttgaggaagcaaagtccccagagggccctgaagcagccacagtaaagccgcgtccaccagcagcagggaggtccagggtctcaggtcagggagccgcatggctctgtcaacggatacgagatgagaaatcatgggggtggagtcccaatccttgtccctgccctcctacccgcccggctccgcctaacccgtccatcggcttctcattttatcctattcaaccctgagagctctcctgagtaaccggtgctcatccgtacacccctcctacgacagacagctttcggccttctggggagctggaagcatgaccatcaggagcctcgtgcttaaaaaaaaaaaaaaaaaatccccggacccccacccccacccccgcctgccgcggcgagctaagtggtccgggctccgctccctcctatcgccgggtgcagagggactgggaagcaggagcgtggagtgggtagtcacttgggctgcgtccctgttggcgctccaggttcccctccgcaccaactcaccagccgcggcggggagaccgcagctccggggacttctgcttcagcgctgaggtccgctccgtctctcccaacctcgctaccggctctggtccgccagctacgctcggccagggcgggc

SEQ ID NO: 2074 - DNA, 14693 bp, Homo sapiens
  source 1..14693: mol_type = genomic DNA
ttggaagcactggaatacagctttattcctacacgattagacccgttaccccgtgggtctggccgaccgtcctgactcggagatccctgagctgcgccgccgcttccttcgtcaacatccagcagctacttgatgagcgccctccagtgggccttaggtccctatgccggcgcggggttacagcagtggacagacaggccagtccctgtcctcgaggagcccatgatccgcggggagacaggcatttaacgacgactcacacgatcacttaaatacaactgtggtgaaccgcacaagagggacgcgcggcggtctgcggggaatgacgaggccgacctcgtctgcgacccagggagggcaagggtggaccaggcaaagggaacagaggactgggacctggaggtgggcgggaggcgtttggttcattggaggaaaggaatagccctgtgtgtgatgagcattgagaggaggtctggcgagcaccatctagggctgaagaactaggcagtggctccagcgcggggcggtgggggggacaagtgagccagggcaagaagaatggatttggccctagagtacgggttctccaaatgtaacctcggccctacagatctctgagactatgtcagggggtttgtgagattttataacaaaattaagatgttagtacaatatcgtgtttcgccgccgggcgcggtggctcacgcctgtaatcccagcactttgggaggccgaggcgggcagatcacaaggtcaggagatcgagaccatcctggctaacacggtgaaaccccgtctctactaaaaacacaaaaagttagccgggcgtggtggcgggcccctgtagtcccagctactcgggaagctgaggcaggagaatggcgtgaacccgggaggcggagcgtgccgtgagccgagatcgtgccactgcactccagcctgggcaacagagcgagactctgtctcagaaaaaaagaaagattatttgcagccgggcgcggtggctcacgcgggtaatcccaatactttgggaggccgaggcgggcggatcaccaggttaggagatcgagaccatcctggctaacacggtgaaaccccgtctctactaaaaaatacaaaatattagccaggcatggtggaggacgcctgtagtccgagctacttgggaggctgaggcaggagaatggcgtgaacccgagaggcggagcttgcagtgagccgagatcgcgccactgcactccagcctgggcgacagagcgagactccgtctcaaaaaaaaaaaaaaaaaagttttttgccttcttcattctataagtgtacagtggagtttttcagaagctacatgatatgtattgacaccatggttcccacgatgaatagaatgtgtgcctatgtattctcgtgttttaaatttttctcacttttaagttctagtaccataaatattgatagctataacccacatacccaaaagctttttggggtccttgatgatttttaagaggtcctgagagaaaaaaattttgagaaccactgtcctagagctccaagaaggtgaatgccataagatgtgtgttttttaaaaaagcatttctcgggcctggtgtggtggctcacgcctgtaatcccagcactttgggaggctgaggtgggcagatcacctgaggtcaggaattcaagaccagcctggccaacatggtgaaaccccgtctctactaaaaatacaaaaattcactgggtgtggtggcatgtgcctgtaatcccagctactccggaggctgaagccacagaattgcttgaacccaggaggcggaggttgcagtaagccaagatcatgccactgcactgcagcctgggcggaagagtgagactccgtctcaaaaaaaaaaaaaaaagaaaaattatcccttatataagtgaaagaaaaaaaaaaaagcattccagccactcagtggagagagattggagggattaggagcagatgatagggtattattttagggagctactacagaagcttgggccagagatgatggtggcttccacaggatggcagtgagtgccctcactctgctttctggaagagaggaaggtggtgaggaattcaggatattaaaaggcagttgaggtgtacatggtcagtttagagacatataaactatcatgggcacagatgatgggagaaggatgaggctaatattttctgccctccagacactgctgagtgctgtatctcctgcatcttcttaaggagatacactgtcttccttaatcctcctaaaagtcctctcaggctccgctgtccaatatgacagccaccacccacattaggctattgagcatttgatatgtggctagtccgaattgagatgtgctgactatttaaaataaacacctgtgtttgaatacttaaggtgagaaaagggctgcaatttattttcttttctttctttttttttttttttttttgagacagggtctcactttgtcacccaggctggagtacagtgggacaaccttagctcattgcagcctcaccctcccagattcaagcgatccttctgccacagctccccaagtagctgggactatagctgtgtgccaccatgcccagctaatttgttttgttttgttttgttttgttttttgagacagagcctcactctgttgcccaggctggagtgcagtggtgcgatctcggctcactgcaacctccacctcccaggttcaagcaattctcctgcctcagcctcctgagtagctgagattacaggtgtgcaccaccatgcccggctaatttttctgtatttttagtagagacggggtttcaccatgttggccaggctggtcttgaactcctgacctcaggtgatccgccctcctcagcctcccaaagtgctaggattacaggcgtgaaccaacgcacctggccaagactgtaatttctttttcttttttttttgttgttgagacgaagttttccttttgtcacccaggctggagtgcaatggtgtgatctcagctcactgcaacctctgcctcccaggttcaagcgattctcctgccccagtctcccgagtagctgggattacaggtgccgtcacatctggctaattttttgtatttttagtagagatggggtttcatcatgttggctaagctggtcttgaactcctgacctcaggtgatcctcccgcctcggcctcccaaagtgcagggattacaggcatgagccatcgcacccggcctgtaatttcttatattgtttacatgttgcaataatattttggatgtacaggttgagcatcgccgatccaaaactctaaaatctgaaatgttccaaaacctgaaatttttttagtgccaacatgatgccacaagtggaaaatcccacagctgccctcatgtgatgggtcacatatattattaaaaatattgtggtcgggtgcagcggttcacacctgtaatcccaacgctttgggaggccaaggcagcgggcggatcacctgaggtcgggagttcgagaccagcctgaccaacatggtgaaaccccgtctctactaaaaatacaaaaattagccaggcgtggtggtgggtgcctgtaatcccaactactcgggaggctaaggcaggagaatcgcttgaacctgggaggtggaggttgcagtgagccgagatcgcaccattgcaccccagcctgggcgacagagactctgtctcaaaaaaaaagagaaggaaaaaaatcttcaggccatgtgtataaggtgtataggaaacataaatgatttctgtgtttagatttgggtctgatcccaaagatattaaatatatgcaaatattccaaagtctgaaaaaatccaacatccaaaaacacttctgacccaagcatttcagataagggaccagaattattagattaaataaggtatattattaagttaattttacctgtttctgcttatttttttaatgtgagtactagagtatttaaatttacatatgtggcttgcattatctttctattggacagcactgcctaagtaactttttaaaatccctacacccaaggaaacatatagattaagtagcatgctcaaagagtcctacagttaggatatagtgccaggttttaacccagatcagtgtgaattccaagcctaggttctgcctaccacaccagcagcctccctccatgggttttgagataggatgaggagataaagtgacaagggaaagatacagagaggtggagcactgtaccttctttgaatccttgcaggtggacaggtagacagctgtggggaaagattgagaagggatgggatgctggagtggtagaggtggagggcagagggatgggtgtcaggctcttgggagtaggtggggaaagtccaccaacctcaggtcatggtcagggtagggctgacacttaccagcccagcccagtgccttgaagagcccaagcagaagaaaggcagacaggaaaaggcctacgctgtcctcaagggagggccctgaaagacctggcaggcagaaggggtgagagtgagctcctgtcttcctgggtgctggctcagattccgcagagctcccagctcttacctgctacctccagggtgacctcagcgctgcgccccgaggcaggcaggctgggatggtgaattcgacaggcatagcgtgccccatgctgctcagtggtgactgggggcggctgcaagtgcccagagaggctgacagagccatcggaatggtggcgcagggccgagagccacctctgcccctcggccttctgagagcggccccctgggccaccccggagttcccactccacctccaggcccccagaagggtagaagtgggacacaaggcagagcaattccgggggtgcctcccctggggcggcccgtgcaagggttgctggcatcagggacactttggggggttctggggaaagaggacgaaatgagcatagggaaatcagtccatactgtcctccctaagagaccctcagtttgcctgctggcttcctcagaactaaagaaggttaggtttcttctcctgaaatagggaacccactgtctctccattggtgcgtcacagaaatacccatgtcaaagcccctcaaatttccaggaaacttctagcctcccattacccctctaactcccaggaacctctttctatctctacttacttgcccaggcaccctcttatccatcatccctccccctattacggtccccacaatccagtgcccaccctctacccctggagacctctgtcccccaactcactgtacacagcaagctccagggtgacctgtccttgcaggtatggcaggtgtatggtggccagataggtgccctcctgaaagggttgaactgtaggcagccagaaggtcccatttccggtccatgggccccatggctcatcatcatcccaagcagcaaatgccacggccccttcttgggctgctggcatctggccattcagcccaggagttgcagccaggagcagatgtcccttacccaggtgctggcgtcgccactctagcccaaagggagggggacccggagccagagatgaggcggcctcggaggtggggggcatgtaggcaaagctcaagtccagcagagcatcttgtcccagtctcactcgaggggcaggggtgtgggtgaggacagtcagtaccactgaggaagacagggagatgaggggttgggaggggcatgagggagagaaagaaggagaaaaaaatagagaaatgcagttattggggagggctaaactgcagtttacccacccctcagaggacaccttttctgatactcaccatttcctagccctccctgcaaactccttttgctctgcgactgggtggcacctagtgtggctgagggtgagcagagaggtctaggggtggtgagtaggggcaatgagggggtatggcctttgaagcctactctgaacacatagcacactctagctcgggggactgcagaatccgaggccacttctgacacaacctgaaccactctatctccaagcaccacccttgaggaaccaggcctttcttgattacaggcgaagacaatgattgagccatgactgtcagtcttgtggtgctgtacagaatatttactgactctagaaggttccagctctagcctagacctgagcacagacctctatgctctactgaagcagtacagtgcagtggctaagtgcctggagcctggctgaccgggttcaaatcccctctgcagcttatttatatggccttgggccacttcctttttccatggctcagcttcctaatctctaaaattaaaagttgatgataataatagtacctacttcatgaggttgttgtgatggttaaatcattaatacctcttgctactcaagtctattcagttcccaattttagataacagagacacctacccatgaagggtgcttacaacactgtctggaacacagtaagtctacacgtgtttgctatagttacacctaacttagcataccccaagtcaacagcatctctgcaacattccccaccctgctccaatgcccatcttccctgtctttgatgaatgatcaccaagcccgccagacactaaaagcaaacccttggagttactcagactcatttattcattcagcaactattgagcactgaagatgttcaaggtatcctggtagaagacagaatggtgaacaagacaagcagtccctgctctcaaattgcctatagtccaatgacagacaagcaaattgtcaaaaataatgtgctatgtgctatccccaccaggacctaacagatctcacatctgtttccaatttaggttctcatcaatgtacgtttagacaattacaacagccctcctgtctggtctccctattctcagtctctccttcaactccttcttcacactgtagccaaacaaagtgactacaagtctgatcccatcacctacctgtttaaaaatcccaaatatgggccagacgcagtggttcatgcctataatcccagcactttgggaggacgaggcgggtggatcacctgagttcgggagtttgaaaccagcctgaccaacatggtgaaaccccgtctctactaaaaatacaaaattagcctggtgtggtggcacatgcctgtaatcccagctactcgggagaccgaggcagtagaattgcttgaacccgggaagcagaggttgcggtgagccgagattgtgccattgcactccagcctgggcaataagagggaaaccccgtttcaaaaaaaaaaaaaaaaatcccaaatacggccaggcgtggtggctcacacctgtaatcccaacactttggtagcctgaggcgggtggattacctgaggtcaggagttcaagaccagcctggccaacatggcaaaaccctgtctctactaaaaatacaaaaattagccaggtgtgggggcaggcacctgtagtcctagctacttgggaggctgaggcagaagaatcacttgaacctgggaggtagaggttgccgtaagctgaaatcatgccactacactccagcctgggcaacagagtgagactccgtctcaaaactaaataaataaataaaataaaaatcccaaatacctaggaagtcagctgataaaggcataggctgaagctatatggcctgggttcaatttctagccctgcttcttttttttttttttttttttttttttgagatagagttttgctcgtcacctaggctagagtatagtggtgtgatcttggctcactgcaacctctgcctcccaggttcaagtgagtctcctgcctcagcctcctgagtagctgggattacaggcgtccacaaccgtgcccagctaatttttgtatttttggtagagatggggtttcaccatgttgcccaggctggtcttgaactcccgacctcaggtgatccacctgctttggtctcccaaagtgctgggattacaggcatgagccaccacgcctggcctctagctctgcttcttacacactgtgtgtccttgggcaaattatttaactggtttgtgtcctatatttatccatatgcaatacagggataatattaaaacctacaacctatggttgttgagaggaataagtgagattatgcatataaagtgcttagaacagggcctggcatatagaaaatacttgataaatgttagctgttactattttcattaccttcatcactatcatggacttgctggttaacttggaaaaatcatttaacctgtattttcctcactagtccaaagatctgacctttgcctatcttttaaaagaatcaagtaaaataacaggctttttccgggcatggtggctaacacatgtaatcccagcactttgggaggctgaggcgagtggattacctgaggtcaggagttcgagagcagcctggccaacatggtgaaaccccatctctactaaaaatacaaaaaaaaaaaaaaaaaaaattagcggggcgtggttgtgggtgcctgtgatcccatcaacttgggaggctgaggcaggagaattgcttgaacccaggaggcagaggttgcagtgagccaagatcaccccattgcactccagcatgggtgacaagagtgaaactccgtctcaaaaaataaatatgtacataataaaaacaggctttttagaataacacgccctccaaaagaacttctgatggttcgctctcacctacagaacaaagcccagctttcaaggtatttgaacattcagcccctaacccacccttccaggcttctcctgcaccctacaaaccagccacatagaacccctttcttgtgcctagtagaagtggtcatcattggtcatctctttgctttggtcatgaggtcccttcagtttacattgtctttcccattttctcccaaacatctatcaagcttgtccaacctccagcccagggaccacatgcagccaaggacggcttggaatacagcccgacacaaattcataaactttcttaaaacattatgagattttttcacattttttttttttagcttatcagccatcgttagtgttcgtatattttatgcatggcccaagacaattcttctcccagtgtggctcagggaagccaaaagattggagacccctgatctaaatactccatgtacatgaaggtcactttcactgctgtttcttcccagaaatgtctaggtccttcaggtagaagtaatctttttcttcttgtaattatttttatgttctttttaatcctagcttctgaggcctataaggttaaactgttctcatcttcatggaattgttcagtagagtaaaaacagtatgcaatttcacttagtttgtcaaaatccagaaacatacttttgaattgttaaaaaaaaaaaaaaagatccacaggctgggcacagtggctcacgcctgtaatcccagcactttgggaggccgaggccggtggatcacctgaggttgggagtttgagaccagactggagaaaccccgtctctactaaaaatacagaattatccgggcatggtggcacacgcctgtaatcacagctgcttgggaagctgaggcaggagaatcacttgaacctgggaggcggaggttgtggtgagccgagatcatgccattgccctccagactgggcaacaagagcaaaacttgatctcaaaaaaaaaaatccatagaattaataaacaaaacctggctgggcagggtggctcagacttgtaatcccagtaccttgggaggctgaggtgggaggatcacttgaacccagcagtttgagaccagcctgggcaacatagcaagaccccatctctatttaaaagaaaaaatttaaaaaaataataaacaagacctaaaggttttacagtttaactcttttttttttttttttttttttggagacagggtctcactctgtcacccatcaaaggtgcaatcctcccaacacagcctcccgagtagctgggaccataggtacatgccacgacacccaacctttttttttttttttttttttttgagacagtttcacgcttgttgcccaggctggagtgcagtggcatgatcttggctcactgcaacctccgcctcccaggttcaagcaattctcttgcctcagccttccgagtagctgggattacaggcatgcaccaccatgcctggctaattttgtatttttagtacagacggggtttctccatgttggtcaggctggtcttgaactttcgacctcaggtgatctgcccacctcggcctcccaaagtgctgggattacaggcatgagccactgcgcccagcatttttttaatttttagtagagacaaggtctggttatgttgcccaggctggtcttgaactcctgagtgcaaatgatcctcccacctagacctcccaaagtgctggaagtacaggcgtgagtcacctcacctgactccataatattttaaaagaatggtgagaattaaacactatacacacaaagtatattaagaaagtataggcctggcgtggtggctcacgcctgtaatcccagcaatttgggaggctgaggtgggtggatcacctgaggtcaggagttcaagaccagcctggctaacatgaccaaaccctgtctccactaaaaatacaaaaattagctgggcctggtggtgggcgcctgtagtctcagctacttgggaggctgagacaggagaattacttgaactcaggaggcagaagttgaaatgagcagagatcacaccattgcactccagcctgggcaacagggtgagactctgtctcaaaaaaaaaaaaaaaaaaaaaaaagtatatttggggccaggcagctcacacgtgtaatcccagcagtttcggaggccaaggtgggcagatcaattgagcccaggagtccaagaccagcctgggcaacctgacaaaaacccatctccacaaaaaaaatacaaaaattagctgggcatggtggcacatgcctgtggtctcagctactcaggagactgaggcacgaggatcacttgagccacggaggtggaggttgcagtgagctgagatcatgccactgctctccagcctgcactgcactccagcctgggcgacagagggagaccctgtctcaaataaataaataaataagcatatttgtcaataaacatttaaaaatatttgataagacaagtataaatgtatattagcaaaatcatgaatgatcttggaccctggagagatttcatttctaattttacatcagtacaacagctttcattttcttaaatccctgatcaagcagaaatgcttgaaaagaaagagcacagcaggccgggcgtggtggctcatgcctgtaatcccagcactttggaaggccaaggtgggtggatcaccttaggtcaggagttcaagaccatcctggccaacatggtgaaacctgtctccaataaaaatacaaaaattaggtgggcgtggtggcacaagcctgtaatcccagctactggggaggctaaggcacaagaattgcttgaacatgggagacggaggttgcagtgagccaagatcatgccactgcaactgcactctagcctgggcaataagagggagactccgtctcaaaaataaataaataaataaatagcaggcaggcgcagtggctcacgcttgtaatcccagcacttcgggaggcgaggtgggaggatcacctgaagttgggagttcgagaccagccttaccaacatggagaaacctcatctctactaaaaatacaaaattagctgggtgtggtggcaggcacctgtaatcccagctactcgggaggctgaggcaggagaattgcttgaaccagggaggcggaggttccggtgagcgtgagatcacgccattgcactccagcctgggcaacaagagcaaaactctgtctcaaaaataaataaataaataaaataaaaataaataaatagcacagcaccttgctttgaccccagttgtttgtgaaatacagacaatcttaccacccgggcacttccagggctccctgtctgcatgtccttcactttctactttacattaggattatccgtggcaaatacgcccagaacctcctggagagcagagtctacatcagatcatctttgtgacccttaagggcacccagggccaccccagagattctgatttaatcggccaagctaagcatgggattgaatcaggtttcagtatattttagaaacctccaacagtgtggactgagaactgctgagtcctaactcattcttggtgctaaaaagtatttattgaatcaatggataaattaacacagtgccatctcttgatagtcacaacaagaaaagcagctgggaaatagtatccacattttacagttggaaaaacaaactcagaaagcaaagaccattctcatcatcacctcggtggagccagtagccctaggaaatattccaccccaccagagagagctactgtctacacaagagcagtgttcctcagcttctgccagggtgggggcttgagactaagaatggaggtataggcagaggtgagggtttcagcgtgggtttcaagtctgtctccctggttctgtgggtaattctcaggagggtggagggaagggagggtgcagggattggttggggttgccctgtccatcgggctgtgtcgctgacataaaatccagatagaaaagctaagaactctaccggtattctaccccggaataccccgcctccgctgccaggagggagagctcccagatatccaggtcagactctcctcattcttgaattatctgcacagtccctcccacgtcccagcctagaaaagcttctgactcctgggcctcaaactgcaatgcacctttcagtgcaataggagctatccaatctccagccgcgtccatccgcccactcgagcccacctgtttgcggaccacagagcggcagcacatccctacacggggctgtcaggcaaggtcaacgcgctagagtgcaagagcctttgctttgcggattgccgcagcgccgggtgtgggcgcaggtggggatagagtgctgggttttgaaagagtgacccgcaaagctgagggtgcagagcaagacacagatctgggaagagcagagaaaaaacgctcctgcttctgaacccctcccacctcgcatcacctgacaagtctctcaaggtctggtgtcgggaaaccccacctcttcaaagccccgcccttcgaaacaccagaaagtaacccccctgcccggccctgctttccccctaccccctgccaagctgcagttttttttttgttttttttttttaactgggtgagggctagaaggagcggtagagattgattcattctagccaaaccacctctcttaacaaaaaaaggaaactgaaccccgattggcgaaatgtcttgctcaagtccataaagcgagaccaccggctgatctggacccttagaatctacccacccttctccacctcccctccccagctacctgttgccatggtgatgagaacaggctcctgctgaggctctggctgtggtcgcaagaggctggagaggctgaggactgggctggatatgctgaccatcagccaagccccatccagggcccgcgggcagttctgcgcgggggtcaggccgctggcccatttcgcagaggcggggagaggcacgaagcggctcatctcgcagtgtggtgcgggggcgccccggggataccgcctgaaggcagcctggagggcgcccgcggggtctgagtgtagagaaggaagttgcagctgtagagtcaccgccgggaaaggggctggaagggcagcgttcggggaacttcaaatgcacagactaccccgtagtgagactcactttacaaaggggaagctgaggcctgaggtcactgccggatctaaagaggagggggtttcggtggaggcgacagaggtaggggggcggcgagtccctagagactcaccgtgtacactgagatagagctcagggtcgaggtccggccggggcggcggttcccccggtccctggcgcaacagcagtgcaccgggtctcttggccaggccctttccgctcgcatcctccacgaaccaacactcgatcaccgcgggtcctgctgagacggcggtcgccaggcctggcgtatagggacgcgagtgaggagcggtttgtatgtctggtgacctgccccactcccaccctggcatcggctccagtggggccacctccctccgcttccctctagttcttgggcgatgagtcgcggggttcgctcacccaaagccacagcgaggagcagagacagggacttcatggcgctgcgacctcctcagccatgaagcctcctcttcctcctttcactttcactttcctccaaagggcggcatgaggggcggtggaaatccccgctctggttaggtgaaggtgcctgggggaccggtgtttccccactggccaggcagggacccgggtagatcctctccagttctcaccaggacaccccagccttaccgcgccctcctggactacccagcagccccgagttcgagccctccccaaccccaggccctcccccgccccccaactcctgtgtgtgctctccaacatccacttgcccgaaaaccattactccggcttccccctatctgtgccgcgtcccc

SEQ ID NO: 2075 - DNA, 14693 bp, Homo sapiens; identical to SEQ ID NO: 2074
  source 1..14693: mol_type = genomic DNA

SEQ ID NO: 2076 - DNA, 10755 bp, Homo sapiens
  source 1..10755: mol_type = genomic DNA
ttaattttacctgtttctgcttatttttttaatgtgagtactagagtatttaaatttacatatgtggcttgcattatctttctattggacagcactgcctaagtaactttttaaaatccctacacccaaggaaacatatagattaagtagcatgctcaaagagtcctacagttaggatatagtgccaggttttaacccagatcagtgtgaattccaagcctaggttctgcctaccacaccagcagcctccctccatgggttttgagataggatgaggagataaagtgacaagggaaagatacagagaggtggagcactgtaccttctttgaatccttgcaggtggacaggtagacagctgtggggaaagattgagaagggatgggatgctggagtggtagaggtggagggcagagggatgggtgtcaggctcttgggagtaggtggggaaagtccaccaacctcaggtcatggtcagggtagggctgacacttaccagcccagcccagtgccttgaagagcccaagcagaagaaaggcagacaggaaaaggcctacgctgtcctcaagggagggccctgaaagacctggcaggcagaaggggtgagagtgagctcctgtcttcctgggtgctggctcagattccgcagagctcccagctcttacctgctacctccagggtgacctcagcgctgcgccccgaggcaggcaggctgggatggtgaattcgacaggcatagcgtgccccatgctgctcagtggtgactgggggcggctgcaagtgcccagagaggctgacagagccatcggaatggtggcgcagggccgagagccacctctgcccctcggccttctgagagcggccccctgggccaccccggagttcccactccacctccaggcccccagaagggtagaagtgggacacaaggcagagcaattccgggggtgcctcccctggggcggcccgtgcaagggttgctggcatcagggacactttggggggttctggggaaagaggacgaaatgagcatagggaaatcagtccatactgtcctccctaagagaccctcagtttgcctgctggcttcctcagaactaaagaaggttaggtttcttctcctgaaatagggaacccactgtctctccattggtgcgtcacagaaatacccatgtcaaagcccctcaaatttccaggaaacttctagcctcccattacccctctaactcccaggaacctctttctatctctacttacttgcccaggcaccctcttatccatcatccctccccctattacggtccccacaatccagtgcccaccctctacccctggagacctctgtcccccaactcactgtacacagcaagctccagggtgacctgtccttgcaggtatggcaggtgtatggtggccagataggtgccctcctgaaagggttgaactgtaggcagccagaaggtcccatttccggtccatgggccccatggctcatcatcatcccaagcagcaaatgccacggccccttcttgggctgctggcatctggccattcagcccaggagttgcagccaggagcagatgtcccttacccaggtgctggcgtcgccactctagcccaaagggagggggacccggagccagagatgaggcggcctcggaggtggggggcatgtaggcaaagctcaagtccagcagagcatcttgtcccagtctcactcgaggggcaggggtgtgggtgaggacagtcagtaccactgaggaagacagggagatgaggggttgggaggggcatgagggagagaaagaaggagaaaaaaatagagaaatgcagttattggggagggctaaactgcagtttacccacccctcagaggacaccttttctgatactcaccatttcctagccctccctgcaaactccttttgctctgcgactgggtggcacctagtgtggctgagggtgagcagagaggtctaggggtggtgagtaggggcaatgagggggtatggcctttgaagcctactctgaacacatagcacactctagctcgggggactgcagaatccgaggccacttctgacacaacctgaaccactctatctccaagcaccacccttgaggaaccaggcctttcttgattacaggcgaagacaatgattgagccatgactgtcagtcttgtggtgctgtacagaatatttactgactctagaaggttccagctctagcctagacctgagcacagacctctatgctctactgaagcagtacagtgcagtggctaagtgcctggagcctggctgaccgggttcaaatcccctctgcagcttatttatatggccttgggccacttcctttttccatggctcagcttcctaatctctaaaattaaaagttgatgataataatagtacctacttcatgaggttgttgtgatggttaaatcattaatacctcttgctactcaagtctattcagttcccaattttagataacagagacacctacccatgaagggtgcttacaacactgtctggaacacagtaagtctacacgtgtttgctatagttacacctaacttagcataccccaagtcaacagcatctctgcaacattccccaccctgctccaatgcccatcttccctgtctttgatgaatgatcaccaagcccgccagacactaaaagcaaacccttggagttactcagactcatttattcattcagcaactattgagcactgaagatgttcaaggtatcctggtagaagacagaatggtgaacaagacaagcagtccctgctctcaaattgcctatagtccaatgacagacaagcaaattgtcaaaaataatgtgctatgtgctatccccaccaggacctaacagatctcacatctgtttccaatttaggttctcatcaatgtacgtttagacaattacaacagccctcctgtctggtctccctattctcagtctctccttcaactccttcttcacactgtagccaaacaaagtgactacaagtctgatcccatcacctacctgtttaaaaatcccaaatatgggccagacgcagtggttcatgcctataatcccagcactttgggaggacgaggcgggtggatcacctgagttcgggagtttgaaaccagcctgaccaacatggtgaaaccccgtctctactaaaaatacaaaattagcctggtgtggtggcacatgcctgtaatcccagctactcgggagaccgaggcagtagaattgcttgaacccgggaagcagaggttgcggtgagccgagattgtgccattgcactccagcctgggcaataagagggaaaccccgtttcaaaaaaaaaaaaaaaaatcccaaatacggccaggcgtggtggctcacacctgtaatcccaacactttggtagcctgaggcgggtggattacctgaggtcaggagttcaagaccagcctggccaacatggcaaaaccctgtctctactaaaaatacaaaaattagccaggtgtgggggcaggcacctgtagtcctagctacttgggaggctgaggcagaagaatcacttgaacctgggaggtagaggttgccgtaagctgaaatcatgccactacactccagcctgggcaacagagtgagactccgtctcaaaactaaataaataaataaaataaaaatcccaaatacctaggaagtcagctgataaaggcataggctgaagctatatggcctgggttcaatttctagccctgcttcttttttttttttttttttttttttttgagatagagttttgctcgtcacctaggctagagtatagtggtgtgatcttggctcactgcaacctctgcctcccaggttcaagtgagtctcctgcctcagcctcctgagtagctgggattacaggcgtccacaaccgtgcccagctaatttttgtatttttggtagagatggggtttcaccatgttgcccaggctggtcttgaactcccgacctcaggtgatccacctgctttggtctcccaaagtgctgggattacaggcatgagccaccacgcctggcctctagctctgcttcttacacactgtgtgtccttgggcaaattatttaactggtttgtgtcctatatttatccatatgcaatacagggataatattaaaacctacaacctatggttgttgagaggaataagtgagattatgcatataaagtgcttagaacagggcctggcatatagaaaatacttgataaatgttagctgttactattttcattaccttcatcactatcatggacttgctggttaacttggaaaaatcatttaacctgtattttcctcactagtccaaagatctgacctttgcctatcttttaaaagaatcaagtaaaataacaggctttttccgggcatggtggctaacacatgtaatcccagcactttgggaggctgaggcgagtggattacctgaggtcaggagttcgagagcagcctggccaacatggtgaaaccccatctctactaaaaatacaaaaaaaaaaaaaaaaaaaattagcggggcgtggttgtgggtgcctgtgatcccatcaacttgggaggctgaggcaggagaattgcttgaacccaggaggcagaggttgcagtgagccaagatcaccccattgcactccagcatgggtgacaagagtgaaactccgtctcaaaaaataaatatgtacataataaaaacaggctttttagaataacacgccctccaaaagaacttctgatggttcgctctcacctacagaacaaagcccagctttcaaggtatttgaacattcagcccctaacccacccttccaggcttctcctgcaccctacaaaccagccacatagaacccctttcttgtgcctagtagaagtggtcatcattggtcatctctttgctttggtcatgaggtcccttcagtttacattgtctttcccattttctcccaaacatctatcaagcttgtccaacctccagcccagggaccacatgcagccaaggacggcttggaatacagcccgacacaaattcataaactttcttaaaacattatgagattttttcacattttttttttttagcttatcagccatcgttagtgttcgtatattttatgcatggcccaagacaattcttctcccagtgtggctcagggaagccaaaagattggagacccctgatctaaatactccatgtacatgaaggtcactttcactgctgtttcttcccagaaatgtctaggtccttcaggtagaagtaatctttttcttcttgtaattatttttatgttctttttaatcctagcttctgaggcctataaggttaaactgttctcatcttcatggaattgttcagtagagtaaaaacagtatgcaatttcacttagtttgtcaaaatccagaaacatacttttgaattgttaaaaaaaaaaaaaaagatccacaggctgggcacagtggctcacgcctgtaatcccagcactttgggaggccgaggccggtggatcacctgaggttgggagtttgagaccagactggagaaaccccgtctctactaaaaatacagaattatccgggcatggtggcacacgcctgtaatcacagctgcttgggaagctgaggcaggagaatcacttgaacctgggaggcggaggttgtggtgagccgagatcatgccattgccctccagactgggcaacaagagcaaaacttgatctcaaaaaaaaaaatccatagaattaataaacaaaacctggctgggcagggtggctcagacttgtaatcccagtaccttgggaggctgaggtgggaggatcacttgaacccagcagtttgagaccagcctgggcaacatagcaagaccccatctctatttaaaagaaaaaatttaaaaaaataataaacaagacctaaaggttttacagtttaactcttttttttttttttttttttttggagacagggtctcactctgtcacccatcaaaggtgcaatcctcccaacacagcctcccgagtagctgggaccataggtacatgccacgacacccaacctttttttttttttttttttttttgagacagtttcacgcttgttgcccaggctggagtgcagtggcatgatcttggctcactgcaacctccgcctcccaggttcaagcaattctcttgcctcagccttccgagtagctgggattacaggcatgcaccaccatgcctggctaattttgtatttttagtacagacggggtttctccatgttggtcaggctggtcttgaactttcgacctcaggtgatctgcccacctcggcctcccaaagtgctgggattacaggcatgagccactgcgcccagcatttttttaatttttagtagagacaaggtctggttatgttgcccaggctggtcttgaactcctgagtgcaaatgatcctcccacctagacctcccaaagtgctggaagtacaggcgtgagtcacctcacctgactccataatattttaaaagaatggtgagaattaaacactatacacacaaagtatattaagaaagtataggcctggcgtggtggctcacgcctgtaatcccagcaatttgggaggctgaggtgggtggatcacctgaggtcaggagttcaagaccagcctggctaacatgaccaaaccctgtctccactaaaaatacaaaaattagctgggcctggtggtgggcgcctgtagtctcagctacttgggaggctgagacaggagaattacttgaactcaggaggcagaagttgaaatgagcagagatcacaccattgcactccagcctgggcaacagggtgagactctgtctcaaaaaaaaaaaaaaaaaaaaaaaagtatatttggggccaggcagctcacacgtgtaatcccagcagtttcggaggccaaggtgggcagatcaattgagcccaggagtccaagaccagcctgggcaacctgacaaaaacccatctccacaaaaaaaatacaaaaattagctgggcatggtggcacatgcctgtggtctcagctactcaggagactgaggcacgaggatcacttgagccacggaggtggaggttgcagtgagctgagatcatgccactgctctccagcctgcactgcactccagcctgggcgacagagggagaccctgtctcaaataaataaataaataagcatatttgtcaataaacatttaaaaatatttgataagacaagtataaatgtatattagcaaaatcatgaatgatcttggaccctggagagatttcatttctaattttacatcagtacaacagctttcattttcttaaatccctgatcaagcagaaatgcttgaaaagaaagagcacagcaggccgggcgtggtggctcatgcctgtaatcccagcactttggaaggccaaggtgggtggatcaccttaggtcaggagttcaagaccatcctggccaacatggtgaaacctgtctccaataaaaatacaaaaattaggtgggcgtggtggcacaagcctgtaatcccagctactggggaggctaaggcacaagaattgcttgaacatgggagacggaggttgcagtgagccaagatcatgccactgcaactgcactctagcctgggcaataagagggagactccgtctcaaaaataaataaataaataaatagcaggcaggcgcagtggctcacgcttgtaatcccagcacttcgggaggcgaggtgggaggatcacctgaagttgggagttcgagaccagccttaccaacatggagaaacctcatctctactaaaaatacaaaattagctgggtgtggtggcaggcacctgtaatcccagctactcgggaggctgaggcaggagaattgcttgaaccagggaggcggaggttccggtgagcgtgagatcacgccattgcactccagcctgggcaacaagagcaaaactctgtctcaaaaataaataaataaataaaataaaaataaataaatagcacagcaccttgctttgaccccagttgtttgtgaaatacagacaatcttaccacccgggcacttccagggctccctgtctgcatgtccttcactttctactttacattaggattatccgtggcaaatacgcccagaacctcctggagagcagagtctacatcagatcatctttgtgacccttaagggcacccagggccaccccagagattctgatttaatcggccaagctaagcatgggattgaatcaggtttcagtatattttagaaacctccaacagtgtggactgagaactgctgagtcctaactcattcttggtgctaaaaagtatttattgaatcaatggataaattaacacagtgccatctcttgatagtcacaacaagaaaagcagctgggaaatagtatccacattttacagttggaaaaacaaactcagaaagcaaagaccattctcatcatcacctcggtggagccagtagccctaggaaatattccaccccaccagagagagctactgtctacacaagagcagtgttcctcagcttctgccagggtgggggcttgagactaagaatggaggtataggcagaggtgagggtttcagcgtgggtttcaagtctgtctccctggttctgtgggtaattctcaggagggtggagggaagggagggtgcagggattggttggggttgccctgtccatcgggctgtgtcgctgacataaaatccagatagaaaagctaagaactctaccggtattctaccccggaataccccgcctccgctgccaggagggagagctcccagatatccaggtcagactctcctcattcttgaattatctgcacagtccctcccacgtcccagcctagaaaagcttctgactcctgggcctcaaactgcaatgcacctttcagtgcaataggagctatccaatctccagccgcgtccatccgcccactcgagcccacctgtttgcggaccacagagcggcagcacatccctacacggggctgtcaggcaaggtcaacgcgctagagtgcaagagcctttgctttgcggattgccgcagcgccgggtgtgggcgcaggtggggatagagtgctgggttttgaaagagtgacccgcaaagctgagggtgcagagcaagacacagatctgggaagagcagagaaaaaacgctcctgcttctgaacccctcccacctcgcatcacctgacaagtctctcaaggtctggtgtcgggaaaccccacctcttcaaagccccgcccttcgaaacaccagaaagtaacccccctgcccggccctgctttccccctaccccctgccaagctgcagttttttttttgttttttttttttaactgggtgagggctagaaggagcggtagagattgattcattctagccaaaccacctctcttaacaaaaaaaggaaactgaaccccgattggcgaaatgtcttgctcaagtccataaagcgagaccaccggctgatctggacccttagaatctacccacccttctccacctcccctccccagctacctgttgccatggtgatgagaacaggctcctgctgaggctctggctgtggtcgcaagaggctggagaggctgaggactgggctggatatgctgaccatcagccaagccccatccagggcccgcgggcagttctgcgcgggggtcaggccgctggcccatttcgcagaggcggggagaggcacgaagcggctcatctcgcagtgtggtgcgggggcgccccggggataccgcctgaaggcagcctggagggcgcccgcggggtctgagtgtagagaaggaagttgcagctgtagagtcaccgccgggaaaggggctggaagggcagcgttcggggaacttcaaatgcacagactaccccgtagtgagactcactttacaaaggggaagctgaggcctgaggtcactgccggatctaaagaggagggggtttcggtggaggcgacagaggtaggggggcggcgagtccctagagactcaccgtgtacactgagatagagctcagggtcgaggtccggccggggcggcggttcccccggtccctggcgcaacagcagtgcaccgggtctcttggccaggccctttccgctcgcatcctccacgaaccaacactcgatcaccgcgggtcctgctgagacggcggtcgccaggcctggcgtatagggacgcgagtgaggagcggtttgtatgtctggtgacctgccccactcccaccctggcatcggctccagtggggccacctccctccgcttccctctagttcttgggcgatgagtcgcggggttcgctcacccaaagccacagcgaggagcagagacagggacttcatggcgctgcgacctcctcagccatgaagcctcctcttcctcctttcactttcactttcctccaaagggcggcatgaggggcggtggaaatccccgctctggttaggtgaaggtgcctgggggaccggtgtttccccactggccaggcagggacccgggtagatcctctccagttctcaccaggacaccccagccttaccgcgccctcctggactacccagcagccccgagttcgagccctccccaaccccaggccctcccccgccccccaactcctgtgtgtgctctccaacatccacttgcccgaaaaccattactccggcttccccctatctgtgccgcgtcccc

SEQ ID NO: 2077 - DNA, 10187 bp, Homo sapiens
  source 1..10187: mol_type = genomic DNA
tttccggcggttgcaccgggccggggtgccagcgcccgccttcccgtttcctcccgttccgcagcgcgcccacggcctgtgaccccggcgaccgctccccagtgacgagagagcggggccgggcgctgctccggcctgacctgcgaagggacctcggtccagtcccctgttgcgccgcgccccctgtccgtccgtgcgcgggccagtcaggggccagtgtctcgagcggtcgaggtcgcagacctagaggcgccccacaggccggcccggggcgctgggagcgccggccgcgggccgggtggggatgcctctgcacgtgaagtggccgttccccgcggtgccgccgctcacctggaccctggccagcagcgtcgtcatgggcttggtgggcacctacagctgcttctggaccagtgagtgggcccaggccgaggcaggcccgcccgggtacccatgcccggccggaggtgggacttagggtgggggacgccgcggccccgacctagcgggcgagcccggagcgcctgacctctccttccccgccagagtacatgaaccacctgaccgtgcacaacagggaggtgctgtacgagctcatcgagaagcgaggcccggccacgcccctcatcaccgtgtccaatcaccagtcctgcatggacgaccctcatctctggggtacccgggccagtgtgctgggcagggggaggaaaggcgaggattcgggacgggcccagcctcgtcagaacaaaccccttctcgctgccttttcatggagccctggcactccggtttccgggcgttctgccccagggctgagacttggatttgtggctcctgcagcatccctgagggagcatgatttggagagggccttgggcatggagcaggaccaaggaacggccacagggcatatcttacagctcctttaacgtcaggcctccagaaccctctgttctctaaaccatccagggccccacagtcttgggaaaaatttgggggttggacataggatatcctgtgaggaagttctgggccagggactggaagcccagtgtcctggcttcaggtttgcccctggctgggcgtgtaccgttcagccctatttgggagcctggttgccacacctagaggttcctgctctgctgacttcacaggaagttgcttggctctggtaaccagatggccgggtggaggggtgcctggggcttccactcctgaacagagagcttaactgtcctagagttcatggggagccacctagccacactggagcccttcagagctcaccctggctgctgggtggagaaaggcctatagatgtcacaggtggatcctgggaggccaggaaggaggacttggagccatccactagcctagactgggctggttgcagtgacagtacagggagaagtatagaagaatgggcattgtccaagtatgttggggaggtaggcagtccaggtgcagtgattagtaagatgtggagggtgggggagagggaggagccagggagaactgaatgatctggcctaagggtctgaaagatgccactttgggctgtagggaaatggtagtgctgctgtccctcattccctgagatggggtgaaggaagggcactccctggggatatgggaagttggggcatgaagcctttcctgtcctctagggatcctgaaactccgccacatctggaacctgaagttgatgcgttggtgaggaggaatgggcccctcgaagtgggccgggccggccccacctgcctctgcccagatttgccctcctcctgctctgcccaggaggtggcgtccagcagtccaggcagggcatggggtggggccccgcaggccctcccctgtgcctcccttctgcatgctgatgctgggggcagggtggtggagcggggtgcagggggcaggactaattgcatctgtccctgcttaggacccctgcagctgcagacatctgcttcaccaaggagctacactcccacttcttcagcttgggcaagtgtgtgcctgtgtgccgaggtgagctgctcctccagcgagtgcagggaggcacttctggggcaggaaagctggtggccagtgtctctgttttggagggacctatgggggtaggcatcccgggagccaacatgaggcccagctccatcacatgccagcagaggggacagaggctgtgggaggagggatgggtccttggaaagtcctcaactctctgcaactgcccagggatcctgtggacctggagccttggcattagaattcaaggaggcattatccataaccccttctctcagggatgtcactaagagactcattgagaacagtgcgttgtcattggtccatggtggcagtagcatgtacctgcaggccagagggttttgcttctaggagaacaaacaggcttgtggggtgagaaccccaggggataggggccattttgatccctattctccagacagggaggatcacagagattaagctgctggcccaaggtcatggggtaggaggtggcaaagccaggatttgaatccagattgctccttcctctgcaggagcagaatttttccaagcagagaatgaggggaaaggtgttctagacacaggcaggcacatgccaggtgctggaaaaagaagagagaaaggtaagccaggcatagcggttcacacttgtcatcccagcactttgtgaggtcgaggtgagaggatcactcaagcccaggagtttgagaccagcctgggcaacatagtaagaccctgtctctttaaaaataaaaatattttaaacaaaagaaaggtagaaaatatgagttgtatgtagaatatgaaggttctagaataatcctattaagaattttggattctggctgggcgcggtggctcacgcctgtaatcccagcactttgggaggctgaggccagcggatcacgaggtcaggagatcgagaccatcctggctaacacggtgaaaccccgtctctactaaaaatacaaaaaattagctgggcatggtagtgggcgcctgtagtcccagctactcgggaggctgaggcaggagaatggcgtgaacccggaaggtggagcttgcagtgagccaagatcacgccactgcactccagcctgggtgacagagtgagactccgtctcaaaaaaaaaaaaaaaaagtgccggccatggtggctcatgcctgtaatcccagcactctgggaggccgaggcgggcggatcacgaggtcaggaattcgagaccagcctaaccaacatggtgaaaccccgtctctactaaaaatacaaaaattagccgggcgtggtggtgtgtgcctgtaatctcagctacttgggagactgagacgggagcattgcttgaacccgggaggtggaggttgtggtgagctgagatcctgccattgcactccagcctgggcaataagagcgaaactccgtctgaaaaaaaaaaaaaaaaaaaagaattttgaattagctggctgcattggtgcatgcctacagtcccagctcctcaggaggctgaggtgggaggatcacttgagccctcgattttctttttccttgagacaatgtctgtttctgttgtccaggctggagtgccgtggcgtgatgatggctcactgcagcttctgtttcctgggttcaagggatcctgtcacctcagcctcctgagcagctgggactaaggagtgtgcccagctaattcttttttttttttggtagagttggggtcttactacattgccagggctggtcttgaactcctagactcaagcgatcctcccgcctcagcctctcaagtgctgggatcacaggcatgagccattgtgcccaacccagcccaggaatttgaggccagcctgagcaatatagtgagaccccaggtatagatagataggtagatagataggtaggtaggtaggtagatagatagatacgtaggtgggtaggtaggtgggtagataggtaggtaggtacgtaggtagatagatagatagatacatacatacatagatagataagatagatagattgattagatagattagatagccaggtggggtggctcacgcctgtaatcccagtgctttgggaggctgaggtgggtggatcacctgaggtcaggagtttgagaccagcctggctaatgtggcgaaaccctgtctactaaaaatacaaaaattagctggatgtggtggcgcacgcctgtaatctcagctactcgggaggctggggtgggagaatcgcttgaacccaggaggtggaggttgcagtgagctgagatcatgccactgcactccagcctgggccacagagggagacctggtctcaaaaaaaaaaaaaaaaaaaaaaaaaagatttttgtatttgactgtgctctctcatccaggtggtgacatgcttgtatctgtggttaagaggtagtatctgccgggcgcggtggctcatgcctgtaatcccagtactttgcgaggccgaggcgggtggttcacctgaggtcaggagtttgagaccagcctgaccaacatggcgaaaccccgtctctactaaaaatataaaaattagccgaggctgggcgcggtggctcacgcctgtaatcccagcactttgggaggccgaggcgggtggatcacgaggtcaggagatcgagaccatcctggctaacaggatgaaaccccgtctctactaaaaacacaaaattagctgggcatggtggcaggtgcctgtagtcccagctactcgggaggctgaggcaggagaatggcacaaacccgggaggcggagcttgaggcaggagaatggcgtgaacccgggaggcagagcttgctatgagcagagatcgcgccactgcactccagcctgggtgacagagcgagactccgtctcaaaaaaaaaaaaaagagagagataccattccagttgcaatgtggctgcagcagggctaggtggacatgaggagcccagttcagggctgtcacagtagctccagcagcagatgattgtggctgggcctcccaagtgtcacgttggagaaccggagaaggggacttctttgggatgtactctggacttgttgatagattaagtgtaggtggggtgaggaagagaactcaaagatgacaccaggtgttggagctgagccacggggagaagggtgcaaagggaaagcagtgcgggggctgggaggggagagggtcagtcctgttttgcttgtgctgcatctgaggagcccctcacctgtggaaggagagcagtcccagaggcagtggggtgtgcagttctggaacttagaagaatgatcagggggctgggtgcagtggctcacgcctgtaatcccagcactttgggaggccgaggcgggcggatcaagaggtcaggagattgagaccatcctggctaacatggtgaaaccccatctctactaaaaatataaaaaattagcagcgcatggtggcaggcacctgtagtcccagctattcaggaggctgaggcaggagagtggcgtgaacccgggagacggagcttgcagtgagctgagattgcgccactgcactccagcctgggcgacagagcgagactccgtctcaaaaaaaaaaaaaacaaaaaattatcaggaataaagatactgggaattcaaccacaaaaaccacaaagtcacgaatgcagagtgagagtcttcagagagagggcagaggcccaggatggcacagagggagagagaagccaccaagatggcagggagccatggccagagagaaaagcaaaccaggcgcctgtggcaccatggaagcagcaggtgatgctggagaagcgtttccatgcagtgacagctgccagagccagattattatggcctgagggctggtggtgctgcagttgggggggaatggagaccgcagcgggggaatggagaccgcaggggcggcaactcctcccagaggttcagtttggaggaaaaagagacagaaggaagggtaaccaaaggatattagaggtcaaggaggggtttattatttctagctggtcaaagtagaatgtggtaaaacccaataaagtaacagcaaataacaaagaggggcttttaatggaaagctgcagtgcctgcccctcacctccctagccccactcctcagaagcagccccctggagcggtttctctttctgctgcttttggaggctacttctgtctctgtaaaggaacttctgtctctgtaaaggaacaagcagaggccacagtgtcttggcaaatgaccgtggcattgtttatcccaacctgctctgagagatggggactctgctgattcacccctcgtccctgcctctttagttccttcagcaaagaactaataatatgtcattaaggcaaaggcagtatttggcacacttggcttctgtgttccaaaaaattccctttttctccaagcgtagattttaatatggtatttaagtatcaaagtgatttgacacaagtgacacaagtgagcagtagtagcatttgcaaaagctacaaatgatgaagtcttgctccaaaagcatattattattattttttaaattccagtttcaagctcaatggataggttgcgtcagtgggttttagtagagaaggggccagtacctatgaagactcccctgtactattacacatgctgcgtcccaagtagggaaactccagtgggtcatcaccccctccctctagcccaagtgggctgctgggtcagggcactgtttgggttgggttgagattcctggatccctaactagcaccttccaaagaatcggccttgcagagaacaaagttcattgccaaaggtattcccaatgtctgtctctcgctctgtgatagggcttctttactccccactttataagatgaggatatctgctataccccattccttcaacctctccacctctttcctcttttgtctgccatgtgattacttttccatcaccaaggttgatgagatccttactgtgtacttactgtctccaagcatccccaggcttccagccagcacgcagcagccaacattggcttcagaaggaaggaggtttgcatttccttctcttgggtccagtgccatggtctcagggttatctccaatgtggaaagttgctagaccaggagcagtttgactccactgtttttcagtctagcaagtttgagtttttcccaagctcttgatgtgtgttcaaatgaatgttctccctttcccaagagacctccctataagggagggtctagtttcccggggtgccctgagaagaaggggtcagcaggggggaggaatggtggaggctgaggcctcaggcaggtgccctgtgaggagtggctgtgacaagcggctgagatcccagcaaagggttgttgcccagaatctggggcctaagcgaggttggaaatcacaaatgcacttggtttctctagcagctggcacatagtaggatcagcccaggagtggcaccttcaaagagaaaggaacgcatgaggctccgagagcggtcggctggcagccagggcctggctggggagggagggcaggtggtgcgctgacctggggatctttgagagtgtgcaggagtatgtggctgaagcggcccagctggtgagccactgaagatgggggtcataggtagatggaggaattgccaggtcagaatctcggtaggagatgacttgagctgatgctgcctggcacataggggtttagaagatattaggaaggaagccccacagcgtgcccaagtgccatgcaggccctggagacggtcattggagggcgtctgtggatggcgcagtgggggatgggaagtccctaatctgctggggctttcccagcaagcagggactgagggggatagtccccaacacatgggccccagggagaagggcctgtttcattgaggtttggagagtgttgagggtaagctaacctgtcaccccacgcccccgagaatggttactgatagggagaggccttttccttgcaggagatggcgtctaccagaaggggatggacttcattttggagaagctcaaccatggggactgggtgcatatcttcccagaaggtcagcagggctgactgggtcgagcccccccagtatgagcgggatgggctcccaagcctcgcctctgtgctctctcaccagggaaagtgaacatgagttccgaattcctgcgtttcaagtggggtaagggctgctggtctctggccacagccatcctcccggcccagagatggccctgtgggcccctggctcccgccccctcgggctggcttgtatgggggtagatgggcgtgtttgtagcgccaggaaggggacaggtgctgagactaggcctgcctctcgcaggggcttgcccaagggagctgaattgaactggaggatgtcgggggtggcagtggccagaggctggcacagaagcttggctcagggcccagcttatgctaacatttctacctcccccctgggcaggaatcgggcgcctgattgctgagtgtcatctcaaccccatcatcctgcccctgtggcatgtcggtgagcctggggacggggacagagagatggcatctggggtggggggcctgggactccctctggtcccaggctgccctgctccaccccacgtctggccttctgtccactgtgctgcaggaatgaatgacgtccttcctaacagtccgccctacttcccccgctttggacaggtgggtggggactgctgaccttcggctgtctgcctgtctgctgtctgctccgtgtctcccactcagcactatggaggccagctgcaggaggagctgagcatgaggctacagcaggggacagagtggaacatagacagggacttcctggcaccgagacattaaaatgagagcagaggaagtcaggctggggcagaggtgggctgtggggtcaggacaggacaggtcatctacagcacaggacccaggaccaggaccttgttttagaggaagagtggcccctggggagtgtgtggcacagcagggccggggcttagcttctggctcccgggttgcttgggctggggctgtgggcactcctactgctcctcatcactcttggcggccaccccacagaaaatcactgtgctgatcgggaagcccttcagtgccctgcctgtactcgagcggctccgggcggagaacaagtcggctgtgagtttcctcctgggtcccccgtagctgtccccggaccccctgctgctggcttccagcagggtgcctccaccctctccatcccgtcaccctcccagggcaccctcccagggcaccttggccaagcttcccgaggggtgcaggccatccctggtcctttccctcaggtggagatgcggaaagccctgacggacttcattcaagaggaattccagcatctgaagactcaggcagagcagctccacaaccacctccagcctgggagataggccttgcttgctgccttctggattcttggcccgcacagagctggggctgagggatggactgatgcttttagctcaaacgtggcttttagacagatttgttcatagaccctctcaagtgccctctccgagctggtaggcattccagctcctccgtgcttcctcagttacacaaaggacctcagctgcttctcccacttggccaagcagggaggaagaagcttaggcagggctctctttccttcttgccttcagatgttctctcccaggggctggcttcaggagggagcatagaaggcaggtgagcaaccagttggctaggggagcagggggcccaccagagctgtggagaggggaccctaagactcctcggcctggctcctacccaccgcccttgccgaaccaggagctgctcactacctcctcagggatggccgttggccacgtcttccttctgcctgagcttccccccgaccacaggccctttcctcaggcaaggtctggcctcaggtgggccgcaggcgggaaaagcagcccttggccagaagtcaagcccagccacgtggagcctagagtgagggcctgaggtctggctgcttgcccccatgctggcgccaacaacttctccatcctttctgcctctcaacatcacttgaatcctagggcctgggttttcatgtttttgaaacagaaccataaagcatatgtgttggcttgttgtaa

SEQ ID NO: 2078 - DNA, 10187 bp, Homo sapiens; identical to SEQ ID NO: 2077
  source 1..10187: mol_type = genomic DNA

SEQ ID NO: 2079 - DNA, 10187 bp, Homo sapiens; identical to SEQ ID NO: 2077
  source 1..10187: mol_type = genomic DNA

SEQ ID NO: 2080 - DNA, 10187 bp, Homo sapiens; identical to SEQ ID NO: 2077
  source 1..10187: mol_type = genomic DNA

SEQ ID NO: 2081 - DNA, 10187 bp, Homo sapiens; identical to SEQ ID NO: 2077
  source 1..10187: mol_type = genomic DNA

SEQ ID NO: 2082 - DNA, 50060 bp, Homo sapiens
  source 1..50060: mol_type = genomic DNA
gcacccgcaccggcgcgccggccgtcggtcacgtggcctccggccagggcttgcgaagccggaagtgtcctgagtctcgaggaggccgcgggagcccgccggcggtggcgcggcggagacccggctgggtaagtgagacggccgcgggctgaggggccaaggcggcgcggggcgcggtcggtcaggcctgcgccgcccggcggggagcgctcccgccccctgtgggaggctgggatgctgagtcagagcgggggcgggggcgggcgcaccgagaagccccggacgacccgaggccaagccatccaggaccccggctgcgtggacactgcctctggggtgtgtgtcgggtggccgtagccggtggaatggtcgcgcgggccctgttacctgcatccccgctccgcgccgcgcggccggtcctcgacctgcatcccgtccggcggctttgggcataaagaggacgactccgttaccgggcctgggccctggctgcctggggaggcaggggcacctctttcccttagactcgctgttttctaccctctttccgagcgtcgacacaacgggcagtttttaaatgtattgatttttcagaggattaaaaagagacgtttccttagagttttagtgatgttcagtccgcagaggttgactcacaccggaaattagaagcataagatgttttaaatatatgccgatgaaatacgaattcccagacatttccttgctcctcgtctacctggcttatgggtttaatttgtaatctctatcccaagtattcttagtaggtggcctcaaaacaactcccaagtaattgccaaatgtataaccaaagactggtcttttccactctgaaaccccagtgtatgaatcacataggggcagagtttagaaatcctggaactttgtccataggccatgtcgtcaaacctgttttcatccctcaacaaatagtaactttcgttttggacggtgtaaggaagtaggctgaagacggcatcatcagcaacatagttgttgagtgtctgcttatatgcttgtcaaaaatttgggaagatttatatggcaagcacgttgtgggtgtgctgagtcatgttttaacatgttattgtggagttattggaagataatttcaaaagacatttcccctgaccactattgtgattactgttaaatagaaaccatagttttgtatttgcatagagaacagatatcttagctgataaatatttttcttattatcctgaaggtacatacatataggtacctaatggtactatttgccatttacagttacattgattagggaaggtttttcgttagatagttgagacgtttgttattgtatcgtgagtgaaatgtaatgactggcaaatgtgtattccttatttgtgaaaagggaatcttatttttattgcttatttcctatagtcgtatataaagtttatctaaattagatgggtagtaaaattatataaaaatatcctactatatcagtgattggtaaaattgagacccctgaccattctgcattttcctaacccagcttggggatattggtggtcattaattcatcacagaatacctagtctagcatactactttttgctttaacttactgtggagggatattaaaatccatgttttaatgacaatacagcaggtttaagggggcatggtgggactagtgtttatgttatgttagcatacatcaattttagtccagtgtggagcttggatactttgtataccttgatagatccatagcttttcagtattaaagacttgataatacaggctacttggtacgtttatatatttatacttggaggttggagaaactatccttaaattaattccagaagagttcgtaacttttcaggaataataatttttgcacctttcctttatgtttgtcaggttctgtgtagattgtgtagataaaattttagcttatgggaatattatgcagtgacaacatttgtcttcattagtgtttctctgctctgaaggaaacaaagtaatttttcctatatttgttatattttacattattacttttctttattttaaaacaccttaaattatgtcataaattaatctttcaaaacatttgaaggaggtaagtaacaatatcactctcatcaacaaagacaaaattagaagagaaataggtgttgtttttgtttgtttttgtttctttttgagatggagtctcgctctgtcaccctggctggagtgcagtggtgcgatctcagctcactgcaacctctgcctcctggtttcaagcaattcttctgcctcagcctcccgagtagctgggattacaggcatgcgccaccacgcctggctaatttttttgtatttttagtagaggcggggtttctccatattggccaggctggtctcgaactcctgaccttgtgatccgcccgcctcggcctcccagagtgctgggattacaggcatgggccactgcacccggctgagaaatagatgtttctttcagccctgtgttaagtgaattaaattgaatgtatgtcattggttaatgttttttttttcaaagctcatacagcattttagccttgaatattgctagaaactcagatcttttttttttttttttttttttgagacggagtctcgctgtgtcacccagcctggagtgcagtggcgcgatctcggctcactgcaagctccgcctcccgggttcccgccattctcctgcgtcagcctcccgagtagctgggtctacaggcgcccgccaccatgcccggctaatttttttgtatttttagtagagacggggtttcaccatgttatccaggatggtctcaatctcctgacctcgtgatccgcccgcctcggcctcccaaagtgctgggattacaggcgtgagccaccgcgcccggccaattttttttttttcttttttttttttttgcgatggagtcttgctctgtcacccaggctggaatagggtggcacgatttcagctcactgcagcctctgcttccgggttgaagttattctcctgttgcagcctcccgagtagctgggatacaggcacctgccaccatacctggctaatttttgtattttttgtggagacggggttttgccgtgttagccaaggtggtctcaaactcctggcttcaggtgatctgcctgcctcggcctccaaaagtgctgagattacaggcatgagccactgctcccagctgaaacttagattttttttgtcatattattgtattttattatagtatgtatagtgtatactaacttacagggaaaaaatgtaaacaaaatgaaggtcatggggaaaatggcatcttgctttaatcttcaacttaaagttactcttaataatccatttataccattatgtcaaattttagtcatccctgcagaattttagacgaatgaaaacagacaaggtaacaccaaagagttaagcacagaaagtgatattgattaaaaagttgaaagtaaaaatctacattggctagaactgaacattcagatccgtctctccagaggaaaatctaacttgaatcataatggttcatattttgacttgttcataccatatcagttagcaacttatgacttgaaaatactttgaaacttaagatatttatattgaactgtttatacacttcatgtcagtaacagataatgggtgatcttacttgagactaaaaacagctaacatttgtttcttagctgtgttactcccttaaaacatagttgcaaattttttttttctcttagtataacaagaggattgcctgatccagccaagatgcagagcacttctaatcatctgtggcttttatctgatattttaggccaaggagctactgcaaatgtctttcgtggaagacataaggttagtacagagaaaactttgaagaccttttatcactgtatgtattttgttctaagatgcatgttgacactaaagtgtgtgacttggtgattttgatccctttgtctgaagaaattgttttaatgattttcgtggtcatttaaggcatagctgtgtcaggcagtgaacatatctacccagtggtggcacaggttaagtgttagtgagtggaggaaaacagattggttgaaaatggactgggaaagattagtgttgtgccttttgatgctttccccagcccagctccctaatggtagagtgatttcactgacagaagttcagtgtaatgagttgaggtagcatttgatgtggcattttggttggtagggaggcagatgtgtattgggaggggaactcacaggtgtttctgataggctctggtaagggtaagtgcccctactaaaacagcatcctacaaagtagattggagtaaaatgagattctcaacaaggagcccaggttgaaaagaccatattttggtataaggtaatcagaacctggtagtggaagtgggaataaaataaaaagattattcccagaggcacttcaagaaccaaaaaggggccgggcgcggtggctcacgcctgtaatcccagcactttgggaggccgaggcaggcggatcacgaggtcaggagatcgagaccatcctggctaacacggtgaaaccccgtctctactaaaaatacaaaaaaaattagccaggcgtggtggcgggcgcctgtagtcccagctactcgggaggctgaggcaggagaatggtgtgaacccaggaggcggaggctgcagtgagccaagatagcaccactgcactccagcctgggtgacagagcaagactcaattaaaaaaaaaaaaaaaaggattttgtttagattcaatgtggaggatgaaatttaaaatagttaaaataatttaaaattaagaaattgaagataattaaactttctattctgggaaaaagctggagaaatggagtctgagaaagaagctggaaaaatggagtacaaagttcatttataatacaaataataactaatttttcagtgctatgaatttgtttcgagctaaatgatgtttggagcttcctaaatccttattttcagaaacagggccctaaacgttttagtagagaggaattgcttcctcttttcctgtattcttgagactaccagtcagttctgtcagtgacgatgagataagcgtacatgggggaggggctgtttcctctggggagagaatattgactataaacaccctttatggctcatagagaatgaatcagaagtaccatacagacaacttttagctttcctccccctgtatctagaattatccacaagctctggattcttattcagattacttgcgatcaatcctgggtactccgtcctagaaattgcttttgttttatgccaaggagaaaatgactagtgcctcagaatttagcattgagaacacgtctgatcatcttatcttcctgtagtccaaattaacaaacttttaataatcacttggtatgtgtcaggcactatggcagacctagtgaatattactatagctaatgtgcggttagctatactgcacattaactggacacagtttcgagtttagtagcaagattgattagaaaggaagtaaagtggaagctgatgggatgagagatagtcaatagtgatagagactggatgagacatattgaaagggcctggcactagaagatacgtcacatatcctgctcctctttccttacttagatactcagtgttcttcatgtaagtgactacacatagtatgcactctgtaaatgtttgctgaatgaaagaataagtgaatgaatgaggactgattagactaccccaagacaacctaaagttctccaaaggaaacaaatatgtactttacccattatagtgtggaaatctaaaatgagaatttcagaagtataagaattaattaaaagattgtgaagtcgagcatggtggctcacgcctgtaatcccagcactttcggaggccaaggcaggtaggttgcttgtgcccaggagttttgagaccagcctgggcaacatggcaaaaccctgtctctactaaacacacacacacacacacacacacacacacacacatacacacacgaaaaagattgccaaggcccagtctagtatttagtccccaacagttttcctagggatgtgctttgagaaaccatatttgttcttaatgatggcagttgcaactgtttaggactatatcctacaaaaaatcctgcttccctttaactatttaaaggatttttaccatgatattagcccttttatattatttcttagaatgaccaaattcttacatttattacttgttattcaaagtatattacctacttaatctgttttttattaaattgcttttagttactaaagtatgagtgtgggtgtgtgtatatgtgtgtgattaccatggtgaagtttaagggaagagacttgaaggatgtgttgatctgcacatatggatatatacatatatatatatatatatatggatctctattatttgtatacactttgacttagtgaataatagatgactgtgtaggtgaataaagggaaaatagtacgtttccacctggatcccgataatctcacaggcatgatgtagtctacacaagtttggaaaataatgaccatgaggtcagtgggtatattgcaaaattgtattattttccctgcttgctcctctgttaggattctcctagttttagactgagtttgaggcctgtctcagcttaagaaaaatcactctgttgggtgatgcatagatttggcagtgtcttaacccttgctgaactgagggaaaaacagtgaaactgaactgtacttaaattcttctcttttcatatgtgtgaaaatggtcattggctctttgatctttcatcttcctctagaaagaatatatatcaatttgtgtattttgcatgaccagggtgaggggaatcacataggattatgaagcagttaaatggccttaagaaaaggatcatgcgattctggagtgagagaggagggtgatggctctaagtggtgaatctgaggaaagtataaagagggctccaaagcaggaacagtacagaggtcctgacagagagccatgaaatgtctttagccatgaaatgtgcttgaaccccaagctcaaagagaaaaggattttcctgcttgctctagggaagttcaaccttggataaatgggggaaaatgtaaggctaaactcaagatctggactggccacgagggagaggcttgctcattagagtgattggaaggaagtgagagggtctgaaagacaatcttaaaggaaggttaataagaagaacatataaatatgatgtttgcctgaaatgtaagcatgtgttttgaacctctaagattccctcccaactacagctgtgctttgtaattttgtgtgtgatgtaggtcatgaaagagtgagagtgggatgctgtggtacatcagtagagaagaagaaataaatgcctttactcctctagagagggtctgtgaaggaacagcctgccctggtcatctaggtagaattgcagaaagtaacccagggcagcaggggcagaaaccaaccaggaagtctactttagcctcgctctgcaactcctgctttccccactcccctcccccacgttgtcctagctacaaaataattctgaaaagttaactgtattactttgatattcttaataaaaatctcataggtggaatatagtgttcagtctctctctcctgctttgattagtttaaaattattaggccttggagaagcccttatgagtttcactttctatttcgtctttaaaagatgattttgcttttgatactattatggcttttatcttctgatgtgtgactatttttgcccctactgtatcctcatgaaaggtttatttataatatgaaagaaaatatccatttctgaattccaaaaggtgtaatttgaaagaaatgttgagcagttaattgattcattttaactttttagaaaagtcaaaagtcctcatacagattccctgtgcctaaaagatgcatgatgttctgtaagaaaataagttgcaatagcgagttctaatgctaccttttaatctcttttacaatattatgaataaataaaacatttctctctcttttttaaagaaaactggtgatttatttgctatcaaagtatttaataacataagcttccttcgtccagtggatgttcaaatgagagaatttgaagtgttgaaaaaactcaatcacaaaaatattgtcaaattatttgctattgaagaggaggtaagtagtaaaacttcaatcttatatttattgtagttacgagtcaagaaatagaacctaatattaaaaaatggattttttaaaaaactgttgaaaattagggtttgtacaaccaaatactttatcctaaaggattcttgaatatatagaacaatagaaataaaatatcataaaaatggaatcagaaacagtagtgtaagaaataaaagggggcggccggctgcggctgggtgcagtggctcacacctataatcccagcactttgggagaccgaggcaggtagatcatgcggtcaagagattgagaccagcctggccaatgtggtgaaaccccgtctctactaaaaatacaaaaattagcttggcatggtggtgcgcacctgtagttccagctacttgggaggctgagacaggagaattgcttgaacccaggaggcagaggtcacagtgagctgagatcgcaccactgcactccagcctggcaacagagggagactccatctcaaaaaaaaaaaaaaaaaaagaaaggatcatttgagctcaggaattcaagaacagcctgggcaacatggcaaaaccctgtctctgtaaaaaatacaaaaatttgccatgcatggaggtgtacgcctgtagttccagctactcaggaggctgaagtgggaggatcacctgagcctgagaggtcaaggctatggtgaaccatattgtgccactgtactctagcatgggtgatggagtgagaccctgtctcaaaaaaaaaaagaaagaaggaaataaaagggtattgaatatggttaccagtattattactagaaaaagaaaggtaacaagttaaatctaataattataaagagaaaaaataattataaaaagaaaaaatcgaactttaaaaaaataaaaattttgtatttcatgaataaaaatttcaagagtcctacagtttaagatatgaagtccaattataaaagaattgatttttttaaggggaaatagtggaattaagaatgtcattaggaaaagtaatctagaaataatggaaatagaaattattttaatccctttaaacatgagcaatcaataaaatctttgggaaaaaatgtagtttatactctttatccgagtgattttatttttagtgattatttcttaggaagtaatcagaaatataattttatgcatgaagatgttaattggcatcctgtttataataaagaatggttaaataagttgaataaattagaatgtgtggcagatagttacctggaattagccaaactcaagattaagagcatagccttccacactgccaagtctgctcaagacttttgataccaattgcaaaggagtttggcaaactgcacagagagaacagttcccacaagattaccctcacatcatcccagccggctacaaatgtgggggttgcccatgacactcaggtttggtaatttgctggaatgtagaaatgactcacaaaactgaggagagtgctatacttataattacagttttattgtagcaaaaagatagaaattagaaccagccagaggaagagacacaaagcgtggaatgtgggagggttccaatcttgaagcttctttgtcctgagggacacattactctctcagcattgatgtatgacagtatgcatgaagtattgccagtcagggaagctcacccaagcctttggtgtccagggtttttactgaggctggatcatttattgcctgtattgctgacctttagtccccagctccttccagaagtttggggtaattcctttagtctccattaagcccccatcctaaatcatgctgtgagactctccagtggccaaagcccccagaggaacaaagacagaagtcttgttctttcagataggacattttaggggccagagatcactgtccagtagccaagggcaaagcctgacttctctttgggtaaagttaattttttaccacacaatagttaagtggtaatgaaaagagatatttaccaaaattttaatcttcttggaacaccttatatatgatgttatgtgagaagaatcaggattaaaaatatatatgtagtatgatcttaacatatacagtgtaatatgcaaacagcattatgtatctatgacattatttcatccatagaaaaaagactgaaagaaaatacgccaaaatattaattcattatctccaggtaatggaattatgtatacttcccaaattttcaacaatcaacatacattatcatttaaaagcaacagttttttttttctactatgattatttctctctcttttttgaaatgactgccagagagtaatttaaaatattttataaaagtgttttggagatatgtagaaaaaaattagaaaagaaacaaaggataaaaagttggagatgaatagtagattttaagactcattcagattttcagattctgaaattgtcatgcatcttataatcattgtgtatatataatttgatggtatttctttttccccgtaatgctgttattaaattgatgaagcattataatcaatggtacattaaaattaaggtttaaaacaaatcagcatctcagatgcaaatgagcagactggagctttgctgcaagagggaccactcagctgttctgctacccatttatttttaaggataggactccattccttgaagtaacagtagtcatcataagaaaaatttcattttaagaggttagaagagctgttgtcctaaatgtactgttatacataagaaattcagcactggtgtggtgactcacgcctgtaatcccagcactttgggaggccgaggtgggcggatcacgaggtcaggagatcgagaccatcctggctaacatggtgaaaccccgtctctactaaaaatacaaaaaaattagccgggtgtggtggcactcgtctgtagtcccatctattcaggaggctgaggcaggagaatggagagtggcgtgaaccctgggaggcagagcttccagtgagccgagatcgcgccactgcgctccagcctgggtgacaaagcgagactttgtctcaaaaaaaaaaaaaagaaggaaagaaagaaattcaagtgactgggtgtggtagctcatgcttgcaatcccagcactttgggaggttgaggcaggcagattgcttgagcccagaaattcgagactagcctgggcaacatagtgagaccccgtctctacaaaataatagaaaaattagccaggcatggtggagcatgcccgtaatcccagctacttgggagctgaggcaggagaatcacttgaaccttggaggtggaggttgcagtgagccaagatcgtaccattgcactccagtctgggtgacagagcaagactctgtctcaaaaaaaaaaaaaaagaaaggaatttaagatgattttaacaaaaccattgtaacattgtaccaatgattttgtagttcagatttagctactttttactgtggtttgtcttcaaaaacaaatccaacttcttcacctaataggaatttggaaaatgttagttttttttttttgttttttttttttgagatggagtctcgctctgtcaccaggctggactgcagtagtgcaatctcggctcactgcaacttccgcctcccaggttcaagtgattctcctgcctcagtctcctgagtagctgggactagaggcatgtgccaccacactcagctaatttttgtatttttagtagagaccgggtttcagcatgttggccaggatagtctcaatctcttgacctcgtgatccgcccacctcagcctcccaaagtgctgggattacaggcgtgagccaccacacccggccggaagatattaattcttatatgtgtatgttcaacagatactgaatctcaggtgaagcaaagtgccttcatcattgtagcaaatcctacatttaaatgaaatcagataagtactggcatataatcaaaatttattttttatgttgattcccaatcaatgattttttttttcagacaacaacaagacataaagtacttattatggaattttgtccatgtgggagtttatacactgttttagaagaaccttctaatgcctatggactaccagaatctgaattcttaattgttttgcgagatgtgggtatgtttgtttatttatatgatatcatttgtatataaaatttaataacagaatttttaaaaaatatcttccattcaaaactgaagacctttatgcaatgcttcattagatatgacaccaaaagcacaaataccagaaatacataaattggatttcatcagcattaaacatttttgggcctcagaggacatcaggtaagtgaaaagacagcccatagaatgagaaaaaaatgtttgtaaatcatacacctgacaagggatttttatccagacaactcaacaataaaaagccaaataacccaatttaaaaatgggcaaaggattcgcatagacatttctccaaagaagatacacaagtggctaacaagtacataaaaaaaagctcaacattaattaattaataaccgacatcattggttattagggaaatgctcatcaaaaccacaatgaaataccactttataccaatgaaaatgactaatatcaaaaagacaaacagggccaaccatggtggctcacgcctgtaatcccagcactttaggaagtggaggccggcagattgcttgagtccaggagttcaagatcagcctgagcaacacagtgagcccctgtctctacaaaaaataaaataaaaaatagccaagcatggtggcatgcacttgtagacagctactcaggaggctgtggtgggaggatcacttgagcccaggagattgaggctgctgtgagccttgattgtgccactgcacttcagcctgggcaacaaagcaagactatctcaaaaaaaaaaaaaaaaaaaaaacaagtgttggcaagaatatggagaattggaaccctgatacattgctggtaggattataaaatgatacagccattctagaaaacagtctagagttcctcaaaaagttaaatatagaattatttaacttttgaccaaatgacccagcagttccactgctacgtatataccccaaagaattaacatatccatataaaaacttgtactccagtgtacttagcagcattattcataatagcaaaaaaaaaaaaagatgaaaacagcccaaatgtccatcaactgatgaacagataaacaaaaatgtggtgtgtctatacaatggaatattgtttgtttacaaaaagatatgaagtagttatatatgctacaacatggatgaacttgaaaacattatgctaagtgaaagaagccagacacaaaggctgcaatattatatgattccatttatatgaaatgtcaagaataggcaaatccatagagacagaaaacagattagtggtttctgggggatcaggagaagatggagttgggtatgagttgtctttttggtgtgacaaaagtattctgaaatcagtggtgatggttgtataactctgtgaccatactaaaaatgactgaattgtacactttaaaaagatgaatgttatgtttgaattatatctcagtgaacctattttttaaaaaaaatactgcaatcaaaggaaataacatcttaagagaaatgaatcaaatatttgaggaatgggaaaaagtcaagtgataaggtaaaaggttggtgggaattcttgaacttgtcactggaagcagagtgattatttaggtgaggatacaatgagagagaaacaatattactagtatgctacagcctgtttaatcaaatagaaattatagatatgatgtcttcctaagtgtattggtagtcctgagttttaataattatacattgatacccctaaaccttttacatattttgaatttgaacattcatctatcagccctcaagcaaatgtataaagttatcactcagtgacactgtcagttagacaaaatagcttaatttcagcaaagtagacaactttgcccttaagaaaaaagaagaaaaaatgggctttttggaatagtgccaagcatatgagaatacatttttacagaaacaagtttgacactttgctgtttttctgtttcttttttgctgttttacatattgagttcagtttacttttagggaattttttttcccaagataaagaaatgtaaaactctggtgaaagattgatatcttttttgggaatctttattatttttatgtttaaacagatcacccacatatatataaccaaagtaattcaagaaatcatatgcttaagactgttttgttacattttcctggtagtacttaagagacactggatttttccttagaccacattaatttttatcattctaaaacttcttataactaaaacataacatcttttatatatatatatttattatctattctttgagtaaaattactttgaaccaaattatggaaaaatttatattaagtttgggtgactatatcaatgaatttgagacatgcacacatacacgtaaatatctacattatgacttcttttgttttatattgttgaagtgggtggaatgaatcatctacgagagaatggtatagtgcaccgtgatatcaagccaggaaatatcatgcgtgttataggggaagatggacagtctgtgtacaaactcacagattttggtgcagctagagaattagaagatgatgagcagtttgtttctctgtatggcacagaagaatatttggtaagtcatgtatcactaatattttcatttaaagaagcttgatatattgtaattataattgggtaattggtcagccaattcactataaaatgtcatttttatgacaaaaattaaattttctattctaatgaatatgtgcaacatgggaattaggtactcgcttccaagggtgctgttatttttctattaaaaattcttggaagttttgtagcacccttaaattctttagttttactgatgctatggatctaaattaaaagggtctgttttttgatgagcagtcagcatattacaagcttgttataatactgttttttatatattcattatatttatgaaacagataattctatttgggggagttggttattgaatgacgaaaaggaccattgttagaaacacacacacacaaaatgcccctgagaagatctaacttgaaattttagaaagctagaaaagctctgtagttgaaaaagtttatgtaggtgtgtttttgtaaagtcagtaaatatttgaaatacttaagaaaatatacttaaaagtaaatacttttaacatgtaatcaggaagtttaatatatatagctcactgattattcatggctttgggttttgtcttaaaagtcatagaatcaatgacttttttgcatttggattgtgctgttgtaattttataagatgaaagatatctaccacaccctgtagctttattcagattattctaagtctggcatgaactaaatgtcttaaattgttatcctaacaattggtaacctcaaattgatctgtagatatatgtgatgatcttttagataagagtacctaagaatgggtcagacacagtggctcatgcctataattccaacactttgggaggctgaggattgcttgagcccaggagttcaagaccagtctgggcacaatgacaagaccccatctctgcaaaaaattacaaaattagccaggcatggtggcgcacatctgtacacccagctactcaggaggctgaggcagaaggatcccttgagcccaggaatttgaggcaacagtaagctatgattgcaccactgcaatctggcctgggctataaagcaagactctgtctcttaattttttaaaaaaaggtacctggcccaggcatggtggctcatgcctgtaatcccagcactttgggaggccgaggtgggcagatcacaagttcaggagtttgagaccagcctgagcaacatggtgaaaccccatctctactaaaaatacaaaaattagctgggtgtggtggcgtgtgcctgtaatctcagctactttgggaggttgaggcagaattgtctgaacctgggaggtggaggtttcagtgagccgagatcgtgccactgcactccagcctgggtgacagagcgagactccgtctcagaaaaaaaaaaaaaaagtacctaaaaatggattttattcattcattgcacaaatatttatgaagtgcctactatataccagatactgttctaggtgctcagacttctatggtgaactacatacacagtattcctgctcttatggagcccacgttctggtagggaaaaaagacaattaacaagtaagtaaagtaaattcagatcattaaagtttagcaaagacaataaattaaggtaataagataaagagtgactagcaggagaaacatagcctgggaaagcctcctttgaggactaaatgaactgacactgaaatgataaaaagaagcaagccaggcacagcgttctgactgctgttctgtgccgttccctggccctgtgaaagctacctccccctgcagaaaagaaactcaaccaccagtcctcatactcctcggcagttccctccatctctgcttgctgagaacctactgcatcagtctagcctactgcatcagtctgaaccctactgcatcagtctagcctcctctcccctacaacctgtgttgttgagggcccaggatgcctatggggtcctctggctgtctgagttgtgacgtatgagctgctttgtgatacagtgaactccctgtcattgtggatctggagaatgtgtcatagaacctagatagcagagggaagtacagttgtaatgaattcaccttcaagcttcctgagactcttggctggaacagaggcaggactcagacgtttctggcgagtggaatcaggcttcatatcctgaattctccacgtgaatgtaagctccacaaaaccagggactttcatcttagcctaccgagaacaccaagcagaattagacaagaagaaatcacccccttcctgctcctttctccgtcctacatgacatttgtgcttttgctattatccttttgtctcttcctgggcctcaacatgtgactgagtcaacacacatcttcattctcatttctctgttggtggtcttctcagttatatttggctagaccatgctttctgcttctagaagcaacactgctgaattcacaccagagctttggtacaaggcaacttcctgattccttcactttccccagttcagacattccccttgtcttttctcttagagcagtgagcctccaataaatagctcaaggccatgttcttccagactgcctcctttccagtagcaagctcaagcgcgtgtccttcaaattcaatgattagataagataacttgttcaaaaattcaatttctctctttctctttctctcacccagtactttttttttttccccaaccccactttctgtaagaacagcctatttctaaaagctagttcaccaggcccagctccttgtctctggagcccacacctgtcatagccaaagccacagtagatgaatgctcaggacactactgttcccaggagggcactgcttgccaaggtttactgctctaagaatgttcttgggcttcagtctggttccatcaggcccagagaaaacagcagctgtaaaggcctggagacaagaatgacctcaggagttggagaaacagaaaagatggcagttttactggaatttagtgagtaaagaggcaagtggaaggacttagaattaaagaagtgatcagggggctagccagatcagacaggctagtagtttaaaccctgtcagaccaatacccccttgttataataaatattttgtagtgttcccttcagtatcttgaaatgaaattcctagataatattataaacctgcacacctaattaaaatagcatatcttaataatgtaaaggaacatattttataataaaataatagatatttaatatgtaaaaatttagaaacagcttcatgagcaaacaagtagtgatatatgcttgcagctatatgtaatactactttgaatacaagtgcagtgataactcatgttgtattagtgaatcacatcacaaatggtagtattgttattgacatgattttccaaagtagtgaacaatttttggtaaagtttctaactaaaagtaaatttaaatatagttacattcttggaaaagctgtacaaaaatactttgttatatataaaatggagttcgaaatagatttctcacttgcacaagtatctggcagaatattccaaagtcattcaggctatatataggaggatcatttttcagaactgtcacatacactgcagtatgtccttcagtgtctggtctccgccttttccaatcatgataatcactgtaacaagcaaacagcagtcctgtaccagccttcatgaggttgctcccccaataccaactattaatctttcatgtaacctcctgggaacacagtttagcttttgcctctaagacttttaacaggaagagcaaaacattaaataaattaattccaagtctgtgctgtactctaggctgaaatttaaccccattctatttatttcctatttcagaatgggaaatattcaaatacagtgcaccagaatgagataaataatagtctaaggctcagcagcctagctatattctacatttaactggaaacttccctcgttttgaagctcccaggaactacaacccatatgttaaattctctctcttttgtatgttaaagtccaaagaaaacattcttctactgttttttgtttttgttgttgttgttattgtgacagagtctcaatctgttgcccaggctggagtgcagtggcataatctcagctcactcaagctccacctcccaggttcaggtgattcttatgtgccagcctcctagatagctggggttacaggtgcacaccaccacacctggctaatatttttgtgtctatatatatatatgtatacttttgagacagagtctcactctgttgcccaggctggagtgtagtggtgccatcctagctcactgcaacctccacctcctggattcaagcaattctcctgcctcagcttcccaagtagctgggattacaggtgtgtgccactacacccagctaatttttgtatttttagtagagatgaggtttcaccatgttggccaggctagtctcaaactcctgacctcaagcgatccacccaccttggcctcccaaagtgctgggattacaggatgtgagccaccacaccctgtctcttctactgtttttaatatgatggatatcatctcagtaatataatcctgaaaaccttggagtagctttatccttatgctcttcttccagatgcaatagcccaggcccagtaacaccaagccagtaacacatcaggacagagccagtgggcacaaatgtatcagaccagcatgtgtcaagccaccccaagttaatcactcccagggaatagcttccagctgtaccaattaggcagtatattattgcaccgtgtgaggaggtccgtctttgtctccttctggaatcactgtgtcccctcttcccaggaggctttatattccagaaggcatcagacatatccaggtacttttggcctcttcatgacaccatttacacactaagtaccagctgctaggtcaaaggtttggcaatcacttctttggacaataatcactttatgtgctgtgctacagaaccagcaaagccactgagatcccatatatctagtaggcatatgtttggacactcacgtcaatacccagttcttatacttgtctgcattctgatttctcattaaaatgtgtttctcaaaagagtctttttcccacccccatctccagcacccccccaccaccccgaccctcagaaatcagagattgtgatcctttgggagtgagagtcacagattgcatcatttagaagcccctcccagcagcatttcctacactggttcccagttccctgggccatagctaaatcctacaatgtcataaggaattgttttggtttgggatcatttaggtggtaactctactttggtccatacgtacacttttcaagatttatcttccaaaaatcttcaagttgcaagtgtataactttcatgaaggcagatggcaggaggccatgctgtgtgtgaccactggttattctctgcagaacaaaatgtccatcagaatatctgttaggttttgtgagctcctaaacaatttcttagaagctccatctgttctcagtgactatggtattagtgcagagtgtccaatcttttggcttccctgggctacactggaagaattgtcttgggccacatataaaatatgatagattatcttgggccacacataaaataatgatagctgatgagctattttaaaaaaatcacaaaaaacctcaatgttttaagaaagtttatgaatttgtgttgggccacattcaaagctgtcctgggctacatgtggcccacaggctgcaggttggacaagcttggtgtaatatgtcctatgtgtaaggacgtgtgtttaatgtcagtagatccccagtgaacccagtcaagttagtcctctgaattgattctagagaatttaatttcattaaattaaatgcacttaccctgacagattgcatttgagggataaggcaaagaaattaaggctgcctgataggtttcgggtgtgagcagctagatatgtggtggtattgtttacttaaagtttaggaggaaacaagtttaagtgggaagaccaagagtcaattttggatacgttaagtttgagctgccttttagatatcgagagaatagtaggatatatgaatctgaagctcagggcccaaggtagttttggaagttaaagcatacatatgatatttaatacattaggtctgaatgggagatgagggagtaaggcagttataataagcatggacagctgtactgagaagttttgctgtggtgggaagcagagaattgggtaattgttgaaaggagttttgtggtcaatttagagatcttttaaaatgggagatattaaagcatgtttgtaagcagaaagtaatgaatcagaacagagggaaacattgctgcattaaataagtgggataattacaagaattgatttctggaattggcaagatgatatgataggctctacagcacagatggaaaagttggccatgtataggtgcagttccattgtgactggaaagtaggcctggaaaatggacacagattggccaggtgcagtggctcatgcctgtaatcccagtactttgaaaggccaaggctcttaaggtcctcaaggatcacttgagatcaggagttcaagaccagcctggccaacatggtgaaaccctgtctctactaaaaatacaaaaattagctaggcatcatggcaagcacttgtagtcccagctactcaggaggctgatgcaggagaatcactcgaacccgggaagcagaggttgcagtgagccgagatcaagccactgcactccaccccatctcaaaaaaaagagaaaaaaataaaacggacacagattcaggtaggttgtatttggtaaagggcataagggagtgctggtctgattccttccatttccacattaaattatgaagcagggtcatcaaaactgaggatcaaaggaggtggtggaggtttgaggagggaggggaagatgtgaaatagtcttttcagattgggaaagtgaagttattaggaaaacaaaatagaatttctaagcattattgagtatccatttgtttgtataatgaaatgggtcacaggttcatgatttttttcttttttttttaatcttagcaccctgatatgtatgagagagcagtgctaagaaaagatcatcagaagaaatatggagcaacagttgatctttggagcattggggtaacattttaccatgcagctactggatcactgccatttagaccctttgaagggcctcgtaggaataaagaagtgatgtaagtggtttcccgatctaaaatcagagaagcatttaaaaaatgatttctgtcttggttcatcttattgttagtggtttatgctaataaaaattgatttaacaatcatttctgatattttaagctacctggtttttaaaaagaatgcagccttataaaagtttgcataattttatgtttaagatatttatgtttaaatatcttatatacacagtataaatggtattcagtctttggcccatcattaaaaatgtactgctttctagactttatttcagcacactgtttatttcactctgcatacttgtcagcactttcctcccatacaactgaaaaaaaatacatagttctgtggagtattagaatcattaccagatctaaaacaaacatcagtcttaccctaaagtgaactgattccttttaccatttaaaaaataacattttgggccaggcgtggtggctcacgcctgtaatcccagcactttgggaggctgagggaggaggatagcttgagcctaggagttccaagactagcctgagcaacagtgagaccctgtctctataaaaaaatacaaacattagccaggggtggtggtatgctcccatagtcccagctactcaggaggctgaggtggtaggatcacctgatcccaggagattgaggctgctgtgaactgtgattgcgccacggcactccagcctgggcgacagagtgagaccctgtctctaaataaataaatgaaagaaaattaaaaataacattttggcagtaatgtaacattaaacttttttttccagtgttgcagatttggaccagacacttgatatattttactagtataatgtatacacatttatgtattgtcacaatttttttttaatttccatttttattttagattcagagggtatgtgtgaaggtttagttaaaagggtatgttgtgtagtgctgaggtttggacttttgttgatcctatcacccagatagtgaacgtggtaccgaataagaagtgttcagcccttgtctccttccctccctacttttggagtcctcagtgtctgttgtttccatctttgtgtccatctttgatgcattaaataagtgggataattacaagaattgatttctgggattggcgagacaatatgatgggctccacagcacagatggaaaagttgtgaacgcaagatttagctctcatttataagtgagaacataacagtatttggttttttgtttctgcattagttcacttaggataaaggtctccagctgcatccatgttgctgcaaaggatatgatttcattcttttttatggctgcatagtattctacagtgtatgtgtaccacatttttgttatccagtctgccattgatgggaacctagattgattctatgtgtttgctatcgtgaatactgctgggataaacatacaagcgcatgtctttttaggtaggatgatttatttttctttggttatatacccagcaatgggattgctgggtcaaatgatagttctatttttagttatttgagaactccaagctgcttttcgtaggggctgaactaatttgcattcccaccaatagtgtataattattcccttttctccacaacctcaccagcatctgttacttttttttatttttttatagccattctgactggcgtgagatggtatctcattgcagttttgatttgcatctctttgatgattagtggttttttcatgtttgttggcagcttgcgtagtcttctttttttttttttttttttttttttgagatggagtctcgctctgttgcccaggctggagtgcagtggtgcgatctcagctcactgcaagctccgcctccctggttcacgctattctcctgcctcagcctcccgagtagctgagactacaggcacgtgccaccacacccggctaattttttgtattttttagtagagacggggtttcaccatgttagccaggatggtctcgatctcctgacctcgtgatccacccgcctcggcctcccagagtgctaggatcacaagtgtgagccaccacacccggcgcatagtcttcttttgaggagagtgtattcatgtcctttgctcactttttaatgggaatgtttgtttttttcttgttgattcgtttaagttccttatagattctggatgttagtcctttgtcaaatgcatagtttacaaataatttctcccattctataggttgtctgtttattctgttgagagttctttttgctgtgccaaagctctttagtttaattaagtctcctttgtctattttttattttgttgcatttgattttggggtattcatcctgaattatttgcctaagacaatgtatagaagagtatgtcctatattttcttctagaatttttgtagtttgaggtcttacatttaagtctttaattcatcttgagttaatttttgtatatggtaagaggtaggggtctagttttattctgcatatggttagctagttttcccagcaccatttttcgaatagggtatcctttcccccattgtttatttttgtcaactttgtcaaagatatgttggttgtagatgtatggctttattttaggagtctctattctgttccatcagtctgtgtatctgtttttgtaccagtaccatgctgttttggttaccgtagctctgcagtatagtttgaagtcaggtaatatgatgccttcagctttgttctttttgcttaagattgccttggctattcaggctctgtttttgttccatatgaatttagaatagttttttctaattctgtgaaaaataactgataatttgataagaatagcattgattctgtagattgctctgcgcagtatggatattttaatgatattgattcttccaacccatgcgcatggaatgcttttccatttgttgtgtcatttatgatttctttcagcggtgttagttcttgtagtcatctttcaactcctcagttaagtgtattcctaggtatttttgtgtctgtgtgtggctatggtaaatgggattgcgttcttgataaagtctcagctttgtccgtgtatagaaatgctactgattgttctacatttattttgtgtcctgagatttggctgaaattatttatcaggtctaggagtcttttggcaaaatctttagggttttctaggtttagaatcatactgtcagtgaagagagataatttgactacctgttttcctatttgaatgccttttatttttgtcttacctgattgctctggctgagacttctagtactatgttgaataggagtggtgagagtgggcatccttgtcttgtctcagttcttaaggggaattgcccattcagaatgatgttggctattggtttgtcatagatggctcttattattttgagatatgttccttctgtgcctagtttgttgagatgtattgccataattattatgaaataattactgtgtataaagtcattttttgtaagccaaggaagagatggatttctagatgtgaaattaattataaaaataatccataattgaccacacttctttttattttaaaagacattagtgaataaccttgtttcatgagaaggccagaccacatacacataaaactatgatgtgaagaatattgagtttagtgaatggataacaaccactgacagcctaacctgtccaaccattcttttaggtcttaacatatttctcagacctttatatatttggccctatcttttgttttgtttgttttgtttttttgagacagtttcactctgttgcccatgcaggagtgcggtggcctgatctcagctcactgcaacctgtacctgccaggttcaagcaattctcctgcctcagcctcccgaatagctgggattacaggcacccaccaccatgcccggctaatttttgtatttttagtaaagatgggtttcaccacgttgcccaggctggtcttgaactcctggcctcaagtgatctgccccccgccttggtctcccaaagtgctggcattacaggcatgagccaccgcacccagcctggccctatcttttatgaagcaaacctgacttaaagtaataatcacaactgtaaaaagacaattatctaatctcttctcaaaaaattgagggagaagcatgtttttccttttgttggttggaggaagtaaaacaaattcagatggtacaatgactttttctataacttgggtatttaagtgttttccagcaaggacagtgtacatatttatgggaagaagacacctatttaactgtactgatgattttggcatagcatcctattgagcctgctttatgtcattgcccttttaatgaaatctcttcattaataaaaactgataatttgtgtttttctcattacacataaattgtgcctaacagttaatcatacttttttcatcatagatagtatcagcctttaaagcaatgtcagcatttcttgctgccctaaaaatggtttaaataaaagtgtgtgctgctcactaataaaggaaacatgtgactcataagcagctaggaatacctgatgattttatctgacacccttgtgggcagatataccattagaagaattttattttattagcacagaaactcaactttttatgaacattgatgctaaagaatgttcagaggtgattgaagtactcagtaataataattgttttactttactaatgaaagatatattcatccaacattatagtagtgctgattcctcagcatctcatttgcatgttatgaatgtacttatatgtggatcttatcaaaattaaacttttttaaaacttgtaagcattcccctaagacttttgccatttattctattcacttctcttttgcattaatcccacacatgtgcacttacttcttagatagttgtcacatgaacacaccttatttttcacgttaatttcctctttgaaaaatctcttaaggcagaaatcctggctgccactgctgaggaagcagcaaatggtctaaatcagttgtggtggtttgttctattttttaaaaaaataattaatttgctcaaagcacatttactttaatgttaaacaaatgtgctttttccaaaatgtgcaaatgtgtgttttccagtgtgcaaagaatctgatactgtgctctatatagtataatcttttttgttttaaagaatactattcattctgcagaaactttagttgtgcctttggataatatgggtaagagggattatatgctttttttcatggtctagagacattctgtgacacaacttattttgtgtttgctcagttttttcagatggaaaaattaatatatttgttgtgaacatcaagatgctgttataaagcactgtgagatctcaaatgaaaattaattatggcatatataaataaccgtacaaccactattgtacttcagtcagtcagattcaaagtattttgattgttttatggatcctgtgagcatcaatcacaaagtttcatctagtagataattgtaggtgcaattgaggaaatacttttgcaaagcccattaataagtcatgcaaaaatgaactgcttattttattctgcttttgttcctcccaaggtataaaataattacaggaaagccttctggtgcaatatctggagtacagaaagcagaaaatggaccaattgactggagtggagacatgcctgtttcttgcagtctttctcggtaagtatggtgtacctaattctcatcttttgcactttggtgtttgaaatctttgttgcctagaaccacagatactcaaatactgaagtgtagtttgattttattttaattagatattgtcaaagcatgtgctttgataaatgatttttgtcttcgtggtggtgaaaagatttattctctgctatatgaataatttcccaagatcttcattaggacacagggcatacatttttgagattggtaatcactggtcttggaattcttcccagtgtagggatcatgctcaggaccttagtatcttttgtaatgacctccatattgatggataacaaatagtggattagatatgagtaaatttctcaactggagttgtaaaaagcaaacaatgaagagatttagtattatcttcattttaaaaaattcaaattattcaaagggtgagaaataatagttttttgtactttttagcatttcaaatgttcatttgggtcttgtttaatgtcacagacagaaatcaaaaaaattatattgtcatttaagaatcctgttaccacaaagaaagaattaaggtaaaagaaattaaaagtagaaagtaaattattttgtatttcactctggaaacaaagccaagacatgcatcggtatttagtatctgtgattactgaattagcttccatttttcttgagtgtggtagttatataatccttaattggacacaagttatgaattagtggcttatcaccttttttaagttgtgggtgctttttgtatgactttaaataaataaatatataaaacaagctaataaaatatcacttatcattttatatgttgggttctgtgaaaattcatttaaaccaagagttccaatgctgaaatcattttcaaaaaccactattgttaacagttttttgtgtgtgttattttaaaaagtttccaaaatgaaatcgtcatgtaactagattactaagagaaattcattgtgttggagagtagaaatttaatattataactgtgatttgtgttaaatttttatttaggaaatactcattttggggatctcaggcaaaactgataaagtgtaaagggctcagaaaatgaacacttgctggtaaataattatattgccaaaactcagaatcaaaaaaatctgatgatctgaactgcagcatatttctggagggtaacaggcattatctatcgaatcagtctttagcataccaagttacaaattctttgagaaaaattgcttagatgccagaaagtatattatataatttttttgttttaaatagtaagaactctaagtactacaaatcagccgtgaaaacaactaccagaaatgtaatgggtcttggcacggtggcatacacctataatcccacctgctcaggaagctgagacaggatacttgagccccagagtttgagactgcaatgcataaagcatctgtgaatagctgctgcacttcagcctgggcaacataacaagaccccatttctagaagaaaaaaagctataattccttattcattgatgagtggcattaaatgaaggttacctagctttctgaaaagttgacagattttaaattttttaaattaatctaatatagtaataatgacagttcctttgatttgctggtaaatactatgattttttaacctagacagaatatgatatattcactcttcaagtaacttttcaatactattttaggggtcttcaggttctacttacccctgttcttgcaaacatccttgaagcagatcaggaaaagtgttggggttttgaccagttttttgcagaaactagtgatatacttcaccgaatggtaattcatgttttttcgctacaacaaatgacagctcataagatttatattcatagctataatacgtaagtatctctattttcttcttgtatcaacatgttctgttatataatattttcctaagttaggaaaagaaatagaaaagatgcctcagcttcaccaaaagtacccatttcccacatggaaaattatatttaagtgcttagtaaattccttttcacttatttttggagtaaaaggattgataattctaaaatttatagttaaattagcttgtttcttaaactgtaagttttacaaaagtactttcattgctgtgccttctttcaagttacataatcacataaccacaaatggcatctaccaataaaccagccaggttttgctaagtgtactatcctgccatgttaaaatatcaaagcctaagtcttcattgttagcatggttatttgcctatgataaccctatgcagataatatggttactattaaccataataatggttaaagcacctggctccggaaaaataatcagtgtttgttttatgtaaacaaaaacacattacacccatgtgattaaaaaaaactacccatgtgataaaactgcatataaagttttggtcaatgatggaccatatatacaacactggttccgtaagattataatatcatatttttactgtaccttttctatgtttagacatgttcagatatacaaatactgtttctaattatgttacagctgcctgcagtattaagtacagtagcatgctgtacaggttcgtagcctaggagcagtaggctagctaccctatatagcctaggtgtgtagaaggctataccatgtagttttctgtaaatatactctgtgatgttcacacaatgatgcagtttttagaactattcccatcattaagcaatgcatgactgtacacatacatatacttgcatgtaaaactggggaaatttgagtaagttgggtgtatcaatgttaatagctggttgtgatgctttgctatatgcaggatgccaccattgggggaagctgggagaagaatatatggtgtctctcttcatcatttcttagaactgcatgtgaatctacagtgatgtcaatgttttgtaaaaagctcacccagtgtgattatcgttaataataacttaattgtacattttaaaatagctaaaaaaatataatttgattttctgtaacacaaaagataaatgcttgactggatggataccccattctccatggtgtgattattatgtattgcatgtctgtaacaaaacatctcatgtacctcataaatatattcatttcctatgtacacacaaaaattaaaaacaaaaaattttcaaaaggtgacacagtggaggcttgtagagccaaattacaatattgctgctgaaacatttcttttgatgtcattgatctattcatggggaagctgtcttttcccccgaagcatcattttgaaaatacctagttttattaatgtatttaacaaacatatagtcacataacaagtgctgttcttggttctttacatatttaagccatttaatcctcacaacaattctgtgaagtgggtactgttattatttccattttactgatgaggaaacagtgcagaggagttaagtcacttacggttttataggaagttagtggaagagctgagatttgaacccatgtatctgattcaagtcagtgctctaaaccgctctgctatgttggttctctatttgaaaatattaataatcttggccaggcacagtggctcacacctgtaatcccagcactttgggaggccgaggcaggtgtatcacttgaggccaggagttcgaaaccagcctggccagcatggcgtaaccctgtctctattaaaaatacaaaaatcagctgggtgtggtggtgcatgtttgtaatcccagctactcaggaggctgaggcacgagaatcgcttgaatccaggaggcggaggctgcagtgagtcaagatcgtgccactgcactccatcctgggcaacagagcgaaactctgtctcacatacacacacacacacacacacacacacacacacacacacagaggaaagaaaatattaagaatcctgtatattacacaggtatccaaacataaaaatactttagaattgcttactgtatggacaggttatatggaatggagtttgtagtatccacattaacaaagcaagtttatatggactggttatgatattagggatatgaattagaaatggatgttgttgcactcatttaaaatattttgcctctcactttatccccagttatagtgtccttttgaatttttctcacacagtgctactatatttcatgaactggtatataaacaaaccaaaattatttcttcaaatcaagaacttatctacgaagggcgacgcttagtcttagaacctggaaggctggcacaacatttccctaaaactactgaggaaaaccctatatttgtagtaagccgggaacctctgaataccataggattaatatatgaaaaaagtaagttgggatttttcttgtcgttcttactagccattagaaaaatacagccagcctgggcaacatagtgagaccttgtctctacaaaaaaataaaacaaaaattagtggggcatggtggcttgcacctgtagtcccagctgcatgggaggctgaggtaggaggatcacttgagcccaagaggcagaggttgcagtaagccgagattgcaccactgcactccagcctgggagacagtgtgggaccctgtctcaaaaacaaaaaaatccacaaagtctgtcattgtagaaatgattgtcatccttataaagctgatgataatattagtgtagagctttcataaatattaaaattttataaattactatagttgaaagagagtaattgtaaaattgaaaaagccttgtagacatgatttgacttcaaatattttgtttcctaaaacgataaaatcgtttgtcatacgtttcactgtaactctctttaaaaagtgttttgctaacactcaaaattaccttttatatcataaatttcagcaaatattttttgtgtgcagtatgtatagaacattgtgccaagctttagagtctaagaaaaattagatctgcatttttagaatcttttaaattactcattctactggtagaaaaaaaaatggatcacccagaattttacagttctatttgaaggttgggatttgatgtagatttaaagagaagcattggactcattgtgttggtgtatatttaaggaaaaaatgaaactccttagaaatatttgaggtaatttgttagagaatgagcattattgtttgaagtggtgtttttttaatcacgaaaactacattacagattttgccactaatgtttaatttagacattgtgtttgctctataaaggataaagtgattttttcaaaaagttttctttctcattttattttacttcatatttcagtttccctccctaaagtacatccacgttatgatttagacggggatgctagcatggctaaggttagtatttaatttaattactatgtaaacatctgaatttaatgtatcctatcaatagtggaagcaataacatgtattgtgtcttcatgtatgtctatatgacttaggaaattattcacttaaattgataccctttccaagtgattttgtggtctttcttttttactttttatcctttcttgaattcattatataagaaaattctctccattgagatagtgcatgtttagataatgttaaggataacatatttattatatttatatctatttttaactcttagaaattggtggtttattgtgtttttaattaacctgataaaaatgtgtaagcttgaataattttgtgtaaaagtttttcttaccctataccacaattagcaccaaatattgacattttatttctttattaggcaataacaggggttgtgtgttatgcctgcagaattgccagtaccttactgctttatcaggaattaatgcgaaaggggatacgatggctgatgtaagtaatagattgaaattttgaaattgattttcatgtagaccttgccccatcattgatattttctctcttcaaactagttaggttaggtgcttgatttttattataatacatttgtttcacatttagtttataaaacatttagcagctcatttttcatgagtcctacaatgaccttgtgagacagaacaaatagtatctgaattttaaaacttacaccacgctataggatgtgacggcaaatgcatttcttttcctaggaccttgagtagttggttgtcatttaactatgttagaagtctttggcttgttagaattcagtacaatctgtactttctagcatttaagtcctcaaagtcttccttaatttcctaccattttcccaaatgaagtacacagtccttttttatcacaccgtattttttttttttctttttgagacagggtctcgctgtcacccaggctggagtgcagtggcacaatcacagatcactgcagcctgaaactcctggcctcaagtgatcctaccacctcaccttcccaagtacctgggactataggcatgccccaccacacccagctaatttttttttttttagtgatggggggtctagttatgttgcccaggctggtctcaaactcttgggctcaggcaatcagcccgcctcagctgggattataggcatgagccacacccagccttcacaacattgagatataattcatatactatataactcatgcatttaagcatacagtttaatggtttttattatgttcagagttgtgcagccatcatcactaattttagaacattttcatcaccccagaaagtatctctgcatccattagtattcactctccatctccgcctaaacagccctgccctaggcaaccactaatatactgtttgcctgttccagacatttcatataaatgaaattatacaatatgaatatataatctaacaagcaatttaaaagctaattttttaaaactagatcgcttaatatagttattctagttcagaataactggttatctagtttaagtagtttcttcctgaaagtgactctaagaaatgtaagatggatgtaatttttacctgttttttactttaatgatttatagatgtcatctttccatctgaaaaaaatggaaaatacattatctcttttggaaattatgcttgtttctacacatcattcaaagcttttgaattttgcgtacacatcatgatggccttgtggccgacagatgttaagaagtttgttttctgcactcatgtcgctatgtatgtgcccttggactgtaatgcttttgacagtttatgtatgcctacctcatacccaccccgtcttgcaaaagtgtgtatgaagcatttcatcactctttttaggctcctttttttttctgttagcattatatgaaacccataaatttgtgtttatctttttcactgtgttcacatatcttagttcctaagcctatgcttttctgtttccactaagaagcttccttgtttttactggtttctggaaaaatctctgtgtactaacagtttttattttctcttatctatcgtcaattgctgatccatgaagcttttattccttttacttattagtttatagtccaataagtcatgagaaaatagttttaatgtaaaccactgttggcaaacattttctttaaaggatcagtctaatattttagactttgtgagctgcatatggtctcttctttgtttttacaatctttaaaagtgtaatgttagctcatgggccatacaaaaagcaggcctcaagtcttagtttgttgatccctgatgtagatcaaaagcccttcaattatatatttcttactgtgtcatccttcttcagatgacatcacaagttgagcatccctaataaaaaatattccaaaagtcaaatctttttgctcaaagtttatgctcaaaggaaatactcattggaacattttggattctcagattagggatgcttaaccagtatgtatatatgcaaatatcccaaaatccaaaatctgaaaaacacttctggtcccaagcatttcagataagagatattcaacctgtaattggtttaaagtataaatcagacagtagtctactctgagtagtaaaaattaattctggtggtataaactgtaatgctctacaaactatttgtgtaattgtagattagtttttactccttaatgtaattttaataccttaggtttttaaactgttaacctaagtagtaatggtttgtgaaaatatgagttccctaatacatcaggatcacagaaatgcttattataataatgtttcaaaaagtgtgaattgatgaatatcatgaatattgttataaaatgtttttgaactgtagtactgcagtataattagtgatagatagaaaaaataactccttagataaactaattagaataattttctttttttagtgaattaattaaagatgattacaatgaaactgttcacaaaaagacagaagttgtgatcacattggatttctgtatcagaaacattgaaaaaactgtgaaagtgtgagtagactacttccttactagtaggggttaaattattaaatgttccatttctatttaaatgacttagttatccttggcacaatatggcatgctatgctagggtttctattaaagatcagcggcctggcacggtggctcatgcctgtaatcccagcactttgggaagccaaggcaggtggatcacgaggtcaagaaatggagaccatcctagccaacatggtgaaactccgtctctactaaaaatacaaacattagttgggtgtggtggcgcacgcctgtagtcccagcaactcgggaggctgaggcaggagaatcgcttgaacccagaaggcagaggttgcagtgagctgagatcatgccactgcactccagcctggtgacagagtgagactccatctcaaaaaacaaaataaaataaagatcagccttagattagtgattactttatcatcacaaaggcaaaaatgccagttttcttggtaagaagtgaacaccatctcttagtggcatttcctcccagccattgggcaggaaaaggtagtgggaaaaacatctcatttctatcttgtaaaacagaaactgtgaataagaaaatatgaaacttgtaatcaacaaaggaaataggaagagatattctagaacagccttttagtagtatttttagaattataggaattacttttagtttatttttacttgttaatcttattcctgagaacacgttttgaaacagaatgatatttttaactgccctctttctagaatatactatttgtactgcagaggaaatacaataaatgaaatcagtattcactattgaccttcattaattctgaaatgtatttttactattatcctcatataagattatttgaaattaatttgtcttttctgttttatccatcccttaatctgcaaatttaaaatagaagcagataaaattccttcttcaggaaggcatcaggtttttttgtttttttggtttttttttttttgagagagagtctcactctgtcatctaggctggagtgcagtgatgcaatcactgctcactgcaacctccgcctcccaggttcaagcgattctcctgcctcagcctcccaagtaactgggactacaggtgcatgccaccacgcccggcttattttttttttttttgtatttttagtagagatggggttttaccatgttagccaggatggtctccatctcctaacttcgtgatcttcccaccttgacctcccaaggtgctggaattacaggcgtgagccactgcacctggccggcatcaggttttttttttaacaatctgctggcttatagactttgaatcaattttttatttttaaatggttatgatgaaagctgaaattattatttataaaacatctttttaaaactatgtattgattatactcatttaattttctcttttgacttttcatacagatatgaaaagttgatgaagatcaacctggaagcggcagagttaggtgaaatttcagacatacacaccaaattgttgagagtaagtgtttacaaaattacgaaatttgtaagctcataacctattcctttgctggcactattagatttaaactttcttaggagctaggcatggtagtacacacctagagtcgcaactactcaggaggccgaggcaggaggatcacttgagctgaggcattaaaagctgcaacgagttatgatggtgccactgcaccctagcctgggcaactgcacgaaatcttgtctgtaaaataaataatttaaataaataaactttcttatagagatgatatttctcactgcagagaaagaatttttcccatctttagaaacttctttacaatattaaataatcttactgccttgaaattttttgtaacatattcaaatgactactgtaatttaaacctctctcgctgcctctctctctctcggtgtttaaatccataatgctcttgtgttcttgctgtggcagttaaagcaagttcataaatgtaatttcacatgcagttgaatgtaaagtgcttgagcttgtttagaaatagatttaaattaggctgggcgcggtggctcatgcctgtaattccagcactttgggaagccaaggcaggtggatcacctgaggtcgggagtttgagaccagcctggccaacatggtgaaaccccgtgtcattagctgcgtgtggtggtgggcacctgtaatcccagctacttgggaggctgaggcaggagaattgcttgaacccaggaagcggaggttgtagtgagtcgagatcacaccattgcattccatcctgggtgacaagagtgaaactccatctcaaaaaaaaaaaagatttaaattagaaaaatattatcagatttttttctaaaataaaaaaggaaagaaagatttgaggtcttcaaggcagtaattacttctatagctagaaaaagaaattaggacacaagtctctactctgctgaaaaatacaatagaacttctgggagtctctgaatctcttattaacatgtattatagaagtgcgcaggtttatatattagtaatcagtgagagctgattactactcccagacctgccccatttacctgcctactcatgactggctacttaagcaaggccttttaattctttgcatccttggtttctttttctctaaaatcagcaatttcttaccctgcccgtcttatgggttgttgtactaattaaatgagataaataaaaatactgtactcttggctgggtgtggtggctcacacctctaatcccagcactttgggaggctgagtcggatggatcacttgagtccaggaattcaagaccagcctgggcaacatgatgaaaccccatctctacaaaaaatacaaaaaaattagccaggcatggtggtgcatgcctgtggtcccagctacttgggaggctgagacaggaggatcacttgaaccgaggaggcgaacgttacagtgagccgagatcgtgccacttgcactccagcctgggtgacagagccgagactgtctcaaataaataaataaataaatatattgtaatcttgcaagcttttagtattcgaagtattctttcataaaatggatgttaaattaaaagtgaaaggaacttgatacgatatccttttcactttccagcttaggctgatgtttgtttcttttcctcagttttagatctcaaacagtggttttcaaaatatgagtaatgaacaactagtaggttatgaagttgggtgccttgtaatcagcaatgtatttttcagtggaacagaatagaaaatgtcagaatgtgtcacatataataaggaaatcattgtttatgaaactttgattcaggtatatacacactttaaatgttactgagttaaaacagtgagtttcttactatgagttgtggtcaggaaagtttgaaaaccatagctatagaataaggtgattaaaagtcagaaagcacaaaatagtcttccccagtatttgtctgcatttaaatataggcagccatattgctgtcagtgttttatattcttctctgttttcaccttagaacatgatttacctgctcataggcctagtggacatttatttccagggccagcatcgtttgagcactttaaatcaaaattaatatattttcttttggggatctcaaaatgtttctcatttttatgacattcctgtgagattaagatttctttttatttattcatttatttttaaacagagtttccctcttgttgcccaggctggagtgcagtggcgcgatcttggctcactgcagcctccgcctcctgggttcaagcaattctcctgcctcagcctcccgagtagctgggattacaggcatgtgccaccacacccagctaattttgtatttttagtagagaagtggtttctccatgttggtcaggctggtctggaactcccaacctcaggtgatccgcccgccttggcctcccaaagtgctgggattacaggcatgagccaccttgcctagccaagattaagatttcttatgagaaagcatagatgactaaatagcttgaggtaatggagtcttatgacatcaggacttctcacttcaagccaattacttttccgtagatatcattttttctctttttcttttttttttgagatggagtctcactctttcgccaggttggagtgcaatggcgtaatctcggctcactgctacctccacctcctgggttcaagtgattctcctgcctcagcctcctgagagctgggacttcaggcgcccgccaccacgtccagctaattttgtttgtttttttttttttttttggagacgaagttgctcttttgcccaggctggagtgcagtggtacagtctcggctcaccacaagctccgcctcctgggttcacgccattctcctgcctcagcctcccgagtagctgggactacaggcttccaccaccaggcccggctaatttttgcatttttagtagagacggggtttcaccgtattagccaggatggtctcaatctcctgacctcatgatctgcccacgtcggcctcccaaagtgctgggattacaggcgtgagccactgcgcccggcttcgtagtggagaccttacagacatttttcccaccacaaaagtaaaatttataagtagaaaaaaataccacatatattatgcacccaaaaaatgatgcttaaaagttttgtccattgccctgcagcagtgcttctcagagtggctcctgggccacaggtcgcagtggttcacacctgtaatcccagaactttgggaggctgaggtaggcggatcacttgaggccaggagttcgagaccagcctggccaatatggtgaaaccgtgtctctaataaaaatacaaaaattagccgggcgtagtggcagacgcttgtaatcccagctactggggaggctgaggcaagagaatcacttgaacctgggagatggaggttgctgtgagccgagatcatgccactgtcctccagcctgggcgacagagaccctgtctcaaaaaataaaaaaaaagtaaagaagagtggctcctgggccagcagcttcagcctcacatgggaacttattagaaatgcacattttgggaccccacctcggatgtgttgagtcagcaactcactggcagaacccagcaaaggccctttttaataagccttccaggtgattctcatgctgctaaaatctgggtaatcactgttttcattttcttttatatgtattattaaatgactgttactctacaaacatatggttgttatttttactttttggataccattatagtgtaggcatttcccaggtttttttggtaacaccattttcttaatgatatgatgttgcagccagtggatttattacagtcttacttattattgctctactgttggtcctttagtttgcttttcactcttctatgtaatgctgtaagaaatgactttttccataaactattttccatatattggatgtataatttaacacattctaaacattaatgttaaaacagacataaagcataaaaaccgagatatatatttgatcatataaaaatttaagctgggcacagtggctcatacctgtaatcccagcactttgggaggccaaggtgggggtagactggttgagctcaggggttcaagaccagcctgggaacatggtgaaaccccaactctaccaaaaaaaaaaaaagaaaaaaaagaaaaaattagcaagacgcaatagcacgcacttgtaatcccatctactcaggaggcttaaggtgagaggatggcttgaactcaggaggcagaggttgcgggagctgagattgcaccactgcactccagcctaggcgacagaatgagactctgtttcaaaaataaaataaaaatttaagatctgtacatgtttaaaaaatgttagaatgcaaataagttgggaaaatgtgataaagggttttttataaaaaataactcatacaaattgataaggaaaatagtcaatctgcaaaaaatagatgagcacagaacatttagagacaatttataaatgaagaaaatatatctggtgaaaacactcttgaaaaaatgctcaaatccaatagtaagaaaaaattgcataacagtaagatactatttttgtctttcagattatcaaggcttaaaaaattataatgccagtgctgacaagagtgtggtttaaagggcatccttatttgttgctagtggcaatgtcagctactactgacaacattatttgaaaggcaatagtgtgtatcaggacctttaaaatatatggacatatttatcctttaagtctaaccttcatcctttcttcataagttttacaaatactgtatgcatttctgtggtaggtaagtgataaacttactaagcttaaaatgaacagaatcttagatgaggtttcttttcattttctgtttttaagaggagttgctttggtttggcctctaaacaagaagagcacaaatcttgctgcctacacagttgatatttggaactattctagtggttctatttaattttcaaaaccgggttatgaaatggagaattaaccactttttacagataaggaaacaagattagaagtattttacatgtggttttagaagggtgtttactgaatgaactgttttataagatgtattactgctggtctcatgttttattatcatactgtacccctggtggaaatcaacctaagaaactcttttgtatttaaaaatggaaataattactgtgcctttgaattgaagtaatctacaaaagaaatgtggtccagactttagactttgttgggactgtgatgatcatttctggcttttggcaatctggatctgaacctttggttttatttagctttccagttctcagggaacaatagaaaccagtcttcaggatatcgacagcagattatctccaggtggatcactggcagacgcatgggcacatcaagaaggcactcatccgaaagacagaaagtaggttatagctttatgcgtagtttctgctcttattaatgtcctttttcacattgactcagttaatttatttgagtttttcttccttaaatagtgtagaaaaactacaagtcctgttaaattgcatgacagagatttactatcagttcaaaaaagacaaagcagaacgtagtaagtaaaatttgctatttgttaatttaataaatccctcttagtaattagttataattcagttaaattaatttggtatatctgtaagggtagcttcttaagctgtttttttcagagatgtgattctgtcaggaaaaaggttgattgtgttaaaaaaaaaaaaaaaaactatccttaaaatcaaccttttgaatactttaaatcagggtcatgaacaccagaacctctaaaggccaggcaggtaacagaaaggaatgagattggccagtggggactcatctacaggggagagccactactcatattcaccaaaggtattgcccaatcttcccatttctcaaaaaaagctagaaatacagaatttgttagaaataccttgatttttaaatgttaactgttaattgttttttacattgttatttacagaccaaataaaagcatctgtgggccataagtaaccaatgagccacaaatctatgacatctgcttcagactcttagcctttttgaagcaataatctcaaaagaaaatacattgtgtataatattatgattctatattaacaacagtaatatattttcctatttctaggattagcttataatgaagaacaaatccacaaatttgataagtaagtatccagattatgtttaatagttatttttggtgctattttggttatctttattaatatgattcttcttaaagttgaaattaattacaatttaaaaatacattttaatcttgattttacaggattgttacaatatgtagacatttttgaggttcacacatctgctccctaattgggaagttaccatgatgggagaaggaggggggagaaagattaccatttcagtcagtcagcttctgcctcatatgctctgattacagaagtacagataatacagcacataggcaagggcagacttaactaccgtcttaattttaaccgcattcaataggcattttttttacatccattttgaaccttctctttatcttcttgctgctataatgtctatcttagaaacgtttactttctcctgtaaatattctaaagccacaacaatcattataggaaagatacatttcatatatttgaaaatttctaaatattgaaagtagaaacagtgacattggtttaagcctctgattatttctaaattacaggcaaaaactgtattaccatgccacaaaagctatgacgcactttacagatgaatgtgttaaaaagtatgaggcatttttgaataagtcagaagaatggataaggtgagtaaacttcttttggagtgattagtggttgactgcacaatataaatgtatatttgaagtaagaatgcttcactagactgcatatcaattgattctttttggttttcagaaagatgcttcatcttaggaaacagttattatcgctgactaatcagtgttttgatattgaagaagaagtatcaaaatatcaagaatatactaatgaggtaggtacagctgtcaaggaaaaattaaaattcttctcagtttataactgatagtgattgacaagggagaaatgggatagaatgtgcctacattcagttccacccaccaatttttaatatgtattttgagccaagttttaagaatgtagatgttttacaactaaaaacagctgataaaccatccttttatcaactgtatgaaaagtttctttcttaaaagggtgttgatttaagtattgtatcatcgatagttttgaaatcaaaatttaaagtttttttaaaggacttattaaaagctgtaacacttgatgtcagatctgtagtaagtacttttgttctgtgattaatgtggggtttttttcttttttttttttttttgatgtttcagttacaagaaactctgcctcagaaaatgtttacagcttccagtggaatcaaacataccatgaccccaatttatccaagttctaacacattagtagaaatgactcttgggtaagaaactcatcatttggaaactgtagtgtttccatttgctttcattgcagtttgtgcttttgctcttacattttgaaattttttatgtttgttgtaatacaatgtttaataaggttatctattgaccagttaaaagaaaataaaacataaacatcattctaaaacatttgcatactgtttttgagcaaaggtgcttgtttattttattagtatgaagaaattaaaggaagagatggaaggggtggttaaagaacttgctgaaaataaccacattttagaaaggtgagtaatgcaaaaataattactgtgattttctgtgcaattgagttcattcacatctgtacttatatcttcctgtatcaatagattcagcagtggtaaagggtcataaagtcagaactcatgtttttctctctatgattgtgtatctgtgatgccttttaatggttgattagttccattttatagaagcactggttaatcgaattacttatttgaatcagtttgtaaagatcaaactctatttacattatttttataacttaattcattggaatcataattttcaatttggtgaatcagagttgctttttaagataccagcactttggtgctgagtagcttacggggtcctctgcacacctccttgcaggtgaaagccacaggtaaatgcagtactttgaggagttaggtgtctgcttattatctgcaaaatcctaatagataaggccaaagagatttgaaagcctgcagaggcaataaagcaatttttggatggcagttttccttatcctgattcctcagagaaattaagtcatatttggctctgtaatagaaccttttctttttcaagcccttaggttctcctctataggttctcaaacgcttgtaatgctaataaaaatatttcacatttggccaggcacggtggctcacacctgtaatcctagcactttgggaagccaaggcaggcagattgcctgagctctggagttcaagaccagcctaggcaacatggcaaaaccctgtctctaccaaaaatacaaaaattagctgggcatggtggtgcacacctgtaatcccagctactggggaggctgaggcacgagaatcacctgaatctgggagatggaggttgcagtcagccgagatcacaccactgcactccagcctgggtgacagagtgagaccctgtttcaaaaaaaaaaaaatggatatggaatttttgggtcagagagtatgtcaatttcaatttttgttgggttttactaattttattctttttttttttttttttttttcccccgagacggagtttcgctgttgcccaggctggagtccaatggcgtgatctcagctcactgtaacctctgcctcccgggttcaagtgattctcctgcctcagcctcctgagtagctgggattacaggcgcccaccaccacacccagctagttttttgtatttttagtagagctggggtttcaccatgttggccatgctggtcttgaactcctgacctcaggtgatccacttgcctcagcctcccaaagtgctgggattacaggcatgagccaccgcacccggccaattttgttctttaaaagggtgcatgttatagtcctaagcagataaaacctatgcatttggcaacattgaatgtataacatcttttaaacattcgccaatttgtttagtaaaaaccgagatcttattttaatttatatttctgtggtttatagtgatgtcaaacatcgtttaatatgtttgttcaattttcatttttggggagagttactcgttaactttaaaaaatattttccttgtttatagtaattatctaacttttatagtatccagtttacagtttcttcagaactttagctaaatccttttaggcttaaagatcaccaagtagaagagactataaagatgtgctttttttttttttttttttttttgagatggagtctcgctttgtcgccaggcgggagtgcagtggcgcgatcttggctcactgcaacctccacctcccgagttcaagcgtttctcctgcctcagcctcccgagtaactgggactacaggcacacgccaccatgcccagctaatttttgtatttttagtggagacaaggtttcaccatgttggccaggatggtctcaatctcttgacctcgtgatccacctgcctcggcctccctgagtgctgagactacaggcgtgagccaccgtgcccagccaaagatgtgcttttaacttttatatttaactacttatgccttgtggaataaaatcccaacttcctaaaccacatttagtaagtcagttcctcctgtgttttatttgcaggtttcttgacaatatataggtgatataacatggcataatcttaacgtaaatgttaagtgacaaaactagtaatggaagccagattttgttcagagtattatactactctgtctccatgtggataacccactatcacttcaaatttttttttgaatctaaaatcatctgtcccaactcagttttctctctgctccttatcctgttcaaaggtaccacctttctcctactcccttaaacataaattattttagacacttaatcttctttataccctctcaacaagtttggctcccatatttcccctcgtcaccctcattcagatctcctttccctttcatatgtgatatatggtaataacctattttttttcttaaccccaagctcttcccatctgtcatgggtattacagccaaaatcatctttcagaatactgatgtaatcgtatgacttctttggctcaaaagtttctaaactcctgttacctaaaaagtcaagtctaaatttatacttcaattcaaagagtgtaatagcctggttccagcctgttcacccaactttacttcccactgctccccaaaataacattgtgttctagcaaggtctcatttctcaacttcctttgggtatgtcacactcccaactcggtatctttttttttttttttttttttttgagacaaagtctcactctgtcacccaggctagagtgcggtggcatgatctcggctcactgcaacctctgcctcccgggttcaagcaattctcctgcctcagcctcccgagtagctgggactataggcacacgctaccacacccagctaatttttgtatttttagtagagaaggagttttgccatattggccaggccggtctcaaacttgtgacctcaagtgatctgcctgcctcggcctcccaaagtgctgggattacaggcgtgagccactgcgccggccccaattctatcttagcttataaatcccaccccaccagaaagaaattatccagttcttactgacagtttcttaattacatcattacatcggtttttcatgtatttatgataataccatgctgttccagtaagaaatagaacaaatcatagttacttaaactctttaaaaataaatagctatttattcctctgaaaagtattttaaggttgggggcctttatacataaatgcaacttttgagattacctttttttctttgtgtgtgtgttttaggtttggctctttaaccatggatggtggccttcgcaacgttgactgtctttagctttctaatagaagtttaagaaaagtttccgtttgcacaagaaaataacgcttgggcattaaatgaatgcctttatagatagtcacttgtttctacaattcagtatttgatgtggtcgtgtaaatatgtacaatattgtaaatacataaaaaatatacaaatttttggctgctgtgaagatgtaattttatcttttaacatttataattatatgaggaaatttgacctcagtgatcacgagaagaaagccatgaccgaccaatatgttgacatactgatcctctactctgagtggggctaaataagttattttctctgaccgcctactggaaatatttttaagtggaaccaaaataggcatccttacaaatcaggaagactgacttgacacgtttgtaaatggtagaacggtggctactgtgagtggggagcagaaccgcaccactgttatactgggataacaatttttttgagaaggataaagtggcattattttattttacaaggtgcccagatcccagttatccttgtatccatgtaatttcagatgaattattaagcaaacattttaaagtgaattcattattaaaaactattcatttttttcctttggccataaatgtgtaattgtcattaaaattctaaggtcatttcaactgttttaagctgtatatttctttaattctgcttactatttcatggaaaaaaataaatttctcaattttaatgtaaagagtt

SEQ ID NO: 2083 - DNA, 26887 bp, Homo sapiens
  source 1..26887: mol_type = genomic DNA
ccggcagggggagcgaggaggaagggaaccgcggccgggccaggtgagggagggaggaacacttgccgcgggccgtgctgaggcgctgcgttcgcgtgcggaacccgcgtgtgccgggctagggccatccgacgggcgcgctccctccgggctgcgggagggcacgacgggtggggtggcggcaggtgaagaggagtgtgggcgggtggcggggtggcggggcggcggagcgcggcggggcggtgccctaggcgggagggagggtcggaggagccctatcctgctgcgcgatggaggcggtggaggcggcggctccggctggaggctgggacggcctcgcgcttcgagggcttccgggcccctttagccgagggctcctggagggtcccagcgttgagcaacggggtccgggggtccgaaatcaagcgagtgagtataggcagccggtggggtagggtcggccaacagagccggctgggtggggcccctcacctcttcccgtcgcccttctggttgaccagggtttcctccaccctgacggcctcttctctgctgtggcaagctggccgcccctgcctgcctgcaggtcctgctcaggcacgaaggggttaatgggggctggaagggctctgctcctccctacaaacctcaggcacagaggtctggggacctctggaccgatccttgagcggctgacccagagtctccaggaggccccagggtttttcactttcacttctccctcctcaatgttggcctcacccacaggccccacatctggccagtgccctgaggtgtgtgcagatgtacacaggacacaagcttgggcataccctcaggctggggcacatgcaggagccccacccccatgcccccaccgactggcccaggcctctctgggtgcagactgccaacacaggcacgtctcctgcaacactaccaaatctgcggccaccagcatccctaccacccgcctccacgggactgtccttcctgcaggagcagctcctggggacaatggctggtcctgctcagagaggaaggaaaggggcctggaaccagctggtccatccccacacagcactcctcactggacttgtccctgggtcccctcagtgacactgagagacataagtcattgtcactgtcatggcccagaatgactactcagggcaagaaaaatgcactaaggacagcttcccttttctgacatggcccacaaagctccagctgcaggcggcaggggttgtggggggcaggacatgaggcaccccatacaggcagcaacacacaccacatcccagacaggcagcactattcgtatactcacccactgcggccctggactcacatgcgttcctgaacctcaggcccagggccagcctccccactggcgcccagccccccagcccgttactgggccttcccagttcccagccagcatcctctccagcccagggtctgaggtcctgagatcctaaaaaccctgggagaggttgcctgcctcccactcccatcctgagcatgcacaagcgaaggctgcaatgaggttgtatacagagaggccttgcaaacagtggccctgaccaccagcaccagggaggctccagcaaggcacagaggctccagcaaggcacagaggcacagagctgaggttgacacccagctggagaggccctgtacaggaaagccatgggtgcgctgaactggttagaggagaccctggagacagtaggtggggaaacgcacaggccaagtcaggccttggcgtctgggatgcctgggcctagaaaccaggcagagcggcgggcctcggcctcactctgcccagcctggtcgggccatagagcttctcccggcaggcaggctggctgctgggtgccggggggcagcatacgacccagtggcctgaagttctccaacatgtcctcgtgtcctcggctccctcggctggccaggctccgcccccggccctccctgcgcccggccggtgcgcagggaggtcggaggagcgggcactgcccaccctccggatgtataagcgtcctggccagaggcgggcggtgcgcgcaagtgcgcgtgacgctcgggctcgcgggctgcgcagcctgggcagcgtccctctgctggggtctccagcgacgatagtgagccaacttcagggggctgttgggcatttactgggctgggtcctgtcctgctgcgccaaggaacagaggacgctgcggccctggggctcctgtcagtggccggtgcgagagcccaagctgccctctcctcacccaggtgcaggggcagccagggaggaggtggaggcgggaggggccaagggcaggggcagggctgggctccggcagccactcgctgcttcatgggtgccctgccacctcgggctagggctgggtgctgctggcatagacacctctcctcggggggctgtagaagctgacggtggcttcgctgcacagagaaaggccgtgccttggcaggagcaacgggatgttcaaggggcgttggtcatggaggtccctgggaatggaggaagggggcagggagcttggaaagcaagagggccctgcacttccagggtgctccacccgtctgggcccctcggctgctaccagccccaagtggggggcccatgacgccataatcctctgggccaggggcccctggcagtgagtggcaccacaggcccccgcccccggactccgtgggctgggctgggctgggcgcggtgcggctgggcacacgcagtcggaggcggcgccggccaggccgccgggcgcctatggacgcgcggagcccgctgtctccccgagccagtgcgttcagcatcgcctctctggttgcagcggaggcggcggagcgcaccgcccaccagggctcagggtcctccgaccgggtgaagcttcgctggctgccaggatccccggcagggatgcacttcagcaccgtcaccagggacatggaaggtgagcctccaggccgtgtctacactggcccgcccgccagaccccctgcctcagctgctgtggggcccgggtgcaaagtaggtggaggcagctcttggtagcgtgggctccaggcttctggctgcgattctggggcagagaggaagagccggcatcccgcccacagcctgtcccctcaccagcctgggggcccagcttggagatgggcactcaggtatacacaggcccggaagagggcgagtgaggctgggaaggagagcagaggtggccgtgagcctggagaggggggaggaaagttaataagagaggagagagcgggagagtttcacagaaggagagaaagcctcgaggaagccgtggagacgaaattgagcaaaggggagaaaacacaaaaaacccaaagaagaaggtaggggagaaacagaaggacacgaaaaggcaataaaaagcaagagcgaaagagaagagagaaaacgaagggaaaatttaagacagaaagcgaagtcataaaaaagaaaaaaaggaaagactttagtttttttttttttaaaaagaaaaacataaaaaacaaaggacatacaaaaataagaggaaaggcaccgactaaaagaaagacaaagaatgattaaaaataaagtgaaaaggaaggcgaggatggaggaaaaggggaagaggcggaaagtaaaacagaaataaagagaaactacagagataggggaagaaaaaagatgatcgggagggaaaatttaaatgaggacgacaaaggtaaaataacaaattaggaaaagaacgtctgggagagagagaggagaaacgcacgcgggcgggcggcagagcgagggccggccgacgggcccggcgcaccggtgagccggtccgggcggtcggggggccccgggccgagcgagccgcggcgggcgggctgggggccggggagggggaaggggcgggggaggggcgagggccgggggagggatctagtccattgtctccgcgcgggggtgggggggccccgggcggggcggggcggggcgcctcctcggggccggcctgcggtgtggggctgcacggcccggggcgcacgcagcgcggcgcccgccactcggcccgcggcgcggggcagcgctcagcttggtggcgggggcggcggcggcggcccgcgggtcatgatctccgccgtgtccagcccgtggctcacgcagctctcgcatttctgcgacgttgcagccttcacggccagcagcctgagcagcctgggggccgcggggggcttcccgggcgccgcgtcgcccggcgccgacccgtacggcccgcgcgagcccccgccgccgccgccgcgctacgacccgtgcgccgccgccgcccccggcgccccgggcccgccgccgccgccgcacgcctacccgtttgcgccggccgccggggccgccaccagcgccgccgccgagcccgagggccccggggccagctgcgcggccgcagccaaggcgccggtgaagaagaacgcgaaggtggccggtgtgagcgtgcagctagagatgaaggcgctgtgggacgagttcaaccagctgggcaccgagatgatcgtcaccaaggccggcaggtcagggcgcccctccccacgccgcgaccctccccacgtgctgccgccagggctgcgggcctccgcctgatccgcgcgagcggggccgaaagccgggtcgggggcgcggcctggccacctgcgggcccctctgggccccgctgcctccttcgctgttcgccgtcccggctccggcgacagccgcccggcgctcccctcctaacacctatcctccgccggggcgggaggagacggcgcgggccgcacgggaacggcgaggagccccgcgggactcgcccgcccgccccgcagccccaggacgccgcgcggcccagaaaccggcccggcttggggcgcacccggctgggggcaggcagcggcgtccagggggcctcaccgcccggccgactcctagtaaatcccacctcaagaaaactctggttcagttctggagttcagtctatgcgggcaagataaagagcggcagccgggcaactctctggacactttcaggagaggattacccttaaaaacagcgtgcactgttgcgtggaagttgctacccagtttccttcaacctagatccctatagttgtggggcctggctctgtatccagcggcccgtcacctcccaaccggcctgtatttgttttaaagaccaagagacaaggggaacaagttttgcagatgcacccgatttgaccggtagacaaaggcgggtgccgcgctgtgtctaatgtacacaccagctcggagtccgaacagccaaggggagctcagggcctgtttgcaaagccttctcgtggtttctgtttccctgctgccggcgtcctttctgaggaacctgggcctgtgctctgctccagctctgtggtttttttccaggccctccttgctgtccccaggcacacaggccctcctgaggacagcggcagcccagccgctggctcaggccagcccggcaagggccttgtcggcgctgggcttcacccgggagcccacgtcccgcagcaccctccagcctgcagaggcttcgggtgggggagggagcgggcctgtcctagaggctggctcctggcatctgtcttctgcccaccgcctgcagggagttgcttgtgaggggaggcagaggggacggcaagtgagggccaatccttgtgttgtcctgaagggccccacggccactactgctgtgccatcatgtgggggtagcccatggcctacacccgtccaggcactgcagaatgtcctttcaagagccctgactggtcactgagccagggtccaaagcgggggagatttgaggaacaggaaagacacaaactgagtacactctgggtagctgcgtcttggggttatgtgtcttaaggggagtggaagcttgccctgtgccctgaggaaggtggggagactcttatcatggggccatgatagagaggggccctgagagtcaggggagggagggctctgagccttggcctcactgaggggattgggtaacagccgaagacccagctaaaagggcagcggggacgccttgaactcacacaggactacccggtttcactttgttggagccgggagctgcttcgatcaagctggggaggctctgctaagggcgcacgttaggcaccctgctgccggccgaagctgggaccaagaggccaaaaagtcagcaagggcgaggccgagtttatgtaggccaaggttgccgaaggtgggggctccagcgctgggctggccatttctgtgtccaggaacggcccaggaggctcccctgctgcgccaagctcccagttgagtaggggcctgcccagattagagcagctaagccaggaaagatggagcccaagggctgggacgacacagcagcccccagaggctggagggaggggccgagcagaggggccgccagccccaggcaggtcaaggggggctgccttccaccagctagggtgacccaaggcctcatcacccccaggcggatgtttcccaccttccaagtgaagctcttcggcatggatcccatggccgactatatgctgctcatggacttcgtgccggtggacgataagcgctaccggtgagcgagtggttgtaagcgtgagggaccgggagggcaccctggaaagtggcgggtctccgcctggtgacccaactccaagggtcgtctgcaccatgaaactctttaggcacctgcgatgctgcccgatcaacccgctccctcctccactcccatctgaccccagacccacaaccctactccatgccctctcagaacccgcctctggagccgcaggctgcagacagctcttgctcccctgggctggtgtggccctagggtggtcagccaagtactcagccccggacttcttcaagtctccctctcccaggaggccggcctgagcgcctagtccccttcccccatccccagggaactctggatcctggagctgggccggaaaggtggggtggccaggagagattatgcagggcgggcctcagctgcccggacaattaacagcaattaataaagagaacgcgcactgccctgtgcctgaggcccggcaaggccaagtgtgggctcccaccgcagcggcaccggggcgggaggacccgcatccagcgaaatgagatggcaggagcccagcctccccctctcggtgccccacagggtgtccagttccttgattgttttgagtgttggggtgggtgggagttctctgtttagtccatagtcccccttggaaaagctcccagcacatgcggcagcagagggttcaatctcacaggtggggaaacttctcaaaggcacttttagggttcgcccagcacacgggtcaaggccctctgggttcacctccacatgcacgaccccaccccgtgccgctccaggtacgccttccacagctcctcctggctggtggcggggaaggccgaccctgccacgccaggccgcgtgcactaccacccggactcgcctgccaagggcgcgcagtggatgaagcaaatcgtgtccttcgacaagctcaagctgaccaacaacctactggacgacaacggccacgtgagcgactgcctccccaggctccggtgtcccccaaggcctcgagtcccgaggcacccgcctgtccctaagaggcctgtagaatccccaggcccccggctgtccccaggcggctctgggctgtccccgaggaggccctttagagtccctgcgaggctagaggctgaggcggagcttgggcagtgctggtgtgccgatgaggagagcggcctctggtcaggggtcgcacagcctagtgggcctgggccctgggagaggggtcgccctccttctctcaccccactcctgattttatgcaggaagcttttttaatggaaaagatggggccctgcaagggggctggagaaagaggctttatggagtccaggccagtgaggtcgctgggcaggcacctaaggaaagagaacctaaacccagatcttttgccacttggagctcattcctggcagttgccaatgggtcacagcctcctcttggcccagtgacccagcctcatcttggaattaagggttttgcccaactcatccaggaaactcattgccaactcagacctcagcccatttcctggctcccaccccagatcctcagcccagccccaccgctggagctgattccccaccttgtcttccagattattctgaattccatgcacagataccagccccgcttccacgtggtctatgtggacccacgcaaagatagcgagaaatatgccgaggagaacttcaaaacctttgtgttcgaggagacacgattcaccgcggtcactgcctaccagaaccatcgggtgagggcctgtggggaggacctgagcggattcaacgcctctggaaaagcgggtgtaattttcagttgccgtttggggacagtgggtccgcttagacctgcaggctgtggtcccagtggagcccaacccaactggagccccactcccaagggcctcaggcagccccctccctctcgaggctggccggcccagcctcctatcagcttgacctctccagcggcaactgtcacttcgtcctgaaagtttgttttccgaaccattccggaaactccccatcaggggcctgatctgaggtttacccagattactagggaacccgctctgttccccaccccccaccccactgcacgtggggggtggtgaccacattcctgtcccagcgaggagcacagggcctccatccccacccacctgggggacaccagagaggggttccctagtgagagaggaggttcctcagacccccgcccccctgcaggagggagcaccagctccgtagaggaggggcagacgtggactggttcttgtcagggcagcagaaaggcccttggtgcgcttctcctaacactcccctatcctccgccgaggtcgggtggcccaggctgcagggctccagcggcttgctcacacccacctccctgcagatcacgcagctcaagattgccagcaatcccttcgcgaaaggcttccgggactgtgaccctgaggactggtgagtgtcctcccccgagagagtgagcgccgggcgcctggcgcaggcgccgccctgatccgcctcccgcccgcaggccccggaaccaccggcccggcgcactgccgctcatgagcgccttcgcgcgctcgcggaaccccgtggcttccccgacgcagcccagcggcacggagaaaggtagggccggggtcgtgggatccgggttccggccctgtgcgcgctctaccccgggccggcggcctcgcccgacctcgcctgcgcccccggggcgctccaggctttcgcgccggttgcacaacggccgcggcggcgggcaagcgcgcactcgcccgcccggcccgacggctgcgccccgcccgccgccgccgccgcccgcagaggggcgcgggccccggggagggctcggggcgccggcgacttggggtctcgggcacgctggcaccgactggtcggggaacaccgagggcggccaagagccttctctccgccagggcctcgcatggggcgtcggagctcctcggcggccccggccggccgcgctcactcctcggccctctccgcagacgcggctgaggcccggcgagaattccagcgcgacgcgggcgggccagcagtgctcggggacccggcgcatcctccgcagctgctggcccgggtgctaagcccctcgctgcccggggccggcggcgccggcggcttagtcccgctgcccggcgcgcccggaggccggcccagtcccccgaaccccgagctgcgcctggaggcgcccggcgcatcggagccgctgcaccaccacccctacaaatatccggccgccgcctacgaccactatctcggggccaagagccggccggcgccctacccgctgcccggcctgcgtggccacggctaccacccgcacgcgcatccgcaccaccaccaccaccccgtgagtccagccgccgcggccgccgccgccgctgccgcagctgccgcggccgccaacatgtactcgtcggccggagccgcgccgcccggctcctacgactattgccccagataacacgggccctgtcgcgctcccgccccggtcctgcacagccccgaagttcgccgggcccggccaccctgccccaagggcaagcaaggaatacgttcccccagccccaggggccaccgcggctctccccttccccagcctcgaagccatgggggccccctcgccacccccagccccttgggctatcgaagtatccggttccccagtccctggagccaccgcgggtccttccccggccccgagggccaagggggtccccgcccgccagtgccaaagcgcccggtcggaggcggaaggaagtgatatttattgttctccccgagaccgcgtcgcccgcggcccggccggcagttgcagtgtagacagcccgagagccccgcctgcaggcggtgtagatacatgtagatactgtagatactgtagataccgccccggcgccgacttgataaacggtttcgcctcttttggaagccgcctgcgtgtccatttatttgtgcccagttagatcgcgttgggaatcttcgggacagcgagcccggggtagctcagggccctcagggcctccccagccccaatccctgccgactgtaggtcggtcccggtcccacagcgccctgtccgccacgcctcctgccctctgcccgccccataggggctcccactgcccctcccctctccgaggcccctcctgccaggcctgtgcactccccccaccttcccaccgtcccgtctcatcccaacctccccagggctggtggtaccgcccaggtgtgcatcctgcctttttacttaaattcctcccacctgcagttgtccctattctgggacttgggcctgcgccctggcctgttttcgggacagatgcttgtgcttttccatggaagctgggaagaagggtcatgacagacactgccggtcggtgctgggagggggagaagcccctgaccgggatggggtcatggaaagacaaaaacaggcagcactgttctgctagcatttcccctgccggcctagcccaggcccgcatgttccctccttagtgactttatttgctgtgagtgtccctacggagtgacctggccagggggcacaatgacagtagccatgagtcatcttgagacctgtgtatgaagcatttttcccaggccaggtggctaagggacctctccccgttaactcaacaccagggatggggcgagaggaactctttgatccctcccttcctgagcgcaagcaggaagggctgacagccggtcagcgccaaggctgctgacttggacacaagatgaacgggaagtgcacgtggccgaggctctgtcccccacctcccgtgcctgtcccagtgtgtttgtggcaactgctgccttctaggccactcggctcatcaccccacgtggtagcggcagcctgagtgccacctctccgagggcacagccaggagtttccagatgtccaccctcgcggacctgtttttcgtatacatgtttgctctggcggcgtgaagtgagtggggtcttagtaattgaatggcaggaaccattcccagaggccagtctagggtgggagggggtctccaggggccatccaaagcctcaaagggcatctagcaccagagagtgaggacctctgcagcatctgcccaggctccgtgagcacggctttggagatgcatttggggggacggctgtggatgcccattcccaagtcctgatccccacctgcgtgaacttggggcagccattacccatgtgccccacggtgggtggggctttgcactgcagagggcctccctctcttgctgtcagaaggcagccattccgtactccacatccaggatgtgcggaggggctgccattcgagacctccgccttggttttgttcagagctaaagggaggaaaagccctcccctgaacaaagagcaaacacagtgtttgtaaatgagggtgggacacacagcaatgtgcaaggaccctgagtgtgcagcaaactggcctgttaccgtgcccctcctgttgggatggccatgcaagatggagcacccagccgtccagcagggccgccgctggccatccggggctgttcgcattctttttttttttttttttttttttttgagactgagtcgcgctctgtcgcccaggccggaatgccgtggtgcgatctcggctcactgcaacctccgcctcctgggttcaagtgatttcttttgcttcagcctcagagtagctgggactacaggaatgtaccaccatgcccggctaatttttgtatttttagtagagacggggtttcaccatgttggccaggctggtctcgaactcctgacctcaggtgacccgcctgccttggtcttccaaaatgctgggctttcaggcatgagccatcacactcggccacacgtcctaatgaactaggattcattaaacattcaggtcctcactggccccattccaggtgctccgtggctcacaggccgcgggtcaccacactgctgctgttgctgctgagggcactcccacgctgggcagtggcccccagaagtgtgggtttcctcccctccacctttgtagatgagtttgtgcatctgagaacttcttgtaaatgagagctcgcaggccggcgtctgggtggcagcttccgctggctgtgtgtctgcaagactggcgcacgccgctgctcaccgtccctcatgtgctcagtcctcaaccagtgcccagtgattgcctgcccgctgcgggggctgtctggctgatgccccagccactaccgttcctgtggaggtgacgttcccatgggcagctgccctaaggcctggcttccagcagcttcctctgtgacagctgtgatctgaacgttcacccccaaggtgatggtggcaggagatggagcctttaggcggtgattaggtcacgagcgtggagtcctcatgagtgggattagttgagtgctatgctgctcacagacctccagcctccagaactgggagaaataactgtccattgttgataagccaccgggcctatggtcatttgtcctagctgcactactggactgacagtggccgttcttccatctccttcttgttccctgttttaggttccccgttgagcacacctgccctgccccttctgtaagctgctgtgatgggcagtatggtgtaggggatagggggctcgtcccaccgctgttcccccacaggctccccctcagctgttggacttcccccaaacatcctcctccaggttccctagctggtccagaggccccgttgccctcccctagcctggctgcagacgtccagctgccaggactcaggaggacgagagaccagaagggcccccagactcctcactcccaaaaactctccaaaaacaacagatgcacaacgcaggaaatagatagattcttgactaagcgggggtggggaccatccacacccccttcacaccactgcatcccacggaagggttctaggaccccagggcctgggggtgcagctggacgatcctgcagtagccccgctccctgttttcagaagacccccccacggctgccctctgcagcatgtgcccctttgtcgaagggacaatgggcactccattgcccagagaggcttctcacccaggaaagcactggaggtgcagaggcaggagcacgcgggggcttggctgcgggacaaggcgagtctgtttggtggcaccttgagctgcggaggaagacaagaccctggcccggtggagatgagaccctggcctggtgggcttcaggccccaccctgcggcgcaccctccagctggggaagtccatggggtgtgtgggatccatgcgatgacagttgtatgaggctgaggccctgatctccaggtgtgccgcagatcaaagcacccgcataccagagaattccacgtagccacagttgccaagggcagaggcagcctcacctctcactggtggagggagagtgatgggtgaggagctgcttctaggacgaaagggatggctccagtgtgtcaggcagtgcaacccaaccaggagctgggcaccaggggagagcatgtggcccgtgttccagagactctgtgttccagagactcagttttcccttcagctgtggtgctgacctccgccctgtgtggagaagctctctgtcaacagtggaggcctgtgtcagccatgggcacggggacgttcattcctgcttctctcctccctgtgggttccaatgaggcggtgtgctcgggcagggtccacaagcatctgcaccatcctgcctctcctccttgccaagctccttcaccccccgccctgaaggagcatcctgcagagcctggccaaggagcaggtgggggcacggccccccagcctggcatagtggcacccaagcctagggagggcaggatgagacctttttccttggtgctacctcacacattttctggatttcaaaaaacacaactggtgcctttgattcaattccctttcctgcttgttgtactacttcaaaccagatgggctcctcagatgaaactccggagactcagtgtctctctttaaccgctgccaggtctgtgtgtgggaaacagcagaaccagaaatattttgctaaaaccagcccatgtgggggagaggcttagcttttaatagcagtaattaaattatcttcttaattataaagggtgatggcattgtcaacatgctttatctatcagctttcaattgcacaaagtaagcacgtaatcctctcctcccggccccactggcatcctctgctctgtggccagcccaggcccccttcctgcagtgcagacccccagaagctttggggtgcatctccccatttcaccagttctgaggtgcacagggttttttgcctgcatttcaacacctctgaagttggtgttctcttattcaaagtggggggtctcagcctaactgaaggatcttggctgcacatgaaaccatggtgcagtggcagttgccagggtgctgcagttgaggcccatgtcggtgcgcccactgtggcctcgggcaacgctgggtgccagcatgttgctctgggtgactttcttgcaggtggtgactccggcttctgtctccagcccttacagtggccctgtccttccaggaccttactcttcattcacatcatttctcaggacactcctccctgcacatccctagtcttccccatctcctcttcattcctctgtcattctagcttcagttcctctcaacagtttttttgtttgttttttgagatagagtcttgctctgtcgcccaggctggagtgcagtggcacaatctcagttcactgcaacttccgcctcctgggttcaagcgattctcctgcctcagcctcccaagtaaccgggattacagatgtccgccaccacgcccggctaatttttgtctttttagtagacatgggtttcaccatgttggcctttttttctttttgagacagggtcttgctctgttgcccaggctggagtgcagtggtgtgatcatggctcactgtagcctcgaactccggggctcaagccatcctccagactcagcctcctgattagctgggactacaggcgtgtgccaccacaccctgctaatattttgtagagacatatgagtcttgctatgttgcccaggctggtcttgaactcctgcctcttgaactcttggcctcaagtgatcctttggcctcagcctcccaaattgctggcattacaagcgtgagccaccgtgcccagccctcttctcaaatagtttttttttcccctccgtttctgaattcatcctttatctcagaatatgttttccggattactcccccaagacaagctttttttcttgtgacatcatcacagaacgaagatggtgacagcagcagggccacaaaacagtccccagtctacccagttgctcatggctgtggtttggaccttcagccatgaggcagtacgtcttcccagggcagggtagggaccttcaccgcggggctgggtctcaggagctgccgggcgcccttctccagcccgcctttgtgataagggacagaatcggggtcactggcaggacacaggtccccttccctgtcgcctcaggctggtgggattcctgcacccgagtgctgctggggctgcaggcgaggcctgggctacacaggaagcccgggcaccgcagagtggccgctagctggtggcattgttcctccacggattcagagcttacgagcacgggcgttgagctgaggcaaaatacggaaacagccacttccatgcaaataatcacccttctgataacaataagtcaagtctcaagggactaagaaaaacaagcagctttattaagatgcagctgaccgatctgaaagcctgcctgctccgccacctcctgggagagcctgcagggcccgagctctggggacaagagctgctgctcaggccccagaggaaggtctaggtgggaaatgggccgccaggaggtggacaccaacacataggagcacatcccaagacacccatcaccctgtgtggtgggtgctggaaagaaacagcctagttatgagagagacttgcaactgggggcaccctagcaccccacggaggcatttccaggtggcccctccagcttggctgtgtgggcttccttggaggaccctccctccaggcggccagccagaaggggccatctccaggcaggcacccccttcaggagagcccatgcccagtcactgcctgggaagcttactgcagggctggcccccacctgccactgtcacctcctgacctccacctgctctcctgggtcctcaggcctcacacagtcctgtccttctaacaggtgactgcaggatggagccccaggcatctcggcatcctgatgcggtcactgccaggaggggagtggtctcagggtgggccagacccctggacaccagcgtggtctccttcctgagctgccgagggagatttgcctggcaaagcccacctggcccctcggccctcagccgccgagtttccctcctgcagtgggaggtttcccacgactggagggaagcagtggctattccagtagtagctgtttctcatgcacaggtctcttccccagaaagaatttgagctgcaggacagagatcctatcacatatatacccagaaggtgattcaaggtgaatattaaagacttggatatccattaggatgatgatgattttaaaaaacaaaaacagaaaacaacacgtgttggtgaggacatggagcccctggaagccgtctacactgctggtgggactgtaagatagtgcagcttctgtggggaacagtgtcatgggtccttgaaaaattatacagttgttagggagagtgaagcaggaggactgcttgaagccaggagttcaagacccgcctgggcgggcctaggcacctgtagtcccagctactcaggaggctgaggcaggaggatcgcttgagcccaggagttccaggctgcagtgagctacgatcacaccactccacgccagcctgagtgacagagcaatatcttgtctctaaaatcaattaaaattctacatagaaccgtatgttccaggaattccacttctgggaaaatacccaagagaattgaaagcagagtctcaaagagatatttctccacccatgttcatagcagcattactcaaatagcaaaaggtggaggcgagccgagcgtccaccgataagtgaacggatcaacaaaatgtggtgtgtgtgtaccgtggagtattatccagccttaaagaggaagggaattctgttacatgctacaacagggatgaaccctgaggtccttatgctccgtgaattgagccggtcacaaaggacacattttgtactgtacaattccacttgcatgaggcacctcaagtagtcagattcaagaaacagacaggagaatggggattgttagggactgggggagaggaatggggagttggcgtctagtggggacagaggttccattttgcgttcatctggaggtggacgcacagcatcgggaatacacaatgccactgaattgtgtacttcaacatggtcacaatggcacattctttattttttgtagagacagggtgtcactgtgttgcccaggctagcctcgaactcgggttcaggctctccttccacctcggcctcccaaagtgctgggattataggtgtgagccaccacacctggccaaatttgtgggttttttggtttttatgtttttgaaacagagtttctcccttgtcacctaggctggagtacagtggcgcgatcttggctcactgcaacctttacctcctgggttcaagcgattctcctgcctcagcctcccaagtagctgggattacaggcacctgccaacacacccagctaattttttctatttttagtagagacggggtttcaccatgttggccaggctggtctcgaactcctgacctcaggtgatccgcccacctcagcctcccaaagtgctgggattacaggagtgaggcgctgcgcccagccaaaatttgtgtttttaaatgtatgtttaacaatttaaaaatcctagatcatccacagtttgcaaaagccactgctatccatcttggattgaccaattccctacctgcctctaaagcggtggttttttaacaggagcagtcttgccccctggggtgtttgacagtgcctgggacactgggtgggggtgcttctggcatctggtgggtggaggtggggtatgcttttcacctcctgcaatgcacgctcggaaccacaggtccggagccatggggctgctgtggcgaggtcttcccacatggccgcaccctgtctgaaggagctagtggtggggccccgaatattctgaggccaggagctcccaagtcccacctggcatgaagcggtgccccagggccctctccgcactcctccccctgcccaagtgggcccagactccccagtgaggccgcatggcctggagtgctcgcctggagcctgaggggtctggctgctgtgaggtgggcttcgagggtggctgccaggctgtgctggagagggctgggcatcagaaggctggtgacagccttgcagggagacggagggttaccggagccatccctggaggtggcccctccaagtgctcgggccccaggcaagtcccaccggctcccgagtggaaggtgtaagccacgtgggcacaggtgggagggagttctcaccacccatggctgctagtgcccctgaaaccacctggaagtcccagcggcttccccagggacaggcagtgctgtggcccgtgtccaccccagctctggggcctgtgctcgtggctccgtgtctgcccgtggtctccctctctctcaggggtggtttctctgtccctacccaatatggtgctctatagctttccttaggatcctagctcctcaggaggaagacgtgtggccccttgctccaggaaggcccagtcctccctcactgggggtgggagggtaaggcaaaagtgccaaagtgtccatcccatgaatgcaagacacacagtgcctgctctagaagagctcatgttccagcagggacagctaacacccaggggcctgcacggggtggagggctcttcagaggcaggatcacctcggagatgggtgcaggggacctcgggccaccccagggccaggcctgcttgccctgcttaggagctgggtctcccactcagggagggaggggtcatgtctcaagggcagccactgggcctgaaaagcagaaccgcatgtgatcagtctgggtgggcaagacttcaagagagcacgcctaccctcaagggatggaagcagaggctggtagccgacgtccatgccagccaccaactcagagccagcacactacccgcatgtgcctctgccaatgagtggatgaaaagcagcgacctacagatgcaggcaacctggatgagtcttgactttatctcacggagggaaggaagcaggctcgggaggtgccgtgccgcgtggctctgtttataagctgtctgggaaaaggcaaaaccacagtacagaacacagatcagccagtgcaggcaggaagggccagcacacggggtgggaggagcttcctgggtaacgctcaatcccatacgctacagagggcgcatgttattgaacattaaggtttttttaaaaaattttaatttaatataatttaattattattatactgttttagggtacatgtgcacaacatgcaggtttgttacatatgtatacatgtgccatgttggtgtgctgcacctattaactcgtcatttagcattaggtatgtctcctaatgctatccctccccctccccctaccccacaacagtccccggagtgtgatgttccccttcctgtgtccgtgtgttctcattgttcaattcccacctatgagtgagaacatgcggtgtttggttttttgtccttgcgatagtttgctgagaatgatggtttccagtttcatccatgtccctatgaaggacatgagctcttcattttttatggctgcatagtattccatggtgtatatgtgccacattttcttaatccagtctatcgttgttggacatttgggttggttccaagtctttgctattgtgaatagtgctgcaataaacatacgtgtgcatgtgtctttatagcagcatgatttataatcctttgggtatatacccagtaatggggtggctgagttctactcttataaagagcgtgctggcctttcccatgccttctcgtctgttttgacccattctgggtatcggtccttttcgtctccccctctccatcctctctcagcccctttcactgggtttcagtgtgctgggcacaggttcagggtgtgttgttactcttaatttttttttttttttttttgagacagggtctccctctgccccccagcctggagtgcagtggtatgatcatggctcacggcagccttgacctcctaggctcaagtgatcctcttacctcaacctcccatgtagctgggaacacaggcacgcaccaccatgcccggctaatttttaagttttttgtggagatgggattttgccatgttgctcaggctggtctcgaactcctgagctcaagtgatcctcttgccttggcctctcaaagtgctgggattacaggcgtgagccaccacacccaaccaggatttattactcttaactagtaaaacagcacattcctgctcatttcaagagacaggatcttgctctgtcacccaggctggagtgcagtggcatcgtgatcaaggctcactgcagcctcaacctcccagtctcaagcaaaccttcctcctcagtctcccgaacagctaggactacaggtgtgtgccaccacacctggcttttttgatgttgttgttgttgttagagatgggggtctcactatgttgcccaggctggtcacaaactcctgagctcaagtgatcctcccgcttttgccctccaaagcactgggattataggtgtgagccactgcacctggccattgctccttatttcttttctttctttcttttcttcttcttttttttttttgagacggagtttcgttctggttgcccaggctggagtgcaatggcgtagtctcagctcactgcaaactccacctcctgggctcaagcaatcctcctgcctcagcctcccaaatagctgggattacaggcatgcgccaccatgcctggctaatttttgtattttcagtagagacggggcttcaccatgttgggcaggctgatctcaaactcctgggctcaaatgatccgcctgcctcagcctcccaaagttctgggattgtaggcatgagccaccgtgtccagcccctttgaaaccccatctctactaaaaatataaaagttagctggacgtggcggcaggtgcctgtaatcccagctacttgggaggctgaggcaggataactgcttgaacttgggaggtggaggttgcagtgagctgagattgcaccactgcactccagcctaggcaacaataagactccgtctcaaacaaataaaataaataaaagtaggtaagggggagatctggttccctgatccgacgtctttccttggggtcactgactgtgggaaaggcctgtgctgggctgaggtgggacctggtgtggctgtggaggccgtgtctgtgtctgtgtcctgtgggcggctcggctcgttgggagatgcagtcctgtcctgcccttccatgcggttcagacactggacatttgtgcagtctgatctgcaagaaaagagaggcacctctgacatggtacttcatccactctcattggatggggttgtcacccaggtggacatgtcctgaaggacaaggaagtgaaagctgagacgtctaggaacacaccagagagagaagtggagcttctgagggatgcaggtggctgtgtgaacctggggctcccctgccccgcagagtgccaacccttcaatacccagggcctggtggctgggaggaccgcaggtgaccgtctttgttgaatgctgaggccgggccatgggcacatggagttgtcgtgtttcccttcactttggttcatgtttgaaatttccaaaattaaaaaaacagtgacttgttcagtaaattccaatatgaataaagtgcatgttttgtaataaatacttctccatagagtcacactcccagttgataaatcaaaacttgttggataaaacaaagtaaatttctcctgacatttaaacattgactgtaaactcattataaacacttctaaatatttaatggaaactacaagcttaacatatctgatccaaaaatgccttaaacacctcagtacagacacccacacactatgaggatgattccctcaaactggttctgaaagcagtagctgtgcttttctctatcgcgttcttattctttctccgacgtgctcttagcaccctcctggggattagcatccgacccacatcactcgggaaaagccctggctggcggctcccaggcggaggcaccacggtgaggccaagtgctgctgtccagtaagcctgactgccccctcaggctctttcccttcacatttacttatttattttttaaatcgacatataaaattgacgtatttattgtgtaaacttcttaccacaaaaatgagaactatgtcaggtgatgtatttgctagttagctagacttaagcaggcctttagttttcagtttttaacattgagggaaaatacacgtaaatcaaatttaccatcgtagccctttgtaagtgtacatttcagtggcatgaagtccatccacatgactgtgcagccatcaccaccagccatctcagaactcttcatctcagaaaactgaaactctgtccccattaaacaagaactcctcattcccctcccctggcagccagcattctactctctgtctctgtgaatctgactactctaggcgcctcatgtaagtggaatcacacagcatttgtctttttgtggctggcttagttcactgagtgtaaggacctcaaggttcatccgtgttctagcctgtgtcggaactccctgcctttataaggctgaacactattctgttgtatgtctgtaccacgttttgttgattcattcttctgtcaatggacacttgggttgctcccacctgttggctgctgtgagtaatgccgctatgaacgtgggtatagaaatatctttgcagccctgctttcagttctcttgggtattctgccacaagaggaactgctggctcatatggtaattctatgtccaggattttgagaaatgaccacactgttttccatagctgctactccatttttacattcccaccaatagcgcacaagggttcagatttctccacacacttgttttctgtttttttttttgttttttttttttgagatggagtctcgctccgtcgcccaggctggagtgcagtggcgcgatctcggctcactgcaagctctgcctcctgggttcatgccattctcctgcctcagcctcccgagtagctaggactacaggtgcccgccaccacgcccagctaattttttgtagttttagtagagacggggttttaccatgttagccaggatggtctcgatctcctgacctcgtgatccacccgcctcagcctcccaaagtgctgggattacaggcgtgagccactgcacccggccctgttttgtttttatttttggtgtacccatcctcatgggtgtaaggcagtatctgtctcattatagttctgacttgcatttccccagaggatagtgatgctgtgcctgctggctactcatacatcttctttggagatatgtctacttaagtcatttgtctatttttttttaatttttaatttttagagacagggtctcactatgttgcccaggctggactccagctcctggattaagtgatcctcttgcctcagcctcttgaataactgggtacataccacggcacccaggatggcccatttttgaatcggcttttttgttgttgttgagttttaggagttctctatatattgtggatattaatcccttatcagatatatggtttgtaaagattttctctcagtctgtgggctgcttttttactctgttgatggtgtcttttgatgcatacaacttttaaattttcatgaagtccagtttgtctatttttttcttttgtgaaatgtgcctttcgtgtcatatccaagaatttattgctaaattcaatgtcatgaagcttttggcctatgttttcttctaagggttttatggttttaggtcttaatttaggtctttgctctattttgagtttatagggtatgaggtgggggatcaaactgcattcttttgcatttgtaaatccagttttcccaacatcatttgttaaaaagacagtcttttcccccattgaatggtcaccacattaaaaatcatttggccagccaggtgcagtggcatgtacctatagtcccagctacttgggaggcagaggtaggagaattgcttgaggccaggagttcaagaccagactgggcaacgcagtgagaccctgtttctaattgagaaaaatatcactggtttatttctaggctgtctattctattacattggtctttacatctgcctttatgccagtaccacactgttttgattactatagctttatagtaaattttgaaaccaggaagtatgaatcctccaagtttattcattttaagattgttttagctattaaggggtccttgagactccatatgaatttcaaaatggctttttctatttctacaaaaaatgtcattgggatttttgaagggaatgcattgaatctgtagactgctttgggtagtatggatatcttaacaatgttaagttttccaatccatgaacatgggatgtatttccatttatttatgttttaatttctttcagcagtgttttatagatttcagtgtacaagtctttcacctccctagttaagctaattcttaagtattttattatttttaatgctgagtctcttttgataacaaaacctcttgttatgttgaggaactctttagcccatcttttgtatttgctttcagtttgtgacactttagcatctcttcctgagatgagcgattctttgggtttcatggatgggagagcccattgcattatcctttcatttggagatattgcctggtgtgttgggacaaggaaggactaaccttccttgtcagtgtcttatcacacccgcagggctgagtgacagggtggtcctgggcaggctgcctgtggctgtgcaagctgagtgggtgcacactggactcttcccacctactgatggtgtgtgaggctgatgtgcatggattctagctccttccctgtttctggggcctcagctgtctgtgttcactctttcttgctacacaaagagaaacaaggacaagccttatttgataaaggccacaaacactttgaccttcctccacccagtgtagggatctgtttcccctctcctggactccagggctggtcacagaaggctctgggctccaacctggcttgctggacgtgctcttgaagcccccaagtaagaagtctgagtccctgagaccaccacactgcaaggacacttgaaggtactcaggttggtggtccccgctgtgcccagcccctgaatgaagccaaggctccaagcacctgagtgaagaggctgtgatggaagcgaatcctccagccctggccatcaccccgtggagtagacaaactgctcagcccagcctctcctaaattcccgacccacggagcccacgtgcccagaatggctgttatgctgctctgtttgaggtggtttattaatgtagcaagagataatggcaccaggatgaggccaaatgactcgatttctctacaccccacattttacaggtttcagagcccaagtcaggaggtcaagtgtgcatgcaagaggtggcaggggacagatgtgctgctgttcccaggccacctgcacagctggatggtggaagcagttcacttaaaggccatgagttactcgggaggctgaggcaggaggatcacttgagcctattagttggaggctgcagtaagctatgatcatgccactgcactccagcctgggtgacagagtgagacccccactgtccctggtctcttaaaagaaaaaacaaacaaacaaaccaa

SEQ ID NO: 2084 - DNA, 22843 bp, Homo sapiens
  source 1..22843: mol_type = genomic DNA
ccggcagggggagcgaggaggaagggaaccgcggccgggccaggtgagggagggaggaacacttgccgcgggccgtgctgaggcgctgcgttcgcgtgcggaacccgcgtgtgccgggctagggccatccgacgggcgcgctccctccgggctgcgggagggcacgacgggtggggtggcggcaggtgaagaggagtgtgggcgggtggcggggtggcggggcggcggagcgcggcggggcggtgccctaggcgggagggagggtcggaggagccctatcctgctgcgcgatggaggcggtggaggcggcggctccggctggaggctgggacggcctcgcgcttcgagggcttccgggcccctttagccgagggctcctggagggtcccagcgttgagcaacggggtccgggggtccgaaatcaagcgagtgagtataggcagccggtggggtagggtcggccaacagagccggctgggtggggcccctcacctcttcccgtcgcccttctggttgaccagggtttcctccaccctgacggcctcttctctgctgtggcaagctggccgcccctgcctgcctgcaggtcctgctcaggcacgaaggggttaatgggggctggaagggctctgctcctccctacaaacctcaggcacagaggtctggggacctctggaccgatccttgagcggctgacccagagtctccaggaggccccagggtttttcactttcacttctccctcctcaatgttggcctcacccacaggccccacatctggccagtgccctgaggtgtgtgcagatgtacacaggacacaagcttgggcataccctcaggctggggcacatgcaggagccccacccccatgcccccaccgactggcccaggcctctctgggtgcagactgccaacacaggcacgtctcctgcaacactaccaaatctgcggccaccagcatccctaccacccgcctccacgggactgtccttcctgcaggagcagctcctggggacaatggctggtcctgctcagagaggaaggaaaggggcctggaaccagctggtccatccccacacagcactcctcactggacttgtccctgggtcccctcagtgacactgagagacataagtcattgtcactgtcatggcccagaatgactactcagggcaagaaaaatgcactaaggacagcttcccttttctgacatggcccacaaagctccagctgcaggcggcaggggttgtggggggcaggacatgaggcaccccatacaggcagcaacacacaccacatcccagacaggcagcactattcgtatactcacccactgcggccctggactcacatgcgttcctgaacctcaggcccagggccagcctccccactggcgcccagccccccagcccgttactgggccttcccagttcccagccagcatcctctccagcccagggtctgaggtcctgagatcctaaaaaccctgggagaggttgcctgcctcccactcccatcctgagcatgcacaagcgaaggctgcaatgaggttgtatacagagaggccttgcaaacagtggccctgaccaccagcaccagggaggctccagcaaggcacagaggctccagcaaggcacagaggcacagagctgaggttgacacccagctggagaggccctgtacaggaaagccatgggtgcgctgaactggttagaggagaccctggagacagtaggtggggaaacgcacaggccaagtcaggccttggcgtctgggatgcctgggcctagaaaccaggcagagcggcgggcctcggcctcactctgcccagcctggtcgggccatagagcttctcccggcaggcaggctggctgctgggtgccggggggcagcatacgacccagtggcctgaagttctccaacatgtcctcgtgtcctcggctccctcggctggccaggctccgcccccggccctccctgcgcccggccggtgcgcagggaggtcggaggagcgggcactgcccaccctccggatgtataagcgtcctggccagaggcgggcggtgcgcgcaagtgcgcgtgacgctcgggctcgcgggctgcgcagcctgggcagcgtccctctgctggggtctccagcgacgatagtgagccaacttcagggggctgttgggcatttactgggctgggtcctgtcctgctgcgccaaggaacagaggacgctgcggccctggggctcctgtcagtggccggtgcgagagcccaagctgccctctcctcacccaggtgcaggggcagccagggaggaggtggaggcgggaggggccaagggcaggggcagggctgggctccggcagccactcgctgcttcatgggtgccctgccacctcgggctagggctgggtgctgctggcatagacacctctcctcggggggctgtagaagctgacggtggcttcgctgcacagagaaaggccgtgccttggcaggagcaacgggatgttcaaggggcgttggtcatggaggtccctgggaatggaggaagggggcagggagcttggaaagcaagagggccctgcacttccagggtgctccacccgtctgggcccctcggctgctaccagccccaagtggggggcccatgacgccataatcctctgggccaggggcccctggcagtgagtggcaccacaggcccccgcccccggactccgtgggctgggctgggctgggcgcggtgcggctgggcacacgcagtcggaggcggcgccggccaggccgccgggcgcctatggacgcgcggagcccgctgtctccccgagccagtgcgttcagcatcgcctctctggttgcagcggaggcggcggagcgcaccgcccaccagggctcagggtcctccgaccgggtgaagcttcgctggctgccaggatccccggcagggatgcacttcagcaccgtcaccagggacatggaaggtgagcctccaggccgtgtctacactggcccgcccgccagaccccctgcctcagctgctgtggggcccgggtgcaaagtaggtggaggcagctcttggtagcgtgggctccaggcttctggctgcgattctggggcagagaggaagagccggcatcccgcccacagcctgtcccctcaccagcctgggggcccagcttggagatgggcactcaggtatacacaggcccggaagagggcgagtgaggctgggaaggagagcagaggtggccgtgagcctggagaggggggaggaaagttaataagagaggagagagcgggagagtttcacagaaggagagaaagcctcgaggaagccgtggagacgaaattgagcaaaggggagaaaacacaaaaaacccaaagaagaaggtaggggagaaacagaaggacacgaaaaggcaataaaaagcaagagcgaaagagaagagagaaaacgaagggaaaatttaagacagaaagcgaagtcataaaaaagaaaaaaaggaaagactttagtttttttttttttaaaaagaaaaacataaaaaacaaaggacatacaaaaataagaggaaaggcaccgactaaaagaaagacaaagaatgattaaaaataaagtgaaaaggaaggcgaggatggaggaaaaggggaagaggcggaaagtaaaacagaaataaagagaaactacagagataggggaagaaaaaagatgatcgggagggaaaatttaaatgaggacgacaaaggtaaaataacaaattaggaaaagaacgtctgggagagagagaggagaaacgcacgcgggcgggcggcagagcgagggccggccgacgggcccggcgcaccggtgagccggtccgggcggtcggggggccccgggccgagcgagccgcggcgggcgggctgggggccggggagggggaaggggcgggggaggggcgagggccgggggagggatctagtccattgtctccgcgcgggggtgggggggccccgggcggggcggggcggggcgcctcctcggggccggcctgcggtgtggggctgcacggcccggggcgcacgcagcgcggcgcccgccactcggcccgcggcgcggggcagcgctcagcttggtggcgggggcggcggcggcggcccgcgggtcatgatctccgccgtgtccagcccgtggctcacgcagctctcgcatttctgcgacgttgcagccttcacggccagcagcctgagcagcctgggggccgcggggggcttcccgggcgccgcgtcgcccggcgccgacccgtacggcccgcgcgagcccccgccgccgccgccgcgctacgacccgtgcgccgccgccgcccccggcgccccgggcccgccgccgccgccgcacgcctacccgtttgcgccggccgccggggccgccaccagcgccgccgccgagcccgagggccccggggccagctgcgcggccgcagccaaggcgccggtgaagaagaacgcgaaggtggccggtgtgagcgtgcagctagagatgaaggcgctgtgggacgagttcaaccagctgggcaccgagatgatcgtcaccaaggccggcaggtcagggcgcccctccccacgccgcgaccctccccacgtgctgccgccagggctgcgggcctccgcctgatccgcgcgagcggggccgaaagccgggtcgggggcgcggcctggccacctgcgggcccctctgggccccgctgcctccttcgctgttcgccgtcccggctccggcgacagccgcccggcgctcccctcctaacacctatcctccgccggggcgggaggagacggcgcgggccgcacgggaacggcgaggagccccgcgggactcgcccgcccgccccgcagccccaggacgccgcgcggcccagaaaccggcccggcttggggcgcacccggctgggggcaggcagcggcgtccagggggcctcaccgcccggccgactcctagtaaatcccacctcaagaaaactctggttcagttctggagttcagtctatgcgggcaagataaagagcggcagccgggcaactctctggacactttcaggagaggattacccttaaaaacagcgtgcactgttgcgtggaagttgctacccagtttccttcaacctagatccctatagttgtggggcctggctctgtatccagcggcccgtcacctcccaaccggcctgtatttgttttaaagaccaagagacaaggggaacaagttttgcagatgcacccgatttgaccggtagacaaaggcgggtgccgcgctgtgtctaatgtacacaccagctcggagtccgaacagccaaggggagctcagggcctgtttgcaaagccttctcgtggtttctgtttccctgctgccggcgtcctttctgaggaacctgggcctgtgctctgctccagctctgtggtttttttccaggccctccttgctgtccccaggcacacaggccctcctgaggacagcggcagcccagccgctggctcaggccagcccggcaagggccttgtcggcgctgggcttcacccgggagcccacgtcccgcagcaccctccagcctgcagaggcttcgggtgggggagggagcgggcctgtcctagaggctggctcctggcatctgtcttctgcccaccgcctgcagggagttgcttgtgaggggaggcagaggggacggcaagtgagggccaatccttgtgttgtcctgaagggccccacggccactactgctgtgccatcatgtgggggtagcccatggcctacacccgtccaggcactgcagaatgtcctttcaagagccctgactggtcactgagccagggtccaaagcgggggagatttgaggaacaggaaagacacaaactgagtacactctgggtagctgcgtcttggggttatgtgtcttaaggggagtggaagcttgccctgtgccctgaggaaggtggggagactcttatcatggggccatgatagagaggggccctgagagtcaggggagggagggctctgagccttggcctcactgaggggattgggtaacagccgaagacccagctaaaagggcagcggggacgccttgaactcacacaggactacccggtttcactttgttggagccgggagctgcttcgatcaagctggggaggctctgctaagggcgcacgttaggcaccctgctgccggccgaagctgggaccaagaggccaaaaagtcagcaagggcgaggccgagtttatgtaggccaaggttgccgaaggtgggggctccagcgctgggctggccatttctgtgtccaggaacggcccaggaggctcccctgctgcgccaagctcccagttgagtaggggcctgcccagattagagcagctaagccaggaaagatggagcccaagggctgggacgacacagcagcccccagaggctggagggaggggccgagcagaggggccgccagccccaggcaggtcaaggggggctgccttccaccagctagggtgacccaaggcctcatcacccccaggcggatgtttcccaccttccaagtgaagctcttcggcatggatcccatggccgactatatgctgctcatggacttcgtgccggtggacgataagcgctaccggtgagcgagtggttgtaagcgtgagggaccgggagggcaccctggaaagtggcgggtctccgcctggtgacccaactccaagggtcgtctgcaccatgaaactctttaggcacctgcgatgctgcccgatcaacccgctccctcctccactcccatctgaccccagacccacaaccctactccatgccctctcagaacccgcctctggagccgcaggctgcagacagctcttgctcccctgggctggtgtggccctagggtggtcagccaagtactcagccccggacttcttcaagtctccctctcccaggaggccggcctgagcgcctagtccccttcccccatccccagggaactctggatcctggagctgggccggaaaggtggggtggccaggagagattatgcagggcgggcctcagctgcccggacaattaacagcaattaataaagagaacgcgcactgccctgtgcctgaggcccggcaaggccaagtgtgggctcccaccgcagcggcaccggggcgggaggacccgcatccagcgaaatgagatggcaggagcccagcctccccctctcggtgccccacagggtgtccagttccttgattgttttgagtgttggggtgggtgggagttctctgtttagtccatagtcccccttggaaaagctcccagcacatgcggcagcagagggttcaatctcacaggtggggaaacttctcaaaggcacttttagggttcgcccagcacacgggtcaaggccctctgggttcacctccacatgcacgaccccaccccgtgccgctccaggtacgccttccacagctcctcctggctggtggcggggaaggccgaccctgccacgccaggccgcgtgcactaccacccggactcgcctgccaagggcgcgcagtggatgaagcaaatcgtgtccttcgacaagctcaagctgaccaacaacctactggacgacaacggccacgtgagcgactgcctccccaggctccggtgtcccccaaggcctcgagtcccgaggcacccgcctgtccctaagaggcctgtagaatccccaggcccccggctgtccccaggcggctctgggctgtccccgaggaggccctttagagtccctgcgaggctagaggctgaggcggagcttgggcagtgctggtgtgccgatgaggagagcggcctctggtcaggggtcgcacagcctagtgggcctgggccctgggagaggggtcgccctccttctctcaccccactcctgattttatgcaggaagcttttttaatggaaaagatggggccctgcaagggggctggagaaagaggctttatggagtccaggccagtgaggtcgctgggcaggcacctaaggaaagagaacctaaacccagatcttttgccacttggagctcattcctggcagttgccaatgggtcacagcctcctcttggcccagtgacccagcctcatcttggaattaagggttttgcccaactcatccaggaaactcattgccaactcagacctcagcccatttcctggctcccaccccagatcctcagcccagccccaccgctggagctgattccccaccttgtcttccagattattctgaattccatgcacagataccagccccgcttccacgtggtctatgtggacccacgcaaagatagcgagaaatatgccgaggagaacttcaaaacctttgtgttcgaggagacacgattcaccgcggtcactgcctaccagaaccatcgggtgagggcctgtggggaggacctgagcggattcaacgcctctggaaaagcgggtgtaattttcagttgccgtttggggacagtgggtccgcttagacctgcaggctgtggtcccagtggagcccaacccaactggagccccactcccaagggcctcaggcagccccctccctctcgaggctggccggcccagcctcctatcagcttgacctctccagcggcaactgtcacttcgtcctgaaagtttgttttccgaaccattccggaaactccccatcaggggcctgatctgaggtttacccagattactagggaacccgctctgttccccaccccccaccccactgcacgtggggggtggtgaccacattcctgtcccagcgaggagcacagggcctccatccccacccacctgggggacaccagagaggggttccctagtgagagaggaggttcctcagacccccgcccccctgcaggagggagcaccagctccgtagaggaggggcagacgtggactggttcttgtcagggcagcagaaaggcccttggtgcgcttctcctaacactcccctatcctccgccgaggtcgggtggcccaggctgcagggctccagcggcttgctcacacccacctccctgcagatcacgcagctcaagattgccagcaatcccttcgcgaaaggcttccgggactgtgaccctgaggactggtgagtgtcctcccccgagagagtgagcgccgggcgcctggcgcaggcgccgccctgatccgcctcccgcccgcaggccccggaaccaccggcccggcgcactgccgctcatgagcgccttcgcgcgctcgcggaaccccgtggcttccccgacgcagcccagcggcacggagaaaggtagggccggggtcgtgggatccgggttccggccctgtgcgcgctctaccccgggccggcggcctcgcccgacctcgcctgcgcccccggggcgctccaggctttcgcgccggttgcacaacggccgcggcggcgggcaagcgcgcactcgcccgcccggcccgacggctgcgccccgcccgccgccgccgccgcccgcagaggggcgcgggccccggggagggctcggggcgccggcgacttggggtctcgggcacgctggcaccgactggtcggggaacaccgagggcggccaagagccttctctccgccagggcctcgcatggggcgtcggagctcctcggcggccccggccggccgcgctcactcctcggccctctccgcagacgcggctgaggcccggcgagaattccagcgcgacgcgggcgggccagcagtgctcggggacccggcgcatcctccgcagctgctggcccgggtgctaagcccctcgctgcccggggccggcggcgccggcggcttagtcccgctgcccggcgcgcccggaggccggcccagtcccccgaaccccgagctgcgcctggaggcgcccggcgcatcggagccgctgcaccaccacccctacaaatatccggccgccgcctacgaccactatctcggggccaagagccggccggcgccctacccgctgcccggcctgcgtggccacggctaccacccgcacgcgcatccgcaccaccaccaccaccccgtgagtccagccgccgcggccgccgccgccgctgccgcagctgccgcggccgccaacatgtactcgtcggccggagccgcgccgcccggctcctacgactattgccccagataacacgggccctgtcgcgctcccgccccggtcctgcacagccccgaagttcgccgggcccggccaccctgccccaagggcaagcaaggaatacgttcccccagccccaggggccaccgcggctctccccttccccagcctcgaagccatgggggccccctcgccacccccagccccttgggctatcgaagtatccggttccccagtccctggagccaccgcgggtccttccccggccccgagggccaagggggtccccgcccgccagtgccaaagcgcccggtcggaggcggaaggaagtgatatttattgttctccccgagaccgcgtcgcccgcggcccggccggcagttgcagtgtagacagcccgagagccccgcctgcaggcggtgtagatacatgtagatactgtagatactgtagataccgccccggcgccgacttgataaacggtttcgcctcttttggaagccgcctgcgtgtccatttatttgtgcccagttagatcgcgttgggaatcttcgggacagcgagcccggggtagctcagggccctcagggcctccccagccccaatccctgccgactgtaggtcggtcccggtcccacagcgccctgtccgccacgcctcctgccctctgcccgccccataggggctcccactgcccctcccctctccgaggcccctcctgccaggcctgtgcactccccccaccttcccaccgtcccgtctcatcccaacctccccagggctggtggtaccgcccaggtgtgcatcctgcctttttacttaaattcctcccacctgcagttgtccctattctgggacttgggcctgcgccctggcctgttttcgggacagatgcttgtgcttttccatggaagctgggaagaagggtcatgacagacactgccggtcggtgctgggagggggagaagcccctgaccgggatggggtcatggaaagacaaaaacaggcagcactgttctgctagcatttcccctgccggcctagcccaggcccgcatgttccctccttagtgactttatttgctgtgagtgtccctacggagtgacctggccagggggcacaatgacagtagccatgagtcatcttgagacctgtgtatgaagcatttttcccaggccaggtggctaagggacctctccccgttaactcaacaccagggatggggcgagaggaactctttgatccctcccttcctgagcgcaagcaggaagggctgacagccggtcagcgccaaggctgctgacttggacacaagatgaacgggaagtgcacgtggccgaggctctgtcccccacctcccgtgcctgtcccagtgtgtttgtggcaactgctgccttctaggccactcggctcatcaccccacgtggtagcggcagcctgagtgccacctctccgagggcacagccaggagtttccagatgtccaccctcgcggacctgtttttcgtatacatgtttgctctggcggcgtgaagtgagtggggtcttagtaattgaatggcaggaaccattcccagaggccagtctagggtgggagggggtctccaggggccatccaaagcctcaaagggcatctagcaccagagagtgaggacctctgcagcatctgcccaggctccgtgagcacggctttggagatgcatttggggggacggctgtggatgcccattcccaagtcctgatccccacctgcgtgaacttggggcagccattacccatgtgccccacggtgggtggggctttgcactgcagagggcctccctctcttgctgtcagaaggcagccattccgtactccacatccaggatgtgcggaggggctgccattcgagacctccgccttggttttgttcagagctaaagggaggaaaagccctcccctgaacaaagagcaaacacagtgtttgtaaatgagggtgggacacacagcaatgtgcaaggaccctgagtgtgcagcaaactggcctgttaccgtgcccctcctgttgggatggccatgcaagatggagcacccagccgtccagcagggccgccgctggccatccggggctgttcgcattctttttttttttttttttttttttttgagactgagtcgcgctctgtcgcccaggccggaatgccgtggtgcgatctcggctcactgcaacctccgcctcctgggttcaagtgatttcttttgcttcagcctcagagtagctgggactacaggaatgtaccaccatgcccggctaatttttgtatttttagtagagacggggtttcaccatgttggccaggctggtctcgaactcctgacctcaggtgacccgcctgccttggtcttccaaaatgctgggctttcaggcatgagccatcacactcggccacacgtcctaatgaactaggattcattaaacattcaggtcctcactggccccattccaggtgctccgtggctcacaggccgcgggtcaccacactgctgctgttgctgctgagggcactcccacgctgggcagtggcccccagaagtgtgggtttcctcccctccacctttgtagatgagtttgtgcatctgagaacttcttgtaaatgagagctcgcaggccggcgtctgggtggcagcttccgctggctgtgtgtctgcaagactggcgcacgccgctgctcaccgtccctcatgtgctcagtcctcaaccagtgcccagtgattgcctgcccgctgcgggggctgtctggctgatgccccagccactaccgttcctgtggaggtgacgttcccatgggcagctgccctaaggcctggcttccagcagcttcctctgtgacagctgtgatctgaacgttcacccccaaggtgatggtggcaggagatggagcctttaggcggtgattaggtcacgagcgtggagtcctcatgagtgggattagttgagtgctatgctgctcacagacctccagcctccagaactgggagaaataactgtccattgttgataagccaccgggcctatggtcatttgtcctagctgcactactggactgacagtggccgttcttccatctccttcttgttccctgttttaggttccccgttgagcacacctgccctgccccttctgtaagctgctgtgatgggcagtatggtgtaggggatagggggctcgtcccaccgctgttcccccacaggctccccctcagctgttggacttcccccaaacatcctcctccaggttccctagctggtccagaggccccgttgccctcccctagcctggctgcagacgtccagctgccaggactcaggaggacgagagaccagaagggcccccagactcctcactcccaaaaactctccaaaaacaacagatgcacaacgcaggaaatagatagattcttgactaagcgggggtggggaccatccacacccccttcacaccactgcatcccacggaagggttctaggaccccagggcctgggggtgcagctggacgatcctgcagtagccccgctccctgttttcagaagacccccccacggctgccctctgcagcatgtgcccctttgtcgaagggacaatgggcactccattgcccagagaggcttctcacccaggaaagcactggaggtgcagaggcaggagcacgcgggggcttggctgcgggacaaggcgagtctgtttggtggcaccttgagctgcggaggaagacaagaccctggcccggtggagatgagaccctggcctggtgggcttcaggccccaccctgcggcgcaccctccagctggggaagtccatggggtgtgtgggatccatgcgatgacagttgtatgaggctgaggccctgatctccaggtgtgccgcagatcaaagcacccgcataccagagaattccacgtagccacagttgccaagggcagaggcagcctcacctctcactggtggagggagagtgatgggtgaggagctgcttctaggacgaaagggatggctccagtgtgtcaggcagtgcaacccaaccaggagctgggcaccaggggagagcatgtggcccgtgttccagagactctgtgttccagagactcagttttcccttcagctgtggtgctgacctccgccctgtgtggagaagctctctgtcaacagtggaggcctgtgtcagccatgggcacggggacgttcattcctgcttctctcctccctgtgggttccaatgaggcggtgtgctcgggcagggtccacaagcatctgcaccatcctgcctctcctccttgccaagctccttcaccccccgccctgaaggagcatcctgcagagcctggccaaggagcaggtgggggcacggccccccagcctggcatagtggcacccaagcctagggagggcaggatgagacctttttccttggtgctacctcacacattttctggatttcaaaaaacacaactggtgcctttgattcaattccctttcctgcttgttgtactacttcaaaccagatgggctcctcagatgaaactccggagactcagtgtctctctttaaccgctgccaggtctgtgtgtgggaaacagcagaaccagaaatattttgctaaaaccagcccatgtgggggagaggcttagcttttaatagcagtaattaaattatcttcttaattataaagggtgatggcattgtcaacatgctttatctatcagctttcaattgcacaaagtaagcacgtaatcctctcctcccggccccactggcatcctctgctctgtggccagcccaggcccccttcctgcagtgcagacccccagaagctttggggtgcatctccccatttcaccagttctgaggtgcacagggttttttgcctgcatttcaacacctctgaagttggtgttctcttattcaaagtggggggtctcagcctaactgaaggatcttggctgcacatgaaaccatggtgcagtggcagttgccagggtgctgcagttgaggcccatgtcggtgcgcccactgtggcctcgggcaacgctgggtgccagcatgttgctctgggtgactttcttgcaggtggtgactccggcttctgtctccagcccttacagtggccctgtccttccaggaccttactcttcattcacatcatttctcaggacactcctccctgcacatccctagtcttccccatctcctcttcattcctctgtcattctagcttcagttcctctcaacagtttttttgtttgttttttgagatagagtcttgctctgtcgcccaggctggagtgcagtggcacaatctcagttcactgcaacttccgcctcctgggttcaagcgattctcctgcctcagcctcccaagtaaccgggattacagatgtccgccaccacgcccggctaatttttgtctttttagtagacatgggtttcaccatgttggcctttttttctttttgagacagggtcttgctctgttgcccaggctggagtgcagtggtgtgatcatggctcactgtagcctcgaactccggggctcaagccatcctccagactcagcctcctgattagctgggactacaggcgtgtgccaccacaccctgctaatattttgtagagacatatgagtcttgctatgttgcccaggctggtcttgaactcctgcctcttgaactcttggcctcaagtgatcctttggcctcagcctcccaaattgctggcattacaagcgtgagccaccgtgcccagccctcttctcaaatagtttttttttcccctccgtttctgaattcatcctttatctcagaatatgttttccggattactcccccaagacaagctttttttcttgtgacatcatcacagaacgaagatggtgacagcagcagggccacaaaacagtccccagtctacccagttgctcatggctgtggtttggaccttcagccatgaggcagtacgtcttcccagggcagggtagggaccttcaccgcggggctgggtctcaggagctgccgggcgcccttctccagcccgcctttgtgataagggacagaatcggggtcactggcaggacacaggtccccttccctgtcgcctcaggctggtgggattcctgcacccgagtgctgctggggctgcaggcgaggcctgggctacacaggaagcccgggcaccgcagagtggccgctagctggtggcattgttcctccacggattcagagcttacgagcacgggcgttgagctgaggcaaaatacggaaacagccacttccatgcaaataatcacccttctgataacaataagtcaagtctcaagggactaagaaaaacaagcagctttattaagatgcagctgaccgatctgaaagcctgcctgctccgccacctcctgggagagcctgcagggcccgagctctggggacaagagctgctgctcaggccccagaggaaggtctaggtgggaaatgggccgccaggaggtggacaccaacacataggagcacatcccaagacacccatcaccctgtgtggtgggtgctggaaagaaacagcctagttatgagagagacttgcaactgggggcaccctagcaccccacggaggcatttccaggtggcccctccagcttggctgtgtgggcttccttggaggaccctccctccaggcggccagccagaaggggccatctccaggcaggcacccccttcaggagagcccatgcccagtcactgcctgggaagcttactgcagggctggcccccacctgccactgtcacctcctgacctccacctgctctcctgggtcctcaggcctcacacagtcctgtccttctaacaggtgactgcaggatggagccccaggcatctcggcatcctgatgcggtcactgccaggaggggagtggtctcagggtgggccagacccctggacaccagcgtggtctccttcctgagctgccgagggagatttgcctggcaaagcccacctggcccctcggccctcagccgccgagtttccctcctgcagtgggaggtttcccacgactggagggaagcagtggctattccagtagtagctgtttctcatgcacaggtctcttccccagaaagaatttgagctgcaggacagagatcctatcacatatatacccagaaggtgattcaaggtgaatattaaagacttggatatccattaggatgatgatgattttaaaaaacaaaaacagaaaacaacacgtgttggtgaggacatggagcccctggaagccgtctacactgctggtgggactgtaagatagtgcagcttctgtggggaacagtgtcatgggtccttgaaaaattatacagttgttagggagagtgaagcaggaggactgcttgaagccaggagttcaagacccgcctgggcgggcctaggcacctgtagtcccagctactcaggaggctgaggcaggaggatcgcttgagcccaggagttccaggctgcagtgagctacgatcacaccactccacgccagcctgagtgacagagcaatatcttgtctctaaaatcaattaaaattctacatagaaccgtatgttccaggaattccacttctgggaaaatacccaagagaattgaaagcagagtctcaaagagatatttctccacccatgttcatagcagcattactcaaatagcaaaaggtggaggcgagccgagcgtccaccgataagtgaacggatcaacaaaatgtggtgtgtgtgtaccgtggagtattatccagccttaaagaggaagggaattctgttacatgctacaacagggatgaaccctgaggtccttatgctccgtgaattgagccggtcacaaaggacacattttgtactgtacaattccacttgcatgaggcacctcaagtagtcagattcaagaaacagacaggagaatggggattgttagggactgggggagaggaatggggagttggcgtctagtggggacagaggttccattttgcgttcatctggaggtggacgcacagcatcgggaatacacaatgccactgaattgtgtacttcaacatggtcacaatggcacattctttattttttgtagagacagggtgtcactgtgttgcccaggctagcctcgaactcgggttcaggctctccttccacctcggcctcccaaagtgctgggattataggtgtgagccaccacacctggccaaatttgtgggttttttggtttttatgtttttgaaacagagtttctcccttgtcacctaggctggagtacagtggcgcgatcttggctcactgcaacctttacctcctgggttcaagcgattctcctgcctcagcctcccaagtagctgggattacaggcacctgccaacacacccagctaattttttctatttttagtagagacggggtttcaccatgttggccaggctggtctcgaactcctgacctcaggtgatccgcccacctcagcctcccaaagtgctgggattacaggagtgaggcgctgcgcccagccaaaatttgtgtttttaaatgtatgtttaacaatttaaaaatcctagatcatccacagtttgcaaaagccactgctatccatcttggattgaccaattccctacctgcctctaaagcggtggttttttaacaggagcagtcttgccccctggggtgtttgacagtgcctgggacactgggtgggggtgcttctggcatctggtgggtggaggtggggtatgcttttcacctcctgcaatgcacgctcggaaccacaggtccggagccatggggctgctgtggcgaggtcttcccacatggccgcaccctgtctgaaggagctagtggtggggccccgaatattctgaggccaggagctcccaagtcccacctggcatgaagcggtgccccagggccctctccgcactcctccccctgcccaagtgggcccagactccccagtgaggccgcatggcctggagtgctcgcctggagcctgaggggtctggctgctgtgaggtgggcttcgagggtggctgccaggctgtgctggagagggctgggcatcagaaggctggtgacagccttgcagggagacggagggttaccggagccatccctggaggtggcccctccaagtgctcgggccccaggcaagtcccaccggctcccgagtggaaggtgtaagccacgtgggcacaggtgggagggagttctcaccacccatggctgctagtgcccctgaaaccacctggaagtcccagcggcttccccagggacaggcagtgctgtggcccgtgtccaccccagctctggggcctgtgctcgtggctccgtgtctgcccgtggtctccctctctctcaggggtggtttctctgtccctacccaatatggtgctctatagctttccttaggatcctagctcctcaggaggaagacgtgtggccccttgctccaggaaggcccagtcctccctcactgggggtgggagggtaaggcaaaagtgccaaagtgtccatcccatgaatgcaagacacacagtgcctgctctagaagagctcatgttccagcagggacagctaacacccaggggcctgcacggggtggagggctcttcagaggcaggatcacctcggagatgggtgcaggggacctcgggccaccccagggccaggcctgcttgccctgcttaggagctgggtctcccactcagggagggaggggtcatgtctcaagggcagccactgggcctgaaaagcagaaccgcatgtgatcagtctgggtgggcaagacttcaagagagcacgcctaccctcaagggatggaagcagaggctggtagccgacgtccatgccagccaccaactcagagccagcacactacccgcatgtgcctctgccaatgagtggatgaaaagcagcgacctacagatgcaggcaacctggatgagtcttgactttatctcacggagggaaggaagcaggctcgggaggtgccgtgccgcgtggctctgtttataagctgtctgggaaaaggcaaaaccacagtacagaacacagatcagccagtgcaggcaggaagggccagcacacggggtgggaggagcttcctgggtaacgctcaatcccatacgctacagagggcgcatgttattgaacattaaggtttttttaaaaaattttaatttaatataatttaattattattatactgttttagggtacatgtgcacaacatgcaggtttgttacatatgtatacatgtgccatgttggtgtgctgcacctattaactcgtcatttagcattaggtatgtctcctaatgctatccctccccctccccctaccccacaacagtccccggagtgtgatgttccccttcctgtgtccgtgtgttctcattgttcaattcccacctatgagtgagaacatgcggtgtttggttttttgtccttgcgatagtttgctgagaatgatggtttccagtttcatccatgtccctatgaaggacatgagctcttcattttttatggctgcatagtattccatggtgtatatgtgccacattttcttaatccagtctatcgttgttggacatttgggttggttccaagtctttgctattgtgaatagtgctgcaataaacatacgtgtgcatgtgtctttatagcagcatgatttataatcctttgggtatatacccagtaatggggtggctgagttctactcttataaagagcgtgctggcctttcccatgccttctcgtctgttttgacccattctgggtatcggtccttttcgtctccccctctccatcctctctcagcccctttcactgggtttcagtgtgctgggcacaggttcagggtgtgttgttactcttaatttttttttttttttttttgagacagggtctccctctgccccccagcctggagtgcagtggtatgatcatggctcacggcagccttgacctcctaggctcaagtgatcctcttacctcaacctcccatgtagctgggaacacaggcacgcaccaccatgcccggctaatttttaagttttttgtggagatgggattttgccatgttgctcaggctggtctcgaactcctgagctcaagtgatcctcttgccttggcctctcaaagtgctgggattacaggcgtgagccaccacacccaaccaggatttattactcttaactagtaaaacagcacattcctgctcatttcaagagacaggatcttgctctgtcacccaggctggagtgcagtggcatcgtgatcaaggctcactgcagcctcaacctcccagtctcaagcaaaccttcctcctcagtctcccgaacagctaggactacaggtgtgtgccaccacacctggcttttttgatgttgttgttgttgttagagatgggggtctcactatgttgcccaggctggtcacaaactcctgagctcaagtgatcctcccgcttttgccctccaaagcactgggattataggtgtgagccactgcacctggccattgctccttatttcttttctttctttcttttcttcttcttttttttttttgagacggagtttcgttctggttgcccaggctggagtgcaatggcgtagtctcagctcactgcaaactccacctcctgggctcaagcaatcctcctgcctcagcctcccaaatagctgggattacaggcatgcgccaccatgcctggctaatttttgtattttcagtagagacggggcttcaccatgttgggcaggctgatctcaaactcctgggctcaaatgatccgcctgcctcagcctcccaaagttctgggattgtaggcatgagccaccgtgtccagcccctttgaaaccccatctctactaaaaatataaaagttagctggacgtggcggcaggtgcctgtaatcccagctacttgggaggctgaggcaggataactgcttgaacttgggaggtggaggttgcagtgagctgagattgcaccactgcactccagcctaggcaacaataagactccgtctcaaacaaataaaataaataaaagtaggtaagggggagatctggttccctgatccgacgtctttccttggggtcactgactgtgggaaaggcctgtgctgggctgaggtgggacctggtgtggctgtggaggccgtgtctgtgtctgtgtcctgtgggcggctcggctcgttgggagatgcagtcctgtcctgcccttccatgcggttcagacactggacatttgtgcagtctgatctgcaagaaaagagaggcacctctgacatggtacttcatccactctcattggatggggttgtcacccaggtggacatgtcctgaaggacaaggaagtgaaagctgagacgtctaggaacacaccagagagagaagtggagcttctgagggatgcaggtggctgtgtgaacctggggctcccctgccccgcagagtgccaacccttcaatacccagggcctggtggctgggaggaccgcaggtgaccgtctttgttgaatgctgaggccgggccatgggcacatggagttgtcgtgtttcccttcactttggttcatgtttgaaatttccaaaattaaaaaaacagtgacttgttcagtaaattccaatatgaataaagtgcatgttttgtaataa

SEQ ID NO: 2085 - DNA, 10630 bp, Homo sapiens
  source 1..10630: mol_type = genomic DNA
ccggcagggggagcgaggaggaagggaaccgcggccgggccaggtgagggagggaggaacacttgccgcgggccgtgctgaggcgctgcgttcgcgtgcggaacccgcgtgtgccgggctagggccatccgacgggcgcgctccctccgggctgcgggagggcacgacgggtggggtggcggcaggtgaagaggagtgtgggcgggtggcggggtggcggggcggcggagcgcggcggggcggtgccctaggcgggagggagggtcggaggagccctatcctgctgcgcgatggaggcggtggaggcggcggctccggctggaggctgggacggcctcgcgcttcgagggcttccgggcccctttagccgagggctcctggagggtcccagcgttgagcaacggggtccgggggtccgaaatcaagcgagtgagtataggcagccggtggggtagggtcggccaacagagccggctgggtggggcccctcacctcttcccgtcgcccttctggttgaccagggtttcctccaccctgacggcctcttctctgctgtggcaagctggccgcccctgcctgcctgcaggtcctgctcaggcacgaaggggttaatgggggctggaagggctctgctcctccctacaaacctcaggcacagaggtctggggacctctggaccgatccttgagcggctgacccagagtctccaggaggccccagggtttttcactttcacttctccctcctcaatgttggcctcacccacaggccccacatctggccagtgccctgaggtgtgtgcagatgtacacaggacacaagcttgggcataccctcaggctggggcacatgcaggagccccacccccatgcccccaccgactggcccaggcctctctgggtgcagactgccaacacaggcacgtctcctgcaacactaccaaatctgcggccaccagcatccctaccacccgcctccacgggactgtccttcctgcaggagcagctcctggggacaatggctggtcctgctcagagaggaaggaaaggggcctggaaccagctggtccatccccacacagcactcctcactggacttgtccctgggtcccctcagtgacactgagagacataagtcattgtcactgtcatggcccagaatgactactcagggcaagaaaaatgcactaaggacagcttcccttttctgacatggcccacaaagctccagctgcaggcggcaggggttgtggggggcaggacatgaggcaccccatacaggcagcaacacacaccacatcccagacaggcagcactattcgtatactcacccactgcggccctggactcacatgcgttcctgaacctcaggcccagggccagcctccccactggcgcccagccccccagcccgttactgggccttcccagttcccagccagcatcctctccagcccagggtctgaggtcctgagatcctaaaaaccctgggagaggttgcctgcctcccactcccatcctgagcatgcacaagcgaaggctgcaatgaggttgtatacagagaggccttgcaaacagtggccctgaccaccagcaccagggaggctccagcaaggcacagaggctccagcaaggcacagaggcacagagctgaggttgacacccagctggagaggccctgtacaggaaagccatgggtgcgctgaactggttagaggagaccctggagacagtaggtggggaaacgcacaggccaagtcaggccttggcgtctgggatgcctgggcctagaaaccaggcagagcggcgggcctcggcctcactctgcccagcctggtcgggccatagagcttctcccggcaggcaggctggctgctgggtgccggggggcagcatacgacccagtggcctgaagttctccaacatgtcctcgtgtcctcggctccctcggctggccaggctccgcccccggccctccctgcgcccggccggtgcgcagggaggtcggaggagcgggcactgcccaccctccggatgtataagcgtcctggccagaggcgggcggtgcgcgcaagtgcgcgtgacgctcgggctcgcgggctgcgcagcctgggcagcgtccctctgctggggtctccagcgacgatagtgagccaacttcagggggctgttgggcatttactgggctgggtcctgtcctgctgcgccaaggaacagaggacgctgcggccctggggctcctgtcagtggccggtgcgagagcccaagctgccctctcctcacccaggtgcaggggcagccagggaggaggtggaggcgggaggggccaagggcaggggcagggctgggctccggcagccactcgctgcttcatgggtgccctgccacctcgggctagggctgggtgctgctggcatagacacctctcctcggggggctgtagaagctgacggtggcttcgctgcacagagaaaggccgtgccttggcaggagcaacgggatgttcaaggggcgttggtcatggaggtccctgggaatggaggaagggggcagggagcttggaaagcaagagggccctgcacttccagggtgctccacccgtctgggcccctcggctgctaccagccccaagtggggggcccatgacgccataatcctctgggccaggggcccctggcagtgagtggcaccacaggcccccgcccccggactccgtgggctgggctgggctgggcgcggtgcggctgggcacacgcagtcggaggcggcgccggccaggccgccgggcgcctatggacgcgcggagcccgctgtctccccgagccagtgcgttcagcatcgcctctctggttgcagcggaggcggcggagcgcaccgcccaccagggctcagggtcctccgaccgggtgaagcttcgctggctgccaggatccccggcagggatgcacttcagcaccgtcaccagggacatggaaggtgagcctccaggccgtgtctacactggcccgcccgccagaccccctgcctcagctgctgtggggcccgggtgcaaagtaggtggaggcagctcttggtagcgtgggctccaggcttctggctgcgattctggggcagagaggaagagccggcatcccgcccacagcctgtcccctcaccagcctgggggcccagcttggagatgggcactcaggtatacacaggcccggaagagggcgagtgaggctgggaaggagagcagaggtggccgtgagcctggagaggggggaggaaagttaataagagaggagagagcgggagagtttcacagaaggagagaaagcctcgaggaagccgtggagacgaaattgagcaaaggggagaaaacacaaaaaacccaaagaagaaggtaggggagaaacagaaggacacgaaaaggcaataaaaagcaagagcgaaagagaagagagaaaacgaagggaaaatttaagacagaaagcgaagtcataaaaaagaaaaaaaggaaagactttagtttttttttttttaaaaagaaaaacataaaaaacaaaggacatacaaaaataagaggaaaggcaccgactaaaagaaagacaaagaatgattaaaaataaagtgaaaaggaaggcgaggatggaggaaaaggggaagaggcggaaagtaaaacagaaataaagagaaactacagagataggggaagaaaaaagatgatcgggagggaaaatttaaatgaggacgacaaaggtaaaataacaaattaggaaaagaacgtctgggagagagagaggagaaacgcacgcgggcgggcggcagagcgagggccggccgacgggcccggcgcaccggtgagccggtccgggcggtcggggggccccgggccgagcgagccgcggcgggcgggctgggggccggggagggggaaggggcgggggaggggcgagggccgggggagggatctagtccattgtctccgcgcgggggtgggggggccccgggcggggcggggcggggcgcctcctcggggccggcctgcggtgtggggctgcacggcccggggcgcacgcagcgcggcgcccgccactcggcccgcggcgcggggcagcgctcagcttggtggcgggggcggcggcggcggcccgcgggtcatgatctccgccgtgtccagcccgtggctcacgcagctctcgcatttctgcgacgttgcagccttcacggccagcagcctgagcagcctgggggccgcggggggcttcccgggcgccgcgtcgcccggcgccgacccgtacggcccgcgcgagcccccgccgccgccgccgcgctacgacccgtgcgccgccgccgcccccggcgccccgggcccgccgccgccgccgcacgcctacccgtttgcgccggccgccggggccgccaccagcgccgccgccgagcccgagggccccggggccagctgcgcggccgcagccaaggcgccggtgaagaagaacgcgaaggtggccggtgtgagcgtgcagctagagatgaaggcgctgtgggacgagttcaaccagctgggcaccgagatgatcgtcaccaaggccggcaggtcagggcgcccctccccacgccgcgaccctccccacgtgctgccgccagggctgcgggcctccgcctgatccgcgcgagcggggccgaaagccgggtcgggggcgcggcctggccacctgcgggcccctctgggccccgctgcctccttcgctgttcgccgtcccggctccggcgacagccgcccggcgctcccctcctaacacctatcctccgccggggcgggaggagacggcgcgggccgcacgggaacggcgaggagccccgcgggactcgcccgcccgccccgcagccccaggacgccgcgcggcccagaaaccggcccggcttggggcgcacccggctgggggcaggcagcggcgtccagggggcctcaccgcccggccgactcctagtaaatcccacctcaagaaaactctggttcagttctggagttcagtctatgcgggcaagataaagagcggcagccgggcaactctctggacactttcaggagaggattacccttaaaaacagcgtgcactgttgcgtggaagttgctacccagtttccttcaacctagatccctatagttgtggggcctggctctgtatccagcggcccgtcacctcccaaccggcctgtatttgttttaaagaccaagagacaaggggaacaagttttgcagatgcacccgatttgaccggtagacaaaggcgggtgccgcgctgtgtctaatgtacacaccagctcggagtccgaacagccaaggggagctcagggcctgtttgcaaagccttctcgtggtttctgtttccctgctgccggcgtcctttctgaggaacctgggcctgtgctctgctccagctctgtggtttttttccaggccctccttgctgtccccaggcacacaggccctcctgaggacagcggcagcccagccgctggctcaggccagcccggcaagggccttgtcggcgctgggcttcacccgggagcccacgtcccgcagcaccctccagcctgcagaggcttcgggtgggggagggagcgggcctgtcctagaggctggctcctggcatctgtcttctgcccaccgcctgcagggagttgcttgtgaggggaggcagaggggacggcaagtgagggccaatccttgtgttgtcctgaagggccccacggccactactgctgtgccatcatgtgggggtagcccatggcctacacccgtccaggcactgcagaatgtcctttcaagagccctgactggtcactgagccagggtccaaagcgggggagatttgaggaacaggaaagacacaaactgagtacactctgggtagctgcgtcttggggttatgtgtcttaaggggagtggaagcttgccctgtgccctgaggaaggtggggagactcttatcatggggccatgatagagaggggccctgagagtcaggggagggagggctctgagccttggcctcactgaggggattgggtaacagccgaagacccagctaaaagggcagcggggacgccttgaactcacacaggactacccggtttcactttgttggagccgggagctgcttcgatcaagctggggaggctctgctaagggcgcacgttaggcaccctgctgccggccgaagctgggaccaagaggccaaaaagtcagcaagggcgaggccgagtttatgtaggccaaggttgccgaaggtgggggctccagcgctgggctggccatttctgtgtccaggaacggcccaggaggctcccctgctgcgccaagctcccagttgagtaggggcctgcccagattagagcagctaagccaggaaagatggagcccaagggctgggacgacacagcagcccccagaggctggagggaggggccgagcagaggggccgccagccccaggcaggtcaaggggggctgccttccaccagctagggtgacccaaggcctcatcacccccaggcggatgtttcccaccttccaagtgaagctcttcggcatggatcccatggccgactatatgctgctcatggacttcgtgccggtggacgataagcgctaccggtgagcgagtggttgtaagcgtgagggaccgggagggcaccctggaaagtggcgggtctccgcctggtgacccaactccaagggtcgtctgcaccatgaaactctttaggcacctgcgatgctgcccgatcaacccgctccctcctccactcccatctgaccccagacccacaaccctactccatgccctctcagaacccgcctctggagccgcaggctgcagacagctcttgctcccctgggctggtgtggccctagggtggtcagccaagtactcagccccggacttcttcaagtctccctctcccaggaggccggcctgagcgcctagtccccttcccccatccccagggaactctggatcctggagctgggccggaaaggtggggtggccaggagagattatgcagggcgggcctcagctgcccggacaattaacagcaattaataaagagaacgcgcactgccctgtgcctgaggcccggcaaggccaagtgtgggctcccaccgcagcggcaccggggcgggaggacccgcatccagcgaaatgagatggcaggagcccagcctccccctctcggtgccccacagggtgtccagttccttgattgttttgagtgttggggtgggtgggagttctctgtttagtccatagtcccccttggaaaagctcccagcacatgcggcagcagagggttcaatctcacaggtggggaaacttctcaaaggcacttttagggttcgcccagcacacgggtcaaggccctctgggttcacctccacatgcacgaccccaccccgtgccgctccaggtacgccttccacagctcctcctggctggtggcggggaaggccgaccctgccacgccaggccgcgtgcactaccacccggactcgcctgccaagggcgcgcagtggatgaagcaaatcgtgtccttcgacaagctcaagctgaccaacaacctactggacgacaacggccacgtgagcgactgcctccccaggctccggtgtcccccaaggcctcgagtcccgaggcacccgcctgtccctaagaggcctgtagaatccccaggcccccggctgtccccaggcggctctgggctgtccccgaggaggccctttagagtccctgcgaggctagaggctgaggcggagcttgggcagtgctggtgtgccgatgaggagagcggcctctggtcaggggtcgcacagcctagtgggcctgggccctgggagaggggtcgccctccttctctcaccccactcctgattttatgcaggaagcttttttaatggaaaagatggggccctgcaagggggctggagaaagaggctttatggagtccaggccagtgaggtcgctgggcaggcacctaaggaaagagaacctaaacccagatcttttgccacttggagctcattcctggcagttgccaatgggtcacagcctcctcttggcccagtgacccagcctcatcttggaattaagggttttgcccaactcatccaggaaactcattgccaactcagacctcagcccatttcctggctcccaccccagatcctcagcccagccccaccgctggagctgattccccaccttgtcttccagattattctgaattccatgcacagataccagccccgcttccacgtggtctatgtggacccacgcaaagatagcgagaaatatgccgaggagaacttcaaaacctttgtgttcgaggagacacgattcaccgcggtcactgcctaccagaaccatcgggtgagggcctgtggggaggacctgagcggattcaacgcctctggaaaagcgggtgtaattttcagttgccgtttggggacagtgggtccgcttagacctgcaggctgtggtcccagtggagcccaacccaactggagccccactcccaagggcctcaggcagccccctccctctcgaggctggccggcccagcctcctatcagcttgacctctccagcggcaactgtcacttcgtcctgaaagtttgttttccgaaccattccggaaactccccatcaggggcctgatctgaggtttacccagattactagggaacccgctctgttccccaccccccaccccactgcacgtggggggtggtgaccacattcctgtcccagcgaggagcacagggcctccatccccacccacctgggggacaccagagaggggttccctagtgagagaggaggttcctcagacccccgcccccctgcaggagggagcaccagctccgtagaggaggggcagacgtggactggttcttgtcagggcagcagaaaggcccttggtgcgcttctcctaacactcccctatcctccgccgaggtcgggtggcccaggctgcagggctccagcggcttgctcacacccacctccctgcagatcacgcagctcaagattgccagcaatcccttcgcgaaaggcttccgggactgtgaccctgaggactggtgagtgtcctcccccgagagagtgagcgccgggcgcctggcgcaggcgccgccctgatccgcctcccgcccgcaggccccggaaccaccggcccggcgcactgccgctcatgagcgccttcgcgcgctcgcggaaccccgtggcttccccgacgcagcccagcggcacggagaaaggtagggccggggtcgtgggatccgggttccggccctgtgcgcgctctaccccgggccggcggcctcgcccgacctcgcctgcgcccccggggcgctccaggctttcgcgccggttgcacaacggccgcggcggcgggcaagcgcgcactcgcccgcccggcccgacggctgcgccccgcccgccgccgccgccgcccgcagaggggcgcgggccccggggagggctcggggcgccggcgacttggggtctcgggcacgctggcaccgactggtcggggaacaccgagggcggccaagagccttctctccgccagggcctcgcatggggcgtcggagctcctcggcggccccggccggccgcgctcactcctcggccctctccgcagacgcggctgaggcccggcgagaattccagcgcgacgcgggcgggccagcagtgctcggggacccggcgcatcctccgcagctgctggcccgggtgctaagcccctcgctgcccggggccggcggcgccggcggcttagtcccgctgcccggcgcgcccggaggccggcccagtcccccgaaccccgagctgcgcctggaggcgcccggcgcatcggagccgctgcaccaccacccctacaaatatccggccgccgcctacgaccactatctcggggccaagagccggccggcgccctacccgctgcccggcctgcgtggccacggctaccacccgcacgcgcatccgcaccaccaccaccaccccgtgagtccagccgccgcggccgccgccgccgctgccgcagctgccgcggccgccaacatgtactcgtcggccggagccgcgccgcccggctcctacgactattgccccagataacacgggccctgtcgcgctcccgccccggtcctgcacagccccgaagttcgccgggcccggccaccctgccccaagggcaagcaaggaatacgttcccccagccccaggggccaccgcggctctccccttccccagcctcgaagccatgggggccccctcgccacccccagccccttgggctatcgaagtatccggttccccagtccctggagccaccgcgggtccttccccggccccgagggccaagggggtccccgcccgccagtgccaaagcgcccggtcggaggcggaaggaagtgatatttattgttctccccgagaccgcgtcgcccgcggcccggccggcagttgcagtgtagacagcccgagagccccgcctgcaggcggtgtagatacatgtagatactgtagatactgtagataccgccccggcgccgacttgataaacggtttcgcctcttttgg

SEQ ID NO: 2086 - DNA, 11905 bp, Homo sapiens
  source 1..11905: mol_type = genomic DNA
cgcctgcccggaaaggagtgagcggcgcctagtcccgggctggcgggagtgcagttctgagtcccgcccggcgtgcgcggagcggggcagccagcagcggaggcgcggcgcgcagcacacccggggtgagtgcccctgccggggtctgcggagccccagaatttcctgcccaccctcttccccctgccccggggaggagatcctggcgccccacccagttggctccgtgaatgcagctcagcccgccaccccgcagggtgtcaggccttgcggggggccacggaggatccccaagggaggaggagaaggatggggtgtttaccaacacagcccagcgttcccgggcctggtgtgcgcggagctttccccgctgctgcttccttggagggagggacccattctacagatggggaagctgagaccacacaactaggaagtgtcagagctggagaccagctgggtcatttgactccagagcccaccccatttggaatggagggggcgccagaccctctcctactgccttcccatcatctggaggggagggcagaggtgcagagagacctgctgggttcctggaggggccaggaaaggggcacagggtgaggagtgggctggagcctggaccccagggccgcaggatggaggcgtattcatttacaccataaaagtggctgggtgaccctggctagagcggggaccaagggggacaggggtagggggtgagccagtggagcctcacatgccaggcacgggggctgatcacgtccccacacctttccccccgcccattacaggttgttcccccaccccctgggaagtgctggaaggagcccggccctcgagccctcggcatagtggctgtgggagccctgatggccctgagccaggggtgacccctccccagatccccagagctgattccccacacctccttatttggccagcacagccccaaagggagccaggtcagacacaaccctcctctgagctcaccctttgtgctgggcacataacattggactttacctctccaagtgtcagtggagtcctgtatgaaacaaaagcaccgtaccccctccccaagggtttctccccccagggattagtgtgaggtcgtgtggatgaagggattcagttgaggctctggttatttttgtcacctccctagatcctgtctctgtcaggggtgccacgtcccattcacccaaagaggaagtagaggcacagagagggtgagagacttgcccaaggtcacacacccaatctcagcctgggctccaagtccctctgccctgtggccgggcctggtccttagggatggaacccagccccgctgccccctgccctgcccacctgcagccttgggccatctgctcagtgttccctcgttccctccttctctcctttcccaggctggggctggggctgcgtttccctgtttagagttaagtaaaccagacccaggggaggaagtgactggctgggcaggcggggccctgaccaggcctgtcccctccccctaattttcgagctaagcaactgattcccacagaggggccctgggccctgagagcagtggctttggagctggaggggccccagcatccagggcgggttggaggtggcctggcacctgcccccaccccacatcggccttgagcaaggccccgggcccttccccgccattctgtagtttcacttttgttggtttcaacacctggaaggctgcggctgctgccgggcggcccgggcctcaggggacagcccccccacagcagtgctccctggctagccccagggtacccggtggagatgcccgctcctaccactcagcacatgcagctccacagggagcagcgagggctccagccacccccggggcagccctgggcctaagtgcctgggccagtggggtcctgtctagggtgacggcagcccgagaggagggaggccagagtgaaggtgggggtggagccggtgtcactgggagacgctggaggtaggggcgggggtccccatgggcagagcaagccaggagagagcttgaggtcggcctgagggtgggcttcggggtctcccagtcccactgcttactttctgcgtgacctcagcaccgcatcaagcctgcccaggcctcagtttccacctctgtcagatgggggtggtaacagcagcttccaggattcagtgagtgaaggtgcacaggtgcccgtggttgggaactgtctgtggtctgcccctgactggcccccatccgtgtccacccacaggaccatgggctccatgttccggagcgaggaggtggccctggtccagctctttctgcccacagcggctgcctacacctgcgtgagtcggctgggcgagctgggcctcgtggagttcagagacgtgagttgggtgggcaggcgtgggaagggggctactgccaaggttagcccggaggccggtccaggatggggactgccccccctccgccatagggccctggccccatttgaaccccagcggcccctgccatgggcactgctcatgggaagcccgcagctgaggcccctgagctggctcctccccataccctcctggggcatggggtctggtctgtgctctgatctgcgtcttgtggctcccagggcactccacacctttctggaggaggcagctaaggcctggggagagtcaggcctgggctctagggtgaggagctccctgacccccttcccgggacactcacccctccgtgtggcacccacagctcaacgcctcggtgagcgccttccagagacgctttgtggttgatgttcggcgctgtgaggagctggagaagaccttcagtgagttggtcccaggcctacattccaggcaggcttcctggaggaggcatgggccaagtttgatctgaaaggaagagtctgggtttgccaggtggaaggcagagaagggaggtatatgcagggccctgcagggccaagacagagcagctgggatctgtgaagtgtgcttgcgaaggtggctgccttgtgtgggctgagcagagggcctagggcagggctggctggggaggcctcgaatacagcataagagcccaggacttcgtcctgtgggcgccaggaagccacaggggtttctaagcagggaagaggcacagacagctttctcctctacagctgggctggggtgggtggggcccaggatctagggtagggtacccctaaggagcaggcaaaagggacccctgccctgggcaacccctctcaggaggagcctgtgggggcaccaaggcaggggcatggggcaggcagggttttgtgtttgctggtgcagtttacagcttttcaatgatcaggcagacacaggactcacgccagctccggtcccaagccctgcagcgcaagggccggcctgtggggagacctcaggccctcttctgagtggtggccaagggactggggagggagagtgagcccagacctgagctcagggaggggagcacagcttctggatgaaagtttggccgggattttctggccacctccacctggtgaatccagcagctggtggccgatggagtttggggcagcaggtggggccctcaactgttgagacaacctcaactgcaccccactcccgttcctctgcgcccagccttcctgcaggaggaggtgcggcgggctgggctggtcctgcccccgccaaaggggaggctgccggcacccccaccccgggacctgctgcgcatccaggaggagacggagcgcctggcccaggagctgcgggatgtgcggggcaaccagcaggccctgcgggcccagctgcaccagctgcagctccacgccgccgtgctacgccagggccatgaacctcaggtcagctcccacccaggcaggagactggggggctggggaggggctgtccagcctagggctcatggtgcttctgggttcctagctggcagccgcccacacagatggggcctcagagaggacgcccctgctccaggcccccggggggccgcaccaggacctgagggtcaagtgagtgagggatgacctcatgccctttctggccagcccagaacccctggccagtcgctgggctgggccaggctgagctccgactccttgtccagtgctctccccaggctggccccgcctcctccttcaggcccggaacttcccacagtcccaagccctagccctagggggttctcctcttctggtcctgcccgggaggcctcctgccttcccctgtgggcagggccagtgtgcccaattgcccgattgcccgtgctgggcagggtcctgcccggggggcctggtgggggaggcagggcaggaggttggagcagccctgcccagccccgtggccgccagctttgtggcaggtgccgtggagccccacaaggcccctgccctagagcgcctgctctggagggcctgccgcggcttcctcattgccagcttcagggagctggagcagccgctggagcaccccgtgacggtgagcagctggcgctgggctggggggtcctgggcagagcgggaccccagagtcagctgagcctgctctgcagggcgagccagccacgtggatgaccttcctcatctcctactggggtgagcagatcggacagaagatccgcaagatcacggactggtgagtcactgggaacacccgccccaccgccctgctccccaggcccctgctgtcacctcccagcccgccctatcgtgactcctccccatgagctcccttcagactcagagtctcgtagctgtgtccttctggcccctcacgcagcgcatcctccctccagcttccactgccacgtcttcccgtttctgcagcaggaggaggcccgcctcggggccctgcagcagctgcaacagcagagccaggagctgcaggaggtgggtgcccccggccttccggaggcgggtgtaggaggtgggtgcccccggcctcccggaggtgggtgcaggaggtgggtgccctggcctggcctccaggaggtgggtgcaggaggtgggtgccctggcctggcctccaggaggtgggtgcaggaggtgggtgcccccggcccagccaccccacctgcctgcccagcccccgctgactgcccactctggcgcaggtcctcggggagacagagcggttcctgagccaggtgctaggccgggtgctgcagctgctgccgccagggcaggtgcaggtccacaagatgaaggccgtgtacctggccctgaaccagtgcagcgtgagcaccacgcacaagtgcctcattgccgaggcctggtgctctgtgcgagacctgcccgccctgcaggaggccctgcgggacagctcggtgagcagcctgaggcctcgccccctctccgcccgcccctcctaccaggccggggcgtttctgcctcacttccagcctctggctccctgcacctgggctttgcctaggggctccttctcctcccagcctcctccatggcccaccgcttccagggagtctgccctgatggccctggcccagcaagccctaccctgactttcctaagtccctggaggctgcacaggatagttttaaagtcagaagcctcattccaatccaggcccccctgtgaccttaggcctgctcatggtctgtggaaccggtgtgatgcccctgcctccgggggtcacccgccgcgcacagcaggtgcttgcgggtgaggctgggctccttctcctgggccgtccctaggaggcagcatgcttgcctttcccaagcaattgccaatccatgtggtgtctttgggcccccaccagggcagagcagggctgatcatctcacgtcagagagaggggaaggggctgcccagtgagcccccacagggctctacatctccagctgggcctggctggagatcccagggtccctgaaggcccccgccaccgttctggtctgtctctgccctggcacccagatggaggagggagtgagtgccgtggctcaccgcatcccctgccgggacatgccccccacactcatccgcaccaaccgcttcacggccagcttccagggcatcgtggatgcctacggcgtgggccgctaccaggaggtcaaccccggtgagagccacggcatccttacccgtgtcctgggaggctcagctgccccactgggtgggtgtgagcctgagggggaggtatctccatcctgggcctggcctgccctcctgggatgaggggcacacatcccatcactctcaaggggctgttgggctctgcagccagtgtgaggctttatgtcggcccccagccaactcccccttgttgagtttacaagggagccggcacgggcttgtgcaaagaacagaggctgtgcggtgggcatggcccaggttggaagcccatctcgcctactttgagacatttcttagcttctctgagcctcagctgcctcacctgcaaaatggaaataatagcgcaaacctcagaggaatgttgggaagcttagtgactgttggagactgcaagctggagccaggggcagcctttggtgtggttgctttggttgcacagctttttttttttttttgagatagagtcttgctcagttgcccaggctggagtgcaatggcatgatctcggctcactgaaacctccgcctcccaggttcaagcgattctcctgcctcagcctcccaagtagctgggattacaggcacgcaccaccacgcctggctaatttcatatttttagtagagatggggtttcaccatgttggtcaggctggtcttgaacccccgacctcacgtgatccacccacacaggccgttgggggcccaagcaccctgactcttgcccactggatgaggcagggcccctccctgtcctgtgaccaagtcccctcccgacatgggctccaccacatcacacccatgctatgggccgggcccccactcagtgtcactgggggcactggggggtttgctgcttctgcagggccagtgtcctggggctggatctgggccccaacaggattcccctgcacgtgggcagaggctggtgcagctagagcatcacctggaggcccgtggcagatagaatgctgccagctcaaagcaccagccgtcggggcagcgtgtttgccagggaagctgtaacaaagtgccaccggctactggcttaaggggcagacacggtcccacagtcctggaggctggaagtccaagaccaaggtgtcagcaggggccgggggcactggctgatgcctgtgatctcagcactttgggaggctgtggtgggaggaggatctctggagtccaggagttcgagaccagcctgggcaacatagcaagcccttgtatcttaaaaaaataaaagatgatgaggtgttgtcagcaggagtggctccttctgaggctgtccaggaagatctgttcccggcctctctcctgggcttggagcggccgtcctcatcttcacacactgttctccttctatgtgggtccaaatgttccttttcataaggacatcgggcacactggattggggcccactgtaatggccttatcttaacccagtgacctctgtaaggaccctgtctccaaagaaggtcacatctggagttcctgggggttgcgactccagtgtatcttttttggggtcacaacacagcccctgacagtgtgtatgttggggtcctcctgcctcccatgaggacttgttcccattttactgatgggaagtcgagacttcagagctgaagtgaccagctcggcctcccggaacttgccatgtgccagctggggctgcctgtggctccctgtcctctctggcttctgtgtggagctctgggaacagcaacagctgaagctgctaacttcctgtggctccagcagctggcccgtgctgcccgtggagaacttatgaagtggtctggtgttacctgcattttacagatggggaaatggaggctcagagaggtgaagtggctgggccaaggtcacacagctcctaagtggtgggttctttttttttttttttttttcggagacagaatcttcgctctgtcgcgcaggctggagtgcagtggcgcgagctcggctcactgcaacctccgcctcccgggttcaaatgattctcctgcctcagcctcctgagtagctgggattacaggcacctgccaccatgcccagctaatttttctgtttttagtacaggcagggtttcaccgtgtgggccaggctggtctcgaactcctgacctcgggtgatgcccccccccccccccgtctcggcctcccagagtgctgggattacaggcatgagccactgtgcctggctgctaagtgatgggttcttgactgcaggccagcagggcctccgtggcgtcttgggccgggaggcagatgctggtgtgttcgggggttcccagctcacccacctctgcccacagctccctacaccatcatcaccttccccttcctgtttgctgtgatgttcggggatgtgggccacgggctgctcatgttcctgttcgccctggccatggtccttgcggagaaccgaccggctgtgaaggccgcgcagaacgaggtgaggggcggggctggggtcctgatgagggtagcagggccaggcagcccctcaccacaccactgcccccccagatctggcagactttcttcaggggccgctacctgctcctgcttatgggcctgttctccatctacaccggcttcatctacaacgagtgcttcagtcgcgccaccagcatcttcccctcgggctggagtgtggccgccatggccaaccagtctggctggaggtgaggcccgggccccagcccggctgggggccccgcagcacccgcagccctgaccgccctcccctgcgttgccgcagtgatgcattcctggcccagcacacgatgcttaccctggatcccaacgtcaccggtgtcttcctgggaccctacccctttggcatcgatcctgtgagtcctgggatggagtgtccgtgggtggtgaaggcagctgggagtgggggctggggctcccctcggttcagccgtcctgcagcgctgtcgctgagcactcctgtgtgccaggccctttcctcagcacaagaggcagacaagcctcctgccctgcggagcctgcatcacagtcccctgagtgtgcggaggcaaagcgagaccagccaggaaccagtctcctgagtgtgcagaggcaaagcgagactggacaggaaccagcctgcagcttgcactgtgccaagcactgttcccaaccctctgtggaagtgattttcttttttcttttttttatttttggatatagagtctcattctgttgcccaggctggagtgcagtggtgtgatcttggctcactgcaacctccatctcccgggttcaagcgattcccctgcttcagcctcctgagtagctgggattacaggcgcccgccaccatgcctggctaatttctgtatttttagtagagacagggtttcaccatgttggctaggctggtctcgaactcctgacctcatgtgatccacctgcttcagcctctcgaagtgctgggattacaggcgtgagtcaccgcgcccagcctgattttctatttgaacctcgtaacaaccccgtgggcctcacattagtagtgtcctcacctaaagaagagactgaggcacagaggtcatgcccaaggtcacccaggctggcaccgtggcagctggcccatctgcgctctgttgcccctcggtgggtgggtgatggatgaggctgcaggctccgagggggaaaacagggtggtgagagagtgactcgggccggggacttcctggcagtgatggcgagggagcccctgagtccagcccacccctgctgccaccctagatttggagcctggctgccaaccacttgagcttcctcaactccttcaagatgaagatgtccgtcatcctgggcgtcgtgcacatggcctttggggtggtcctcggagtcttcaaccacgtgtgagggccaaggctgcccgggggacgggaggctggcaggccagagtgggccccagtgagcacacctccctcttgcccgccaggcactttggccagaggcaccggctgctgctggagacgctgccggagctcaccttcctgctgggactcttcggttacctcgtgttcctagtcatctacaagtggctgtgtgtctgggctgccagggccgcctcggcccccagcatcctcatccacttcatcaacatgttcctcttctcccacagccccagcaacaggctgctctacccccggcaggtgggctgcggctggtgggggccgggctcacacggcctcatggggaccccgcggtcacagggccactgggagctgcaagatcctcgtccgagaaacggggatgcaggccccgggccgtgcagacagggccgtcagaggtgatggtgtgcatctttagcaggtggcacaactggcactgggaaccgggggtcccttccctcaggagtccttatggaggcagaccctcacccagtgagggcacggagcccccgggggccctggagggaggagcgaccgcaggctctctgggccccgtgactgctgtgactcaggttcctttgcaggtgtgcacagcagggacgccctgactctcgccctctccctggcaggaggtggtccaggccacgctggtggtcctggccttggccatggtgcccatcctgctgcttggcacacccctgcacctgctgcaccgccaccgccgccgcctgcggaggaggcccgctgaccgacaggtgggaccggggcctaaggtgtggggggctgcttgcggggagaggccactgtccggtgtgtccctgactcctcgcttcctgacagactcctgagtggccaggagcaggcctggcgggtggtgggggacctcctggggctggagtgctgccaacactgcctgctcatgccccaggaggaaaacaaggccgggttgctggacctgcctgacgcatctgtgaatggctggagctccgatgaggaaaaggcagggggcctggatgatgaagaggaggccgaggtgggtgcagtgccttcctgggggtgggacggctgaggccctgccggccctcactgcacccgccccgcagctcgtcccctccgaggtgctcatgcaccaggccatccacaccatcgagttctgcctgggctgcgtctccaacaccgcctcctacctgcgcctgtgggccctgagcctggcccacgcccgtgagtgacctggccaccgacggctggccccagctcctggcttctcacataccgctgctggctgggcgggttgcttctctctgggcctcagtttcccctctgtaaagtgggactgtccaaggaggtccctcgctggccccccgtgcagggagggcttcaggctgcggcaggtaggtagggggctggcaggcacccacttgccgttggcccccactgtctcctttgcttgcagagctgtccgaggttctgtgggccatggtgatgcgcataggcctgggcctgggccgggaggtgggcgtggcggctgtggtgctggtccccatctttgccgcctttgccgtgatgaccgtggctatcctgctggtgatggagggactctcagccttcctgcacgccctgcggctgcactggtgagcgaccacccactggcctgggctgctcaaggcgtgagttcccctcaccaacccctctgcttctcacccccagggtggaattccagaacaagttctactcaggcacgggctacaagctgagtcccttcaccttcgctgccacagatgactagggcccactgcaggtcctgccagacctccttcctgacctctgaggcaggagaggaataaagacggtccgccctggcagtga

SEQ ID NO: 2087 - DNA, 7920 bp, Homo sapiens
  source 1..7920: mol_type = genomic DNA
ggacgcccctgctccaggcccccggggggccgcaccaggacctgagggtcaagtgagtgagggatgacctcatgccctttctggccagcccagaacccctggccagtcgctgggctgggccaggctgagctccgactccttgtccagtgctctccccaggctggccccgcctcctccttcaggcccggaacttcccacagtcccaagccctagccctagggggttctcctcttctggtcctgcccgggaggcctcctgccttcccctgtgggcagggccagtgtgcccaattgcccgattgcccgtgctgggcagggtcctgcccggggggcctggtgggggaggcagggcaggaggttggagcagccctgcccagccccgtggccgccagctttgtggcaggtgccgtggagccccacaaggcccctgccctagagcgcctgctctggagggcctgccgcggcttcctcattgccagcttcagggagctggagcagccgctggagcaccccgtgacggtgagcagctggcgctgggctggggggtcctgggcagagcgggaccccagagtcagctgagcctgctctgcagggcgagccagccacgtggatgaccttcctcatctcctactggggtgagcagatcggacagaagatccgcaagatcacggactggtgagtcactgggaacacccgccccaccgccctgctccccaggcccctgctgtcacctcccagcccgccctatcgtgactcctccccatgagctcccttcagactcagagtctcgtagctgtgtccttctggcccctcacgcagcgcatcctccctccagcttccactgccacgtcttcccgtttctgcagcaggaggaggcccgcctcggggccctgcagcagctgcaacagcagagccaggagctgcaggaggtgggtgcccccggccttccggaggcgggtgtaggaggtgggtgcccccggcctcccggaggtgggtgcaggaggtgggtgccctggcctggcctccaggaggtgggtgcaggaggtgggtgccctggcctggcctccaggaggtgggtgcaggaggtgggtgcccccggcccagccaccccacctgcctgcccagcccccgctgactgcccactctggcgcaggtcctcggggagacagagcggttcctgagccaggtgctaggccgggtgctgcagctgctgccgccagggcaggtgcaggtccacaagatgaaggccgtgtacctggccctgaaccagtgcagcgtgagcaccacgcacaagtgcctcattgccgaggcctggtgctctgtgcgagacctgcccgccctgcaggaggccctgcgggacagctcggtgagcagcctgaggcctcgccccctctccgcccgcccctcctaccaggccggggcgtttctgcctcacttccagcctctggctccctgcacctgggctttgcctaggggctccttctcctcccagcctcctccatggcccaccgcttccagggagtctgccctgatggccctggcccagcaagccctaccctgactttcctaagtccctggaggctgcacaggatagttttaaagtcagaagcctcattccaatccaggcccccctgtgaccttaggcctgctcatggtctgtggaaccggtgtgatgcccctgcctccgggggtcacccgccgcgcacagcaggtgcttgcgggtgaggctgggctccttctcctgggccgtccctaggaggcagcatgcttgcctttcccaagcaattgccaatccatgtggtgtctttgggcccccaccagggcagagcagggctgatcatctcacgtcagagagaggggaaggggctgcccagtgagcccccacagggctctacatctccagctgggcctggctggagatcccagggtccctgaaggcccccgccaccgttctggtctgtctctgccctggcacccagatggaggagggagtgagtgccgtggctcaccgcatcccctgccgggacatgccccccacactcatccgcaccaaccgcttcacggccagcttccagggcatcgtggatgcctacggcgtgggccgctaccaggaggtcaaccccggtgagagccacggcatccttacccgtgtcctgggaggctcagctgccccactgggtgggtgtgagcctgagggggaggtatctccatcctgggcctggcctgccctcctgggatgaggggcacacatcccatcactctcaaggggctgttgggctctgcagccagtgtgaggctttatgtcggcccccagccaactcccccttgttgagtttacaagggagccggcacgggcttgtgcaaagaacagaggctgtgcggtgggcatggcccaggttggaagcccatctcgcctactttgagacatttcttagcttctctgagcctcagctgcctcacctgcaaaatggaaataatagcgcaaacctcagaggaatgttgggaagcttagtgactgttggagactgcaagctggagccaggggcagcctttggtgtggttgctttggttgcacagctttttttttttttttgagatagagtcttgctcagttgcccaggctggagtgcaatggcatgatctcggctcactgaaacctccgcctcccaggttcaagcgattctcctgcctcagcctcccaagtagctgggattacaggcacgcaccaccacgcctggctaatttcatatttttagtagagatggggtttcaccatgttggtcaggctggtcttgaacccccgacctcacgtgatccacccacacaggccgttgggggcccaagcaccctgactcttgcccactggatgaggcagggcccctccctgtcctgtgaccaagtcccctcccgacatgggctccaccacatcacacccatgctatgggccgggcccccactcagtgtcactgggggcactggggggtttgctgcttctgcagggccagtgtcctggggctggatctgggccccaacaggattcccctgcacgtgggcagaggctggtgcagctagagcatcacctggaggcccgtggcagatagaatgctgccagctcaaagcaccagccgtcggggcagcgtgtttgccagggaagctgtaacaaagtgccaccggctactggcttaaggggcagacacggtcccacagtcctggaggctggaagtccaagaccaaggtgtcagcaggggccgggggcactggctgatgcctgtgatctcagcactttgggaggctgtggtgggaggaggatctctggagtccaggagttcgagaccagcctgggcaacatagcaagcccttgtatcttaaaaaaataaaagatgatgaggtgttgtcagcaggagtggctccttctgaggctgtccaggaagatctgttcccggcctctctcctgggcttggagcggccgtcctcatcttcacacactgttctccttctatgtgggtccaaatgttccttttcataaggacatcgggcacactggattggggcccactgtaatggccttatcttaacccagtgacctctgtaaggaccctgtctccaaagaaggtcacatctggagttcctgggggttgcgactccagtgtatcttttttggggtcacaacacagcccctgacagtgtgtatgttggggtcctcctgcctcccatgaggacttgttcccattttactgatgggaagtcgagacttcagagctgaagtgaccagctcggcctcccggaacttgccatgtgccagctggggctgcctgtggctccctgtcctctctggcttctgtgtggagctctgggaacagcaacagctgaagctgctaacttcctgtggctccagcagctggcccgtgctgcccgtggagaacttatgaagtggtctggtgttacctgcattttacagatggggaaatggaggctcagagaggtgaagtggctgggccaaggtcacacagctcctaagtggtgggttctttttttttttttttttttcggagacagaatcttcgctctgtcgcgcaggctggagtgcagtggcgcgagctcggctcactgcaacctccgcctcccgggttcaaatgattctcctgcctcagcctcctgagtagctgggattacaggcacctgccaccatgcccagctaatttttctgtttttagtacaggcagggtttcaccgtgtgggccaggctggtctcgaactcctgacctcgggtgatgcccccccccccccccgtctcggcctcccagagtgctgggattacaggcatgagccactgtgcctggctgctaagtgatgggttcttgactgcaggccagcagggcctccgtggcgtcttgggccgggaggcagatgctggtgtgttcgggggttcccagctcacccacctctgcccacagctccctacaccatcatcaccttccccttcctgtttgctgtgatgttcggggatgtgggccacgggctgctcatgttcctgttcgccctggccatggtccttgcggagaaccgaccggctgtgaaggccgcgcagaacgaggtgaggggcggggctggggtcctgatgagggtagcagggccaggcagcccctcaccacaccactgcccccccagatctggcagactttcttcaggggccgctacctgctcctgcttatgggcctgttctccatctacaccggcttcatctacaacgagtgcttcagtcgcgccaccagcatcttcccctcgggctggagtgtggccgccatggccaaccagtctggctggaggtgaggcccgggccccagcccggctgggggccccgcagcacccgcagccctgaccgccctcccctgcgttgccgcagtgatgcattcctggcccagcacacgatgcttaccctggatcccaacgtcaccggtgtcttcctgggaccctacccctttggcatcgatcctgtgagtcctgggatggagtgtccgtgggtggtgaaggcagctgggagtgggggctggggctcccctcggttcagccgtcctgcagcgctgtcgctgagcactcctgtgtgccaggccctttcctcagcacaagaggcagacaagcctcctgccctgcggagcctgcatcacagtcccctgagtgtgcggaggcaaagcgagaccagccaggaaccagtctcctgagtgtgcagaggcaaagcgagactggacaggaaccagcctgcagcttgcactgtgccaagcactgttcccaaccctctgtggaagtgattttcttttttcttttttttatttttggatatagagtctcattctgttgcccaggctggagtgcagtggtgtgatcttggctcactgcaacctccatctcccgggttcaagcgattcccctgcttcagcctcctgagtagctgggattacaggcgcccgccaccatgcctggctaatttctgtatttttagtagagacagggtttcaccatgttggctaggctggtctcgaactcctgacctcatgtgatccacctgcttcagcctctcgaagtgctgggattacaggcgtgagtcaccgcgcccagcctgattttctatttgaacctcgtaacaaccccgtgggcctcacattagtagtgtcctcacctaaagaagagactgaggcacagaggtcatgcccaaggtcacccaggctggcaccgtggcagctggcccatctgcgctctgttgcccctcggtgggtgggtgatggatgaggctgcaggctccgagggggaaaacagggtggtgagagagtgactcgggccggggacttcctggcagtgatggcgagggagcccctgagtccagcccacccctgctgccaccctagatttggagcctggctgccaaccacttgagcttcctcaactccttcaagatgaagatgtccgtcatcctgggcgtcgtgcacatggcctttggggtggtcctcggagtcttcaaccacgtgtgagggccaaggctgcccgggggacgggaggctggcaggccagagtgggccccagtgagcacacctccctcttgcccgccaggcactttggccagaggcaccggctgctgctggagacgctgccggagctcaccttcctgctgggactcttcggttacctcgtgttcctagtcatctacaagtggctgtgtgtctgggctgccagggccgcctcggcccccagcatcctcatccacttcatcaacatgttcctcttctcccacagccccagcaacaggctgctctacccccggcaggtgggctgcggctggtgggggccgggctcacacggcctcatggggaccccgcggtcacagggccactgggagctgcaagatcctcgtccgagaaacggggatgcaggccccgggccgtgcagacagggccgtcagaggtgatggtgtgcatctttagcaggtggcacaactggcactgggaaccgggggtcccttccctcaggagtccttatggaggcagaccctcacccagtgagggcacggagcccccgggggccctggagggaggagcgaccgcaggctctctgggccccgtgactgctgtgactcaggttcctttgcaggtgtgcacagcagggacgccctgactctcgccctctccctggcaggaggtggtccaggccacgctggtggtcctggccttggccatggtgcccatcctgctgcttggcacacccctgcacctgctgcaccgccaccgccgccgcctgcggaggaggcccgctgaccgacaggtgggaccggggcctaaggtgtggggggctgcttgcggggagaggccactgtccggtgtgtccctgactcctcgcttcctgacagactcctgagtggccaggagcaggcctggcgggtggtgggggacctcctggggctggagtgctgccaacactgcctgctcatgccccaggaggaaaacaaggccgggttgctggacctgcctgacgcatctgtgaatggctggagctccgatgaggaaaaggcagggggcctggatgatgaagaggaggccgaggtgggtgcagtgccttcctgggggtgggacggctgaggccctgccggccctcactgcacccgccccgcagctcgtcccctccgaggtgctcatgcaccaggccatccacaccatcgagttctgcctgggctgcgtctccaacaccgcctcctacctgcgcctgtgggccctgagcctggcccacgcccgtgagtgacctggccaccgacggctggccccagctcctggcttctcacataccgctgctggctgggcgggttgcttctctctgggcctcagtttcccctctgtaaagtgggactgtccaaggaggtccctcgctggccccccgtgcagggagggcttcaggctgcggcaggtaggtagggggctggcaggcacccacttgccgttggcccccactgtctcctttgcttgcagagctgtccgaggttctgtgggccatggtgatgcgcataggcctgggcctgggccgggaggtgggcgtggcggctgtggtgctggtccccatctttgccgcctttgccgtgatgaccgtggctatcctgctggtgatggagggactctcagccttcctgcacgccctgcggctgcactggtgagcgaccacccactggcctgggctgctcaaggcgtgagttcccctcaccaacccctctgcttctcacccccagggtggaattccagaacaagttctactcaggcacgggctacaagctgagtcccttcaccttcgctgccacagatgactagggcccactgcaggtcctgccagacctccttcctgacctctgaggcaggagaggaataaagacggtccgccctggcagtga

SEQ ID NO: 2088 - DNA, 15819 bp, Homo sapiens
  source 1..15819: mol_type = genomic DNA
gctgcggaagcattcaataaatatttattataattaaaagaccgtagcaatacccccaccaccaagacccttcacccagaaatagagagattggaattgtaaacaccgtatccagttctgaccaccctgaaagccagggcatcatcgcgcccgttttgtcctaaatgaagggctcccggacaatgtcctgaaagtggcagatgacctcatcttccactgtccacagggcacagggcagaccggggtgctctatggggtcctggccgatgcctgggtccaggggtgttccccaggtggtcaggcaaggacacgcggtcattctgcctcctgcgtcttgtcctcgggcgcctgggaccctctctggttccacatgtggttgttcagccccagctgtaccatctgtgcgtggtggataatgaggggttgcagccctgggctctgagggggtgcgggtgaggccgtagggaaggctggggactgcgggaagggcagtgactgtggaaaggctgctggctgtggggagggcggtgggggggtgccagcctgccatgcgtgcaggggtggcggctgcgggcaccccggccaagtgggaaagggtggcggggctcccaggggcacctggcccccaaagggcattcgagccccatagggcgccccagtcccaaatgacatgtggctcccaaaagccacctggagctgctccatctgtgcctggtaggacaagtagctctggaggtaggctgagtaggctgcgttcagtgccgccgcctgcatccgctcaccgtccaggtgttggctctgttcccgcagggctcgggtgtcctgttccttcctccacatggcctttcgggcctgaagcctgtggggcttgaaggtgttggccaccttcctggcgaagatctgggagtgttcgtccagccgcaccagcccggagagcaggctggccgtgtcggagctgagctgggccggggagctctccaggggcaggaaggggatgacacagtctggcgacccctgtcgcgtgaggttgctcatcatggcttggttcacctggtgcaggctcaggcgacagtcgaagttggaggtgagaagtaggatgatgaaagctgagtggtctatggcgtcctgcaggcagctcagctccccgcgccccggcacctggaaatcctcgcagaaggtggccccgtcgggcacgccaagggcctccagcttctcccgaacccgcagggcgatgtgttcgtctgccctggcgtggaggatcacaaagttatagaatttctgttccgatgatgattccagggaggaagggaacagggaggagggggtcaggtgagctgaacaaggagtagatgaaggaggaggaggaggaggaggaggggatgtttctggggtggtgggagtaggtgggcacggcttggtatttggagaggtggtatcttctacagaaagttggagtggcgtctggtctttgacagagcaggggtttttgaccggctccagaataggcaaggggagagactgggggcctgcagacccctcggtgcactccactgggtagttggtgctggtttctggagctgcgggggtatcagggaggccagtggaggttgcatctggggccacttcgggaagcccaggaggtgggctgcttggcagctctggtgggctggcaatctcccccgatggcggccagctcatctcctcaggctcctggcagccaccggggacaggctcgggcaccaagctggcctgggggtcgtcacagagcttgctgggcccatgtgggctgcggtgcaggctgaggaagggcatggtaggggactggctgatttccaagttgctggccagggaggcagggctgccagtggatcgcagggagcacccttggctccagtccgaaacaccgtcaatggggcgtgggaggctcctggtcccagagggcaaagccgaggatggtgggaggcagcccagattggactggagcgtccggatgctccctggatccccagcaatgtcccacccacaccggtttcgggcctcatcctgaagttcccccagccggtggtcgtccctggagctgagggtgcggacggcttcctggtaggccacgtcccgcagcgaggcggggcacagcttctcctcagccagcaggtggtacaagcgggccacagcccaggacacatctgggggctcctctgggtcctcggtgctgtccacgccagcccactggcgggccaccagccgggccaccgcatcggccttcaatgcctctagagagatcctggcctcagtttcctggcccagcttcaggagaaccatggcatgcaggaggtcctgcccctggcagcctgggcgtggggtcttcagtttgtgcttcagatacaagagcttgtcctggcctgctgcacctagaatgtcgaaggcgctaggaagtgatgggcctgtgcaggccatgggcacaggtgggtgcagcctccggcagcagaagctggaggtggtgaaggcatgttccacactgccccccgccttctgcacgcccagtgtcccctacccattcactgttccaggttctgcaggagctgcccaagcagatctgtaggaaacaggagaagcaaacacacttacccccaagaaaggtcagcacgggaaggcggcccacacacccccgcctgctttccccgcctgccacccagacctagccaggtgaccttcggcaacacgtcgcctccttcaacttccatttcttcctctgcaaaatgctatgaggccagtgtggtggctcaggcctgtgatctcagcactttgggaggctgaagcaggaggatcacttaagcccaggacttcgagaccagcctgggcaacacagccagactccgtctccactaaaagtttaaaaattagctgggctgggtgagggggcttaagcctgtaatcccagcagttgtggaggccgaggcggggggatcacctgaggtcaggagttcgagaccagcctggccaacatggtgaaaccccgtttctactaaaaatacaaagaattagccaggagtggtggtgcattcttgtaatcccagctacttgggaaactgaggcaggagaatcgcttgaacacaggaggtggtggctgcagtgagccaagatcatgccactgcactccagcctgggcagcagagtgaaactccggctcaaaaaacaaaaaaagtagctgggcgtggtggcacgtgcctgttgttccagctactccggaggctgagatgggaagatcgcttaagcccaggaggttgaggctgcagtgagctatgatggtaccactgcactccagcctgggcaacagagtgagacccagtctcaaaaaaaaaaaaaaaatgctgtcatctgagacttacctggtgttacctgagaggtaaacactattacactattttccccatttacagatgaagaaagcaagacacacagaggtgatgtcacttgcccaaagtcacactatcagtggatggcagaagacggatttcaacccaggcagtctggctgtggaggctgtgtgcctaatggcatacacttacagacttgttttggggaattgagttggattaacacagagatacttctgagcttgatgactgaaagccagtaggtgctcaatacatgcttgctaaatagcctcggctgagcacggtggctcacacctgtaatcccagcactttgggagtccaaggagggcggctcacctgaggtcaggagttcaagaccagcctggccaacatggtgaaaccccatctctactaaaaatacaaaaaaattagccgggtgtggtggtccgcgcctgtagtcccagctactcaggaggctgaggcaggagaatcgcttgaatccgggaggcagaggttgcagtgagcaaagatcgcaccattgcactccagcctgggcaacaagagcgaaaccccgtctcaataaataaataaatagtcagccttctagatggtcctcaaggacccaacatcctggtatttgcagtcttgagcagtccttccaacactgtcccagcgttggactatgacattaacagaatatggcaagggagccaggcaccacatccactcatttttcaagagaagccagagatctagatttttagaaatccgctcattcttctcgggatgacaatcaattccaatatttttaagagactttgtgagtttaaaaaaaagtttgggccaggcgcagtggctcacgcctataatcccagcactttgggaggctgaggcgggcaaatcacgagatcaggaggtcgagaccagcctggccaatatggtgaaaccccgtctctactaaaaatacaaaaaattagctgggcatggtggcaggcgcctgtaatcccagctactcgggaggctgaggtaggaaaatcgcttgaacctgggaggcggaggttgcagtgaaccgagactgcaccattgcactccagcctgggcgacagagtgagactccatctaaaaaaaaaaaaaaaaaagtttggagccaggcctggtggtgtgtgcctgtggtcccagctactcgggaggctaaggcaggaggattgcttgagccaaggaagttgaggctgcagggaaggatacatacatagcattcattcattcatttaagaagtaattttttggccgggcgcggtggctcatgcctgtaatcccagtgctttgggaggctgaggcaggtggatcacaaggtcaggagttcaagaccagcctggccaacatggtgaaaccctgtctctactaaaagaaaaataaaaaaaataaaaaataaaaaatttagccgggcatggtggcgtgtgcttgtaatcccagctacttgggaggctgaggcagaagaatcgcttgaacctgggaggtggaggttgcagtgagccgagatcgtgccactgcactccagcctgggcaaaagaacaagactccatcaaaaaacaaacaaaaagaagtaatttttagccaggtgtggtggctcatgctgctaatcctagcactttgggaagctaaggcggacagatcatttgaggtcatgagttcaagatcagcctggtcaacacggtgaaactcccgtctctagtaaaaaaaaaaaaaaaaattgccagacatggtgttgggcacctgtactcccagctacttgggaggctgaggcaggagaatcacttgaacccaagaggcggaggttgcagtgagccgagatcacgccactgcattccagcctggatgacagagtgaaactccatctcaaaaaaaaaaaaaagtaattttttcagcatctgccatgtattgggtactagtgaatacaccagtatgcagacaaggaaaaacagcaatggactcttccctggagcaactgactgtctaatggtatgttagttatatgtaatatataagcatcatatatattacatacgacaatataacgggcatgtgtggatacacacacacacttacatgcaaccacttatttgagggcttactacatgctatattgtgctccccatctgttctttaaactgggcacagtcctgcctcaggacctttgcactggctgttccctctgcctatatctctgttaccccccagatatccctatggctcactcccttaccctccttcatgtttttggttaagcctgtcctgatcccaccgtgcagatctccctttgacaggggccacaaaatatggcccacgatttttttttttttttttgagacagagtctcactcttgttgcccaggctggagtgcaatggcacgatctcggctcaccgcaacctccgcctcccgggttctagcgattcttctgcctcatcctcccaagtagctgggattacaggcatgcaccaccatgcctggttaattttgtatttttagtagagacggggtttctccatgttggtcaggctggtcttgaactcccaacctcaggtgatctgcctgtctcggcctcccaaagtgttgggattacaggcatgagccaccccgtccagcctttttttttgagacagagtttcactcttgttgcccaggctggagtacaatggtgcaatctcagctcaccgtaacctccacctcccggattcaagcaattctcctgcttcagcctcccgagtagctgagattacaggcgtgcgccaccatgcccggctaattttgtatttttagtagagacggggtttctccgtgttggccaggctggtcttgaactcccgacctcaggtgatccgcctgcctctgcctcccaaagtgctgggattacaagcgtgagccactgtgccggccaattgttttttagttttgtcttgttttgacacagagtctcgctctgtcgcccaggctgcagtgcagtggcatgatcttggctcactgcaacctccacctcccaggttcaagcgattctcctgcttcagcctcccgagtagctgggaccacaggcacccgccaccacgcccagctaatttttgtactttttatagagacggggtttcaccatattggccaggctggtctcgaactcctgaccttgtgtgatccgcccaccttggcctcccaaagtgctgggattataggtgtgagccactacacccagccaattgcttttataaataaagttttattgcaacacagacatcctcactcatttacacacatcgatggctgctttcccactagagtgatggagtagctacaacagagaccatggggtctacaaagtggaaaatattcactctctgacccttgacagaaaaagcttgtagacacctgggttatgagacaggcatgtgattttttttattttccattccacagaggggcaaacatgaccaagatcacacagctagtgactgacagagcagccatttgatgccaatgtttgtaactgtaacaccaaatgccttttaattagtatggggtatgactggctattatgggttcaatcgtgtctctccccaaaatcatatgttgaagtgccaacctccagtagctcagaatgtgactttatttagagaaaaggcctttttttggtttgtatttggctttggtgtttttgtttgtttgtttttgatgttgaaagtatttttatttggccgggcctgacggctcatgcctgtaatcccagcaatttgggaggtggaggtgagctgatcacttgagatcaagagctcgagaccagcctggccaacatggtgaaatcccgtcttcactaaatatacaaaaattacccaggcatggccaggcgcagtggctcacgcctgtaatcccagcactttgggaggccgaggtgggcagatcacctaaggtcaggagtacgagaccagcctggctaacatggcgaaactccatctctactaaaaatgcaaaaattatccaggcatggtggcgggcgcctgtagtcccagctactcgggaggctgaggcaggagaatggcgtgaacctgggaggcggagcttacattgagccaagatagcgccactgcactccagcctgggtgacagagcaagactctgtcttaaaaaaaaaaaaaaaaaaaaattagccaggcatggtggcatgcgcctgaaatcccagctactcaggaggctgaggtgggaggattggttgagcctgggaggttgaggctgcagcaagcaagctaagatctcgccactgcactccagcctgggtaacagagcaagaacctgcatcaaaaaaggaaaaggcagggggcattcagatacagacacgtaactgcacagaaggaagatgatgtgaggagacccagggagaaggcggccgtctgcaagctaaggagagtcctcagagggaaccaaccctacaacacctcgatcttggacttccagcctccataactgtgagagaataaatttctgttgcttaagccatccgggctggggcactttattaccacagccacagtagctaatacactgcagatacttgcagtctagatcagcctcaacactctctgtctgtgttgtccagtatggcagcccccagctacctgtgtctactgggcacctgaaatgtggctgtggtagtaaagagacactgaattttaattttttttttttttaggatgaagtcttgctctgtcgcccaagctggagtgcagtggtgcgatcttagctcactgccacccccctctcctgggttcaagttattctcgtgcctcagcctccccagtagctgggatcacaggcacatgccaccacgcccagctaatttttgtatttttagtagagacagggttttgccatgttggccaggctggtcttgaactcctgacctcaagctatctgcctgcctcagcctcccaaagtgctgggattacaggtatgagccaccatgcctggcttgaattttaacttttatccaattttttttttttttttttttttggagacagagtctcgctctgtcatccaggccggagtgcagtgacgcaatctcagctcactgcaacctccgcctcctgggttgaagagattctcctgcctcagcctcctgagtagctgggattacaggttcgcaccactatgcccggctaatttttgtatttttagtagagatggggttgcctcatattggtcgggctggtctggaacccctgacctcagatgacccacctgcctcggcctcccaaagtgttgggattacaggcgtgagccaccgcaggacacaaagaagggaacaacagggccaggcacagtggctcacacctgtaatcccagcactttgggaggccgaggcaggtggatcacctcaggtcaggagttcaagaccatcctggccaacatggcgaaatcccgtctctactaaaaatagaaaaattagccacgtgtggtggcgggtgcctgtagtcccagctactagggaggctgaggtgggagaatcacctgaacccaagaagtcgaggctggagtgagcagagatcacaccactgcactccaacttgggtgacagagcaagactctgtctccaaaaaaaaataaaataaaataacagagcctgcttaagggtggtggtgaggaggagggagaggagggtcgggagcggtggctcacgcctgtaatcctagcactttggaaggccgaggtgtgtggattgcctgagctcaggagttcgagaccagcctgcgcaacatggtaaaaccccgtttctactaaaatacaaaaaattagccgggtgtggcagtgtgcgcctgtaatcccagctgcttgggaggctgagggaggagaattgctggaacccgggcggcagaggttgcagtgaactgaaatggcgccactgcactccaccctgggcgacagagcgagactctgtcttaaaacaacaacaacaaaaaactacctatcaggtacgacagttattacctgtgtgatggaataatctgtacaccaaaccctgtgacatgccatttagctatataacaaacctggatatgtacccgttaatttttgtatttttgtagagactgggtctccccatgttgcctgggctcaagtgatcctcccaccttggcctcccaaagtgttgggattacaggcgtgagccaccgcggccggcattttatctaatttttaattaattaaggcagggtgcagtggctcatgcctataatcccagtactttagggggctgaggtaggaggatctcttgagcccaagagttcgagaccagcctgggcaacagtgagacccatctctacaaaaaataaaaataggccgggtgtggtggctcacgcctgtaatcccagcactttgggaggctgaggcaggtggatcacctgagtttagaagttcgagaccagcctagccaacacagtgaaaccctgtctctactaaaaataaaaaatattagcagggcatggtggcaggtgctggtaatcccagctactcgggaggctgagacaggagaatcgcttgaaccgaggaggcagaggttgcagtaagccaagatcacaccattgcactccagcctgggcaacaagagcaaaactccatctcaaaataaagaaacaaacaaataaataaataaataaaattaaaataaaaataattagctgggtgtggtggtgcatgcctgtggccccagctccttggtagactgaggtcagaggatcgcctgaggccaggagaatcaaggctgcagtgaccggagatcgcgccactgcactccagcctgggcaatagagtgagacgctgtctcaaaaacaacaaaataaaaaaggtatggaagatgcctcattcgtaatggaacattatattggaccatgttgggtatattgagttaaataaaatatattattaaatgcatttacatattggattaataaaatgtattattaggagatatatatatatatttatttatttatttatatattttggagatggagtcttgctccattttccaggctagagtgcaatggcatgatctcgactcactgcaacctctgcctcccaggttcaagcgattctcttgcctcagccttccgggtagctgggactacaggcatccgccatcatacccggctaatttttgtatttttagtagagacggggtttcaccatgttgcccaggctggtctcgaactcctgacctcaagtgatctgccagcctcggcctcccaaagtgctgggattacaggcgtgagccactgttcgcggctgcttcatgttatatttctgttggacagcacagttttagacatctccactacagtccagtaatattggagtatggcccctttttgacacaaggaaacagaggtacagagaagttgagtaagtagtccagagtcacacagctcataagggatacagctggattggaacccaggctgtctggttctagaatccactgagctttttggctccttttaacattttcagatttaacacagactccagcttatgtggacctggttatggggcctgagaaacagcctcacctagttttaattaaactaatgttcaggaaataagcatatggcctaagtactcctctagagaagtggaggataaaaggtttttcctaataatcttaggaaataataataataataataataaaataatgcaggcacaatcggacaataagaaaaaggccagacggccgggcgcagtggctcacgcctgtaatcccagcactttgagaggccgaggcgggtggattgcctgaggtgaggagttcgaggctagcctggccaacatggtgaaaccccgtctgtactaaaaatacaaaaattagccgggcatggtggcgcaagcctgtaatcccagctattcgggaggctgaggcaggagaatcgcttgaacccgggaggtggaggttgaacccgggaggcggaggttgcggtgagctgagatcatgccattgcactccagcctaggctacaagagtgaaactctgtctccaaaaaaaaaaaaaaaaaaaaaaaaaaaaaaagaaaaaggccagatgcccagcttctatctctgttgtaagctctacataaaatgggataaaaatgaaaatgggctgggcgcggtggctcacgcctgtaatcccagcagcactttgggaggccgaggcgggcagatcacgaggtcaggagatcgagaccgtgctggctaacacggtgaaaccccgtctctactaaaaatacaaaaaattagccaggtgtggtggcgggcacctgtactcccagctactcggaaggctgaggcaggagaatggtgtgaacctgggaggcggagcttgcagcgagccgagttggtgccactgcactccagcctgggtgacagagtgagactccatctcaaaaaaaaaaaaaaaaagatcctatattcaggtgggaccacaagtcggccaaaactttttgaaatgatcaagacaactacttggaatacggtccaatacccccaccccccgttaagttcgatgatccacgaatcaactgctcttcccacctcccggtgtttcctgggaacggttgtgtgtataacttaccaagcaaaaagcaaacatacattggcacgtaccctccaatttttagctgataagagggcatagatgataaagtgtggagaagggccatgctgggacagggtagcagtggggctgggcgtcatgctgaaaattcattgagtttaacacttagaattcacactcttttttgttttttttattttttttgagacggagtctcggtctgtctcccaggctggagtgcagtggcgcgatctcggctcactacaagttctgcctcccgggttcccaccgttctcctgcctcagcctcctgtgttgttgttttttgacaggatcttgctctgttacccaggctggagtgcagtggtgtgatcatagctcactgcagcctcaacctcctgggattaagaagtgatcctcccactcagcctcccaagtagctgggactacaggcacatgccaccatgcccagctaattattaatgttttgtagggacggggtctggaactcctgggcccaagcgatcctcccaccttggcctcccaaagtgctgggattacaggtatgagccactgcacccagcctacatgtcagtaaaatatatatacatatatatattttttgagacggagtcccactttgtcgcccaggctggagtgcagtggtgcgatctaggctcactacagcctccgcatcctgggctcaagtgattcttgtgcctcactctcctgagtagctgggattacaggagcctgccaccacgcccagataatctttttttttttttttttctgagaccgaatctccctctgtcgccaggctggagtgcagtggcgcgatctcggctcactgcaacctccacctcctgggttcaagcaattctcctgcctcaccctcccgagtagctgggactacaggtgcatgccaccatgcccaggtaatttttgtatttttagtagggacggggtttcaccatgttggccaggatggtctcaatctcttgatctcgtgatccgcctgccttggcctccaaaattctgggattacaggcgttagccaccacgccctgctagtttttgtaattttagtagagacagggtttcaggctgttggccaggctggtctcgaactcctgacctcaatcgatccgcctgccttggcctcccagagtgctgggattacaggcatgagccactgcgcccggcctgtataggactcttaaagcagtgcctggcacacgcatgccccacaaacattagcatgcaagactgaaacctccttgcaagaaggactcaggggagttttgcagaaaacacgacaaagccagccagacttagaatcatcaaggcaggaccatctccacctgaatgcctggcaaatctctaaaatcacgtggtctttcttctcattctctctgcccccccgggcctgaactcaactctatttcagtgactgccccagcttcccccgcccgcctcccctgcccactgccacctccaccttctcgagacccagcaagtttcatttctcactgtccatggctgggacaaagtccactcctcactctgaagagcaggcgcctggcgggacaaaaacacccatggggtaggagggttctggctctgccacctgccggcttgtgtggtctgtttctcagcctcagcttcctcatttataacacccacatgaactggtacttaggatgaatgggagtctgttttgaagctttcatgcgaaaatatggttaaaaagtttagatcagtgcccagcaaggagcaagagcttgatataataatattagtgtgacaataaatattggcagactttttctcttcctcttcctttttaaaaaaatttttgatttttaatttcatttctttttttttttttttttttttttgacacagagtcttgctgtgtcgcccaggctggagtgcagtggcgtggtctgggctcactgcaacctccgcctcttgggttcaagtgattctcctgcctcatcctcctgagtggctgggattacaggcatgcaccaccacgccccgctaatttttgtatttttagtagagacagggtttcgccatgttggtcaggctggtctcaaactcctgacctcaggtgatctgcctgggattacaggcgtgagccacctgcccagccccatttcattttttttagagacagggtctcactctgtcacccaggctggagtgcagtagtgggatcacggctcactgcagccttgaactcccgggttcaagtgatcctcccacctcagcctcccgagtagctgggactacaggtgtgcggcaccacacctggctaatttttgtatttttggtagagacagagtctcacccatgttacccaggatcctgggctcaagcaatccacctgcctcagcctcccaaagtgttgggattacaggcataaaccactgcacccggctaactttctttttgaatttttttgtagaggtggagtctcgctatgctgcccaggcttgtcttgaactcctgggctcaagtgatcctcccaccttgtcctttttaaatgttttaaccacctctcccactctccttcccacactctcatgcagcctttcatgcatcgaatatgcatttattgagcacctactaggtccaggaactgttcaaagtgccactgcatatcaaggcaggcacatctaccctcacagagctcccagtctggttcagggagaccaacagtaagcgagaaaataacccaagatcatttcagagaatgaaaagtaacgtgaaagccatgagccgggggctgtgtggctctgagagactggctgggaaggggctacaggggaccacggtggtcaagggaggcctttggggacaggaggtaacattgagctgagacctaaaggagctgagggaggaggctgggtggagatcagggaggaaagcttctggaaggtgaagccacctgcccaaaggccctggggcaggactgcgcctggtgagctggaggaacagtaaggaagcccatgtggctggataaccgttaggagggggagaaaggaagaaggtgtgtggtggtacagggtgtgaggttgggatcctgggtgtcagggaagagtttggggtgtcagggaggaatttggggtgtctgggaggaatctggggtattcgggagggatcctgggtgttggggaagaatccagggtgtcagagaggggtcctgggtgtcacggaggaatttggggtatcagggagggaccttgggtgtcagggagaaattcagggcgttgagagaaatatggggtgtgaggtaggaagcttgggtgtcaggaatttggggtgagaaggaatatggggtttcaggtaggaatcctgggtgttggggaggaatctggggtgtccgggaggaatctggggtttgggggaggggtcaggctgtcggggaggaagccagggtgctggggaggatcccgacagtgggggaggatctgggccaccagcgcggggagctggaggttgaggggaacgtcaacctcccaacgcgcggcgccaggccccctcctccgcaccggggccctaagagggaggccaggtggcctggagccctggcgagcggcacgggctcagggccaccccccacacccccgacaccttctccacctcaggcccgtcctcgccccttccccacctaccagggatccggggctgccggctgcgccactgggtcctggggtcctgggggctggggcttctgcggagttgcccgcggaccgtagcgcgctgagggcgctggctccaccccgcggcccgcgccctgggaa

SEQ ID NO: 2089 - DNA, 15944 bp, Homo sapiens
  source 1..15944: mol_type = genomic DNA
cactttcgagagtgccgtctatttgccacacacttccctgatgaaatgtctggatttggactaaagaaaaaaggaaaggctagcagtcatccaagtaagtgaaggtgttcatttcacgttcttactgggcagggtctctcttgctgagtagagtttgctagcagaatgcatgtggttttagccttctttggtctttctttgatctggtgcttgaaatctagtcagaattattcaggaaggaaagtggaagaaaagggatatgatatgggcatgggagaagggtataactcagaacacaagtaatagcaccaatatctagttaatgtgataatgtatttatgcagtatttaatttttttctctgtagcattctgtacctggaaaaaacacattagggaagctatggaaatcattttgcaacagtctttttagcaaatcacatctttgccttaaagaaacaaaactccaagaggttaaaagagcgtatccccttttgttagttttattggctggaggggagacaggagctggcattgtatgacaatgtcttagataggagagaacattcaggtatgcctaggagtaagtaaatggctttctttcacctaatgaaggataatggaagaagtggagaagtggaaagttgttaaggtgtatgggaagatcagaaactggtatcggcaattgtggggtactcgggtaaaaatggagttggcttcagcaagttgattcccaggtttacagatgattacgtgctggtatgtgtcttcatatgggcgtgcctgtgtatgaacctactacaaaggttgcaaagtttacaaatcaaactatggatagtggttaactccaggtagtctgcctccagaccccatgtcctaaccatcaggcaatattgtctctcacttggacaaagaatgtgaattccatgtgccctcacaaaatatttccaaaattctaaggctgagtgagtctctttttaattttttttcattttctttatttctgctagatctcattcaacagcaacgttttcttcactctcatttcatcctttaactgcatttttgcttgttttactgaagcatgtcctagaataaccttttcatacagatcgtatggctataaacttactgaatttttgcatatctcaaaatacttatacctttttatttagttattcagatggatgtgaaatttccctatcttattttattttattttatttcattttatttcatttatcgatttagagacaaggtctcgctgtgttgcccaggctgaagtacagtggcatgatcgtggctcactgcagccttgacctccctggctcaagcaattctcacacctcagtgtcacgagtagctgggaccacaggtgtgaaccactatggccagctaatttaaaaaaaaattttggtggagatgaggtttccctgtgttgcccaggctggtcccaaactcctaggctcaagggatcctccagcctcagcttcctaaagtgatgggattacaggcatgagccacaggtaattttcttggcctggtcaaaggtaattttcttgttttttagaggtaaggtcttgctctgttgcccaggctggagtgcagtggtgtgatcatgattcattgcagccttaacctcctgggctcaagcgatcctcctgcctcagcctcccaagtagctggaactacaggcttgtgccaccacacttggctactttctaaaatatttttgtagatacggggtctcactatgttgcccaggctggtgttgagctcctgatctccttctgcctacaccttctaaagtgccgggattgtggggatgagccactatgctttgcctggatatgaaattttaaattcaaaataattttctctaaatgtttggaaagcttatctctattgttttccagtggttcatgttactgatgaaaagttttttattaatcaagatctcttttctttggaaatgaaggttttaggatttttgtgtgcatggttgcaattctgaaatttcataggagtctctccaagtttgttcctctttcactcctcctgcctagcatttggtgagttttgcccactgatgaaatgtcttcagatggggcaagtccttaagtcattcagggatatgctttgtaatggattagtccttctcagcaattctgacctatagcaggagccctaccagaggggtacatctcacctaagcaaggagaatgtattgtagggaccttacctatgagttggtaaatagagataggaagttctgaaggaactggaagagaggtttgggacactctcagagagggggcaggtggggagctggtccccagcatttgagaggtatcattgccagccctgcatccttcacgtgcctgggcaagtcagcaaatgcatccttgctggcctagctgtggcattcctcatggcctgtggatataaagaatgtgcacagctttacaatgattagtgccagagttgtaaaggccatgagatgggaatattagtttatggaagccagttttttttgttgttttttctgtttctgagaactaaattagaatattagtaaaatcgctatttttaagtatattagaacaattctatatactcacattagttctgttttcctaggattagtcacctaaggtgattttattacctgacacttacctggaataattttcatgtcatgacttttagatcttgtggaatatctatttagatatcattaccactgcttcatctccataccttgtgggtgtatttgattttttaaaatatctgaaatttggttgttgatcacaccacagagtatcacactgggtacacatcccaccaaaataaagtgtgacaatgtatggagttgagtggctttcctgagctgactaaatgcccatggaaagctattgtatgagtgcattctcacattgctctacagaaatacctgagactggtcatttataaagaaagaggttcaattggctgatggttctgcaagtggtgcaggcagcatagcagcctctgcttctggaggagcctcaaggagctttcacccaccacagaaggcaaagccagagctggcaccttcacatagccggagcaggaagaagagagaaggggaaggtgccacacacttttatttttttattatttattttggggggagtgggggcgaagtctcactttgtcacccaggctggagtgcatgtggtgggatctcggctcactgcagcctccgcttccctagttcaagcgattctcctgcctcggccttcccagtagctgggattacaggcacccaccaccacacccagctaatttttgtatttagtagagacacggttacaccatgttggccaggctggtctcaaactcctgacctcaggtgatctgcccaccttggcctcccaagtgctggggttacaggcgtgagccactgcgcccaaccaccacacacttttaaacgaccgaatctcataagaattcactcactcactatcgggagaacagcaccgagggggtggtgctgaaccatctgtgagaactctgccccatgagccagtcacctcccaccagcccccacctccaacactgggaattacaattcaacgtgtggtgtgggtggagacgcagaggcaaaccatatcggctatgtattcaacatatatttatttcttcagagccaacaaagtgccaggtcttgttctaggcacagacaacaccgtatggaataagaactatgtcctctactattatagcttcacattctagtgagaagcaataattaataataaataatacacaatattggataatttccatcaaccatagcaacggaaaaggcaatctagaagaagagcaagatgggaggtttcgctcactgaacttcaagacttgttgtaaagctaaagtaatccgaacaatgtggtattggcctaagaactaacaaatatttcagtggaagagagtagacagcccagaaatagaccctcgcttaaaacatttactcggtttctaaggaaagcacagaacaatccggtgggggaaagaagtctctttaaaaaatggtctgactggaccaggcgtggtggctcacccctataatcccagcactttgggaggccgaggtggatggattacctgaggtcaggagttcaagaccagcctggccaacatggtgaaaccctgtctctactacaaatataaaaattagccaggcatggtggcgcgtgcctgtagtcccagctactcgggagcctgaggcaggagaatcacttgaacccaggaggtggagactgcagtgagccaagatggcaccactgcactccagcctgggtgacagagtgagactccatctcaaaaaaaaaacaaaaaacaagatctgactgactggatatacacacaaaaaaccatgactcctacttcatgcatacacaacaattaacttaggagaggtcacacaccttcacatagaagctaacaccataaagctttttagaggagagtatctaagtaatgggagtaggaaaatttcttagaggagacacagaaatgataaaaataaaagagaagatgataaactagatttcatcataattaagaagacatcagtaagaaaataaataggcaactcacacactgggaataaatatttacaaaataggaatctgacgaaggactgacactcagatacataaaaaattcctacaacacaataataaacaggaaacaatctaatagatgagcaaaatatttgaacatataagggaagataaatgaacaataagcacatgaaaattgttaaatatcgttagtcggcagggaaatgcaaatgaaaaccataattagctatcactatatgttcagcagaatgattaaaaataataataaaaataggtaccaaatgttgtcaggaaagttggtggtgcaacactttcccaaaggatctggcagtttcctgtaaaaccaaatggcctcaccaaatggcccaggcattccaatcctagttatttaccccaaagaaatagaacacagtcatgtggcacttaatcatggggatatgttctgagaaatgcatcgtgaggggacttcatccttgtgggaacgtcacagggagtgcttacacagaactaggtagtacagcctgtggcgcccagcctgcaaaaccagacagccggcgtgtgactgcactgaatactggaggcaattgtaacacaatgggaagtacttgtgtatctaaacatagaaaaggtaagtgaaaatgtggtacaaaaggttacaaatggcacttccatagggcacttaccacgagtggagcttgcagtactgggagtggctctgggtgagtctgtgagtgagaagggaagtggatgtggaggcctcggacatgactgtgcaccactgcagactttatgaacactgcacacttaggttatactaaacctatttaaaaattttactttcttcagtaataattaacttattataactgttttactttataagagttttaatttttcaaaactttttgactcgtgtaataatgcttggtttaaaacaagcacattgtacacctatacaaaaatattttctttgtattcttattttataagcttttttctatttttaattttcttctttttttttaactttttaaacgtttttgttaaaaacgaagacacaaacacacacattagcctaggcctgctcagagtcaggatcattaatgtcactgccttccaccacgtcgtgtcccactggaagctctttaggggccacaacacgcacggacctgtcatctcttatgacaacagtgccttcttctggaatccctcttgaaggacctgcctgaggctgttttacagttaacttaaaaaaaaattagtagaaggagtacactctaaaattatgataaaaagaatagtatagtaaatacataaatcagtaacattcatttattatcattatcaactattaggtactgtaaataattatgtgtgctatattttatataactagtagtgcagtaggtttgtttacaccagcatcactacaaacatgtgaggaatgcattgcaccatgatattatgacggctagattagtaggtgataagaatttttcagttccattatgatctgcagtgactatttatttatatgattgtaaaattgtgattgaggctgggcacattggctcatgcctgtaatcccagcattttaggaggccaaggctggaggatcacttgatgtcaaaagtttgagaccagcctgggcaacatagcaagaccctatctctctataaaatttaaaaaataataaaaaattagccgggtgtggtacatgcctgtagtcccagctacttgggaggctgaggtggaaggaacccttgagcccgagagttggaagctgcagtgagccatgatagtaccactgtactccagcctgggtgacagagtgagaccctgtctctaaaaataaataaataaatacaaataatttttaaaattgtaaataatatttactgactttagatttgctgaattaatgtaggccaaggacctcatatgtaatcatagtttcagggtaaaatgctaacatttcacatcttgacaatgtcaagcaatgttatagctgacagttttaggaaatgtaagaaaggaagaaatgtgaagaaaaatgtatttatttatttaaaataaaataaaaattaactggctgggcacggtggctcacgcctgtaatcccagcactttgggaggctgaagtgggcagatcatgaagtcaagagatcgagaccatcctggccaacatggtgaaacctcgtctctactaaaaatataaaaattagccaggtgtggtggcgggtgcctgtaatcccagctactcgggaggctgaggcaggagaatcacttgaacccagaaggtgaaggttgcagtgagccgagattgcaccattgcactccagcctggtgacagagccagattccatctcaaaaacaaaacagaacaaaataaaacgaaacaaaaacaaacaaaattaactaaagaaaagttgtgaatagaatgagagaaaaatataattaaattccttatctttatagtgaaatgagtaaatgaagaaatagaagatcaagaatattaagtttatggaggtaatcatgagaattacagatagaacctatcaaaagagagacattgcagctgcaactggcattaaggtgaaggataggaaggaagtttggatgttttattttttacctttctgtactgtttgacatttttccgtttgatgtatgacttgtataatatgtacttgtatggcataaaactatgagtaataacatcatacatggtcatattttggtgatatattttacaaggaatataccaatgcatttgaaagccatctgctattaatgttgctcatactttttaatgtttcttttctacagcagaatcatgagacagactttgccttgtatctacttttgggggggccttttgccctttgggatgctgtgtgcatcctccaccaccaagtgcactgttagccatgaagttgctgactgcagccacctgaagttgactcaggtacccgatgatctacccacaaacataacagtgttgaaccttacccataatcaactcagaagattaccagccgccaacttcacaaggtatagccagctaactagcttggatgtaggatttaacaccatctcaaaactggagccagaattgtgccagaaacttcccatgttaaaagttttgaacctccagcacaatgagctatctcaactttctgataaaacctttgccttctgcacgaatttgactgaactccatctcatgtccaactcaatccagaaaattaaaaataatccctttgtcaagcagaaggtaagttgaaaatgtctattgttactaatgtttttaagtcagttacccatccttagacttactatctaaatatcaaggaaataaagaggaagaaatttgatctaatccaatttgccacaaatattgccattataatagaaaatgcttccaaaagagaaaatatactcttaaatcagtttcatccttaattttcaatgtttgcctctctcgctttctcccattagaaatagaacttagacgcaagagatagaagtaatgaacagagaagaatcagaatatcccctaagaacatggaaactaaactttcaatgctgctgatttagcatgtgaagtcgtgacaaaagtcttgagtccaaattctgacttaaataaaattaacaaattgatacaatgatcaagtgaattgttcaactaaaaattacctactcctggtttcagaaatctcctcagtggctatttcaatgactttttcaatagtggtgtcactttttcaatgattcctttttcttttcaaaactttgctcgaattttagttttttttcttttctttttagttgatgtttaataattgcacatatttatgagatagagaatgatttttcagtatgtgtatataatgtgtaatgattaaatcagggtaattatcatatccatcatctcaaatgtttctcatttgtgttgtgaacattcaaaatacgctcttctagcttttaaaaaatacacaataaatcgtagttaaccatattcaccctacaatgctttagagcaccagaaaaaaaaaaacgcatgttattgtttctaaatctgaggcaattattaagtgcttttctttaaccaaagcgattttcaagttacttcattttatggccttataaaaaattgaacattgctcttcctcagatgccaagaataatgtacaaatgtaaatatgctgtgaaacataaagtgatttgctccctagctattttaaatcttttcttgggtcttcttagagtctaatgtggatgaaatatctttgaatacaaaggcctcaaaatctggctagagaaatcattgcaaaatgttatttttgtaaagacttaaattaaaaaacctgcttctcgttaacagcgattacattagactttgccttaactggtatcgctttcccttaccttttgcctgaatttgaagcatacatattcaaaaatagcaaagggtgataaaaacatcccacagtactgataaagcaaacaaaacttaatattctgtactagtcatgactcaaaatttatataatatgaccctttctcagtataaaaatctatttaaaatttcatagatggcaaaattctcatgctttttaagaaaacattctgttcttttttctgatacttattttcaaggttaaagcatgacactgtgtgtttgataagccatgtgaaaatttcttgcatcataagtaaaaggttatgataaataagttcataaattagcaatgttccttatatcataaataagcttaagtcttttttattttggtaagagaaataaaatgattcttgaagtaagaaataaaatccttcctacaatggttgcaagggtgaccatcacaaagattataacgtaacaaagattaatcagatcaaagattttttattatgcttactgttagtattctacagaataatagagaggtgttgattttgctgttgaagtatttttcagatgtacttacatttaaaagaactgtttttgacagcaagactctaacatatgcatattattttttcccttcagaatttaatcacattagatctgtctcataatggcttgtcatctacaaaattaggaactcaggttcagctggaaaatctccaagagcttctattatcaaacaataaaattcaagcgctaaaaagtgaagaactggatatctttgccaattcatctttaaaaaaattagagttgtcatcgaatcaaattaaagaggtaagaagtaaggtaaaattattttgcattctgcctttaaggtggatagtccctatctgtgtcacatacacaggaatgtaatgctctctagcctctgcctgtcttccagcaatccttcccacctactgcttgggggcattggtgtcatcctcctgagagctcaggcagccccaggagaggtcgggagacgggactctgccgccctgcagcactgggtggaacccctgtgccgtgaccttgcgaacatccttaacatctctgagtctgtgtcctcacttataaagtggaaatagtgctctctcacacaaactctctgacagagttattaattaaagagtacgatggtcaagagccccaggttcacagtcgggttagctggcttggtctctgggctttgtcttttaacaatcatgttatcaggcaagttattcaagttctccctctctagcctcccagctttcaaatgggcgtgataatgactctgcttcataggactgtgtggtaaagaatttaggaccgtgtctggcgtaggcagtgctcaggaaatgatcagcagcagtatgtggttataaaaaccttcctataatgaagtcagcttaaataactgacaggactgtctctttttggaatcatgatcttcaagctaatcattttctgtcacgggagagcaacaactatctggaccggtggcacaggggtaaaagaatttaccaagacagttgcaggtggagaaaggcacatttattcgtgaaagtaggaaactacattgcgagaaggcaacgggcatatcagcaagagaagctgactgcaaagaaacaaaggcttgctggggattttacagggtcttgtttatgctgtgtgctgaagagggctttgagctgcactgacagcgcccaggttgcagtgggctaactcgcaggggcctggtgatagctgggcacaggaagattgtcagttatttgcacaggagggctacgtgtcctggatcatgaagacagactaataatttacctgctcttttgctttctctcggtcccgccaactgactacttttccctaaataggactctgcattttcacatacaggtttgtctgtattttacactcattttgttccaggctataagactactggaaatccttaattacaactctattttttttttcagacataaaaataaatggcgtacaaatttatcctaagatattaagatgttttgtgcaagctcttcattttattttttaaactgcatttttctatgattaagacatttattgtagtaatcttattaaatatatgaataaatgagaaaataataataaggggtgattttaaaaaatcactcaaatgtccatagtcagaaacaaccactgttagcatttgggtatatttatccctggcttttctccaaataattataaggaaaaacgatagcttaaattcttactgtactgaaattcacactgttaaggcacttaactgtgtgtcaagtgctgtgataaatttttaaaaatattttatgtatatagtatttttaatcaatattttattttattttattttattttattttttgagactgagtttcactctttgttgcccaggctggagtgcagtggcacaatctggactcactgcaacctccgactcccgggttcaagcgattctcctgtctcagcctcccgagtagctgggattacaagtgcctgccaccacccctggctaatttttggatttttagtagagacaggatttcaccgtgttggccaggctggtctcgaactcctgacttcatgatccacctccacctcggcctcccaaagtgctgggattacaggcgtgagccaccgcgcccagcctggagggggctctgatttgtaatgtgtcacttgggggacagtagggctaatgcaaaaaaagagagaagtatagaagaaagggtgctttatcataaacaaatgagttaaaatgcaaagcagaaaattatgaaattaagtatgataaatctgcatgatagcattattttacaggcattaaaattaagctttggaatgcttcttaattgtatgggagatgttcataatatgatattaaatctaaagagcaggagacatcaatcttagctactcaggaggctgaggcaagagaatcgcttgaacccaggaggcaagggttgcagggagctgagatcgcaccactgcactccaccctgggggacagagcgaaactctgtctcaaaaaaaaaaaaaaagaaaaagaaatcagagccctttactcctctggcggtttcgactgcctgccggaactggcctccattctctctggattcctcctctcccacctgctgttctcttgtccccgaagtgagtcccagaacagccaaggctctggtaagggtgtaggacggagcagaagggagctggaaaaacacgatagtaaaagaaagtcaggagaaaatccgggtggaaagacgagagggagagctagagctcagagttccagaaaggaaagtgtgccgtcaccgcctcatcataaaagccatccacaacttccttccatgaggctcactgagaacagcggcaccaagacacaaccaggaactgccccaggagtgacttcacgagcagtttattcattgcaattgttctcatggtgataaagaaaaagtaccaggagatggatcctggactggaaggtcagagaagcctccctgaaaaggtggcatctaagctgaggctgtgaatgctgagcagaagttagcccgtggccaggggaggtcagaggctggagtaagaggtgggcgctgcaggaaccgagtaaggaaggactcgtgcattacaggaagggggagaaatgctctgcccatgggatgtggtgaagggtgagcggagatggagtaaagaactgcatctggccgggtgcagcggctcaggcctataatcccagcactttgggaggctgaggcgggcggatcatgaggtcaggagttcaagaccagcctggcctacacggtgaaaccccgactctactaaaaatacaaaacttagctggacgtggtggcgcatgcctgtaatcccagctactcgggaggctgaggcaggagaattgcttgaactgaggaggtggagtttgcagtgagctgagattgcactgctgtactccagcctgggcgacagagcgagactccgtctcaaaaaaaaaaaaaaaaaaaaaaaaaaaggctttcaacagcattacagagtctgtgttcttttgattgttaacctctttttttttcctacctttagttttctccagggtgttttcacgcaattggaagattatttggcctctttctgaacaatgtccagctgggtcccagccttacagagaagctatgtttggaattagcaaacacaagcattcggaatctgtctctgagtaacagccagctgtccaccaccagcaatacaactttcttgggactaaagtggacaaatctcactatgctcgatctttcctacaacaacttaaatgtggttggtaacgattcctttgcttggcttccacaactagaatatttcttcctagagtataataatatacagcatttgttttctcactctttgcacgggcttttcaatgtgaggtacctgaatttgaaacggtcttttactaaacaaagtatttcccttgcctcactccccaagattgatgatttttcttttcagtggctaaaatgtttggagcaccttaacatggaagataatgatattccaggcataaaaagcaatatgttcacaggattgataaacctgaaatacttaagtctatccaactcctttacaagtttgcgaactttgacaaatgaaacatttgtatcacttgctcattctcccttacacatactcaacctaaccaagaataaaatctcaaaaatagagagtgatgctttctcttggttgggccacctagaagtacttgacctgggccttaatgaaattgggcaagaactcacaggccaggaatggagaggtctagaaaatattttcgaaatctatctttcctacaacaagtacctgcagctgactaggaactcctttgccttggtcccaagccttcaacgactgatgctccgaagggtggcccttaaaaatgtggatagctctccttcaccattccagcctcttcgtaacttgaccattctggatctaagcaacaacaacatagccaacataaatgatgacatgttggagggtcttgagaaactagaaattctcgatttgcagcataacaacttagcacggctctggaaacacgcaaaccctggtggtcccatttatttcctaaagggtctgtctcacctccacatccttaacttggagtccaacggctttgacgagatcccagttgaggtcttcaaggatttatttgaactaaagatcatcgatttaggattgaataatttaaacacacttccagcatctgtctttaataatcaggtgtctctaaagtcattgaaccttcagaagaatctcataacatccgttgagaagaaggttttcgggccagctttcaggaacctgactgagttagatatgcgctttaatccctttgattgcacgtgtgaaagtattgcctggtttgttaattggattaacgagacccataccaacatccctgagctgtcaagccactacctttgcaacactccacctcactatcatgggttcccagtgagactttttgatacatcatcttgcaaagacagtgccccctttgaactctttttcatgatcaataccagtatcctgttgatttttatctttattgtacttctcatccactttgagggctggaggatatctttttattggaatgtttcagtacatcgagttcttggtttcaaagaaatagacagacagacagaacagtttgaatatgcagcatatataattcatgcctataaagataaggattgggtctgggaacatttctcttcaatggaaaaggaagaccaatctctcaaattttgtctggaagaaagggactttgaggcgggtgtttttgaactagaagcaattgttaacagcatcaaaagaagcagaaaaattatttttgttataacacaccatctattaaaagacccattatgcaaaaggtaggtaaacattgtgaaattttaagtgtgtacttgcttttcaattaaatttctttttttttttttgagatggagtcctgctctgttgcccaggctggagtgcagtggtgtgatctcagcttactgcagcctccacctcctgggttcaagtaattctcctgcctcagcctctcaagtagttgggattacaggcacgcgccaccaagcctggctaatttttgtatttttattagagatggggtttcaccgtgttggccaggcttatcttgaactcctggcctcaggtgagcttcaattaaacttttaaatattaccaatattactcacaactcaaagaatttttaaaataaaattaagaaaaaaaaaacctgagtttcagtaacagtttaaactctacagagtatttttaaatagtattgcttctggctgttaaaaaccgtatattaattcttcaatacatttttttacttagattcaaggtacatcatgcagttcaacaagctattgaacaaaatctggattccattatattggttttccttgaggagattccagattataaactgaaccatgcactctgtttgcgaagaggaatgtttaaatctcactgcatcttgaactggccagttcagaaagaacggataggtgcctttcgtcataaattgcaagtagcacttggatccaaaaactctgtacattaaatttatttaaatattcaattagcaaaggagaaactttctcaatttaaaaagttctatggcaaatttaagttttccataaaggtgttataatttgtttattcatatttgtaaatgattatattctatcacaattacatctcttctaggaaaatgtgtctccttatttcaggcctatttttgacaattgacttaattttacccaaaataaaacatataagcacgtaa

SEQ ID NO: 2090 - DNA, 13317 bp, Homo sapiens
  source 1..13317: mol_type = genomic DNA
tagcttcctcttgctgtttctttagccactggtctgcaggcgttttcttcttctaacttcctctcctgtgacaaaagagataactattagagaaacaaaagtccagaatgctaaggttgccgctttcacttcctctcaccctttagcccagaactgctttgaatacaccaattgctgtggggcggctcgaggaagagaagacaccagtgcctcagaaactgctcggtcagacggtgatagcgagccacgcattcacagggccactgctgctcacagaagcagtgaggatgatgccaggatgatgtctgcctcgcgcctggctgggactctgatcccagccatggccttcctctcctgcgtgagaccagaaagctgggagccctgcgtggaggtatgtggctggagtcagctcctctgaactttccctcacttctgcccagaacttctcactgtgtgccctggtttgtttatttttgcaaaaaaaaaaaagagttaaattaccttaaagactcaagaagccacagagatcaaataattcattgttacagggcactagaggcagccattgggggtttgttccatttggaaattttgagtgctaacaggggcatgagataacatagatctgcttaaggtccctgctctgctaccttgtggctctgtgaagaaattatcaaacctgtctgagactagttttcgcatctgtaagagaattataataccttcttcactagagagtaagcagactgcttcagtgtcatttcttcccactggtggtctttacactcagcttcaagcagtcaccctgctcctttcaatctcaggaaaaagatggcttttgtgtgtgtgtctctagagaaagaactttctaagtgggtgtcagacttctgtatgcagtaatatagtttagtccagaggatgaaaaaaataagagaatgaaaaaggaaaagagagagagagagaagaaaaaagcaagagggaaatatgtataatgtcagctaatgcaacagtttctttcttagtgaaataccaatcagctggttggtaatcttattcatgatggatctcttttgtttttcccctgcgcagacttcacagttgctttagaaacccatagtagagccgaacagctaagaaaatgatttacagtgaggcagggtcagaaactcaagagagaaaaagccagctgcagtcctgaagttgaggatataggagaaaatcaagtaatatttagcaaagactaattcattatcttgaagccatcccttccctcaattccctgcccatagtcctcctccttgtcctcttctctgtatccctctgctgttaggttaatggagatagattttctaattaggctcactgcgagataaaaccacagccaaacttgacttcttttccccatgtaccttttcctgtcagtccctgaagcctgtccatccctgcccatccccttagttccactgtaaggcaggccctcatttcccctggcattgactcttacacactaactgctttcctgattccagtcttcttcctttaattcattctgcacgttcttgtttgttatgtacttgcatttgttgttattatttttccttaggcttcaatctaacaaattactctccttaaaaacttttaataactctccattgccattagaacagctttctaccacagggcctttgcactggctatttcttctacctagaatgctagatcagtgctatccattggcaatattatgtgagccacatatgtacttttaaagtttttagtagcctcattaaaaaaagaaacaagtgaatttaatttcgataatagttttatttaacttagcgtatttaaaataatgtttaaaattttaatatatatttacctattattgatatttttacattccttgtttggtactaagtctggaatttagtatatgttttacatttaccacacttctcaatttacactattcacatttcttgtgtttgataactgtgtatggctagtgactaccgtattggtcagtgcagcccaagtccttttcatgctttaatcactccattcagatctctgattaaatgtcccctcctcagggcagtcttccttgattgccccatgtagagctctccagcctcacttatttgcctcaaatccccttatactgcttaatatttttttttctagagcacaacattttatatttttgtttgtttattttctctctctccctttgtaatggaatcggtaaggaggcaggatcattgctggttttatttaccactatatttccagtggccagcacacagtagccgctagatgtgtaagtgataaatgattgaaataattgctgcaggacaaagtctgaggccctcctgatctggcttgccctcttacttagatttcaccactcccaccactcaccagctaatctgagtttgttttccactctttacgtgctcacgttgtcctctccttaggacatgtttttcttcccctttccacatatctaaaccttactcatcttccaagacccactttaaaatcttccttttctgggaagcctttcctgaatccagacttgatctctgctttctctgaaccacagggcatattttctaagcctattttatggccccttgagatagtgttagctttgctcctatctaaactcttactctagactgtgagtccattgaagtctggagctgcatcatatttttctttgtaatgcccacagcacttggcaggaaatgcctacaatttggacttaagtaaaccttcatttaatcagttattcaatcagttagtgattcagcaaatatttattgagcaccaaccatttgccagacaccattctgagtgctggagacaaagcagtgggcaaacccatcaaacttgcaatggaatacaggagatgaacaatacgatgagaacaatcagatagacaacataatgttagatggttgtgcttcccgtgaaagggaataaaagagggcaaagaaagagtgcctggcactgtttctattagacaatattgtctttgaggctccatggcttgcaacatttaagcagacatacgaatgaagatctgcatgtttgaactctgactttgcgcatattacttcatttctttgaatttccattttcctcatctttaaatgcttatttgaagattaagtgaaagtatataacaaacaagaactatgcaggcatatggtaagggattaatgatagatgataataattaatgttgacatctattgatcacttatactgtagcgggcttttaaataaactctttaaacaccttatctcatttaatccttcaaacattctattggtttcaaacaacagaaaactacaattagctggcttctgcaaggaattttgttggaggaaatgagagcattcagaaattagatgggagcgttagagaattaggcttacaaagaatgtgggaaagtaggctagaaagcagtgtaaaaacaaagacagcataaagcacttgaccttatttactaggttccaccatgggaatccatgcactctaaagatttccccctatttctacatcactttgctcaagggtcaatgagccaagaaaaagaatgcagttgtcaaaatctgggccatgactaaggaaggtctggacatcttgactgccagacagtctccccaatgatatggagtatttaaaatgatactggatattttatttattttttgtattttcaacttttaagttcagaggcacatgtgcagagcatgcaggtttattacataagtaaatgtgtgccatggtgatttgctgcatagatcatgaaaatatggaacgcatcatggatttgtgtgtcatccttgtgcaggggccatgctcatcttctctgtatccttccaattttagtgtatgtgctactgcagcaagcacgatattggatattttattacctacattttacatatgataaaatgaggctcactgaggtttttcttttgttcgttttattttgttttgtttttaaagacttggccctaaaccacacagaagagctggcatgaaacccagagctttcagactccggagcctcagcccttcaccccgattccattgcttcttgctaaatgctgccgttttatcacggaggttagaatgctgagcacgtagtaggtgctctttactttctaatctagagtaagacaatttataagcatgaattgagtgaatggatggatggatatatggatggaaggatggacagatggatgaaaggttgactgaattttgtgcttgcacaaaaagaggcccctctccaccatctctggtctaggagaggggagttgggagaccatgcagtaaagatacttcatgtcatgtgtaatcattgcaggtggttcctaatattacttatcaatgcatggagctgaatttctacaaaatccccgacaacctccccttctcaaccaagaacctggacctgagctttaatcccctgaggcatttaggcagctatagcttcttcagtttcccagaactgcaggtgctggatttatccaggtaatgaatccacttttacatactgcacaaggtgaggtgttcattgtcctgtcatttcattattggactggaaagcttggtttgtggagtctcatcttcattcacttattcattcatacaacagatgtcttattaactatataaccttgagcaagctacctctattctccaggtctcagttttctaatctgtgaagtaggcagttggctgagacagcttctaagggcaattctaattttaggttttcttttaagacaggagagaaaattagcttaaattctttcataagcagctatttattgactacttgctatatgttgtacactctgcaagaagacaggcatatattgatatataacacacagcccctgttgttaaggaggcatatcttcttgaaagagttaataccttaaagtcctgggtatggtcctgggtacatagtatatagtcaacacattttaattatgattttttggatctggaaactgatataaagatagcgacatataacagtaggtgataaattatgtttaaactaaaggtaactaattgtatttttcagaagaggggccttctctgtggtgggtagtcaagaaagatttcatgaactgcataagattcaaacaatgtctagaatattaaaactagtgtacaggatagggaattaggaaaagacaagtaacccaaggagaaagatgtcaagattaaaggaaaacatctgctgtgggcagggaataatggctaagattttcttttctgatgcagggaagtatatcgtttgttgtggcaggtgaaatgtcatcttgatattttaggggaaccaaattctaaaagggttttcatcatcggggccttatttgcaaatcgaactagataatggatcatgttctctgcaatggtttgtaaaacatttcaaaacattttacatattttttattatagaaattattgataaagactaaggtcacagtataaaaatcctttttagagcagacatttctgtagaagagtgagcatacgacctattatactctaatttggatatagataggatgtaacaaaggagtaatggaacaattcaaaggcagtggtatagtgcatagagtcctgttggggtcagaagacctgagccaagtttacccccaacctttataaccatgtaaccttaggcatattacttcatctcccttaatcttagttttcatatctgatcaatggaaatgatgaaacttattctgctggattaaatgtgataataaatattaatatgctgtatatatttaaatttttataaaatatattttataagcataaagtattcttacagaatttcattaggtttttaaaataatttcaacttttatttttgattcagggatttacatggttatattgcgtaatgctgaggtgtagggtacaatcgataccatcactcaggtagtgagcatagtacccaatagttagtttttcaacccttgctgctttctctctatcccctctctagtaatccccagggtctatttttgtcatctttatgtccatgtgtactccatgtttggatcctacttataaagtgagaactcatggtatttggctttctgttcctttgttaatttgcttaggataatggctactagctgcatctatgccattatgttctaaatttcagtttcctgcatgaaaattttgtcaagtactctattaaggtagaccacctctccctttttttttttttcaaacaagaagtagtttttcaccaaacaatgtctcttatgtaattcatcttcaatccactggatacccaataaacttgccccagaaaccttaaatctgtgcttacagagaggccagcttcccttcttgttaacccataggagattctgaattagggcaagcacaaaagatagcacaatagacatcctttgccttttcgtacagtgttcacatacagtaactcaactagtcttgtaagaatgctttgtgatagaccaggcagccttctttcccctatagaaatatatatatatttctttttataggtgaggaaactgaagcttgaataatttaaatgacttatatacattatcattgcttgttagccacagaccagagatttaagttcacatctccagaatccaacttaaatgttttctttgtcttaatactctacttctctaaagtgattatcaccaatgtaatgatatagagacacagcaagaccctttccttctcacctaatgtatagagcaatgcagagatagaatgatgggctataacaatcatataattgaaagaaagaacttcaaaaataatcaagttcagctgtttgatttataaatgtgataactaaaacctagagaggaaaagaggtactcaagatcacacagtaggagaggactgcagaaacaccaaacccaagctcttttgtccactcttccagcgttctttctactatactgcctatcctttatctagttaccaataaataacaaaagcttggaccacaatgcttttattgtctaggaaactcctgaagaagctaaataaaatgggtggggaatattgtaaatgtaattcaggctggattaagaaagaacttatttgtacattgtaactgacaagcacctgcaatgctgaaaggaatttttcattggcttgctgtttgctggctgcatcaaagccctgtctctaggacatgtctctgaacattgtgtgtagcatggctttcatttcttttaggataaaattcaaaaccctttatctggttggtaaacctctgcctaattgggaaccttctttctccacaactccatattgtacactccaatttcatctctgttctccaaccatggaagctatttgtcatgattcctccttgtgtcattttttttctgtcaaccttggggcttttgtgtttgctgttcacttcacctccttttattgttaacttctactcatctttcaattttcaacttaagtgttctcagagaaacctactttgattttcttggtccacaacggttctctggatgtgaactcttatagcacataattttcacttttttccacaaaactcgctcctatcacctgttacaagcatttacctctgataacaagaactttcaaatatctagctgtcatgtaagcacttttcataaacattaagagtatctgtgacacttatgtgtaatttttcgtatctctgaaattgatatttaccagtcatttatcttggctaccaactaacaactatccatattatctgtaccaatcagatgtataatcacaattttgtgtgacagaaaatggctaaacttgatccaaggctattacatgctttatcaactgcacaatctttatatatgtcaattattgatctttaactgatttccttcttatggattttctcctctgcttatcatgtatgcctaacatgacaaaaaagagcctatcattgcagccagtatgataatactcagtctgtggggcttcttatttgcttattccatcatcatctgtcctgcttgatgtctttgcctatgcacaatcatatgacccatcacatctgtatgaagagctggatgactaggattaatattctattttaggttcttattcagcagaaatattagataatcaatgtctttttattcctgtaggtgtgaaatccagacaattgaagatggggcatatcagagcctaagccacctctctaccttaatattgacaggaaaccccatccagagtttagccctgggagccttttctggactatcaagtttacagaagctggtggctgtggagacaaatctagcatctctagagaacttccccattggacatctcaaaactttgaaagaacttaatgtggctcacaatcttatccaatctttcaaattacctgagtatttttctaatctgaccaatctagagcacttggacctttccagcaacaagattcaaagtatttattgcacagacttgcgggttctacatcaaatgcccctactcaatctctctttagacctgtccctgaaccctatgaactttatccaaccaggtgcatttaaagaaattaggcttcataagctgactttaagaaataattttgatagtttaaatgtaatgaaaacttgtattcaaggtctggctggtttagaagtccatcgtttggttctgggagaatttagaaatgaaggaaacttggaaaagtttgacaaatctgctctagagggcctgtgcaatttgaccattgaagaattccgattagcatacttagactactacctcgatgatattattgacttatttaattgtttgacaaatgtttcttcattttccctggtgagtgtgactattgaaagggtaaaagacttttcttataatttcggatggcaacatttagaattagttaactgtaaatttggacagtttcccacattgaaactcaaatctctcaaaaggcttactttcacttccaacaaaggtgggaatgctttttcagaagttgatctaccaagccttgagtttctagatctcagtagaaatggcttgagtttcaaaggttgctgttctcaaagtgattttgggacaaccagcctaaagtatttagatctgagcttcaatggtgttattaccatgagttcaaacttcttgggcttagaacaactagaacatctggatttccagcattccaatttgaaacaaatgagtgagttttcagtattcctatcactcagaaacctcatttaccttgacatttctcatactcacaccagagttgctttcaatggcatcttcaatggcttgtccagtctcgaagtcttgaaaatggctggcaattctttccaggaaaacttccttccagatatcttcacagagctgagaaacttgaccttcctggacctctctcagtgtcaactggagcagttgtctccaacagcatttaactcactctccagtcttcaggtactaaatatgagccacaacaacttcttttcattggatacgtttccttataagtgtctgaactccctccaggttcttgattacagtctcaatcacataatgacttccaaaaaacaggaactacagcattttccaagtagtctagctttcttaaatcttactcagaatgactttgcttgtacttgtgaacaccagagtttcctgcaatggatcaaggaccagaggcagctcttggtggaagttgaacgaatggaatgtgcaacaccttcagataagcagggcatgcctgtgctgagtttgaatatcacctgtcagatgaataagaccatcattggtgtgtcggtcctcagtgtgcttgtagtatctgttgtagcagttctggtctataagttctattttcacctgatgcttcttgctggctgcataaagtatggtagaggtgaaaacatctatgatgcctttgttatctactcaagccaggatgaggactgggtaaggaatgagctagtaaagaatttagaagaaggggtgcctccatttcagctctgccttcactacagagactttattcccggtgtggccattgctgccaacatcatccatgaaggtttccataaaagccgaaaggtgattgttgtggtgtcccagcacttcatccagagccgctggtgtatctttgaatatgagattgctcagacctggcagtttctgagcagtcgtgctggtatcatcttcattgtcctgcagaaggtggagaagaccctgctcaggcagcaggtggagctgtaccgccttctcagcaggaacacttacctggagtgggaggacagtgtcctggggcggcacatcttctggagacgactcagaaaagccctgctggatggtaaatcatggaatccagaaggaacagtgggtacaggatgcaattggcaggaagcaacatctatctgaagaggaaaaataaaaacctcctgaggcatttcttgcccagctgggtccaacacttgttcagttaataagtattaaatgctgccacatgtcaggccttatgctaagggtgagtaattccatggtgcactagatatgcagggctgctaatctcaaggagcttccagtgcagagggaataaatgctagactaaaatacagagtcttccaggtgggcatttcaaccaactcagtcaaggaacccatgacaaagaaagtcatttcaactcttacctcatcaagttgaataaagacagagaaaacagaaagagacattgttcttttcctgagtcttttgaatggaaattgtattatgttatagccatcataaaaccattttggtagttttgactgaactgggtgttcactttttcctttttgattgaatacaatttaaattctacttgatgactgcagtcgtcaaggggctcctgatgcaagatgccccttccattttaagtctgtctccttacagaggttaaagtctagtggctaattcctaaggaaacctgattaacacatgctcacaaccatcctggtcattctcgagcatgttctattttttaactaatcacccctgatatatttttatttttatatatccagttttcatttttttacgtcttgcctataagctaatatcataaataaggttgtttaagacgtgcttcaaatatccatattaaccactatttttcaaggaagtatggaaaagtacactctgtcactttgtcactcgatgtcattccaaagttattgcctactaagtaatgactgtcatgaaagcagcattgaaataatttgtttaaagggggcactcttttaaacgggaagaaaatttccgcttcctggtcttatcatggacaatttgggctagaggcaggaaggaagtgggatgacctcaggaggtcaccttttcttgattccagaaacatatgggctgataaacccggggtgacctcatgaaatgagttgcagcagaagtttatttttttcagaacaagtgatgtttgatggacctctgaatctctttagggagacacagatggctgggatccctcccctgtacccttctcactgccaggagaactacgtgtgaaggtattcaaggcagggagtatacattgctgtttcctgttgggcaatgctccttgaccacattttgggaagagtggatgttatcattgagaaaacaatgtgtctggaattaatggggttcttataaagaaggttcccagaaaagaatgttcatccagcctcctcagaaacagaacattcaagaaaaggacaatcaggatgtcatcagggaaatgaaaataaaaaccacaatgagatatcaccttataccaggtagaatggctactataaaaaaatgaagtgtcatcaaggatatagagaaattggaacccttcttcactgctggagggaatggaaaatggtgtagccgttatgaaaaacagtacggaggtttctcaaaaattaaaaatagaactgctatatgatccagcaatctcacttctgtatatatacccaaaataattgaaatcagaatttcaagaaaatatttacactcccatgttcattgtggcactcttcacaatcactgtttccaaagttatggaaacaacccaaatttccattgaaaaataaatggacaaagaaaatgtgcatatacgtacaatgggatattattcagcctaaaaaaagggggaatcctgttatttatgacaacatgaataaacccggaggccattatgctatgtaaaatgagcaagtaacagaaagacaaatactgcctgatttcatttatatgaggttctaaaatagtcaaactcatagaagcagagaatagaacagtggttcctagggaaaaggaggaagggagaaatgaggaaatagggagttgtctaattggtataaaattatagtatgcaagatgaattagctctaaagatcagctgtatagcagagttcgtataatgaacaatactgtattatgcacttaacattttgttaagagggtacctctcatgttaagtgttcttaccatatacatatacacaaggaagcttttggaggtgatggatatatttattaccttgattgtggtgatggtttgacaggtatgtgactatgtctaaactcatcaaattgtatacattaaatatatgcagttttataatatcaattatgtctgaatgaagctataaaaaagaaaagacaacaaaattcagttgtcaaaactggaaatatgaccacagtcagaagtgtttgttactgagtgtttcagagtgtgtttggtttgagcaggtctagggtgattgaacatccctgggtgtgtttccatgtctcatgtactagtgaaagtagatgtgtgcatttgtgcacatatccctatgtatccctatcagggctgtgtgtatttgaaagtgtgtgtgtccgcatgatcatatctgtatagaagagagtgtgattatatttcttgaagaatacatccatttgaaatggatgtctatggctgtttgagatgagttctctactcttgtgcttgtacagtagtctccccttatcccttatgcttggtggatacgttcttagaccccaagtggatctctgagaccgcagatggtaccaaacctcatatatgcaatattttttcctatacataaatacctaagataaagttcatcttctgaattaggcacagtaagagattaacaataactaacaataaaattgaatagttataataatatattgtaataaaagttatgtgaatgtgatctctttctttctctctctcaaaat

SEQ ID NO: 2091 - DNA, 13317 bp, Homo sapiens; identical to SEQ ID NO: 2090
  source 1..13317: mol_type = genomic DNA

SEQ ID NO: 2092 - DNA, 13317 bp, Homo sapiens; identical to SEQ ID NO: 2090
  source 1..13317: mol_type = genomic DNA

SEQ ID NO: 2093 - DNA, 7231 bp, Homo sapiens
  source 1..7231: mol_type = genomic DNA
ttgggtaatctgagatgtgctttaaaaaaggaccgttgagaaaggggtggagtataaggaaaccgcaagtgagagggagtactctagtggggtgggggtgccgatacacagctaggcttaaggggccagggaaggaagtggtgccagaatcctagagatagtcatgattacgcaagagttgcccggcaggagagtccatagcaaccttgatgctgcagggtgggagccgggggattcaataccccaaactcagcctcctcctcctctccattcttctgctggggctccccaataatggaacatgaccaggagccagagggcgaaggagcctgttgataccattgagagagttcggcgtccccgggcaaaggaaggggagaagggtggggagtgggtctggaaggccccatgaaagacacctggcacaccccctaagtacactagcatccaaagtttatgaaaaacttccacacactcagtcctcacaacaaccgtgagggaggtaaggcagtgattatgatcccatttcacaggttgaagacaccgaggctcagagaggggaaatgactggcccaaggggacaagacgcatcttaagatgtcaagtcctggacccttccctgcaaggccccctgtggaaggaaatagctctgctggacattcagccactgaagagagcccccagtccagaggcttggagaccactggaggctctggcctggtgaccctgggtctcaagagaaatccgtgcggagagggaggggcttttccattccactgatgaggagctcaggctcttgggacatcgtggaggtactgggcaccgctgaggtcttcaagctgcccacagtaacctcttccttttcctcctgccgcaggtgccggagaacctcctgggacagcgagaagctgctgtcatctgcaggttctggaacagggagataggggagagagtaatgaggatcttacccattcccactcaaacatacctagagaacttgctgggaagatcccctaaccctccctaccccccttcctacccaagccccagccactgggactagagtttcatagaatcctagaggtagaagtggttcaggcctggcacagtggctcacgcctgtaatcctagcactttgggaggccgaggcaggtagatcatgaggtcaggaattcaagaccagcctggccaatatgatgaaaccccgtctctactaaaaatacaaaaattagctgggcatggtggcgggcgcctgtagtcccagctacttgggaggctgaggcaggagaatcgcttggacccgggaggtggaggttgcagtgacccgaaatcgagccacttcactccagcctgggcaacagagtgagactccatctcaaaaaaaaaaaaaaaaagtgatttcagagagaatgaaattccaccctcttacttttaaagctaatgctcagagaggagcagaaacctgcccgaggtcacacagtgagggagtagtagagccgaggctgcagccctagtctcctgtgcccagtacatactggcctgggactcttctgtttcctctggaatcctagatgaagtgagaggcccctagaacccacctcttcaggctcccctgagggattacagtcaaagacctaaaaagcaatctggtgtgctgggaagagggggcttctcccagggaaggaaggacaggcccagggcatggtgctccatagccccttctgactctttgggagaccctgggacccctgactcctcctgccctccagcctatcaacccctcaccctaccaacccctcaccctggtaggcaatgaggcggcagttgttctgagactcaggggcatctgccaggatgtcctcaagtgtccggcagaagagtttggcctgctcaagcctatcctcccggctaaagccagcttgactgtattgtgacatggcaaacaaagtctgcaagggggtggcgtactccaggacacaggtgcccgcctagaggaggtaagaggaagaccagactaagccaggggccaggcggatggagaatggagggtccagtccaggctctggcccccagtgccacgggctgaggccccactccctcagcctgtaacgatagagtcctgggaggtggccaccctaatggggtctatgctgtctggcctgcctttgcctctgatacccaactctgaaatcagggacacggctgggctaaatttacccttcacagatccttcttccaagatcctagggcaagacccgaggctgtcaactgctccagctgggaatcaggtctggggctaggctctgggttcaactctggtctgggttcccctgcacccacatgaatccttcagatgttctcacagccttcgtctggggcagctttatggtcaagagcatggtacagtcaagtttaaatcgtccactttcctacggtgtctctgagcctcagtgtcctcctctgtaaagtgggaatgctaacagtccctaccccatagggtggtggtgagaattcaatgaggtgatcagatgacacacccagaatagcatccagcttgtagtaagtgctcgataaatgttactcatcattatcattcagagctgaatcctgcccagacctgggaccagctagggacactacagctcagagaagggcagtgaattttcatcagtgcttggctagggcccagggttctggggtcctgacccctcctcagagacccccactcccctgcacacttacccgctgcccgttctccagaagctcatagatgctgttgctgtaaacccgatccttgatgccagcatggtcaccggtctgctggggcagtttatccaggaagcgaatgttggggtcagccatactcaggttatcaggcaccccacagtccaatgggaggagaatatacagccgctggctcactgcaccccgtagcaggttgttgtaatgctgattgtaagttcgaatccgggcctggagctctgaggcagggaagcccaagaagttattcctgctaaccctatctcccacctgattcaggagtgagacccaggtcattggcccccgcagtgtgtgggtgccagagaatggagagtccagtgcactctcattgtacaggaggccaggaggggcagcgcctccaaaagccctccccacccctcctcttactgcaccaccctttaccctccctcacttctttcctcagatgtctatgtcagcgccacccctttccaccatggctttcagggctgagaggcaggcagagccctgagaggtgacatttccagcattctcgtgtgcacagagggaggcctctagccccagatcagtctcctagcggaagccctaggagatagcaatgagatatggaagagctgccgctttagcctgcaagtcagaagaataaaacacacaggcttagggcaggcacagtggctcacgcctgtaatccagcactttgggaggctgaggcaggtggatcatttgaggtcaggagtttgagactagcctgggcaacatggtgaaacattgtctctactaaaaatacaaaaattagccaggcatggtggcacgtgcctgtaatcctagctattcaagaggctcaggcaggagaatcacttgaacctgggaggcagaggttgcagtgagctgagatcttgtcaccactgtactccaggctgggtaacagaaagagacttcatctcaaaacaacaacaacaacaacaacaacaacaacaacaacaacaacaacaacaaacacaggctccacggtgcagtggtctagggtccaggctctggacaaacctgggttcaaatcctttctcttcctctctctaagctatgtgatatcggataaatcactttacctctcagaactgcacttaaaaaaaaaggccaggcacagtggctcatgcctatagttctagcactttgggaggccgaggtgggtggatcacctgaggtcaggagtttgagactagcctacccaacatggtgaaaccccgtctgtactgaaaatacaaaaattagccgggcgtggtggcaggcacctaaaatcccagctacttgggaggctaaggcaggagaatcactggaacctgggaagcagaagttgcagtgagcccagattgtgccactctacttcagcccgggtgaaaaagtgaaactccatcttaaaaaaaaaaaaaaatctaaggctggtgcagtggctcatgtctgtaatcccagcactttgggaggccaaggtgggtggattacttgaggtcaagaattcaagaccagcctgggcaacatggtgaaaccctgtctctactaaaaatacaaaaaaaaaaaaaaaaaaaaaaaaaaaagccatgccggtggcagggacctgtaattccagctacttgggaggctgaacccaggaggcagaggtcgcagtgagctgagattgtgctactgcactccagtctgcgcaacagagtgagactttgtctcaaaaaaaaaaaaaaaaaaaaatctaaaataggtatgggcttggtggctcctgcttgttatctcggcactttgggaagccaaggcaggaggattgcttgagcccaggagttgagaccaggctgggtaacatagcaaaaccctcttctttttaaaaaatatataaataaaataaaacaggaataaagattattccttcctcatagggtgtgaattagaaaaggcacatgagagcacacagcatgcagtaaatatttattgaaagaatttacagctgggctcacgcctgtaatcccagcactttgggaggctaaggcaggcggatcacttgaggtcaggagtttgtaccggcctggccaatacggtgaaaccctgtctctactaaaaatacaaaaattagccgggcgttgtggtgggtgcctataatcccagctactcgggaacctgagccaggataatcacttgaacttggaaggaggaggttgcagtagccgagatggtaccactgcactctagcctgggcgacagagggagattccttctcaaaaagaaaaaaaaagaattcacaagtgaccttgggcaagtcacttaatggctctaagccccatattcctttctgcaaactaggcatcatagcaacatccttcatgccttgggattaaaggatttggtagacatgaaaatgctttgaaaaatatagtgagttctgtgtgtttagaaacacaagaggctgtgtgtcttagtgtctgttttgtagatcgagaaatgggggcagagaggatggcccacctggcaggatcagccgcagatatccgatgtaatatgaccatgccagcccatgggccacgttgaaattccctttttcacacactgcagagatctcagctggggccaggccctgtggacagcaggatgtggctggggggcctccatcaaggacacccagagaactcctcctcctcctccaaggcttcccaacctgctcctgacttgatccctcttttgccattgccaaacccactgttccaggacattataggttctactccatggactccagcctttaaaccagtcccactcccagtactcagctcagggcaggtcacaccagccacagccaccacttggccagagcttctacctccccctgtgtcataccttgaggcccaggaggatgttcagtgcctgcgagaggcccaggagggcaagcatccaagtgaagggcgggccgaccgcatttgggagggagtagtagaaatagatggacagcagcaacagggccccacggcggagggggcagcccaggcaggcccgcacagtcctccagtagctgccccggtacctgtgagtgacagccagaccccagaccccagcccccagcccagctcagccagagaggttcaaggaggggcagggctaggcatcaagggagtgacacacgttggataccccgtccctgggtactgcagtgagtcacctggagtggatgtggcgcagctcctcagccaggctgcagaccccgtttaacagcagtcccagctgcagggaggctaggtggagcaccaggtaccggagagtgtgctctggtggctctcctagcccccaaagggtcaccaggcaggcactcagcagaaccaaggctgccttctgggccccgtgacccctgggacacgggatggatggatgcaggctggagtggggcatctgtgggcaccaagaaatccatgaccattctccccttgccctcctgcccttctgggactgaggctctggctgggcacttcctcccagttcccctttccctggtgcccagccactcccagaggctgctcttagagacacctctaggaggcaggctgggaataagtcaccccaaagctcctgtctcagcgaggtttgctgaaaacagagcagggcctgcacatacacgccccaccaagacccagggagaccacaggtgtggtgaagaaagaaggcagcaactatcccagacccagacttgaagctgtcctgtgcagccgtacccaaccaagaacccttggggacctgggttcccctgtccccggaacccaccccagggaggaccttagtcaacaaagtggaaaacagagctcagggagtggggacagggcagccagcaggcaccccctcgcctctgggtgccaggggccctaggtttggcgttctgccaggctgatcttgagcctaccttctgcctcccggacactggctgctctggatgatgacgaggagagaaggcccggcgctacgagcagccaagggcagcttctctgagtgcagcctgaaaatgagatgttaacaacgattggtttctccacaacactctagccctggcgtttctccaaaccgcagctttactggtgctgggaaggagggtatttcctgttcctcaggaagggaggtaggaaccttccctcaaagccctgatgagctgggcctgagtcctggggtcaggggtgaggtttgagaaagcctccattccattgccctttgctacccccaaaccaagggtgtttagaaacactcaccgcagtcacagctctgaacagcgggttcccctcaagccaccacgatcaaacacactgtacctaacacctgagcaggactccacacactcagccaaaggcagcacacacatcacacgatgattccccgtctcatatttttcttctggtttccaggatgcagattctttttctgaaaagtgtgacctaggagggaggagtgaaaaatgaac

SEQ ID NO: 2094 - DNA, 2769 bp, Homo sapiens
  source 1..2769: mol_type = genomic DNA
cagacgctccctcagcaaggacagcagaggaccagctaagagggagagaagcaactacagaccccccctgaaaacaaccctcagacgccacatcccctgacaagctgccaggcaggttctcttcctctcacatactgacccacggctccaccctctctcccctggaaaggacaccatgagcactgaaagcatgatccgggacgtggagctggccgaggaggcgctccccaagaagacaggggggccccagggctccaggcggtgcttgttcctcagcctcttctccttcctgatcgtggcaggcgccaccacgctcttctgcctgctgcactttggagtgatcggcccccagagggaagaggtgagtgcctggccagccttcatccactctcccacccaaggggaaatggagacgcaagagagggagagagatgggatgggtgaaagatgtgcgctgatagggagggatggagagaaaaaaacgtggagaaagacggggatgcagaaagagatgtggcaagagatggggaagagagagagagaaagatggagagacaggatgtctggcacatggaaggtgctcactaagtgtgtatggagtgaatgaatgaatgaatgaatgaacaagcagatatataaataagatatggagacagatgtggggtgtgagaagagagatgggggaagaaacaagtgatatgaataaagatggtgagacagaaagagcgggaaatatgacagctaaggagagagatgggggagataaggagagaagaagatagggtgtctggcacacagaagacactcagggaaagagctgttgaatgcctggaaggtgaatacacagatgaatggagagagaaaaccagacacctcagggctaagagcgcaggccagacaggcagccagctgttcctcctttaagggtgactccctcgatgttaaccattctccttctccccaacagttccccagggacctctctctaatcagccctctggcccaggcagtcagtaagtgtctccaaacctctttcctaattctgggtttgggtttgggggtagggttagtaccggtatggaagcagtgggggaaatttaaagttttggtcttgggggaggatggatggaggtgaaagtaggggggtattttctaggaagtttaagggtctcagctttttcttttctctctcctcttcaggatcatcttctcgaaccccgagtgacaagcctgtagcccatgttgtaggtaagagctctgaggatgtgtcttggaacttggagggctaggatttggggattgaagcccggctgatggtaggcagaacttggagacaatgtgagaaggactcgctgagctcaagggaagggtggaggaacagcacaggccttagtgggatactcagaacgtcatggccaggtgggatgtgggatgacagacagagaggacaggaaccggatgtggggtgggcagagctcgagggccaggatgtggagagtgaaccgacatggccacactgactctcctctccctctctccctccctccagcaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtgaggaggacgaacatccaaccttcccaaacgcctcccctgccccaatccctttattaccccctccttcagacaccctcaacctcttctggctcaaaaagagaattgggggcttagggtcggaacccaagcttagaactttaagcaacaagaccaccacttcgaaacctgggattcaggaatgtgtggcctgcacagtgaagtgctggcaaccactaagaattcaaactggggcctccagaactcactggggcctacagctttgatccctgacatctggaatctggagaccagggagcctttggttctggccagaatgctgcaggacttgagaagacctcacctagaaattgacacaagtggaccttaggccttcctctctccagatgtttccagacttccttgagacacggagcccagccctccccatggagccagctccctctatttatgtttgcacttgtgattatttattatttatttattatttatttatttacagatgaatgtatttatttgggagaccggggtatcctgggggacccaatgtaggagctgccttggctcagacatgttttccgtgaaaacggagctgaacaataggctgttcccatgtagccccctggcctctgtgccttcttttgattatgttttttaaaatatttatctgattaagttgtctaaacaatgctgatttggtgaccaactgtcactcattgctgagcctctgctccccaggggagttgtgtctgtaatcgccctactattcagtggcgagaaataaagtttgcttagaaaagaa

SEQ ID NO: 2095 - DNA, 16127 bp, Homo sapiens
  source 1..16127: mol_type = genomic DNA
ctttggaaagtcccgtggaaatccccgggcctacaacccgcatacaactgaaacggggcaaagcagactgcgcagtctgcagtcttcgtggcgggccaagcgagcttggagcccgcgggggcggagcggtgagagcggccgccaagagagatcacacccccagccgaccctgccagcgagcgagcccgaccccaggcgtccatggagcgtcgcctccgcccggtccctgccccgacccccgcctgcggcgcgctcctgccttgaccaggacttgggactttgcgaaaggatcgcggggcccggagaggtaaccgccgcgcctcccggagaggtaaccgccgcgcctcccggagaggtaaccgccgcgcctccccgtgccgtctgcctcgggctcaccgcagtcaagggctgcgggtgcatgttgggcagcgacccccgggctggcaccgtctacctggcgttggttttgcagcgctcctggactgggagtttgttggacgtttctgtctgggttttgaagtgctgggagttgaggtcactgctgcagaggttggagtgacagccctggatacctccagccagctgttcctttcagataatgcacggaacttaagctgcagctgactggtgaagaggcgcccctcgggccctccgatcgggtggtcgttggcgctttgctcctttcgtgtcttttttggagccaagcgttgcatgctcatggccacgtagaccttgcagaagcgctgcggctttttcccaaattgtgcaggaccagcccgacggggcgtagggtaccgcagtggccgccagcccggcggaggtggggggcttcagtcccagagacagcttcccagacgctcacgggtccttgcagggggctggggtcctggcgcggggttcagcttttccagtagcagcagtgtaagagaagtatgcatgtagacgtgggtcgctggcccctgctccagcccctaccccacggttagactgtctttgtcagctggagtcgtcccacatcctgccacctggcctctcagaaaagcagtggcattaagtaaggaaggagcttaactctttttgagcccgctttgttttcggttctcctcgcctcagatcttcttgccttggaaagccagtctggtcaagtgtctcagggtagcattttggcagaaccattgttaattaaagggacttctggaccgcaaccttaatgtaccagattattgagcagccaatgaatgcttcattctcattgtttaaggtgctgctttgatttttttttcaattctttgtactatttttgattttttggagaggcacatccccaaatttggatgaggtatttgttgataaataattcatcaatttccacaatgcagacaaaaatgtctgcccagagtggaaaaataaaacaagggggagaagagtttgagtaacggagaagttctgtggaatcctagtgacaaaagttgagaaactacctttaaataagacagtgaggtaacaaatgttaaaaaaaaaaaagttaagggtaatattgcattgtttgccacttataacgtatctgaaacatttgttctttaatcttaagcgtagagtggtccaagacctggaaatctgggcagtgggttttgatttctaaggaggcagttttacaggctgtgcaaggctaaccctaccaatgagatcacactggcgtatccgatattgacatttgcatgtcttgcctatggtttacagctctcactattttagatctttggtgaaaaatctttagattcagaagagaaaaataaaagagtcaggcaagcaaaaagagataacacctcatttgtttaaaatcttcctactgcccatctctttccatctgattgtggcaggcactgtagccacaggtttggtgttgtgggattgcaaggggcaggtattgaaagacctggctcctaggcaaaactttgcccctgaatggctgtgggatctgagcagtacctgtaactccattgccttagctgcagactaaggtggtagtgtaatttcagggaagggaataaggtcatctttgacttttagtcccatcatcaagcatggtgattggccttcagtaggtggtcaggtagtgcttgttgggtggatgggtggatggatggatagatggatggatggatggatggatggatggatggatggatggacggacggacggacggacggatagatgatattgtgaaagagacttttgctgtgccacaaaggaaaggtatatgtgttatttttatcctgctatgattttgcccaattccacctgtagaggacgtctgacatcaaaagagagcaccatctgatccagagaatgactcccactatgcctttcccagcaatcagattaagaatcccaatctaaaactatcaccagaaaactcctcaggagaaaccatgggtcatctagtccaacctctctcctttgagtgggccacaagaattatctcaacaccttatcaatggtgttgagagtctagacccacacagaagtagctaccctaaaatctaggtttcttctcctccctcttccataggtttaacatttttattaactggaaagttgccctggcaaataagatgttgcaggaatggaattaacaatcactgtgaaatttcctagggaatgtctttgtgctctgaaaacttcttcatcttcttggaaattaggaagtgtggccagacaccctactaagggctagtaaatcacagctggctttttacagtgttccacactggagagatcctacatcatgttaatttgcatcatcctgcgctgttggcatgggttgtagatgctggtctttgccacctttcctccttcatttgccagagtggcctcctggtggaaacttctttccttgtctacttctagattttcattccttctactagttgattatgcttaaagatttcagggtgaaaagccaggcagacttgcctctgtgttggtacctggagggtgatgataaaatttcattggcagttgagttaaaatgattgagctccaatatctgttcttagaagtatagaatttattgttctattattattttgcggtttttcattttttgttttcgtagagacctaggtctcaccgtgttgcccaggctagtctcaaactcctgagcttaagtgatcctcctccctcgacctcccaaagtgccaggattaaaggcatgagccaccatgcctagcctattgttagtctgtttcttattctgatatgaagtccggtgcggaggttctgaaggaatgctgactgctcttaaaattgcaaagcatcttgctggaaatggacttttttattgattagaaaacattcggttttaactctttataaacatcagaataaacttcatgattaaacactttataaatacttctctttggggctaaagaggaaacaccaaccagcagcctaagtgacagcataaaattgcaagatttttcataaagtattttactgtccttccagcatagggagggagtgataactcaagagtttgcccaagagcaggagtgcttggtggtggtctgaggggaggagctacagacttgtcagggctactttgagcccttaactggcatccagtactccccaaatccagtgctgttcagggtggcctcagaatgaaacgggagcttaagttggttttgaggagcagtacctgttgctgacagacagggttggctccctgacaaacattactgaaaacacgggttattcccctcctcctcagtacccactctctgccttccttctcttgtttaggctaatcttttaaagtgatgtaacttaaaacagtccagtgtgagttaatctctggggccagctagtatcccgggagtagaggtgctaagatcttttgcctacagatcagggtaatgacaagatcaaacactggggtttcctgcaggcagctatagaggagtcgtattaaagtcaggctaatagaatggctttttttttttcctttccttttcaggtgttggagagcacaatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtaagacttgttctgttgtgtttcttttgcctgggtgatagctcccgcctgctggatccccattcatgaagctttaataggacaagcccaaactcaaatcaatcttgagatttagtattgagacctttatatagaatctctattcggggtatgtgataatagcagacttgttttgtgaatctatttattaaggatattttctgattgtgtatattgcagagcacattgaggcttggagaatgcatttgtaaacaccatacctccattaggtgatttctttctaattcttgcaaatgtctaatcatctgtaaaatacccttctctggcccgtaatggaaatgttaaaagcctttaagttcaaaaggaaagaatggtgtgaaaactggtagtacatttgtttcccactgtcattagaaaatgcttgtgatgttcttacacttcttgaattggtagcattttatgggttaaccagtgaatggctgttgaagacatgaagaacttcttttgtctcctcctcctctctgacctaggttctattgcctatgccctgcaaggtgaaatagacagatagctgagatttttagcatgaattttagacttcaccttcattatttttaggggttcttagtcactgaattccttcctgtctgtgctgttctgccaatggcctttaccactagtagctatttcctattccaagctttactgttttgttttttaatcatttcccttgggtaagaatatgtgcatcaacaggaatgtcagagcatactgtttcatgcaggcacaaaattctgctctatggatgtgcataattatgacaataaggaagttgactgtacaagctcaattaaatgctcatagtctacataagagcaggaatctcaggtccttatatctgtgacagtcccaaaccatcctaatagaaataatatgtccaagggcagaaaatccttgttgacaaggattacgataagaacactaacttaattaacttcattcaaaagccaagtacattaactttggctttttttgacttgggtaacttagagtgattggtggacatgggtttttaaattttgattctgggggctcttgtacattaccccaacgtcttgcctagatttatgaaacactgattcttagaaacatagatagaaagaaaactggggatagctactatctgcattgttcttggcattaaattaagtgatacttagaggtaggtaattatgtgaagtcatcatcacggggtttatgtgcctgacaatttgtggttttaatcatctcccatttgttaccaaaaagagatggagtcaactttgggggagttggaaacaaagattctgctgaattaaaaatgtggtagaaagaggaacaccttattaagagaattaactgacttttagctttatttccttaagaaaggaaatgctctatttccactagaaaaaaaaaaggaatataaataggaaacacttattttgtaaacatgtcatttaaatcaacaaggagccacactacaaataaaactacaaaagcaggtgcattttggtaacattttctgggaaatcatttttagactcagagtccttttgtttcttcactttcaagaaaactccttaagattctaaaaaaggaagaaaagatatttagggagggaggaaaacaaatgactttttctttgattttaattagcaccttttaaaaaaaaattaatccttcccctgataggagggttcttcaaaggcaatatctgtttggggagggggtgattcacaagtttgcatttgaggatatgagactgcggtgaatgaggaagggagtaggtggcataaaattgaaacttcatgtgaaaaattccagcgtctattggctgcagcgatttcacttgtataatgagtagccctattccagctcaccctgaccacacccacttggaaagtccagggtgcacttcgcagtttaaatgtctacacaccagaacaaaaagtacaatagctgttgctcaattgctagtcaaataacttagcactggggaattccagatgttacttagggaattttatactggtgcatctcaataaagaactgaaagtaagcacaagaagaaaaaaagccttatctttgctctagattttgcaaaggggaaatttcaacagaacgcaatcattgctacacgtctgccaagacacaaggcttgggcgatcttttttgttcatttgtttgaatacttagctagtttttctaaatgtatacattgaaggaatactggctgtggaagtatatttgagggttttttggtttctttacagtttgactgtaattacaatttgataaaatttcaaatagctctattgccctacttatagagtaatgtaagaaacaatgtaacttttcattataaaaattattttgcacttgccaaaggagattaaggagttaactttttttgttttaaacattcccccaaaatatttatcgtttgggggttgaaaaaaatgcagcccattgaattgtgagttttaaactggaaaggtcacagattaatggcatacaattaaacctgtttttttgtttgtttttcttctcaaaatgttagccctaaacactgaattattttcaaatttagacacccaggtgctttttaacttttgtactttacagttactaacaagcaggtttgcataaggcatttttgagagccggactagcaggccataggtaattccgtgttgtcaatacgactttccacaccaggagaggaaactcccagggcccaaaggctaaagtggaatggtcaagtcatttgccattgagtcatagccagaccatccctatctagcaagccatgcctgcttcctggtttgtgcatgttgccctgtgtgctcctccttagaactagagagcagcaatgccagtgccttcaccagcaaatcaagggatggtaggaagggatagggctttagagatcatcacttactgccctcatttcacaagaggaaaaatgcccagtgaacttaaggaatttcctccaggtcacctaaactagttaggagcagacttaagctagaaccaaggtcccctggctcctttgcagttggtgtcattcattaaaaagaagaataaaaagaactctttttttcttaaagctgtcatcatcttgtgaaatatcagtttgcccttgactaggaaattacatcaaattaaaccattcagtcccctagaatagcagtagggctggtttattctgaaaacctttgctgggtcttacatgcagataacttgactttccttctcttctcctcctttctgtcctcaggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcgggtaggtttttccccctaattatctactaacagagctccatggtgggcatagggtacccctgggcgagtccctgccctctggtagcatctgatggactaggtcacatgaatttggctaagcgaagcatactcaatggaaaacaccagaaacctccagtgggactcacccaaggcttttgccctgcttttggttagcagattcccagctgtggatccgttcctgtagcagcgagtcttttgatcatggccttttccactggtgttttgttgtttttcagtttgattgcccttagctttgctgagccagccagtaagattaagacacgtgcctcaccatcctcagtcacaagtttggaatttttgtgaacatttggataaggggctgcaatatgatacctcatcagggatttttttttaaagcaggtgctgtccccgtcctccccaacttttgagtttgccttgtagtggaaaaaagtaaaggaagaaaaccgaaatggggaaaaaagggtgatcatttgaatgatggtttcatgaaaggggaaaaaataagctgagttatataaatgaataattgtagagtgatgtcagaatgactttttagtacagggagtacaggatacattcaagcttttttttcaccccgctccccttagaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcaggtgagatgcctgcagatcacggatctgtacttaaatgctttcagccttatgccttggctcctggagaaaaccacactgccaaagttcaggtaacagagttcaatggaatttgatgaaagtcacctaagggcctcattttcctttctctttctttgaacagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctggtgagaaaactgcattaattcacatctataactagacactgaaacatcagggttttcctttttgcttcttattaaaacagtcttatttaagtatattatttttatttaaatatattgttctgtgacttgcttggttagtaagagtaatgcagtagcagtaatcataataccctcatatctttttgaatatgacttggaaagtactttcatacatgataaattaaggcgcacagtgctcttaatacagtgcctggtatggagcaagtaaacgcctgtcaggttagtttttttctttttgagacagggtttccctccattgtccaggctggagtgcagtggcacaatcatggctcattgcagcctccaccccctgggctcaagcagtctctcgctttggcctctcaaatttacaggcacgagccaccatgcctggcctgttagctgttattttaatagcctcatgtggaataagcactgtgctttggaaatattattttactgcatttttatccttttagcactcttgtgagatgtaggccttggtagccttattttacatattagacagttaaagctcagagaggtcaactaacctgcctaatgccacacagcttgatagtgacaaagccaggattcaaactcaggtcagtctgattctaaagcctgggactttaaccaataagatccaccacctccaggctggttaatgttatgtgagtttcctggaaacagtgcatttttatattagattgtagcacattttgttttcccatttgggtttaactgtggctaagaatacttttctattctgtaagttatatcttttatacattttcaaaatgagatctacttacctatggccttgtttagtagaatactgttttacttatgtattatttttttccttagaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagtaagcagtttatgttcagctctctcctgtgtcatctgtaactgtctttaacctcagccacctgagttgctgccaccctgaagctcaacagtagagtgatttgcggccagtttctgccaatgggaaacaaattcagagtcttgtgcatggttagagaggattatgtaaggcagtactaacttgggtttcaaatcaaaacatgtcatttatccataatgattttcctggatatctggatcccaaaagtcagaattgcagaattatgggttttcaaagtgcatttacatcaaggatagttgttgtttcttgtttttgtattttaattactctggtacatattaaaaagactagtgaaaacacttggaaacaaaagcctttctctcttggcttcttggtaagaacaggcacatcagacatagatggagctgtagaattgtttatgttgcagctcatgattctgccacatggaaatgggaggaaagccccagaatacccattgtgcaggtatccggtctttaaacattggctttatgttaaagagatgcctgtttctgagcacttgaaacgcacaacagatgacaaggaagccgtaagagaatctgtctctcaatgtggagattagcaaattacagagtcaacagtaaatagacaagcgcctttgagtgtgtctgcgtcttagttactcatggctgctaatgctggtggagactagacacaagtttaaagttagtaacagcaaaatacccaacctgaggttccaaagtagtttgtactataaagtagactagtcccaaaccaatggcctcagtaatattttactcagaatttgatctctgagaaattggaaagtcaactgatttttcttagcccttgttttagaactatctataatttttggatggaccaagattgattaaatgaaactgtgattttaaaaataaggaagtcttagcaaactaactgacatcattcttgactcgaacatgttgggaaatgtgtcagatcatgttgcgtgaaaagtgtgagctcttcatcacaggcctgcatttcagtgaatggttctacaattcttgccataatccacattctaaaactttgttctatgagctaatgatgtaaaatcttgtgtgtgattttgtgtattctcatacatattttttccttttggtcttcaggttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacgtgagtgaagtggttgacttcctaacacagcggctgctgtccagaaggggttttgttcctgacctttaagaaaaaaagcccatgtaggcagtcaggcagaactgtcaggacctaccgtgcttttctaccagcttgtgcaggggacagtcacggtggccctgccagccgcccatggaggcaaaaggcactgcgtgattacagcagctcctaatatcacattccaaaaaccagagtgccctgtagacagagctcatgggatgtgcttttactagaccattcaggtctggcatatctaagagagtctaagtttaaactagacttattttgcaacttagatataacagaacaatcttaaaatctgaagagtagtaactggagagaaggaagtctctgttgacactgtaaggaaacagatgtggtttggaaatctctcattggaaagaagggtgatcaggtaatgcctgctccttgcctgttcctgtgagcaatcagtgcttcaagttcaaaatgagagattggtaaagccaaagatgtttccataatagggatgttatttcttttgctgaatttatagacttaaacatatacatatatatatttctatacatttaaggctggcctaatctgtatttggaacccatttatttctctactgtcagcatctctgtatcggtggggtgacccctatgtggtactaactagcatccattctcatgtagattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactggtgagacacttggaggagctttccctccctcccgtgtgttcgatgctttttgctggagcgttttctaccgacagtgacaagcaggctttcctctctgccaggttctgtctcctcatgataaaggattaattcagaacctgaaggggaatgtccatgtcactgtggctccccaggtccgaaatgctacctccaattttcatgctccaagtatgctttcaaatttattttaaaaacaaagaaacacagccattgcataaaacttcttcaagcctccaaaaagccagatggtgatcagaggcttctttgatttgtaagagaagcacagacatctaaaaagcagcccttcttaaataatcctttatcataaggagcgaacagacagagcttcccaggggcctgcctccacctaatggcgcgtcagaaaagccagctttgacagataggtgtgtcgcctgttgctcacagaatggtagggaagctatgtaagaacagtggtttttggtcccaacagaagagagccagggaaagtttgcaggccaacttaggcttggcggttttcctcagcctccctgggggccaagtcagctttccttgagactggaaagaaacatccttcgagagctctggctcatagactgcaatgctctcctgttcccttgctcaggcaggtaaagctctttgtagactccacactctccaatgagatttcattgtgctctccctaagaaatgtgagcaatagtttcctgactttttaatgatctgcctgttctttccactcagagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggctaaccggaaacaggtgggtcacctcctgcaagaagtggggcctcgagctgtcagtcatcatggtgctatcctctgaacccctcagctgccactgcaacagtgggcttaagggtgtctgagcaggagaggaaagataagctcttcgtggtgcccacgatgctcaggtttggtaacccgggagtgttcccaggtggccttagaaagcaaagcttgtaactggcaagggatgatgtcagattcagcccaaggttcctcctctcctaccaagcaggaggccaggaacttctttggacttggaaggtgtgcggggactggccgaggcccctgcaccctgcgcatcaggactgcttcatcgtcttggctgagaaagggaaaagacacacaagtcgcgtgggttggagaagccagagccattccacctcccctcccccagcatctctcagagatgtgaagccagatcctcatggcagcgaggccctctgcaagaagctcaaggaagctcagggaaaatggacgtattcagagagtgtttgtagttcatggtttttccctacctgcccggttcctttcctgaggacccggcagaaatgcagaaccatccatggactgtgattctgaggctgctgagactgaacatgttcacattgacagaaaaacaagctgctctttataatatgcaccttttaaaaaattagaatattttactgggaagacgtgtaactctttgggttattactgtctttacttctaaagaagttagcttgaactgaggagtaaaagtgtgtacatatataatatacccttacattatgtatgagggatttttttaaattatattgaaatgctgccctagaagtacaataggaaggctaaataataataacctgttttctggttgttgttggggcatgagcttgtgtatacactgcttgcataaactcaaccagctgcctttttaaagggagctctagtcctttttgtgtaattcactttatttattttattacaaacttcaagattatttaagtgaagatatttcttcagctctggggaaaatgccacagtgttctcctgagagaacatccttgctttgagtcaggctgtgggcaagttcctgaccacagggagtaaattggcctctttgatacacttttgcttgcctccccaggaaagaaggaattgcatccaaggtatacatacatattcatcgatgtttcgtgcttctccttatgaaactccagctatgtaataaaaaactatactctgtgttctgttaatgcctctgagtgtcctacctccttggagatgagatagggaaggagcagggatgagactggcaatggtcacagggaaagatgtggccttttgtgatggttttattttctgttaacactgtgtcctgggggggctgggaagtcccctgcatcccatggtaccctggtattgggacagcaaaagccagtaaccatgagtatgaggaaatctctttctgttgctggcttacagtttctctgtgtgctttgtggttgctgtcatatttgctctagaagaaaaaaaaaaaaggaggggaaatgcattttccccagagataaaggctgccattttgggggtctgtacttatggcctgaaaatatttgtgatccataactctacacagcctttactcatactattaggcacactttccccttagagccccctaagtttttcccagacgaatctttataatttctttccaaagataccaaataaacttcagtgttttcatctaattctcttaaagttgatatcttaatattttgtgttgatcattatttccattcttaatgtgaaaaaaagtaattatttatacttattataaaaagtatttgaaatttgcacatttaattgtccctaatagaaagccacctattctttgttggatttcttcaagtttttctaaataaatgtaacttttcacaagagtcaacattaaaaaataaattatttaagaacaga

SEQ ID NO: 2096 - DNA, 16127 bp, Homo sapiens; identical to SEQ ID NO: 2095
  source 1..16127: mol_type = genomic DNA

SEQ ID NO: 2097 - DNA, 16127 bp, Homo sapiens; identical to SEQ ID NO: 2095
  source 1..16127: mol_type = genomic DNA

SEQ ID NO: 2098 - DNA, 62424 bp, Homo sapiens
  source 1..62424: mol_type = genomic DNA
ggcagccgcgcccgctgggccacagaggccgctgaggccgcggcgcccgccagcctgtcccgcgccatggccccgcgcgcccggcggcgccgcccgctgttcgcgctgctgctgctctgcgcgctgctcgcccggctgcaggtaaggagcgcccgcgcctgccgggccgcgcggcccgacgcctcctcgggagccccgggaagggccggggccggcggcatcctggctcctccgccttccgagaggagccggagttttggggagcggaggccgtgggaagctggggaggcgcttccagagttggacggcggagggcgggaaagggcaagcggagggaaactggggcgcagaaggagcaggttggcgggaccgcaacacccgaaacgggctcttccaaaagcccctcttagccgcaggctttgatgctgtcattttctccaaatgcttcttgagcacctactaagcgcttgcgccgggcggtgccgcgggagacagcgccgtgggcacctcacttgcggcagataaccgttcccgatacgatttctcccgggtggcctccgtcccaaatttccacccggaaagagacatgattccctccgtccctgaactgcgggcttgcctttgcctcccctgagccccttcggggacacccctgccagctcgcctggaggccccgcacggcggggagagactgcgcgcgcgccccggggatgctggacttgaccctcgcagacccgagtggcttcccggtcctctcggaacaggtttctcagtacagttagcaagcgaatgcagccaggcacggactttctgcctcgtggaggagggccgcagagggaagcacacccagcacaacaaacgctttaaaaatcgttgatacgaacttgaaagctctcacagggaagggcgagtggtggttttcttggtttcggctgggtcagatttcccctctgttaacactaggttaggctgctgccgtccctccgcagccgggcacggaacccggagaggcgtggggagggacgcatggagaatcgtgtttgggtgagaagagaggggaaaagccttgacagaaataatgtgggtgcactgaaggctgaagcaaaagattctagggaagattcattcccaattgtatgggtctgtcagtatggttgagggaaacgaaggcggaaaagtctaaaggattttttcattttaagcacttcaggtgttgcttaattaagtgttcaacaggttgaacggggtgctaccttatttgaaccaaaggaccagggtttcagcgaacagctagccacctaagaaaaacctgcctgaccacgcagttgcaaaattatctctcactgctgtcgcaaaatgacatattcatatgtgcataaaaggcgttcggttctaatatgaacaacaaatgctatcaaaataagtttatttttcagggagacctttcaacaaatgctgtttcccgtctttttgcctttaagcccctttcattatgcatgtttaaaaatgtaaacttttgcattggtcatttccaattctaggggagcgaaccttctaggaaccttatgaattccttggctgggccacgaattcaattgatataagacagactaacaggagaaaaactgtacttaattacatacataggcacaggactcctacaaaataagagacttgaggaagggtcagatgattgaagctcattatagcatccataggggcttctgcagggtgctgcaaaacagattttggggcgggtttggggaggaagcatatggtgagtaaaggacatcttgtcaggcacataaaagattctcaggcaataaaaatggtctctgaccagcccttcggagaataggtgagagcctgtgtgggctggtgtcaacctcctgtctcctctcctgtaatcggagttaatcttctctgggtgagaatcttctctgggtgagaagattcccacggcggagatttgagacatttgagttcgttttggaggatctttctttgggcagagttcagagaaacctctgcccgtggccactaccacctgccctgagttcaaaataatcagcacaccatagtggcatattttggggtggcatttcctgaactctttcacaatcaagtgacattggaatgcttttctgcttattttacttggtgcccaaccttcccagtagaaatgcattttctctcaaaggtgagactagatgcagccttaaaataatatttcctagagatactgtggttatctaggaaaaagctctctctgtattcaatgactgcttgtttggccagcctattccattagctcaaaatttaggaatggcattgacagttcattgaagatgttaatgatcaaacaccaggcaagacttcaggaactgcctagtgggtaaattggttttgcaaaatagttggcataaatggcttccagaaagtgccttatctgtagggatcgtatttagtttcatttttattatattaaataggttcaaacttacctgaaaggctataagttttgccctttaaaacatttctatgattatatctctgcctgcttgtatttgtgagggaattcattttcagatagaataaaactatttgcctacagataaaaacattttgaatttttatgtagctagtcctgctgtttattccaggtaacaaaatatagatgcacactgttttcattaaggtaatggattgtacacggtcatgtttatctggggttataagatgcaagagcaggtgcgtgcatacgcaggacaacagacattggtggtgtcaaacactgtgctaatgaggaataaggggaaggcgcatgggtcacagtctagtggagagcgccagatgggaaaagctgtgatgataagagagcagcaaatgataagaaaagtacagagggtggcagaggaagggagagagggaggaggggagggagagagggagggaggaccgctggaggaatccctaaggacttcgggatgaaggggtttcccaagtggtcttggaaagatgtgtgggaaaccagaggtcagggaagaaatgattctaggaggtgggaagaaagctccctatgttgggaggatggtgtgaatgctttagacctaaaagaatcttacagaaagaaagaaaaaaaaaaacaaccatatatttttatgaccttgcagatagcacaaatcacctaattcaggaaacccccaccaaacaaattgggcattgaacttttatagttttgaggtaactcttggatggcccttactgaggtggtaaagtcgactaatcagaagcaggccacagggccctggagcgcccatggggagacccctccgaagaaatcccccagggtgtgactctgggtcatagggtgggtgggtgctctgtgccacctttcctcctgccccccatcccatccgagaggggagacatggatatatgcagtcatgccttgtttggggagcacagacacagatctgtgggcttacagttcattttgctgagaaatatttcaaatgcctcccctgttatttcctttctaccacttccccctaaaatggcaaacctgtaataggaacatactccctgtgttgataaggaaatagcttgctttttcagttatctaccagaacttcttacatcaggaaaactgaaacaataaaaatgtgcctttggaggtcaataaatcagtgttttatgaggacatgaaaaggggagttccaaagcagggcctcctctgcaaagagtgttgttttaagaaggggtagtgtggacttcatctgccatgtcaatattaaaatttcccccattgtattttcctatttttgaagttcatggaaaaaaaaatagtgtttttcccacatgctgtatccagtggtctctaggaatgttgtctaggccattttttggtttgttttttgtttttttggctgatgtgagtctgcagcccatcctgatggtacgcaactgtccaggtggttcactccctagggcatctgccccctggccaggtggcccatggcctgactgctgtctcctcacagcatcctggccttagtccacagggaagcacacctgcctctgagcacacaggctgctgactccagctcagtgcaccccaggactggcatgggtaggattctgcccagcaggtgatttttcctctgagtaccctttcattctctgcccggattgtgggacggcctttctgtgtatttccctctagttgcagtgtggggctttctatggtgtccactgctggaaacacagtttaagttcagctcaccctttgtgccccaaaacgctaagcttgaaagaaccaagaaggagccgtgggtttcagcaaaatagccttgatccctctgaagttcttagtgaacttttgaggtttaaaaccgagtgggtgtggagcaagattacgcacagccccatatctctgtcctgattctgagagacactctatttcctgcctgcgagaccaacctggcagcgctccccaggcaggctgcctgtctgcctgggtcaccagaagctccttgtcagagggctgactggtgctgctgttctcactgtgtcacgttccagtcgcagtgtgctctcacgccaagaagcccaaagcagccccagtcagcagtgggaagtacattctttagggccgtgtgatgatgactttatatgtgtgtttgttttgtgagccaccgtcgactttcagcctttgagtgctttgggtcactgcttgcaggccacagcattcgataatgagaaaataaacctgaatttgtgttcaatgcattcagtgactgcaacaaatggagtacccacaacctgtagcacactctgcagtggactgaggaaacagagaccaagggccacagctcctgtcttcaggagattggcagtccaggtgtgtgcagatgattaaaagacagcaggatccggtgttctggggagggttttcaacttgtcgtgggcacacaggataaggagtgccttcacctgaaagtgtcagagaggacttcccatccttcctgtgtggtcacatgtgtctaaagctctgcagaccgcatgagagaacagctcttaggctgggggttccagaatgaccagtgctttgtctggcggtgagaacagcagggactcgcatcagagtggagtgtttgcagggaaccgaaggaaggacaggattcctggactcaggggtgtggggagagaggaaggcaaaagccagcactcaaaggctttaggtacaagcaaatagttcagatttaatattgagctgtgagctggagagggccatgatcagttttgtgtattaggggaagagtgtccaggggcgggccggagggggccagtaaggagcctactgccttggtttgggaaagggcctgaatcaggtcagggcagtggcgagagaaggagaatctgagtacaggggcgatttcagagccagtggggctgtgcaggggcagaaggtgcaggggcaaaggacggatgtggctggttattagaaaaaaaaagacatggcaggcaggtctgagtgcaatggtgtttacaaccaattaatcacaaccagttaacagatttatttgttccttctccactcccactgcttcacttaactagtaaaaaaataaaataaggccgggtgtggtggctcacgcctgcaatcccagcactttgggaggccaaggtggcagatcatgaggtcaggagtttgagaccagcccgaccaacatggtgaaaccccgtctctactaaaaataaaaaaattagcccggcgtgagggtacatgcctgtaatcccagctgctcgggaggctgaggcaggagaatcgcttgtatccaggaggtggaggttacagtgaaccgagtggcaccactgcactccagcctgggtgacagagcgagactccatcccaaagtaaataaataaataaatagtaaataaataaataaataaataagacacggcagctgtcaggacaaaaaagctggctgtttgggttatatttttcactttattaaggaaattgctgtcttagtccaaatcaaaatgttgttctggttcaagtgaagaagtgttgttgtttttcccaaacaaaaaagaaggattacgtttaggctcttgaatctccccttttttgggttctcttattgggaggcagagacaaagttcattagaccctgtagaggcaaacatggtaaaagccccgtggcattgtgctgtgcagggaacttgcaggctctgacatctagagagccattgccagacctagagatgtcttggaatgagaagttcagcgtagagacagagctcttaacacacactgaagagagataaacagccagtgatccccagagagtcacatcagagcagaggcaggtgtgacctgacctgtggtcttcccacactggcctcaaatatgtcacctaaccccaaaagaagcagtgtttatgttggaccaagagctgcgcaaaaactgtttgcttgcatgatacacattttcctggcacattgccgctgcctaagatgagcgtttcccttcctctgtgtccagtgcctcttagacttccccatacccccaaaaaatcctgacccagcaggtgacacggaggcccgtctggcaccagcaaagggacagagctgccagatttccaagtatcaggaagacctgactgtaaaaaccacccttttagttcatcaaagtaataataacttattacatttcctgttgagagtgttgagagtacaagagccacttcctcaagctatcagaaatttgaagactttccatgaaaaatgaggaagaaaaactctgtttagctcttggtgaatgtgatggctaagctgggcaatggggaaagattgtgtggcattgccagaaatcctactggcaccactgtgttggctggtttggggttcgcatcacatcccacagatgggaaatggaccacttccctaaagtattgactttttaaaaatatgtattacttacctaatgcagttagcacctaacttaatagtgtatcacgtagtagcacaaacagctggcaagttcatagccagtaaaagagacgtttaaaggcccctgtcttctctcaacttcatagtcagatatacaagcaggatcacatctaacactttcatggtaattgagaatcaattccatttttaaagcttagtcgagattattcacttctgcccttgctaacccgtttccttgttgaataattcctaatatcaggaacttccctctaacagacctaaatctaacatgtcacaatttgaccccatttcctcaaatttgttctttaatggggtaaaaaccagttggtcaatgtcttctttattttaatatttctattgttgaagattgttagcccacaacttccccttccccagggttattcattccagttcctttaacctctttgtaaacttttttttttcttttcaattcaacgagatactttttttggatttactggcaaaaaagccaacaaccccaaaccaaacaaaacccaccaagtattttgggaacatcagactcaggacgttgctgcctctgacttcagagaggctgagatctgatggggaaggtcggatgtcccattcttcgttcccacggagccccacaggaggaacacatgagatgcctctaggacacaggcatgggaaggatgagttccgagtggagaatcgggcagggggtgtttgatctggtcctggaaggatgggtgtgattctgagaggaaaagagagctggagggagaagggcagaggtggtgacaggcatgagaaaatcatgtcccgccctgatgtgtggagcccaggactgatgacaggtaccggggaaggataaagccagctgggaaagtcctggaggcctggatcacaaagggcttgcgaataaacctccagaactgggactctgccctgaagccaggggttctccaactgtggggtctgggcccagcatcagtctcccccgggaactcgttagaaatgcaccttcttatgccccccacctaccgaatcagaaactctgggggtgggggccagcagtctgtggcttcacaacctctccgctgattctgacacatgctcaagtttgagaacagctgctagagaccccgggattccatgaaaaggtttgcactcagctctgacaatattagaagattaatatattacaagtaccggccatctgttgaacccctcctgtgtgccaggcatgtactttacacggattatatctaatgctcactccaccttgctagtaagttgagaaaactgaggcacagagagactgattaacttgcctgagtttgcacagctagtgagtggcagagctggagctcctaccaggcagcgctccagtgactgtggtcttcacccctcaggtaaactgcttgtatagtcaactctgtgatggggtagggagtagagaaagggacctcccagaatggtgggacagaaagctttttggtatttggggacacccatgcaaatgcgtgcccagtctgcatttgtgggggtctgtcttgtctgctcaagtatgtactcactgagggctttctagaacttttttttttttgagaaggagtctcactctgtcgcctaggctggaatgcggtggtgccatcttggctcactgcaacctccgcctcccccattcaagcaattctccctgcctcagcctcccgagtagctgggattacaggtgctcgtcaccatgccaggctaatttttgtatttttagtagagacgggttttcgacatgttggccaggctggtcttgaactcttgacctcaagtgatctgcccgcctcggcctcccaaagtgctgggattgcaggcatgagccaccgcgcctggcctctagaactattcttaagcagaaatggcaatgctgtgtctttaaggctaatccagataaaaggcactccaggcactcttggcacagggtccatgtgccagttgatccctgactcaggaggaaaagaagtgtatgtcttgaatcaccaccacttcctgaagccaaggcagcactggctcgtctatgccccacaccccagagttagactataccgtaccactgtgctgtagccctgggtgtaccgcctcagagggtcgcatctctccacgcgtgttcatcccactcccaccacctgccaggctctgtgtagggtgggaggagggagaaggatggccttggagccccagggcagcagacagtgataggttaaacctttgccctcataagctttcggaagtaggtagttatatttttaaaggtcctttatgtcttagtcttactacaattatagctaatctggggactcttcccttgatgagaataacctgggctcctcttttgacatgtctctaccatggaacaaatcaaaatcattttctattactaactttttttgatcccttaaaagacactttctaagtagtaagagaaaagttcaaataagaaagagggtcagaacacacatggcctctgggtcacggtcagtctcaagcttttacttggagtgagatcaggagacactagcggggtttagggggagaatgacaacatggtgtcactaatgcacagtggccagaaatctagcagcagatccccaaaacctatgacaatggactgtgagatcaagggggcagttaaattcagtgaaaacacagctggaacctctgtcttaaaccttaacctattaacttctgtgggtcacaaggtttaaaagtggaaaattgcccctttctaatgggctgaagtttctgtgctccagttgggtccagttggaggtccctgtgaccaagccactggggtcggaattttttttttttttttgttacccaggctggagtgcagtggcgcgatctcagctcactgaacctcgcttctcgggttcaagcaattctcctgcctcagcctcccaagtagctgggatgacaggtacctaacaccacatttggctaattttttttgtatttttagtagagacagggatttaccatattggccagtttcgaactcctcacctcaggtgatccacctgccttggcctcccaaagtgctgggatcacaggcatgagccaccacgcctggtctgggatccaatttccatgtaaaattgcaaaagaccaagcaccagaaggcataaccagtcatcttaactgtgtggggcagtcctcatgggtaaggggactcaaggtggtgggcacctgcccctctgcacccaaggggtgaggtcacgcagaagaggcctcatgggaggctctccatttcctggcatgagtgacgggcacaaagaggctgaaacagctgtgtctcctgttaggcagccccgtgttcagtccttattagaaaagagagtttcagcccagaaagagattgctaatcttgattttgcaaccctcttccctcagggtatctcggattttgtcccaaatcagtggagtctttccaagggcgtgcttgggagtgtgaatttgattcagtgctagaaggaaactgttacagtcttctgtatagggaagttatgaggttacagtggtctttgagaaaaattatttattaatttatcaagtatttgaatatttgctacatgcctagcactgttccagtctccttatcaccagccatctcagcaagttgattaatctctcttgggaggatgcaggaagggaagggaagccaggcctccaagcacagtgcctggcacgtagtagatatttcactagggccaattcttcctatacccccattcatcaatagataaatagataaaaggtgtccagggatgggagaggtggttctcaatgtctattgtacagtcagagatgactatgcagtgtttggaaataggagaaagtcctggtttttggttttcaataaaatctctagcctgctcctcagagaccggcattgaccttgcctgggagcttgttaggaatgtagtctcaggctctgttccagacccagggaatcagaacctgcattttaataaaattttcaggtgattctgcgcacattggagaagcactggatttcaccctgaaggctgggcagtgaaggaagggagggcagcaggtaaggggaatgcttcctccttccgtcactttggggactcctggcctgagcagttcgtgcagccccagcatggaggcagagcctagagggacgtggcctccagccgggggtgcactctcagaagtgaccacagggcttgttggcttctactacggaaaagaagagaaagcagttcttatctgaaatgaatacaaagttaaagaaaaaaacaaaccccaagaatgacaatgtaaaaaggctttcacactgggagaataaaggggcattcactggagcctgtggaaataggggtgcatcgtaacataaggacaagtcaaagccatcctaattactgtattgaggaaacaaccggccttgcccttggattccaggtagcccagggctgcagactcttcactcttatctctctggaagacaaagacacttgcaattaaagttttgaaacgcaagcttgtttcttcattttcccttgggccatatgttttcttttcaaggagcagagataataaatgcattgtgaggggagtaaggcagagggctgagtaaaaatcaacagaccattgatgggcgcctgagtcagtgctgtgcgctttctttcctttaagaagcacatctggaatcaaggtggtcagagggggaaatgctgatgggcccaataacaagcaactttcaagacggtgtataaagtcaattgtgcagtttgctaaatcagaatggtgaatatgtcaggacttctaatcacagttacctatatttttaagtttttgttttttatcaaacccgacctaagttagattttttttctgtgcatactatatattccaaaaaaagaacttgtgacaaaatggttaatatggcaaatttttatgttatgtgtattttatcacaattaataatatatgttttaaaaatctagtggcaaaggtggtaattcctgcctgctaatgaaaatagcatgaagtgcctagtatttaaacctttatggggtaatggcaatgtccaatatgatcaataccacacaattctgacggtatgggtgtatattaactcacaatgcgtataaattagtaatcagttatgtgaccttataccctacccacctcacactgcacttagtcacacgggctatcttgctgtttctccgtcaagccgtgcatgcttcctccaagggccttggcaaatatgtccacctgtaatcctcctcctggcacgtgctgtacatttggcttgttccctggctttaagcaggactccactcaaatgtcatcttctcaaagaggcttcctgtaatcataccaccaccttacatagattgtttcacttttttcatgacaattgttgcgaccagatttccttatctgtttacttatagttgttcttctcccctggactgtaagccaggactctctcggttgagttctatccactgtatccagaggatctgaaattgtccctggcgcatagtatgtgttcacttaattgggaaataaatgaatgtgtatctgattggtcgactttcaggttgtgaattcagtcagtgttgtcagcagctaaatcaaatcctgtgaacagaactaggcaaaattaaattaccctatgaaaacggacaaaggacttgaatagacatttcttcaaggaagatacacaggtggccaataagcacaagaaaagatgctccacctcattagtcattaggaaaatgcaaactggaaccacaaggagatactacctcacacacatcaggatggctattattttaaaaaccaaaaaccaaacaaaaccagaaaataacatgtgttgttgaagatgtggagaagttggaaccctcatgcagtgctgctgggaatgtgcaatgatgccacccctgcggaaaacagttgaggggtgggtgcctcgaagagctaaacatagaattaacttaggattcctaggtatagaccaaaaagaactgaaaacagggattcagatacttgtgtgccagtgttcattgcaggattattcactgtagccaaaaggtagaaacaacctaggtgtccatcagtggatgaatggataaacaagatatggtctatacatgtggtggaatattatccagccataaaaaggaatggcgttctggtacataatacaatatggatgaaccttggagacattatgctaagcaaaattcgccagacacaaagggaaaaatactgtgtggttccacttacatgaggtatagagagtggtcagactcagagacagacagtagaaaggtggtttccaggagcttgagggagggggaatggggagttactagttaacggttacagagattctatttggggtgatgagaatgttctggaaatagatagtggcaatcgttgctacttattgcccctgaatcatactttaaaatggttaaaatggcaaattttgtatctattttccacaataaaaaatattaaatggccccaaagtttttttaaaaaggcattcaaaggacaggcataaaaagagcctaattcagtgtttggcagtgggagacagccctttctcgcctcccgaaatgagctgcattcctggcctcctgcagattttgccatccagagttgccactttgctgtcggctcctgcctgcacttttcgtctccatctctgtttcctccatgagatcctagcccaggctctgttcttgtctaaaacgagtttgcaccttcttgcgctttctcatcccaacagtctttacaatatgtttcatggtgctgctaaaaaaagaccctcccttccttctacaactcactgactagctgccctttcctggaagccccgaagcagcccccaccttttccttctactgtcagaacatacctgcccagccccccaggctctccgcctgcacctgcccgagtctcccatttgctctgtcctctccctcctctcgaatccttctgtctctgccccgcaacctcaccctccccagcttgtgcacttcctcttgtaagtccttccctatctctgtctgtttccctgcccattcaaagccaaggaagacgtggacaccagtctgaggccagggttgcaattctccttcctcgtccacgatcagggaggatctttccaatgcattagttctggcactgctgtgtggggctctgactggtcacagttttccttcctctctatatgtggctgtgtcctcctttacaaaagctgtgagagggcagagacaggtcctgccttcagtcctacagcaagccaggacctcatgcaggtatgggagagagctcagtgaagatgcctttgacagtgtgatgacagcagaacttcgtaaagagattgatacttcctcctgttaaactctgactacatcaaactctatcttctggagaaaaatcatttttcgagataaaggcgagtgactcaggcaaaggtgaatgactcagactcgctcttacccggtgattaaatgaactcaacagcctctttgcggggaacagtatgtgtgtggggagaggactgattcgttatttgtaattttcagtgagaccagtagaagctgaccagctgtgatgagtgcttttaagttggagttttgaatactttttatcactagatagacattcatagaatgcattttagaatgtcccaaatccctaggccttgtagtcccagctactcaggggctggcatgggaagatggcatgagcccaggaggatcacttgagtatgggaagattgcttgaacccaggaggtcgaggctacagtgagcagtgatcacaccactgcactctagcctaggtgacagaatgagactctgtatcagaaaagagtcccaaatcctttatcattcgttttgggttttctttgaaacagggtctcactctgtcacccaggctggagtgcagtggtgcaatcactgctcactgcagcctcaacctcctaggctcaagcgatcctcctgcctcaacctcctgaatagctgggtccacaggcacacgctaccacacttggataatttttaaagttttatagagacagggtctcaaactcctgagctcaagcagtcctcccacttctgcctccccaaatgctggggttacaggcgtgagtcactgtgctaagcttttttttttttaatcaattataatattgtttgtgacagttatagtttcttcatgatcttctccaataaactagacacatattttcatattgtacaaatcacaaaatgtatgagcctaacttttggcagcagaatttttttttcaagagctatgtgtaaaatatatttcttagaaatgaattatattttaaacactcagggcattttctgttaaaccctgtgattctctgtatctacctctgttgtgacttaggccatgtacctgactggtataacttaggacctccaagtttttaatgtgttacatgattgacaggtttcccaggtagggtgaacacacccatggggtgtgccacgtgatccagcaaggtgagcaggggatcctaaaacactgcccctttatcctcacggtctcttataacacaccatcttggtaggcgcctatgcgatgttgttctgaagcttgaaatgtgaagctctggtttgtacaaaagaaacatgcctgatattttctctgtgaatctgtaagattgaaattctatctgccgagcttatttaaaatgagaatgtctaggatattcgatcataattcgtttatgtcctagttaacagaaatcacagatataatctggcagcagctttatcagcagacggactgagtaaactgtgtctgccttcacccaagtgtggctcgtggaactgactgaacccccagacagaaaagcactgaaatgactcggaccactcatcgccaatttcacattgatgcctcaagtttccaatcccgtgataaaggacttctttatgtgaaatcaaacatgctttttaacgcatgcattttttcctagttgtcctgctaaaatactctgctatgcagctttggtttgtcataatcaggttaaaagtgcacaaggatggtttgtgcgggaagattgtcaggccttgagaacttgtctctgggtacccagtttatcttttccatcatttttcccctttctagtgacacccttttccctctctcccctcagggaatgactggatggaagttacatatacttttactaattccactcagctgtgcccgtgaatatccctcctctattggatacagaccactgcagtggggtgtgatacaatcacatctccatttctcccagcagcctactagaaaggtcttcagctttgaattgaggaggcagaacctttgtgtttgtgcagtctggccgtttgccagtgccacatcatgtataggagttctcacgtctgcctctcagtgcagcaggataggcacagttattaattagcactattgtacaggtgaggagactcaggctgagaatggcttttttttttttttttttttttggtcctgagattttagaaatgtagtcagttttattaaagaaatatcaggcattcttctctccgggtcaaactggaagcccagtttcgaggactgccctgggtagaaaaatcctccttccctgaagcccaactcagttcttggggactgcctggccaggctacttcatactcttgtcaccagcgctcaaggtaccttgtcccctcctccaacctgagttctcctggcccttacttctgctttgctaaaattcccatgtgcagactgggtgtggtgtctcacgcctgtaatcccagcactttgggaggctgaggtgggcaaatctcttgagctcaggggttcaagaccagcctgggcaacatggtgaaaccccgtgtctaccaaaaaatacaaaaattagcccggcatggtggtgggcacctgtggtcccagctactcgggaggctgaggtgggagaatctcttgagcctgggaggtcaaggctgcagtgagctatgatcatgccactgcactccagcctgggtgacagagtgagattctgtctcaaaaaaaaaaaaaaaaaaaaaaaatcctatattctgtcatgtcagactttctttgtcatttaatttttttgaataggaatctgccctatctggtgtctgggcctcacgtgattcctgcatcatttccactcctggttatgaatgttttgctgcgaatcaccatggtgggacgttttcctcacattcacaggcacaggactgtgccatgatccagaatagaaagctggataaaatagagataaatttagctggagaaagcagctaaggaaggggcagaccaggaatgatagcccagaacatctgaattcaaagggtctatattttgactcattaatggaaacacttgtgaccgggagaaactgagaccttctcgccggcctgtcagcccaggtggctgagaaaaaagacattcaaagaaatggacaagaaccaagagcatttgtttgtaggttactctgatgtattaattctaccttttatatgtttgttgtttatttacttctaaaacaaagtgcttcaaagagaaataattccttagggtaagattgtcttatttaaagaagctcttttagtgttttgggtacacaggttgctagtaatttatttgtattctgttctgggtaggatcagtttcgatagtgactttctttaaagatatttttttccaggacagcagggctgttaagtgaagtgttgttttcacatttaatcgtttctctcttaagaaaaaccacatctttcgactctactgtaagattcagaaatttgataccatccttactgaagttatagccaaattctgaaatatagtcaaggatgatattttataaaacaaaatctatggaaaatccctcatttgttcttctaggttacgttcttttcgtctcgatttgacaagaggggccaagcctctttctacatcgttcgatgtcagcatgaattttcagtggagcaagaaagtaattttagtatccataatgacttgcactacaattgggttaacagcatggaaaataaatatttaagtcaaccttccctgcaggattctaaatacagatctgctcgtctctgtggctccactggcagaaatgttatgtttcttcagcttatggtttttcagaattagactcaacatggctttgcgtagggaaataaatccacattgctttataaagggattttttaatttcaaatttattatctcccccgccctccgaaagccttgcacagactgtggacatggttattctagaagagtccatcagccgttaagataaacaccagcctgtatgccctgaaacaaatgcgtagaagacacaaaaagacacaagaaagcgaagcaagagaagtcaaatcatcttgctgttttaactcctttttttagacttagcaaggaatttgtagggggaatttgtatgtgcagagaatatttgctatgaacagactaatgttccttattaattccagtgagttctgtcagaatacaggttagttgatatagattctgtggaccaaagagaatattttcagcttattgattaagaactatactctatcaatccatggctgcttttctaaacaagacctctaagaagtcaaattatattccccaaaacacaagagcaacctgatcccagccagcctccaaggcggctgtgatgtagaataggccctcgattagatcacaagttcattctcctttcacctccagaagaatgcaccccaaaagatggccggtaacatgggttacctgtgcagaagagtgactgggagagactgggacagagtttcctaagcaagctattgttcgttttgaattttgtctcatgggactgtattccctattcaataaataaaaatttaaaagtatttctgctttatttgcttcatgaagacaactgcgattccaaagctttgactctatcagtcttaaaggtgaactagaaaaatctcagtaaataaaagcctgtacatctcaactcagtcatcaaaggcttttccttgctgcatcttagggaaaaagaggcaactgtaagtggctgacaaaatcactctattaactgaagatctggggccttatgcccaaatttccccattccctgggagattccttaagaacacttaagcaggaacatgtttttatcaaatgattgctttactagggctgctaccgataataatagctaccactttgcaaccctggggagcttggtcttggaggatagagtctgactgaagttctaggcaggtgaaagggaaaggcagaagcctagagggctactgccaaggggatctggagccatcttcaggctcttgccagctgctggctggcagggcagttaatggtgaaatggtagacatcagaaccagaatactgtaggcaaaatgagaggtcagactgggaggggcagggacagccgttcattcatgcacacaaaaaaatgacacccagaggatgaacctgacaggccgtgcaggcagagggagactggtataaggaaacagatccagggcagtctaacgggaaactgagcccaagcatgtgggactcaagacagagtctggggatcaggagcaaggagagagccagtctggcctgcagcgtcaaggggacaagtcggtcaatcctcaggtacctggcaaagcaagacaggctggagtgacagaagcactggatttcctaagagttacaagcatggggctgcagtgcacagcgctcaccaggcgatttgttgctggaactgaggcatgagattagaatgagaccagcacagggcacgctttacgggctgtgtggggaggaaaagggtctgcaagtggagggaaagaacactggaagcagagagccagaaaggaagaggaaaaggggcaataaaggcatgctttgtctttggcatgcaccaacaacctaaagagttttccagatttcctttatttacttgcaaaccacatttacttaaaaatatgtacttatgttgcattttaagttgtatgtatattgccatgttgaaggtttgaaggtatacttcaaagtatatcatgtaactagagaacaaagtaggtttctgcttaagctggaccctaaatgagattaaaagcataattttctgcctcaccatagcaattttcccagcagcaaaatttctgctgctgcttaaaagatctgtaatcctataactctgtcaagtagacatgtcagttttggggtgatgaaaatgttcaggaattagatagccgcgatggttgttcaaccttgccaaagtgctaaaaaccactgaacggtaggtatactttaaaaggtttaattttatggtccgtgaattttatacctcagtttttgggcaggggtgggagggcaagaggcacattcaggtgaaaagtcatagtgaggtagaagcttaggagagagaaatggattttatatctgtgacaatcaattaaaagttaggacagctggtcatttctggaagcagtgacttccttgtttcttcgaagaggtgtaaagctcctgagttggaggataggtgggttgaatgaatcgcagccatactcctaaacatggagtgaattgtctacatgttcaggtcagatatactcaacaggcaccagggcttggagcccaggacacagcttgtgacatctgacagtgcccctaagcagctacttcagggatatcccatttaccaaattcccctaaaaagtacctttctgtgtgtagaacacaaagtatgtgctcattttactgagtctgtggctgcccccttaggggatcagaagcaattaataccctttgtcatctgaaatacagtccaacttcatatttatcctgtttgccttgtcatcagcattgcaacaatgctcatgaatccttaggctcggatgaatccagctttttgacccagtttgcatggccgcatgtagttttaccactttgcctctttcttctgtgcatgtacattacacacagagggagacagagaagggtggcatctaaaacagagaaaagcatctcagaagggagaggtgtggtggcttcttttaagcaattcttcctcagtccgctgggctcaatgcagcttccctaagactctgtcacccagtgaatacatggggagcatctgatgtgtgttacccggtgtccacggggagtgttagcagggcccaggaagcaagtccaagtacaaccttcctgtcacacatcacctcaataacacactgggaccttctcatcgacctcagcctcctcataacccctttgctggccagggtgaggtcagaaaggtccgtgatggctgtgtgccccacacccactcagctagcctgggctttcctgggtttggtgctttctttataaagctgccttctataatggagctattttgaggatgcatggctttttccaagccatattatctctgcgccctccatccgagcactttcatatgcagatgaagccctcccctgactgcctttgtgacactgggctccagctggactgaaggtctcttactgcctcccaagagctgtttcaggcctcattgcccctgtttgaactgctcatattgtccaaagtcttcctacttcctcccactacctccacctgccagtttctgtttcctggtctggctgatttctatttatcctggaaggctgattacttaccacctccctcaggaagccatcctggctgcttctgcttccttcctactactgctgaggtagggcccatctggtatgtgtttcattccactctaagacccttgaggggaaggtttgtgactctgtattcgacgacacagcagggaacttgcatgaatcgcaagtgtggtgtgcatacgtggatgtctgttcggctaagcccagttcttcagtttctgacatgactgcttgtcaacaggagtgtgtgttgttttttgctcacaccaagaatgctgatcaggaaaagaacttttctgtggcaaactgataagaatctctgggtgattatagatgcctgggctgctctgttttcttttgttttactcagatgggcagattcagaaattggtatttgtcttagaatcataccgttttgaaccagaagggaaccagaggctgaggaagcttaaacagctcctgcagtccttcaggcaacaggtagtgagggcagagcccaggaagcccctacaacaccttgctttccccgctttttaaaattctctgtgtgtttaacaagttaaaaggtaagcaggccgggcgtggtggctcaggcttgtaatcccagcactttgggaggccgaggcgggtggatcacctgaggtcaggagttcaaggccagcctggccaacatggtgaaaccccgtctctactaaaaatacaaaaattaggtggtgcgtggctatagtcccagctacttgggaggctgaggcaggagaatcgcctgaaaccagaaagcagaggttgcagtgaggtgaggttgcgccattgcactccagcctgggcaatagagcaagactctgtctaaaaaaaaaaacaaaaaaacaaaaaaaaaccctgtaatcccagctactcaggaggctaaagtaggagaatcgcttgagcctgggaggtagaggttgcggtgaactgagatcacgccattgcactccagcctgggcaacaagagcgaaactccattcaaaaaaaaaaaaaaaaaaaaagtaatttggtgattccctttttgttttacctagttttatccagaaagagctgtgtggactctctgcctgacctcagtgttcttttcaggtggctttgcagatcgctcctccatgtaccagtgagaagcattatgagcatctgggacggtgctgtaacaaatgtgaaccaggtacacctgcttctgagccaccttgcattgcccctcaaaagtgggtgaggctttcattattttttctgtctgccagatgaaaaaaagaaattggatagacgcgttatggtagtggcaggtggtaatgtctgtcactctgaagacaaaaatctttctctcaatagagatttgaagggattttaaaatcccttagaaaaaaacaaaaacaactttaaaaactgttgcttaatttgggctgaaacacaattttccaaaacactatttctcgagatggcaagaagtttttaaaaactaatattttagcactttatgactcaaactctcaaatgtgaaatgcagctcttacttaaaattgttttcacagaaattttattttggaataaccacactggaattgttgctgctaaaaattgcctaaacccttgtcgtacctttttccatatacctgttgaggagcagaaggtggactggctaccacctgccccaagttgttctgccagaagtgtggctgactatttctgcagccccagtgaaagccacagtccacggggcccgcactctctcatcattctggggaggggaaggtgggttaccttataacaagatattttggatatttcagctacaattatttattggatgtgcagaaccaagatccagtaatggtcaagtgtgtgttggataggcgggtggggcgcagcgtgacacttggtcaaacgaagctaaccatgagccggtagtaagtgtagaggaagttaacaaaaagaagttaacaagaagttgcctatccagatggaaggcagaggggagaggggatgggtgatgaagttcctcttgcctacccctcttattccctgagtgggttccagggaatctttcaagttctgcggcccagtttaaaatcatcattctattccttttttttttttttctttttttctttttgagatggggtcttgctctgttgcccaggctggagtgcagtggcatgatttcaggtcactgcaacctccatctcccagaggttgaggcagcaattctcctgcctcagcctcccaagtagctgggactacagtcacctgccaccacgcctggctgatttttgtatctttagtagagacgagatttcaccatttggccaggctagtctcaaatttctggcctcaggtgatccgcccgtctccgcctcccaaactgctgggattacaggtgtgagccaccgtgcctggcccatcattctattccttagcagactttttgggtgcagagggtggttggctttttacttagaagaattaagagactgctgtgaccacaggctcagcggacccaggtggggttatttcagccagctgcgtggcctgaggagcccagggtgctgcagtcactgcattgtggcctcttctcctgtgtcatattgtctttggggggtgtcctgggatcatgggcaccaatgattattggtcccatagatgggtgcaatttttgttgctgttttgctttgtgttgctgtttttgtttggttttttgatggttgcatttttctccctcatttttttaaggaaagtacatgtcttctaaatgcactactacctctgacagtgtatgtctgccctgtggcccggatgaatacttggatagctggaatgaagaagataaatgcttgctgcataaagtttgtgatacaggtgagcccgtcctgtcagtgtgtcagtgggaagtgtagaaacctcagacctctttttctatagaaacatttttagaggcagccaatgatgtttcgtttcaggaacatgaaaggaagttgtgactacacatcccaagaaagatgcgttttagatccccaaggcctctgttaaaattcttcatttagaacatttgttctggaatatatttatgttgccatttaatcatgggacacatcatagacttgacataatgtttccataatgttcccacctatttttgtgtggtttaatcctccctgaaatcctgtaggtagccatacttatcccttttattttatttgtttatttatttatttatttttttaatttatttgagacggagtctcgctctgtcgcccaggctggagtgcagtggcgcgatctcagctcactgcaagctctgcctcccaggttcatgccattctcctgcctcagcctcctgagtagctgggactacaggcaccccccaccacgcccagctaattttttgtacttttagtagagacggggtttcaccatgttagccaggatggtctcgatctcctgaccttgtgatctgcccgcctcggccttccaaagtgctgggattacaggtgtgagccaccgtgcccggcctatcccctttaaagattgagaaacggagattcagagaggttgaataacttctccaaggttaacacgtgtgaagcaggactcaaaaccagctctactcttcacctttttcctaaactataaatattttattaacacagtctgatctccttaccagactgtcttaagtttcttgcctggaatgttttttaaagtatagtttatttgaaggaatcaggagcaaaatatgtctcttaattctcttaagaaacagaggttcctttctctcccttctttcctttttccattgagctcattttttgaagaaaccgtgatgttagtcctgtggagattgcacaggccacattttgttggttgcattcccttggtatcatttaatgtattattctgtcccttatatttcttttttctttcttttttttttttttttttgagatggagtcttgctctgtcacccaggctggagtgcagtggcacaatctcagctcactgcaaccactccctcccgggtttaagctattctgctgcctcagcctccccagtagctgggattacaggcacgtgccaccatgcctggctaatttttgtatttttagtagggctgaggtttcaccgtgttggccaggttggtctcaaactcctgacctcaagtgatgcacccgcctcagcctcccaaagtgctgggattacaggcgtgagccacaatgcccggcctgaccccttcttataaattggttgttagatcaatttcttataaattggttgttagctctagaaggccaatcagattctgctttgttttttgttttgtttgtggcaaacttcatatataatatagttcatacatagaatattagaaccatgtaatagctgagcattcctctttctaacattagcagctgctgatggtcatggtttagatgtgtttcctttaagggctgcagaaaggtgatgttctgattctctcatttctttttcatttattagctggcatgctttatgaagataaacttccctcatcaactatttattgataaagttactgcatttatcctgtagtgcagtacatatagaaaagatagaataaatgcttttaaccttatttatcactttgcaaaacaatatcttaatcatccagcattctcccaaggacttatattatggagctatttgaggtgttttagtttcagtctattgcagttattgttgctgttgtttgtttgtttgtttttgagtcttgctctgtcgcccaagctggagtgcagtggcacaattttggctcactgcaaccttggcctcccgggttcaaacgattctcctgccttggcctcccaagtagctgggattacaggcacgtgccaccatgccctgctaacttttatatttttagtagagagggcgtttcaccgtgtgtccaggctggtcctgaactcctgacctcaagggatccccccgcctcggcctcccaaagcgctgggattacagcatgagccatggtcccttgcctgcaataactggttgtaatggtgctcagattgtcacatttctatgaggtggcccaaggtgttttgatacagcccaggcatctattgcttccatgcttagcttgcacaatccttgtcttaaactacaatcagacatttctctaaggtttcatgattgtttttagaggaacattttatttagtgacctcagtctggactctagagaagactcactactggattgatccttgtgtatagaagttttttccccaatggacagaattagagaataagtgtttcttttaacaccataatttttctaatgtgctggagacagctggcagattttggctagggaaggtaacatggaaactccactgagcagaagcatctgatcaagccttttttatttcccactgcttagtaatgaccttgactcattgctgtctcttggaaataaagattcattctgtctactgccaaagttgattaaagccaaaaatctggtacattacatacaatattttaaattatgtcaaaattattcatcaccacccaggcttacattcggatgggatcctaggagtagttggaattttccagagaagtggcatgtgtctgtggacgttcccatgtgttgtggacatgtttttgcattttggccttgatgttgcagagctgactggggccttggaagagtgggcactgcaggaaatggggacttctccagggtcaccaagcttgggtctataaagattggaaataggaaatgtcccctccctactggctgtaacttgagaccataagagacagcgggtttctggtttgttggcttgtttttcccttggaattcctataagtattcaggaatataaggtgcaggggctgtttggacaatccaggtgagaaggagccctagaagggtacaaggtctgttttaaataatgttattgttttgtatcatgttggggggtatggggtcatgtacttatgtgcagttgactgtggttatgcacagtagttatgttctataaagtcaccgtgaacactgaattagcaaatcctgagccattactcctagtggattacagggtgaggttcctgcaagcctccagtcacactgtcacggactgatcaccacgtaaacttgtttcatgtgtgtttctgttaaagacaccttatttgatacatgttgttgattcattaacattgcactcatggccaacagcactgtaattcatgcctgagtgaagcttctctaacacacttattttctctgtaaggcacaccacagttttcttgcacttagaacgctagacagctcttcagcacgacagttgggggctgttgtaagcagggaaatcaccaacaaaaagctcgtttaccttctgtgagctgaaacaagaaggcagagcatcgattacccaacctcagccagaaacctgagtgtggagcaactcaaaatgtacacggttctgtccctgaaggactgcagaagtaccaagaggattgattttggggtgcaaataaattttattgagcaggtgaattcacaaatatgaatctgcaaataatgaggactattgattgatcaataatttgattcatatttgtgtgtgtatgtagtttataacagatacgtgtgtgtgtgtgtgtgtagtttacaacagatcaattcccacgtacctgcattccagaaaaactggaaggggccaggagatttggaacaagaaggccatgtgttgtgaaaacagaaacaagcatgttaccctgagtgcttgaggagagtttgactccaagcatgtcactgggcctgcctctgtaccctctccatgcatgtaactccacaacaacccgttttcaccctgggatgcctcaggatcctacaatgaatcctaaacctccagaaaccctgttctctaaggtccagtcttgcgttagtcttatacatatggcatttgaatttacaaaaaacgaggaagctcaactctgtgacccttctgcattcgccaaaacattcaatgatcatcaattcccaagtccttatctttctactaacatgaaaattgacttttaaaaaaagcccacaaaactcttaattatgagagagagaagaacccccccgtgacgttttcgtgccagtgcaggaagtgcgaggaggaacttgggacttctcgagcagtgtcctggtgattcactctgcaggcctgccaggcgggctgctgctctgggctggatgttggatagcgcagtcgtgggcggtgtgtttgggctgcctgcccctccctggccactgacctgtctcttgtctcccgcaggcaaggccctggtggccgtggtcgccggcaacagcacgaccccccggcgctgcgcgtgcacggctgggtaccactggagccaggactgcgagtgctgccgccgcaacaccgagtgcgcgccgggcctgggcgcccagcacccgtgtacgggttggatgtgtgcgtctgtcggctcttgctgagccatgcaaagccagctttgagacagtcttgataatagcagcaagaaagctccagggtgctaggcagcattggaggaacctgagggatggggaaaggtgggggctgattttccacgagatacaggcccaggcaagacctgagaatgaatcctcggcttaggttcttcaaagggactgcgggcaatttgcctacatgctctggccatggccaggggttgctggggctcctccatccgtggaaacctgggatccccacttaggagccagcaggatagtgcaggggtgattggacgtttttgaaaagtgtgcacccattagaattttggaaaaaccatgcatcccccaccccagcacgtttttaagttgacatctaaaaagttttgttacaagtttgaagaactgataaggacttagttaccagggaattataactgcgataacactgaagaaacgaatccaggggaatgtaaacaccatggccatttgtgcccactatgattcatttttaaatgcgccaattgtatttaactattggacagtttacatagttactttctctccttttgtttcctatccattccaccttccccatagaattttatcctgatatattttttatgcttggagggtttttactaatcaccttttcacattcgaatatgcacatattgaaaaatatgcacctatttgaaatctttatttattttatttattttttttttgagatggagttttgctcttgttgcccaggctggagtgcaatggcacaatctcggctcaccgcaacctctgcctcccaggttcaagcgattctcctgcctcagcctcttgaataactgggattaccgggatgcaccaccacgcctggctaattttgtatttttggtagagatggggtttctctatgttggtcaggctggtctcgaactcccgacttcaggtgatctgcccacctcggcctcccaaagtgctgggctgggattataggcatgagccaccacacctagtcaaaatcttaatttttaaatatttactttgactgagggttaaaaacatttcttctggaccaagttgtcactgcatttattattacacaattggtcacaaatgaatatatcctattttgctatattataatcataaaagtaaaaacttctgacctccataatgagtgggattgtttttccaattcatatatttgtggctaaatattacttcttgctaaaatgcaacagcattcaacatcaattctgtttctactttttgtttttatgtatgtaagtgctgagaaatttgttcacataaataactgaatggcaaaggaaacactttggttataggtgtgtccctcaatttctttcagtaccttctgatttatgtggccaagctcacctactgatgtgatatcagaagttatttttaacgctctatcagttgagaattcaattgtgtccttcaattttgttgaaagtaaaggaatagaaatccttttgagttgaaaaagtatttcttagagtaatttgctttcctgacttctaggaagtataacaaaagcgtttttttccacgacttaacaaatgattatttatgcctattactcattcccttagaggcacctggttttaacccaaaatacttggacagggttgggagaattaaaatattatccatttcaattcatatcaaggaaaatgtccatcacagagtctaactgacacattcggtctttattatcaaatgcattgactaaaccagatgtgctttctcttacaaaaagtctgacttgattttttaatggttaaaatggatctccctatcacagccaactccctctgaattctgattctaaaatagaagaggcccagagcctttcctttaggttttcaccagcatgtcacatcagggattctattagactttctctctgccttgtacctttggaaatgggttcatttttggacaaaataggttgaggatagaggggaaacggtagatgaatggaaatttcactcctgtcccaccctgcataatttcaattcagaacaagtcagcctgatcgcagctgccccatttctatcatcctgcttttgcccttaatagagcgggaaaggtgggaactgtgctgggaggcgcaggaactctgccatccccaatgtccacttgtcacctcgttcagcatctcagaggtttggcagcatagcagcaaactatggggtgggtaaaaagtatatcttttgtgaaatgggaaaagtgtgattatgaaagggagcaaggaaaggagcctgcaggatgcttctggcaggtcagtgttactaagagtcatatggaagtcaagctatggaaattaacacccttaaccctttgtatgcctgttagcccccgtctcttcgattttgagggcttctcacaactctagattgtgcttctcttttaaaaagctgttcaaattaatgtgagttattagatgtcaactgggctcttcttaataaagattcaaggcaaatcaaattgctaggtgaaggagcgggtaccctacctagccagccaaattgcagaaatcaacagtatacttcatacttgactctggacaaagaaaatttatttcctttttttagtgttttattcacgaaagtaaatcacagaagtgctactaatttcaggagtaatttgtggtttgggcaccagccagttgcctgattatgatatcacatagtagccaatgttcttcttgggacttaccgaagaatcatcatgtgtggattgcagtagagggaataggcataggaaacctgagacatttattttgacagtgtagtttttgaagaatatgagagtcaagtcagttcactaaccaggatcagctcctactttcaacactgtccattaaggaaggggtctaagatccattgtgccactgtgtttatcagtaaagttttattggaacacaccctcgtgcattgcttttaatgtattgttggactgctttcatgctatgagtagctgcagcagagaccataggcctgcaaagcctaagatatttactctatgaccctttatagaaaatgtttgataccaacccttggttgcagggaaagagacctgtagggttcttcctcgtcttctttttttaactgagaaaactttgttgacactctgatatttggactgaggagattaagctcatcagaagaggtcaggacagtgaccttcaaagcagtaatgtgtctgccattccctgcagacagaggctgggctagctggcaggtgcatgggggaaaacaagagacagatagcaggagcagtcaacatcggctcccagactaggaaacaaagtgtcggtgaccaggggagtggctcagaacaacaaagggtcatgaccagagctagcctgacctggacatcacataccagtgttagtggcctgacatcaagtcagttacctttctgagcgtggttccataactcactgctggggtcagaactgctctgtgggcccaagcctgtgggagctgaagaagttagacacaggggtgggcacaggggtgggaggtgagggcagagaggggcagcgcctcacctccagtcctctggagtcccagcctggatgatctctaagtgacctcgtttgttttttgtttgttctgtctgggttgtttttttttttttttctcacagtgcagctcaacaaggacacagtgtgcaaaccttgccttgcaggctacttctctgatgccttttcctccacggacaaatgcagaccctggaccaagtaagtaacaacaaaggagtcagaagagatggttggtttttaaacaactcaacctccactgtctcgtctgggttgaaaacggacggattctgttgggttaggcttcctcttgaagccacgttcaaaatggaaaaagtctgtcaattcagcctggggaaaataaaccagtcaaactaattcttcagccctatgtgtgacaggaacttcgtgtgactttttagatttggtaatctgtgacttacggttgcagctttttctaaccttgtttggttgaaaatgatttataacatttattcagtggtcacgcctacttctcccgatttcccaacatcactgatttattcatccagttatttgtgtgtgtgtgtacatatagaagcctcctgtttatataaatgtttgcatgctgtcaacatcgtggggttttttttcacatattatatcctgaagctttttctatattagttcaccagttcatgattttcttggcttttcacagctgcatagtatttcattgtagagatgtactgtaagttatgtaataagttctttattgatagtcatttaggttgttcccagtcttttacagtaatacataattttttaatgaagaatctcatatatatatgatttctcacgtatgtgagtaaatctatagtggaattcatgggtcctttcattgcatgtttgttgttgcataccaataatcaacataatgattctttcagttccctgtatatttcttattaaatgtttattttctgctgggcatggtggcacgtgcctgtaatcccagctactcaggagtcagaggcaggaggtttgcttgagcccaggagtttgagaacagcctgggcaacatagcaagaccccatctcacatttttaaacaatgaaaattaaattaaaatacataaataaatgtttattttctgattcacttatccaaattttatgttcaagaggattttctgtgtttttcaaaaagagcaatcagcaaaagtatgtcacttaaccatgtaattgaagctattggaatatgcattttttttttcttgagacatgatctcgctctgttgcccaggccaaagtgcagtggtacaaacacggctcactgcaccttcaacctcctgggctcaagcaatcctcctgcctttgcctccacagtagctgagaccacaggcacgtacaccgcacccagctgatttttaaattttttgtagagacagggtttcaccatgttgcccaggctagtctctaattcctgggctcaagcaatcttcttgcctcagcctcccaaagtgctaggatgacaggcctgagccacccaggcacggccagaatattctttcctgaagactctgctctgctcctttgctgaccgcaatctcagagtagctgtcagagaacacaggcagcgtttgcttttgtttatttgtttgtcccaccttgtgctgttctcctccctgtggaaggcacaggggattcaaatgtccaagaaggcgtgggttcctctcctgaaggagctggcaatctgggagagttttgcatttgttcactttttaaaaaacaagcttataaaaccaaagcactgaaccaccttttcccccacagctgtaccttccttggaaagagagtagaacatcatgggacagagaaatccgatgcggtttgcagttcttctctgccagctagaaaaccaccaaatggtatgtttaaaaagagcctgttggttgatagatgtgccccagggtggtcagctggtttagatccctcccagatggcacgtggatttgcgggcgtcctctccccctttatttcatcccgtgcatggtcagctgaatatttcattctcatcagtattttaattccaggtatgttgtttccttgataattttctacactggattgggggtaactaataatgttttgatatacataaaaagaaaatagagctgcaaacataaattaaaatgctcagacatggtgggatgatggtggtcacaagtgagggtgtctatgaggagattttagtcatcttcccaaattgttaggatctagctatcattatctatggaacatgttgtagattagattaaattaatcttttttttttttctttttgagatagagtgtcactctgccacccaggctggagtgcagtggcgtgatatcagctcactgcaacctccaactcccgggttcaagcgattctcctgcctcagcctcctgagtagctgggattacaggcgcacaccaccatgcccagctagtttttgtgtttttagtagagacagggtttcaccgtgttggccaggctggtctcaaactcctggccccaggtgatctgcccgccttggtctcccaaagtgctaggattacagtagtgagccactgtgcccagccacattaaattaatcttaagtagagtttcagattgccagaaagttgatggtggaggctggttacttggtgagcaggacagtgtggaggtgtgggtccagatatcggaagagattgcttcagtggcaaggagacctttcagatgaggaaagagaacaataggccacagaataaccgggttaacaagctttgaccaagaaatcaggggtttggccttgatgttttgggaaacaggaagacattaaagcattctggatgtggagttacacaatcagagcaaacttttttaaagaccatttggcagataacattaaatataactgaaggaataaaaagttattttaaaaaagaggagaggaaaagtaggagtccaggaaaccaggtcatgtaaatcaagagttttgagcaaggattctagcaatgaagtgatcagggagggatgaagagaacagttgggtccacgtggtgtcggggatgaaaactacagaaatatttcacaggatggctgtggttctgttctcatgaccagcaaacccctggtgccctgttgctattaggaaagagatagaagaagctccttttgtctgcaggggtcatttttctggggatactgaagggttctggaggttagccaaaatgagactgggtgatgtggtgagcatgatgagagctgttctaaggtagaaacaccgtaatggccctggctgctctcccgtagagtgaaaccggactgagcagggctggctgagattgtggatctcaccctttggaatgtgagtgctcgcggacaaagggcagccaagggtggggactgtcacttctgctatcccagaccaacatttttgattctgaggtttgatttaccgggatttgtttttcaactgcgtaaaattaaagaatctttactaccatatttctcattttcttccaatacagaaccccatgtttacttgcccggtttaataattctgcttctcttcgcgtctgtggccctggtggctgccatcatctttggcgtttgctataggaaaaaagggaaagcactcacaggtattgtgtctatggtggtttttgcaaaccaatcttaaaagatagatttctaggtaaatgctttggaagttgagtagattgtctacttgctgcctatggtgatctgcttaaactaaagcaaaacacgttttatcattctctggcaaaaagaaacaaaactccaaaaacttgaaaaagccaatatcctgcctagttgtatataagggaacaggaatacgctggcgttcaggaaacggatgacttgtaagctctgtatttgagttgtgtagactctgcagcatcacatatatgggagcttgcatttatcctagaatacatcaatttttaatgcatgcttttaaaatatacataaaatatttagatgaccggtaggggggaatttctgactggagtgttactttgaaataagaaccttcggtgggtgtggtggctcacacttgtaatcccagcactttgagaggccgaggcaggtggatcacctgaggtcaggagtttgagagcagcctggccaacatggtgaaaccccatctgtactaaaaatacaaaattagccagacatggtggcacatgcctgtaattccagctacttgagaggctgaggtaggaggatcacttgaacctaggaggcagaggttgcagtgagccaagatcatgccattgcactccagcctggacaacaagagcaaaacttcatctcaaaaaaaaaaaaaaaaaaaaaaagaaccttcgattatgaaaataagttatattgaataaaatttgggtgcttattcttagaatagacggtcaagtcttatcctgtttcttgggaataattttcccacacaaatttgttagtgtctttaaacatcacgtcatgtttaacttgtagactacaaagctaaaaatgtgtaatttttacgaaaggattcaaggcatcattagatttcctaagaatatctcttaaatctttcctttaatattcaagtcattctcttttgacttgaatattaaaaacctgctgtttcaccatccttttccattttcagttgctctcttatttatttatttatttacttatttattttttagacagagtctcgctatgttgcctaggctggagtgtagtggcacgatctcgactcactgcagcctccgcctcccaggttcaagtgattctcctgcctcagcctcccgagtagctgggattacaggcatttgccaccacgcccagctaatttttgtatttttagtagaaatggggtttgaccatgttggccaggctggtctcgatctcctggcctcaggtgatccactggcctctgccttccaaagtgctgggattacaggcgtgagccaccacgcctggcccagttggttgcttatttatagggcccacctttgccttgctgtgatttgatcagttttcccacgtcacactcttggacttcaagagaccctgcatatctagctacttctctaaccattacattgccaaatgaaacactagacaatcagaagattaattaaagaggaaagatggggattgcagatgccagtgttaagcagtgagcaatgtttgagtgatgaccctttttttttttttttttttttgagacagagtctcgctctgtcgcccaagctggagtgcagtggtgtgatctcagctcactgcaacctccgcctcctgggttgcagcgattctcctccctcagcctcctgagtacctgggattacgggcatttgccaccatgcctggctaatttttgtatttttagtagagatggggtttcaccacgttggtcaggctggtctcgaactcctgacctcatgatccacccaccttggcctcccaaagtgctgggattacatgcatgagccaccgcacccagccaagtggtgaccatttcttaaagagtctgttcattgttgaatgcctttatttagtgcagcttcacctccttaacaacatcattactagggatttggataatgcatgttcagatgatgaaggtcgcttgtaggcacgtttatgtgagataaacagacttcctgatgttttgttctttaggtttttctttttgatactattttactgccatatgggcctaccatttagtgaactggatgtcatgactgttagctcttcatcctttcatccatacatgtttattgatcatcagggactggactgacactggggtctcaatatcgagcaacacagacacagccagtgccctcctggaggaagcatcttagtgggcagggtaggcgttaagcccacagagggaagctgagtatgcaagagaaggtgctgagcaccaagtggcagatgacagaaggtcagcccatccctggggccagccagggtctcccagaggaggaaatgggtgagttaagatctgaaagacaagtcagaattcactagacaaggggcatcaggagaaccacaggcattctatcgtgagagagctgcatgatgaggggagcacagtgcattagcgggctggaaggagctaatggcaccgtagcagaaagccagggaccaagtggaagatgaggctggagaggagggcatggcgagaccatgtagcggctgctgaaggagtttgctccttgtccttagcaaaggggaccaagggcggccctctggctttagagtagcaaacaaatgtgtggtacagtgagagtagatgcaggcgcaccagttaggaagctgtttgcagttgtccagaggagaggtgatcatggcaggtctgcatgtttatcagctccgtggacaggtattattttttagtgccatttgtgattgtctagactgattcctccaaggaaacagctgcaactgtccttttctcttttggtggggggtagggagggcgtggtttaccttgatatataattgcaaaataagagaaaagaagcaagaataatgatgataatagcaatagctgacacatattaaatatttaatatgtgctgacatgactatatatattttgcgtgtactacgtacatcttcacaacagcaccatgaggtgggcactattatttcccctattttgtgatgagactgcttagcaccctccctggcacgcttaagtgctcattagctgttacactgaactgtgatgatcttcccatggagaacctgacaactcctaactttagtcggttttgttttttattgttgttgctttttgagacagggtctcactttgtcacccaggcaggactgcagtggcacaagcgtggctcactgcagcctcgacctccctcccgggctcaaacaatcctcccacctcagccccccaagtagctgggaccacaggcatgcaccaccatgcccggctaatttttgtatttttttatagaggtggggtttcaccatgttgcccaagctggtctcaaactcctgagctgaagcggtccgcccacctcagcctcccaaagtgctgggattacaggtgtgagccaccgggtccagccctaactttagtctttatagtgaacccaacattaaatgttcattagaagtgggataaaattgtatctttgcataatataaattcatagatttcttaaaattcataaaatttaaccttttaggtttcatcacttctgtaagagtgggtggagatgtacttttttgaacatattcttctttcttctgagaagcagccagatatagtggaaaaggtcttggggcccgctggtctcagtgggtctgacacctagcttgctgtgtttgcctcacttttatagtacattcaacctagttcactggaaaaaccagtctcctagacatgttttctttgttcttctatgatgtctaacttagtccctcatagccaaagaaaacttgttaagagaatgagaatgtctatagtcatagcagcacctctgacagcccccaaatgtgcccagaggaagtcactgaaacgttagaggatcatgttttgctttgcatagaacaggaagttctgtttttgatgggagtaagatggcttcatagcctttattttttattttttatttttttattttattttttggtttttttgagacagagtttcgctctgttgcctaggttggagtgcagtggcacaatctcagctcactgcagcctccgcctgccaggttcaagcaattctcctgcttcagcctcccaagtagctgggattacaggacattgccaccatgcccggctaatttttgtatttttagtagagatgtggtttcaccatgttggccaggctagtcatgaactcctgacctcaagtgatccacctgccttggcctcccaaagtgctggcattacaggtgtgagccaccgcgcctggcccttcatagcctttaaatcagttgatttacttttaaatgctttcactcccaggagtgctcactgaaagacttgcggtggactctgttgaaagataatattgaactgacctagtggtcataatactgagcctgatagagaaataaaaatctagaatgattgcacttatatgtgtagtgttccccaaaagtcaaatatacagagatatagaataaaacaatggttagcagggacagggggaaagaaaatggggagatgtgggtcggaggatacaaagtagcagatgtgcaggatgaagaaagttgtccaggaatctaatgtacagatggggactgtagttaatcatgttgtatcatattcaagatttttgctaaatttgtagattttagcggatcttgccacacacacataaaaatgggtaactaagtgagatgatgggtatgttaatttgcttcactatagtaaccattttactatctatatttgtcctataacatgttgtataccttaaatatacataataacctttatttaaaagaaaagaagtgggaaataataacttgaagtccttatccttgctttgtgttttctagctaatttgtggcactggatcaatgaggcttgtggccgcctaagtggagataaggtagagtgaacagttgttggtgcctctgttaagtacattcaacagttaggctggtagagccatcctagtcacatattgagcacccccccccacccccactttttttgagacggagtctcgctctgtgcctcaggctggagtgcaggggtgcaatctcagctcactgcaacctccacctcccagggtcaagtgattctcctgcctcagcctcctgagcagctgggattacaggagcccactaccaagcctggctaattttttgtgtttttaatagagacagggcttcaccgtgttggccacgctagtctcgaactcctggcctcaagtgatccacctgcctcagcctcccaaagtgctgggattataggcaggagccaccgcgcccggcctcagctcctttgcttacagggcatttccaggttcagtgatcaaacctcaaattccaggatggatccctgcagagcagctcaaagcccaagtccaggctcattctagatgcctgttttctttgtctttgtttccacttctgtcatctctgtgttcatgtcattttttttagtaccaatcttgattgtctggtacagattcctaagaaggatgaactgcaactttccttgactctgtagttattctggtaacattttatgttgacacagttcaaaattataggaaagtagtgagaaaaggacaaagaccttccatataccctagacataggcccaccagttgtttctattttctctcattgctttgtgatttgcttactctctgtatgtgtgtatatgaacacaggtatgttttcttcttgaatcattttacagtgaatggcagactgtgtgtcccatatccttaaatatttcagtgtgtatttaagaacaaagacattctcatatataaccatagtacatgtatcggaatcaagaaatttaacaatggtacaatactattattcaacccacatttgatattaaattttcattaattatttcattatgtcctttagatctttctttcttttcttcttcttctttttttttttttttttttttttgagacagaatctcactctctcatccaggcttgagtgcaatggcgcaatctcggctcactgcaacctctgcctcccaggttcaagcgattcttctgcctcagcctcctgagtatctgggattacaggtgcccgccaccacacccaactaatttttgtatttttagtagagacagggtttcactgtgttgcccaggctggtcttgaactcctgaactcaggtgatccacccaccttggtctcccaaaatcctgggattgcaggcatgagccaccacgcctggttagatctactttctttgatataaaatgtatacatttgaaagcataagctcaaactgatttctctaattccaggccaactcaacatgattcattctggtctttccctttcccatatttgaatctttctttccccagctgtatgaaacctggctcctattattctcagtatatttcctcatttgctcaattctagaatacatagaacgtagtttcagaattactagagcataccacagtgatacacagagctgcttactcgagttcaatatttgtttacagttgttttggggttttgtatttagattgagaatatgtagtcagaatactgtgttcaaaagtcatttgggttagctcctctccttgctcagatgtgaacatgcttttcatctgagatgcagctacattcatttgtttctagttgtattccattctagagttctcctgcactcggtaatttgaaataacacaaagttccatagtcagttttccatctgtacttgttatggtggaaataatcagtgtaaacactgttttcagcaatgtttagctaaacttgtcctaataactctaggtattaatgcctctgccttctgaatgtaaatcggcaggagtcctcaggtgacagttgtgtcagtacacacacggcaaactttggtcagcagggagcatgtgaaggtgtcttactgctgactctggaggagaagacatttccagaagatatgtgctacccagatcaaggtggtgtctgtcagggcacatgtgtaggaggtggtccctacgcacaaggcgaagatgccaggatgctctcattggtcagcaagaccgagatagaggaagacagcttcagacagatgcccacagaagatgaatacatggacaggccctcccagcccacagaccagttactgttcctcactgagcctggaagcaaatccacacctcctttctctgaacccctggaggtgggggagaatgacagtttaagccagtgcttcacggggacacagagcacagtgggttcagaaagctgcaactgcactgagcccctgtgcaggactgattggactcccatgtcctctgaaaactacttgcaaaaagaggtggacagtggccattgcccgcactgggcagccagccccagccccaactgggcagatgtctgcacaggctgccggaaccctcctggggaggactgtgaacccctcgtgggttccccaaaacgtggacccttgccccagtgcgcctatggcatgggccttccccctgaagaagaagccagcaggacggaggccagagaccagcccgaggatggggctgatgggaggctcccaagctcagcgagggcaggtgccgggtctggaagctcccctggtggccagtcccctgcatctggtaagtgacttcccagtctctcacttctgagcagaagggccagttcttggtacagggtttgggggcaggtattaccatttaggaaggaggaagctaatgggaaaacctcagcttgtgctttttctcttaataagcatttttacaggatggctttggattcagtccacgtgtttggttatacactgcgcccagcgctgtgtggcttcatcgtttaccactggggcagtttctgcatccatgcatatcccatacccttttgcattcaggcttttcatgataggattagacctcaagccccagcactgaccccggaaagacaaagtcaacatcggcgtcaggactggctgagccaaggcattccctcagatttctgctttttggtttttgttttcaaagcaccttaggcctcttaaatctcccccaagaaagcacttataagttttaggaggacacacaaaattgtttagttaatccttaattaattaatatttattgtgaataatgtgttgattctataccaaatgaatgatacagtaaaactgtcttttaaaaagtttcatgagaaaggccccttttataaccacaacgtatcatatatttatggaaccaggcagataattttaacaatttaacatcattataaagatgtatcactgcaacactgcctgagcatgaacaacccaccgattataatattataactttttcccatgagggtaaaacaccatctgttttattacatagttacaaaggactttgcagctgatagtgagggctctggctctgagaattaactgtcatttgaagggtcagggatctctttgagaatcttccgaaagctacagacactccctccagaaaaacgaatatatggatatatactatttaaggggcttcacagaatcctccaactcatatttttaaaaggcccattcataggccgcccctctccagagatgctttttcttctctgcttctttatttagactgcaagtggtgctagcagccggtcttcgaattgttttataaatctgaggtagctagatctgtgccttaaacacagagactgttttgcctcgtgggaatgatggttcctggctttaatctgttcctcaagcttgtggttttgctgcagctacatagatttactgatgtataaattcagtaatagcagttctcagtcaaacagaaaggaggagatatgtttggggatatttttcaaagaactggtatgttttcttctcagaagatctcagaattgttcttattttttaagattgtaaggaatctccatgactgggctttgctgttcgtttgcattgttctatttcttttcttttcttttcttttcttttttttttttgagaccaagtctcactctgtcgcccaggctggagtgcagtggcgcgatctcggctcattgcaacctccacctctcgggttcaagcagttctcctgcctcagcctcccgagtggctgggactataggcgcatgccaccacaccatgctaatttttgtattttcagtaaagatggggtttttccatgttggccaggctggtctcaaacgcctgacctcaggtgatccacctgcctcagtctcccaaagtgctgggattgcaggcgtgagccactgcacctggcctgttctatttcttttctctcagtttattgtcttccccttggttgtggagacagacaggaccctgggctgtggggagcgagaaagctgacgttctgtctctggcagcagccaggtcctggccacactgtcaggggcagaccggtttttcagtgggtgacaccaggaagatgatgttgcctctgtgtgaaaatcagcagcagttcttggaagaacagtgttggccagatttaaagagagagagagagacacatggatcttttaatgccataaaacaaaaagcccgatctttgctctcctgtaagagtcaaaaccgtagcctagtctgtttttcatcatcttttatttctctagcactaaaccatctagggatggagaaaaggaataaaaagtgtgtcatcaactaagtggtgttaatttgcaaaaagtttacactgctttttctgtcttcgtctggtgcttagccatgcaaaacatccgtagagagtctgcccgtggtcgacgccagcaagcgggccaaattaattttcgcctgaggagaggcagcagccagattgattttggaggctgtgctattctctccacaattacttctccatgaacaggccttatggtttctggtcaaaatagtactttctcattcttgctttttcatgtagttttttaaaaagtcacaatttacgttctataaaatgcgtgaaagaggctggagcttcggtgagcagtcctacagaggccttatcccatggtcccctcaaagcccctgtgctctcaggactgtgctgatgtgacatttgtttaagggttttttggatttttatatgagaggattttttgtttgtttttacttacaatcacatcaaatagttctggagaaatgacagtgactggggacttttcctttagggaagagtatctcctgtcccagcatctttgtgaggagaatgattatttttcagacagctccacaagtgtagacaactttaaaaatcatgatacccagtgctgttaaggctatgttagccatgttataagtcctaagaagcaaggagaatgattagcaaagatcagtgaagggggaagcatacttctggttatgtcttaaataaccatgccttaatttaggtctgaagttacgcctaatcctgatgacgtgatggttgccttggttacaagccctctcacctggagattggcgcattctcactgtgcccctagagagttatttcatgcgaaagaaaccataactgcttatgattaatgtgtctgttgttggctggtggcttggttttggctcctgaagccactcgttagtctatcacttctgagctggagaaagttggggtggtctttttttttttttatcttttaaaaatcattttgctttttaattatttcaacttttatcttagattcagggtacatgtgcaggtttgtacctgggtatattgtatgatgctgagttttggggtatgactgatctcgtcatccaggcagtgagcacagtatcttcaatccttgtttctctccctctctcccctgcctagttagaagtgcccagtgtctattgttgccttctttatgtccatgaatacccagtgtttagcttccacttataagtgagaacacgcagtgtttggttttctgtttctgtactaatttacataggataatggcctccaactgcatccatgttgctgcagaggacatgatttccttctttttctatggctgcaaacaattcttgatgaacacagaatacctatttgtttttcaattaatttattgaaggtccaatttattgaaggtccactgagccacagagccttgaaaaagcctgaaaaacaagtagggattaatgccagggagtggaccgtgtgaaaaggtatcaatcatttgagaaatccaggccttccacagtctgccccatccctgacctgcggcctgttgtttgtaatgaatcttggggtctttctcaccagcctggataatctcacaccctatcaacaccccagctctaggcagccacaaccagttagtgggaatcctggctgggtgcagtggctcacgcctataatcccagcactttgggaggctgaggtgggcggatcactttaggtcaggagttcaagaccatcctgaccaacatggggaaaccccatctctactaaaaataaaaaaaattagctgggcatggtggcatgcgcctggaatcccagctacttgagaagctgaggcaggagaattgcttgagtcagggaggtggaggtgatctgagatcttgccactgcactccagcctgggcggcagagcaagactctgtctcaaaaaaaaaaagaaagaaaagaaaaaagggaattctcatagcctaatctttctagtatctcaatatgttaagtgaatggatgcttatacactcattcattcatccattcaggaataaatagatgaacatgagaccactgtatcctgtttgttcccccaagtcactctcagcctcctagttctttggtctgctctagggagctggagaaggagggggatggaagggccggcactggctgccctgggctcacctagtgtcctgggcagaggaggcagaagtgacagagcacaggtgagctggttcatcctagcattatagactctccaaggccatcacctgggagccaggaacacgggacagtgaagacctgcctgacccctcatcctcctctgtcctcagtctccgtccctggtcccactctctcttgaaatgactgttgttgatcatccatttccattctgagagtacagaagattttcctatccaaacttacctcccctcctttcttcccctccagcagcggacagccttctatctctttcttcacactcttgttagaatgccgttcaccaccttgcatttcactttcagctaaatctcgtaagggcagatactggttcattggccctgaatcttgaagttaatatagatatttcataatttggttatctggtgataatattcagctttcattgctgtaaaacatcaatgcactatttcaaaatatacaaaaaatgtggtcactgtgtgtactctgcttcatttcgtcctgtctcccttctttctgcactgatagggctcattttggaaggctttggtctgtaagactttctaagtaattttcaagcatgattcagaatggaactattaaatactgtttcccttcccttaccatcacatacccagtttcttctaaatgcctgaaacagaacttacatttccataaaaaggaaaatcacatgagaagcatatgggttaaatataaaataagttttttaaaaaattccaaaagaacccaatgtagcctgggtagtttgagtgtatttgtgtatatttttagttctcttccttggaagaaaatctacattacaatttggtggtattatttggcatagttcttgtgatttaatattcatgtgttaggcattttaaacaacataataagcttttgagaagaaaggtatgcattgtcttgcttaaaaatgtaaattctgtcagggattgtgttcttagaactaagtttgttctttctgcctgagaaatgcagattccacggagcctgctatgtcaagcatggacaaagtagaagcatcattctgattatgatgggaaacatcactgattcattgtttctgttgacttacttgctatttttaacactctcaagttacctgaacatttttctggttaagtcacattaaatattaatgttaagtcaactaatccattctttttttttaagttttttttgagacagggtttggctctattacccaggctggagagcagtggcacgatcttggctcattgcagcctccgtcccccaggctcaatccatcctcccatctcagcctcccgagtagctgggacaacaggcctgtaccaccacaccctgctaatttttgtgtgtgtgtttttttttttttagagactgagtttcgtcatgctgcccaggctagtctcgaactcctgagctcaaacggatccacacacctaggcctcccaaggtgtatagtcccagccactcaggaggctgaggtgggaggacagccaagcccaggaggtcaggactgcagtgagctgtgttcacgccactgcactccagcctgagcgattaagcaagaccctttctcaaagaaacaaaaacaaatgtctgattatgaagcttgtaccctaacccactgcactgtctgggattacaggtgtgaccctctgcaccctgccaactaatccatcttaactgttggaaacacttccaaattcccatatttaataaaaatccccatgtcattctggctttcaaatcatacttttgggtagccttcaaatttcatcagtcatattgtgttcagggacctgtaagattggttcgatagcctgaaggttacagttttgtcagtgatattatagacgttagtcactgggtgctgagtgttttgtgtgtattatcttcttattcctcacagaaattctatgggacaagttcctcgcccaggatcatacagctagtaagcgacaaagccatggttcaagtatctgattgcaggccagggcacagtggctcccacctgtaaccccagcactttgggaagccaaggtgggaggatctcttgaacccaggagttcaggaccagcctgggcaacatagacctcttctctacaaaaatttaaaaaaaattagccagatgtggtagcatgtacctgtagtcccagccactcgggaggctgaggtgggatgatcacctgagcccagaaggtcagggctgcagtgcaaccttaaaccaccgcactgtctcctcttaagtcagtgcaagtgatgctgatttcatttatttactgtgtcttggagaatcctcagtgtgtcacagaatagggacaagcacagtcctggcatcattggctactctggctgagggagaggcagtagccaggcctggcctggcccagagggttccacaggagggacagtaggatgcacagtgcgtgatggtcccctggttatggtgagacccctctcttctgccagttgtcttgggatgttactattttcactatcactttctcttgtggggagagccttttcttccacatgcttcaaactttatcttttttttttttttttttggcaagcaaaataaatgtcaaataaaggtcagaggcagcctcgaaggggaacactgtcagaaagggatcccgaggagaggaggcaagaggggagggacaaggcctggtttggcttaatggactaacaatgcctataaaaaacctctggtcttcatgtttttaatgtagactattttttagagcagttttagcttcataggaaaattgaggggcaggtacagagatttcctatatacctcctgccccccacacatgcacagcctcccccactagagtggtacatttgctgcacttgacgagcgcatattgacacattggggtccactctttgtgttgtacgttctatgggtttggaccaatgtatcctggcatgcatccaccatgatagtctcctacagggtagtttcactgccctacaaatcctctgtgctctactcaccccttcctctctctgaacttctggcaactactgatctttctactgtctccatagtttttcctggtccagaatgccatagagttggaatcatacattctatagccttttcagattggctttgtttacttagcattatgaatctaagtttcctccatgtcttttcatggcttgatagctcttttctttttttattttttcagacggagtctcattctgtcacccaggctggagtgcagtggcgtgatcttggctcactgcaggccccgcctccgggttcatgccattctcctgcctcagcctcccgagtagctgggactacaggcgcctgccaccatgcccagcaaattttttgtatttttttagtagagacggggtttcactgtgttagccaagatggtctccatctcctgaccttgagagtcgcccgcctcggcctcccaaagtgctgggattataggcgtgagccaccgtgcctggccagctcttttctttttaacactaaataatattccattgtgtggaggacatgggggatttgtttatcccttcatttactgaaggactcttggctgcttccaagttttggcaattatgactacagctgctgtaaacatctgtgtgcagatttttgtgtggacataagttttcaacttctttgggtaaataccaaagagtatgattgctggatcatatgataactgtatgttcagttttgtaagaagtcatcaaactgtcttccaaagcagctgtacccttttgcattcccactagccaagaataagagttcctgccacccacccccatgctcgccagcatttggtgttgtcagtgttctggatctgagccattctaataggtgtgtagtggtgtctcactgttgcataaattctcacttccctaatgacatatgatgtggagcatcttttcatatgcctgtttgccatctggatatctttggtgaggtgtctgttaaggccttgggtccattttttaatcgggttatttgttttcttattgttgagttttaagagttccttgtttattttgggaaatagtcctttgtcagatgtggcttttgcagatattttcttccagtctgcggcttgtttcttcattctcttaagcctcggatctttttaggccatcttgggtaagcctcatctgaaccatccctccccttttcatactcccttactagccaccagcaagggagaggtccctgctaactgcagaggtccccgttgagtttctaggcattcagtgggaagagttaccctcctgggatacgtatcaactgcagaaaccatgagaaccatgttgaaaaggagacccacagcacccacctgattatacagctgccaacatggtgacctattgatgtcaccatcgcagatcagatgtgagctctctgatgtgaacaactaatctgttctgcaatacagaaagcaaatgttaaggaattcttacttttagcaaggacagttcaggactgaggtatctattagataaggatattaccaactaattctaagccttgatctactctcatgctacattcaactcacagcagacttgcgtgatgagaaatgagactgtggggtttaatgtagaattatatagatgagtgttgtaaccgaagacaatcatatgattgaggacttcggcagagcaaacagaagttggttagatttccagagaaagtgccctttcagtctttaagacgcattgagatcctctaacaagacagggatggaaagataatactactcttcagtgtatttcatgaatctctgtgtccttgggagttccgtgagcacggatattactttctgggaggaggaatgccaccattgcacctgtgactgactctttgctatttccctagcattttcaaatctatcatcttgtttgacccttatgctatcctgctgaatattcatgtgctcatttgttcatttatttaacaaatgtgtattattaatatttgcttgctctacgcagttgcacactgccaggccagcacagcttgatacagattgggagagttaggtggtttgttccaaattctcaccactagtgagagccaagtctcaggacaagacccaagagcttctagactcctattctctgccccacatttctgcccctcctgaattcaggcagccattaatgcctccatccctctagctaccacttattcacctctgctcttcagagactgaaacaccacaatgacattgatgtcattagattgctttccggtgaatctggattatgacgtgccatggaaaaagaaggctgtttggcagttttcatccttgaacagtgtcagtcggtaaaggggaaaaaaaccaatcacagaaacctggcgtgctcacgtgcagagcacctgcaagctggtgtttgtgatgcagccaacctggcctggagagagggcttagtcaattctgtatggagagtgttgcttctgttactgttattattgtagtaggtactcaatctatctccactcaacccacagattaacccacacccgcccaggaagctgactgaagcccatagcacactgattattcacaactcttgggtcactctggaatacccagacccttctgctgccacctgctgaatggccatgttttctaaagtccatgggtgctcccagttctgtgagtgtgagctgatcttgtcattcaaaacattaactattacgttaactggcaagaaaaaatgagtttgataatcatgattatttctatgaaaactactgaatactttgggatgattcggggaatgaattgctaaaacctttttggtattgaagttgaggtgaatgacacaaccgtgaaaggtggaaggaagaaaactctagaaggctcctgcacttagactgctttttggcaagtgacttttggttctctttccacgttaaagaacccaaaactagaaattgtaggtaaagcattcaagatacaattggtacaatcagtagacccattcgcaaaggacaggcccgttttccatcagaaagttggtgttttgcagcaaggggtgggtggcttgaacatgagggaaacatatcacaggatcagtattttagaagcataagtggagagcttctacaactcagttttactgaatatttagtagagaaaatctgattagcaaacacttctgtaatattgaaaaatgtccaacttataagatgtcacttccgaaaacggtagtgctagattagagcctcagtggggaaagttcccagagtaatgctcctaagagttgcccgcgccttcaggactggtgacataactgacatagcccagtggaaaatgaaaaattttccccttttgcaaaaattaataagaatttcatgatgacagcaaagcatttaacccagcgtggagctcttcagagcataagaccttgtgcggctgcacaggcccatggcgaccactctgctgccacttaagaattgccacgtattgtgtgattggcacatcagtataacttttttaaaaaaggtttagtctctatcagtttactatatctcacaagagtcaccatgcatggatagacttgaccaatggttgtttttgtcattaattttaggtttgttaaagaaacacttgaagaataaacttgttttagaatctcctaaatctttctaggtaactgtcctttacatcttaacggtcaggaatttttttttttttttttttttgagagagtctcactctgtcgcccaggctggagtgcagtggcatgatctcggctcactgcaagctccgcctcctgggttcacgccattctcctgcctcagcctcccgagtagctgggactacaggcgcctgccaccacacccagctaattttttttatttttagtagagaccaggtttcaccgtgttaaccaggatggtctcgatctcctgacctcgtgatccacccgcctcggcctcccaaagtactgggattacaggcgtgagccactgcgcccagccaatggtcaggaatttaaaggcctagtttttgcccttccacaagcctcacggccttccaaaaataatattctttttttttttttttgagatgggggtcactctgtcacccaggctggagtgcagtggcatgatcacagatcactggagcctcagcatctctgggctcaggtgatcctcccacctcagcctcccaagtagctgtgactacaagcgtgtgccaccacacccaactaacttttttgtatttttcatagaggcagggtttcaccatgttgcccaggctggtctccaactcctgggcttaagcattcacccacttcggcctcccaaaatgccaggattacaggtgtcagccaccgcgcttagttccccaacaataatattcttggttcagtccatgaaacaaaggattctgaaatgtttagatattctacttaggcaaaagggtttgaggtccatctgaaaaaagaaaacaaaaatgaatataggtcctatagaatatttaggttatcagtatcaaagatactgtttgccatggagcaatggcatggaatgaaattctcaagatgaaagactttacacaaaccataggttttacctggattcagactcatcagaggttctcacaagaaagaagtaaacaacaatggattcatgatgatctgttgaaaaataaaatttaaaatggcagagaaataatatataccatgacataagcagataaatcagtgaggaggataaagaagagatgagaacgaattcaaaaccataaatccatcatacagtggctggagatatcctctgtgcagttttacgtgatactgaagagcaacagaaccagcaggcgatgatgtcgtagtgagaacacctcatgatggatggttttgcatttaatctcatctcttctttattctcttcatagacttatctgtttgtgtcatggtgtatattaaaactagaggaactaggtcaagaataatcatacgactaagcaactttaaattgcttattttattaaataaacatggtatgtttttaatcagaatagaattttcattgtatgtgctttttttaaaaaattgaatgtcccattccatgtactttttagttttcactttgactttttctattaaccaagtagtgatttctctaggaggacttaactgtgttgctacgcctacttctgttgctgctacggtagaagcctttttatcagcccctggtcagcagttgctgagttacttaaaaatgtcatcttacaagttcatctcttaaatatttttttacttaaaacatataccttatagttgacacactgattattttatagtataagtctgtatgtactggctgattatagtttcctgagtcctttttttttttttttttttttttttgagagagtcttgcactccacccaggctgggtgcagtggcgcgatcttgactcactgcaacctccgcctcctgggttcaagcacttctcctacctcagcctcctaagtagctgggattgcaggtgcccaccactatgctgagctactttttgtatttttagtagaaacggggtttcgccatattggccaggctggtcttgaactcctgaccccaggtgatctactcgcctcggcctcccaaagtgctgggattacaggcgtgagccaccgcgcccggcctcctgagccctttttacattaaccacaccaccttaatttccagtttcgatttcttcaatgtgaaatgagaaattacagatatttgagagcaaaatccttctggagttttattatttccttttcctattctttttcttcctttctcacttctctgtggccctgggaactgtctcattgtcatatttgtgttctagaatattttgagtgataatgtcggtgctgtgtgttttgttttggttttctgcggggggagtggaaccagcttgcttctgtgccgccattttgaaaccagaagtccttcctttttctttcttttttcttagtttccttgcctacaccaccacaccagttgaacagtttgtggtgattgtttcattttgtttgtatgtttgtttgtttgtttgtttgttaacttttatttgggtccttgcaaagcattcactttagttttcatagaaacatttcccattttttctcactaatatttcactgctttacctaatatgtaattaaatttcctgatgagtttatctggtgacaacagacttgagaagtaacttggtaagtggtgggagcagaagggcgtagatacagtggtgagcagaccctcactggagtacgctgcatgcctggcaatgtgtggagagggggtggagaaggtgctgggtaggtggtaaacaggaatgccaacgggcctccctcatgctaattgggggttcttagacaagtcctgccactgcccatcttgaaggacatcccacacaactgcccatgggagaaacagcatgaggcacagacctccttccaggactttggatttgttgctcatacttgaaatccttgtgtcttcatgggcttttccttgtgttttggtcttggcttctctagaggttacccagtgggtcaggggaaggctcctcaaaggaatttcctacatgcgtatcggtattttagtcaggccatccaaaacatgccttccaaattcgaggaaaatctcgtgtggagtggtaacaaaaacttcattttatttgtatgaattattactaagctgagtcacaatggagaagaaaaaggggtgaatcgtgaggagccattttgacattcctggcccctgatcaaatggaaggattctgtttgtgatgctgagtgttggggtgtttctagatctgcttggtttgtggcactttcctagaccaaagtctaggaaatttctgtctttaaaatggaagaatcgtaagagctagcaggttgcctaacatttgttggactttgtttgtttttcaaaaggcccgttgctgaaagactggccacatctagtcacccacaaagcaatgatgctagaaccccttagggacaaaacacccttcagagttcagaagggaaaagtgatttataggactttttttttctattttagttttgtgaatctgttttgtttccgggagtaattttaatgttaaggaagtggattaatctctactgaaagctgagcccacgtggccccatgatcctccagggctgagttgttagggaccatgaggaaccaaggcacccacggtgatggggcctcagatgtgagtccagagaggagagcagactgaggtctccttccttagctgtgcttgttctgtgttgaacacacacacacacacacacacacacacacacaaatacacatacactctctctctcttttgtaacatctgaatcttgtctgtgattctgtaatcttggtgtgctctcttgccagtatcccagagtcccacctcacaagcaaatggtaaagcatgagtctgcccctaggcttgctcgtttctcatctcttcctctcccctccttttctgttcctcctctcctcctcctcctcttcctctcctcctccttttcctcccctcctcctttcctgttcctcctctcctcctcctcctcttcccctcctttacctcccctcctcctctcctcctcctcttcctcccctcctcctccccccttcttgttcctctctccttcctcttcctccaccctttctttcctctcctcctcctcttcctagccctctcctcccccttcccccctccctcctccactccttttcctcctctcttcctctccccgcctcttctctttacttcttttgtcttttttctcttccattcctcttttctctgccccgccttcctccgcctcagtgggcctggagggttacagtgtggttccctgtggccccgggctgtgggaatccggggagccgccctccactccccggaaccttcctctcggcagaccctgcctccgggcgctgactcaccctccccgtgttctcccttcctctccccgcaggaaatgtgactggaaacagtaactccacgttcatctccagcgggcaggtgatgaacttcaagggcgacatcatcgtggtctacgtcagccagacctcgcaggagggcgcggcggcggctgcggagcccatgggccgcccggtgcaggaggagaccctggcgcgccgagactccttcgcggggaacggcccgcgcttcccggacccgtgcggcggccccgaggggctgcgggagccggagaaggcctcgaggccggtgcaggagcaaggcggggccaaggcttgagcgccccccatggctgggagcccgaagctcggagccagggctcgcgagggcagcaccgcagcctctgccccagccccggccacccagggatcgatcggtacagtcgaggaagaccacccggcattctctgcccactttgccttccaggaaatgggcttttcaggaagtgaattgatgaggactgtccccatgcccacggatgctcagcagcccgccgcactggggcagatgtctcccctgccactcctcaaactcgcagcagtaatttgtggcactatgacagctatttttatgactatcctgttctgtgggggggggggtctgttttccccccatatttgtattccttttcataacttttcttgatatctttcctccctcttttttaatgtaaaggttttctcaaaaattctcctaaaggtgagggtctctttcttttctcttttccttttttttttctttttttggcaacctggctctggcccaggctagagtgcagtggtgcgattatagcccggtgcagcctctaactcctgggctcaagcaatccaagtgatcctcccacctcaaccttcggagtagctgggatcacagctgcaggccacgcccagcttcctccccccgactccccccccagagacacggtcccaccatgttacccagcctggtctcaaactccccagctaaagcagtcctccagcctcggcctcccaaagtactgggattacaggcgtgagcccccacgctggcctgctttacgtattttcttttgtgcccctgctcacagtgttttagagatggctttcccagtgtgtgttcattgtaaacacttttgggaaagggctaaacatgtgaggcctggagatagttgctaagttgctaggaacatgtggtgggactttcatattctgaaaaatgttctatattctcatttttctaaaagaaagaaaaaaggaaacccgatttatttctcctgaatctttttaagtttgtgtcgttccttaagcagaactaagctcagtatgtgaccttacccgctaggtggttaatttatccatgctggcagaggcactcaggtacttggtaagcaaatttctaaaactccaagttgctgcagcttggcattcttcttattctagaggtctctctggaaaagatggagaaaatgaacaggacatggggctcctggaaagaaagggcccgggaagttcaaggaagaataaagttgaaattttaatttgcattttttttgtctagataagaatagcgtgaatagatcctcttttattcgtaaataatcgtgcatctgtgggttagccttgtagaagtggaaaacattccattttccaatgcatttaaatgtaaagccaaatctgcatgttgtgaatttaagaaaacttattatcctaaaggtgcctttctcttggcatcatcccgcttgtgagaagcctagaggacgctccaggtggaaggaaatcccctgggtggttttatcttttgttacccagtgagcactggttccccgcaaatactggggaaaagcaaaaatacacaagcaagttaaaattaattttgcacatctgggaggttataaaagaaagcactaatagtagtcactgcccagactttactggccacaaatgcccagctgaagagcatgactgtggatcactggtttttccctcctgctggaaatgctggggtggtagcggtcgattaggattttcagtggagaagcacaggacagttctgtaatttatgggactccttagccaacataaagaactgcaggaaataactgcacagccaggaggatccgttggtgggaatttaccgtcattcctgcccttttatttaacatcatccacagagagatgttatacaaatggaggaaaccattataccttttgatatggaatatattacagagttacagttcacaaagtagaatgctgagctgaaaacccgagtttctgctgtgactgtcatctcactgagcacttcgcttttctttgcttttattttttccttctataaaaaggcaataatgataatttataatagtttccctacccagagatattagaagtatgctacagtgaatgttaaagtaccttgagatccttaaatcaaaggtgctatatacataagtaagactctactttcagaaaaaggtaatattatttcctgcactgatccctactaattctatattgatccaaaggcaactcaatgctaaaaaatgtatagaaaatataagtctgtgtctgtgtactgtagagatgtatgtgacaagtgtaaacaaaatgaactgaagcagtaatgaacagttattagggggaacatgataaagagattatattaagcttatgtttcaccataaaatcctttttatggcttactaaaaccgagctcactgtaaaatcatgatccaacttattgctaatctttatgatatgcttattcctaatctttatggtatggtgtcaaccgttcatttgtatcttattgctcattccctggaccacagactagggacagaaaatacttgctttaataatatatatgctgttgatttcacaaaaatttattaaaatacagcctgggtacccagtgaaagagctgaaatggaaatggagtatcatgtttcctactcacattttactcagctgtcgg

SEQ ID NO: 2099 - DNA, 62424 bp, Homo sapiens; identical to SEQ ID NO: 2098
  source 1..62424: mol_type = genomic DNA

SEQ ID NO: 2100 - DNA, 62424 bp, Homo sapiens; identical to SEQ ID NO: 2098
  source 1..62424: mol_type = genomic DNA

SEQ ID NO: 2101 - DNA, 62424 bp, Homo sapiens; identical to SEQ ID NO: 2098
  source 1..62424: mol_type = genomic DNA

SEQ ID NO: 2102 - DNA, 28588 bp, Homo sapiens
  source 1..28588: mol_type = genomic DNA
taaaaaataatttgaaaactttaataatgtcatttatatagttataaaaccataaaatcttttaaataaggtacattcaatttctcagagcatctaatattcagataatttatatttcatatgttttccaacattaaacaattgactaaataatgcattttctataaaatgatattacagcttatacagataaaattataaaaatactccacacagaaaaatatggcagtacctattagaaaaatgctacaaactttccattaaaaatatatattttctctttcatttgtcataataaacagaatataattttctttctaaaattaagtcataccgtttctttataggatgataatatgtacaaatcttatatctgaatgaatataaatagcaatactgtaatagtgttacagatatattagtaacttttacagaaaaaaatatggctttctaataaaagcctctagcatagctgaaatctcaaagctatttaagttagacattcccatatttagtaaggcacaatggagtctagttttttttttttaatttccagttgaattactgcaagcagtaataagggaaaatatagtcagtagataacgatccagatctgacagttggattaaccatttggggtttattggaggagatgttagtcctttctccacatcatagtttcttttagtaccctgtggcaaaattagtcactggtaatgagaaagatatcactgaaagcctcaagtgcctgagaaacagtttactcatccatgggatctcgccaattgtgaggaaacagctcaatggccatttccagttataagcagcttatttttactgattggacctggttacctatcatttctaaaaataacttctgatacaatttgtacattgtgaagctgtgaaggaacctgatggtcttctttagactctgagtgacagttttgggaaagtggtacgtctttgagtgctttagtgcgtgcattaggcccttcaaggtgtcttggtcgccattttttattcgccacaaactgagcagcttcaggatctggtcactgggtttgcatgcctttattgttttttcaatgtcttctgctcccactttctttcccggtaagctttccatcaagctacgaagctgctcgaaggtgaggttagcatgtccaatgtgccgctgcacgctgttttcacagaggtcaatatctgcataaagcaaaagcccagataagtgttcacatcatttatattcatccaatgccatcataaaacaagcgtgaggcaaaaggttcttgcagaatttcataattatatttcaatgataaccttttcttttgagagggagttaagtgacaccatttatttctaagaactgagataaatattttttgttataataagataatatgctatatatttttggcatccaacaaaactttggaagaagctcctaattttgaaaattaacagtagaaaataagacacatcactctcagttttctaagaaaaagtttgagaaattaaaaccataacatttcagaaaaaaaggaaagtattcaagttagctactttgtaatacaaagtttcattagtaggcgctagttgataagttaattgccgtaactagcctttaaagaatacacatagcaccagaggactacctccatgaggaggatatctgaaaactcaaagacatgaggtcgaggaactaaaggagacacacagcctagagaatatttcagtaataagctagggtacaaacctaagagggaggaactaacatttctattaatgacatgagtcacttagtatctgtgagccctaaggcaaatcggttcatctttctgggttaaaatgtcctcatttataaaatagggaatttggttgcttccaattctaacggtctctgattttctcttttctttcggcttcagggctaattatacgttcaaagaatacttttggtttgctcaaaacataaaagtttactctttgcataagcaaaagcaatcagctctcaaagacgttggtctcctaaaatctgttgccccggtttcagatacttgaagttttttagggtagtgcaagactatacagtcatttaactactggtgaggacctgaatgaatttctcactgaccctgtctgcattatggaaactcttcttcctttttcttctagcatgtcctcccaatgcttactgaagtcagaactctttccatcatgtgtcgtaaagcttacagtccacactggatgaaactccttttcttcagattctttcacacttctctccctatctctctctgtttctctctcacaccatttctaaaggagaatctttatataaacttataagatgtgagaacattttgctgtaactagctttttcctacaagaggctcaaacacttttcagattttatctcattaattctcataacatatgccattaaaataattttaatgcaggccatatcatgaggattaataagaacatatttgtaagctacgaaaagcctacctggagagaattaccaagtaaatacaacagagcttcttggtagaggtgcaatgtaagatacaaagtggttatagagcttctccttggtggtctagaggggctgcttacagaagcgttaagggatctggaagcgactccctgagatacagccctgccttcaaatgcatttctcttctcttagagtgttcaacatactttacaaggaaactggggagcaggggtgagaacaaaaccttgtataactgtttttggaatcacatctacattatcagttggtggaaactttttcagtccaacaatgattccaacagggaaacaagatccacacaactaaacatacatgcagtcttgttcctggtttatgataaataggtgtctttgatttctgattgatctttttattttagattatcataccttggatgatcttcttgactatatcttggtctttgttttgatgtttccataacttcagcagctggaaagtctgttcttgtgagctgtgttgccgttttatcctctctacactctctgcgtttactttggtgccaggcaaattgtctaccaagacactaagccagttaggcgtaaactttgtaggaacagcaaacctgaagaatgcctcctcacacagggtaacatctaaagaaaggttagaaaacccagaagatttactcaacaattggatttctgagagtctattcaatacaaacaaaaacaaaaaaccaacacaattgaattttccaagataaaatatgctaaaatgcaaagtttgaataaaatcaagcttctgttggctggtcttagtggcagagaccaactgagcttacgtgtcttctaatgttcttttttgggcattgttttcaagagaaagtttagtaaatgtctaattagagtgaaatattgttgtaaataagtaacagccaaaaattcttataatgaatacaaacattaacattctattaaaggtttacctagtacccacagggaacttcatgattaatgtcaaaacaaataattatcactgacttaaaggaatttgaacagtaatttggaatagtgtgttattttttgcccacatttagacacatagtttacctttggaaacaaagcaagagatagatacagatatataagtagacattacataggaaaataaccaaacataaaactatgttatttacataggcattacaaagcccagagcatctgggtagagtaagtatgtcccagaaaatgggagtaatgggtgtttgtttttggattcatcagacctggctttgaatactagttctgccgttctactacctatattcatctgaagcaactttcacagtgtttttataaatgttaaagcctctatagcacagtaccacatagtaagtgcacaataaatgaaaaaaagtaaaattaaaaatgaattaattaaagagaatgttaaaatttgatcactccttttaataccccttccttcattttttttttttttttttagataagaaagcaaaggctaaaatggcttgtctatgatttcaattacacaatgaaacaatgctggaactgggttagaatctcatatatatatcaattcacatttctctgcttcataaacttctttgtagtacgaaaaactgtttggggagagtcaagctggtttataccattgcttgattaaacacaaaaaagcaaatcatctttagtgtaatgtgtctttgagtgaaggtctgagattagtctagtggtgggagtgacaaggtgaacacacacactagcctgatgaattgtcatcactaccgtggaatgcattcgaataacctgaacttaatactagtgacctgtacccaatgaagagcttaacacaaccagagtagcttggaagttccatgcaatagatgcactaataccataggtaacaaagccaagtacacatttctaatgtgtgtgtgtgtgtgtgtgtgtgtgtgtgtgatgaaatcttgctctgttgcccagactggagtgcagtggtacaatctcagctcactgcaacctccatctcctgggttcaagcgattctcctgcctcagccctgagtagctggtactagaagtgcctgctaccatgcccagctaatttttgtatttttagtagagacaaggtttcaccatgttggtcaggctggtcttgaaatcctgacctcaagtgatctgcctaccttggccccccaaaatgttgggattataggagtaagccaccatgcctggcctaatttgtcatcatgtttatatcactttgcttcttagttgccaatttatactttagttaataatacagacattcttgaaagtaataacacacaacttgaattctacagtttggactctcctaatttcatctcagtggcaaacttgacactgccctttgcctatgggcaagatttgatttcagtgtgaaaggagagaaaatcaagctttgaggtgttatctgtgagaagatgagtttttgagagattctgagtggtagctttagcagtaatgcatcgagagtagccttagctggttaagattcaagaaagggaaaatgtaagtttgaccaagaatgtggctggaggccttgtgttcaactcagagagagagatgatactacaaaatcgtacaaagacgtattttggaatgtaattacctattccacatttttgagttgattcactgtttccggaacatatgttgtcgtgtgttgcatttcctttctgagttagcaggagaccaaagacactgcaatttgtgtgttttctacagggtgctttagatgacgtctcatttgagaagaacccatctggacatcttttgcaaactgtatttcgctctggggttcctacagaaaataccaagcaatttagtaccttctcctcaaatcgtttcccagcagatgccctcttaacacagttttggaaagacttttcacttggtttttactgctactattatgttgcacaaaactctagcattttcatttttcacttcattagacagaacaaaacttccaccatcatcccctttggcagtttctcctccttgtaatgcaaatgcaagtcaattttctcgttacctacaaaacgctcatgaaatgtgagaggaaaggaaagaagggtagggtgttcattagtccagcctccgctgagtggcagtaaggccgtgttgtcagccatattcttcatacaattattcctagaaaatcaagataactgctgtgtgtctgctgtaatatcattctttgaaattagtacccattgaatgctgcatcattaaattccaatcagttcctactgaagttctttctttcctgaatcctaattgtgaagcaactcctaagtatgctaaccttgagaagtaaaaatttacaacattataataaacttttgaaggtggcaataaagttggccgctgactcaaaagcgtaagcctgcagttaagctacatagtaaacggaagatgatataccatttgcttaaactgtttaaaacagcagagtcgttaaaacttcaggaagggtgactgcaagggcattttacttcatgatggaaaaatatttgataaatttgaagaaatcattggcagaaaaacttgaaccagtccacaactaaagacgctattaaaaataaataccttcaaacacttgactatattacgcatggctagatcatacattccagtgtatctgaatatgaaaatatctccatctagtgtaagctagttgaacagatttagacttcaatatccaaatgtagattttacaggccaattctggcttatgcaagataacaaatatgaaagagaaaaatcaaagctacagaaacttattaaacttcatttataaatctcaacctcctacctcattgtatcttttaccaaaaccagaaaataaaaaaaggggcaaaatggactggttctagtttcatctcctgtctctttctacatgattcattgacctgcaaaaatgacaaagggctggcagaaaaaaagaacaggaggggaaaacacagcctaaaaccttcacatattaaatattatttccagcattgcactgacattatcttaggaaccaccttacaaagcaaagagggttttctgtttgtgtgtttgtttttagtactttcctactacatcctactccttaaatgggatacaactctatatcaaattctacaatatcataagcagaggtatttgggcagggattccatggcattctttcattgctaatttactcgaaataagtgacttggacacctggacccaggtctccctttgttgactgccgtatgttctgcatgaagaagaatcttttttggggggaaggcgggggcggcggcagggacggagtctcatctctgtcacccaggctggagtgcagtagagggatctcagctcaccacaacctccgcctccagggttcaagagattctcctgtctcagcctcctgagtagctagggttgcaggcatgcaccaccatgccctgctaatttttgtatttttagtagaggcagggtttcatcatgttggccaggctggtcttgaactcctgacctcaggtgatctgcccgccttgacctctcaaactcttgagattacagatgtgagccaccgtgccgggcctaagaatcttgttcattcttcagatacatatctgtggcttgggtcttctcctgcatcctaatgagaagttcatatgtgtcagatatttcttttaggtaagttagcttttaaagttatttaacaaaaagaatctaagaatgacagaactaatgtttcataatatattcagaagctttatctaatgaccttcctgaacatgaacatgacttccctctataactgatggtactttttatgaaaaagatctatccatctaagtaatgattttaccttattactatcagtggaaatataaaaattataacctgccaggcaaaatgtgaaattataatgatggagaaatttggctttacagttgagaattcaccatgcttgctctaagtaattccacaggaattaacagaatgaagtaaataaaatatggagaggagacaatctgatttcaaaacagcaacagcaacaacaaaacggttattaaatactttttagagtaacaccacatagtctttccttctctttgggctggaaacctcttatttcccaagaggaactgctgtgtgggtttttagggagggagaggtaaataaatcccactgtgctgccagtgtacacagagtaaaatgtgtacttttgttctgagtcttctggctgcctgcttgcttcattctacaaacagattttcttacttatttaagaaagatccttgtgatttccattatttttcaaaattttctagtttccaagctgcatagcccacttttcatttttctacatatacaacttactgaatgaattacatggatttgcttttatctgatgggattccacaccccgcaccctgacacacacacaacttagcttagcttttgagtctcaaagtaccatccaatagaaagtaggaactatcaccaattcctccctcaaatactcatacgaagaggaattttaagggactctgatgcaatttgcatcttctgtgattaattttataagattcactatttgagaaacagaatagattttgatttttgaatgtttcatttgtatgcctttaaacctaaagtattggtcgtctaataatttagactttgtatatcacaagttttgagagttaaaatagttacagatacttagcattgatgaccctgttctcaaccaggagtgattttgccacctgacgacatttgacagtgtctgaagacatttttggctgtcacatgggggaaggactgctattggtatctagtggctagagtccaggggtgctgccaaaattctacaatgcgcaggacagctgcccacaaaaaggagtccagcctaggaatccagatatttcttaaaatatcagcagggcttcagttgagaaacactgcttcaaactgagtcatcagaatctatactgattacttcttccatctaagtaagtggatactcttaattttctcaagctatgaaaagttataggctgcactgaagcttcgcaaatgtggcagaaaaaaacgtgggttactggtttaaaagattcaatacacatgagccctgaccaatgctgttcaaaatgcaaaagagaaagcacttggtttataggcaagtgcttgctcttggcttgacaatctgttttgtctaagataaagaataagctcattgaagagattctgctatagtccttaccctcccaaacactcagctcccatgctaaaggaagaactagccttgtttttaataatgaaatgcaattcccctcaccattctcattttttacataattaattataactgcttattgttagcactccagagtctcattaatatgagcataattactctcttggtataaattaacatttctgatgtttgtcaaaaagtgctgcagtttgaaggtgtccatgctgaagtgaaatatagaggtatagatcaactatcaatagtgcaacttgagtttgtttctttaaaaaaaaaaaaaaaccatcatgcatctcatgagagaataatttgctgcatttgagatttgtcattaaattgccctgtagtggcaaagtattcctctgagcaatggtcctttggaagcactccagacacatagtacctacctggcaggtttcattacctttgcaatttgctatcctataatgtcatcagaacaaaagtgttctcctaaactgtcacaactatctgactttgcatgatcctaattaattttgctgcacattgacacgtaccagcttgcaccactccaaatccaggagggcagctcctatgtttcaagcagaactctatctcaaggtagcgcccttccttgcattcgcacacgcggttgtgggtgcgattgcactcctgcttgacgtactgcagctccttgcacacggggctgcagtatagacactcgtcactggtgtgccagctgtctgtgtagtagtggtcagggcaaggggcgcacacggtcttccactttgctgtacagtgttgttttaggtaggtaccaggaggacatttgtcacacaacagctgatgagaggtttcttcgtcataatgaaggtactttggaggaaacgtttcctgggtggtccacttaatggagatgtccagaaactagaaggagaaaggaacacagtggcatcatcttagcatgaaaataggtttgttcttatgtgcaacagtatcatttgactcaaagtcctgtattaccttaagcctaatgagatttgccacaaagtaagcttggaagccataatttttgcctccgggagcttaatctcaaagaccaggaatgcagatagcagtgaacatattaactaaaatccaggctcaaagatgactggagtagaaagcccatcaaaatagaactataacacttagatgcactgctgaattaccatgtgacttgaaagacactttgtcgtcttgggttgcaggattatctctaggtgagtgagttggattaactggtaattctcagaacagctacacaaatcacctgttaaaaatatagattcctgggattcatatccttaagtattcttattccaccgatgtggggatgtgggattgggcctggggatttaaaacacctgcagtgtttctgacgcctgggatgcatactaaataatcatctcttaatttattcatttgacaaataattaactgagcccttagtatgtgccagactttgttctgggcacttgggatacaattctgaataaaataggcaagaaattctgcccttatggagttaatccaattagaggagtaaaaataatacattataataaactacgcaagtattgttttaaaaaaggagagagagcaggtaaagaagcctggaaacatggaggggaaaatagggagattaacatttctaagcacggtgctcatattggggactaaaggatacctctttcagttttcctattctaagacttttggattccaagaaaatactgaagagttggtgatatgcgaaggtatatgattacaacaatcattcctattactcattcatgcaacagatataggttgaatgcctactaggtgtcaagcaccaggaatatgctggtgagtcagacatgtcccctgttgccataagcttgcagttcaccgaaaagattcctcgaatgtaaggttgatattttctctaaacatcatattgaccagcagtcttgactctcataggtgaatgacatctaaaaacaatattaagtaaattaactgaccacatctcttcaggtgtactgggataaatttcagggagcaggcagggatcagaagtttccatacataatggcaggaagaggcctgtgcagtaggggaaagaggatttcatgggcaagggtgccacttggaaggagagtttcaactgggtattctgtcttgtattttagatccccaaaggtcttccagggagcactgaagtagttcttcacactaattacaggaatcacacgctcagaagaaactgtgttttttgtgtgtagggggtggtttgtttgtttttggtacagagatcaacactgactattttcaggccttggggaggtggtaaaccaaacaataattttttccaaactctctttgcagaattcaggaaatctcacaggaaccccctgacctggaaaaggcatgccaagctagggaaacagcacacccttttgaattaggggtggcaaagataaagaatggcctttttcataagcatttgaacattttaactgaagtaacttcattcacttcttatgggaacatggcaagtgtttgggctgatttgacctaatatgagttgataaaccagaagagaagaatgaaacatctcatccggtcattgacctcttcacagagacaattttcaaagacagtgagtgctgtaatgcaaggaactcccaaccaacaataagcaaaattcactgcaagctcagagctgcttcagtggtcttttcaggacattcccttgacctgagagtttctagtgaaagcatcttcttgaattttcctggggcttttaattgtctcaggtggagtgggttgacactagattacagaaatggaccagtagtgagtggcagctctggtttgttctgaatctttcagaaatagatggaacctatttcttcattcaacacacactccttgagcatccactatgtaccaggcatcatggagggaacttagcatgtggcatacataaaacgcaaatggtccttgccttcaagttcatacttgagtgagcacgcagacaataataagtgaagaaataattacagcaagtaattacaaataatgatcaaagtaatgcaagaaagcaagatgacatgtctgactttgttgctagtttgtcatttgaatatataatgggacaactttcagggcttctataattaattctcctataatatatataggagaattatatatgatacataattcagggctcctatagtgtaatcaattctcaatattataaaatgaggatttcctgattcaacttgcaaaaacatgtgaaagtaatgagaaatactgttttctcttgctgttcacattcagtttcctggaaagccacttttgagagttgtgtttgctttcaagaggcctggcttagagatccagagggattcctttatcttgagtgccactgctaagtgagtcacatcctggtaggtaggagtcctgaagttttccccagcagaacttcccactggtctccctttcccatttcaacatggttcaggtgtgcccatttgttcatcaacacggactcttctcccttgccaaaaaatgatgagaataggatgggaaaactccacagatggtgcctgtgatcttcattagaagaagccgtataaatacagatatgaccaagaacactgatgcattttatatttttctaggtatttggacatgatattgttggtttcccaaaaccatgcttcagaaatttgttgctctttcttaaagatacagggaggttgaggtgaaaggaacccacagagaaatgaagaaataaggtcaacttaagaattagagagtatgttaatgaaggtaatttctccaaggctatcacgtggaataatcacatatatttttaaaactgagaaagccttgagaaattacaaacttgttttcagcaagttcaattgggcctctgttttagttgaagatttttccactttggtaaaaagacaggctctgtgtggccaaaattggatgtttaggtctcaatctttggttagccccaattcccacacagaatttctggactcagttactggacagaggatgggcaagattaatagagctcttcatctcagtcctttctctcggtttcttctgcttatttcctggaaaagcgatgaaaaatatgccacaggacagatcaccttaacattggatacagctcctttgccacttgataatattcaaaacctaataaaaccttaaaaattcatttctgtgtaaaatgcagacccttgatgagcatctgcccaagctgggacacatgcatcggtgtgtctgaggaaggatgaggtgctgtctgtagaagaaggtactccgagatcgcgccactgcactccagcctggcgacagagcgagactctgtctcaaaacaaaaacaaaacaaaacaaaacaaaagcctactctattttttgttttatgcttgacttttaaaaaaagaattaaatgattttctttctgtgttctttctttcgttgtcctcccattccctggctacctatcattttgtatagaccacttatgctttaagagaatctgaaagtcttctaatctagtgcttctcatcagtccagaatttcttcctgaagcctccattcctcttttttgaaaggaaagttaaggtttcatctcagctagctttatccctctccttgccttccatttttaatattgagcaatgttaaagaattttccattttaagcataagcatcttttctcacatatcaaatgctagcagacaatggtagaaggtgaagatggtgggtgagttgaattaactgttctctaatgccttttctagctctatcattgtcttatcctttggtttcatagtttaattacccagtgaacttggaaaaaaagtcttgctctaatccccttcatacttcttgttccaccttgttttatttgtggaacccctctttatagcagaactctttaccaacctcccctcttcagattcacccatgccttccattccctctgtaaaatcacctgatgtcccagcttgtcagttatgcttttcctctagcaagccagctcatgtttgatcctaccagtggagttgcatgcttaacaaaagtcagttctgaatctgtttatgctacttgtaactataattaggaaattcaattattatgtaaaccaacaaacatgagtgtgaaaaaaattatttttctatgaaaagtaaatggaatgctttggaatgacttgaaaaaaatgaagcctttcccttaccctccaaataaaacacagaaaaaacaacctactgcagaatttggaataggtgagataactgttaaaacagggaaaacatctagaaggatcaattagtttcaatcaattagtttcataaatatctttaagttccaaagctgaatggatgggtaatacttacagaaaagagttttgtaagaaaggcagcatgagacttagcaaacactgtctctaagaaggggtttagttgtatctcaaaatacagaggaatgaatgtttacttaaatgttttaagtcaaaataaaatatttaagatataagtatataatttttattaaatgcgctaactgattttgcaattaatcattcagctgttggtcacaaatatacaaatttctaataattccccatatttaagaagtaggaaagtatcataatggtatatgcaagaagaaaaaaaggagtattttgaacatggaattttattttgtctatttcaattttatttttattgagatggggtctcgctatgttgcccaggctggtcttgaactctgggctcaagtgatctgcctgcttcagccttccaaagtgctgggattacaggtgtgagccaccacacctgacctgttttgtctatttcattcaagcatacatgtattaaagcaactctgtgccagacagtggaagaataaacaatatatataatattttggtttatacctacttagaatgtttaatcattgttatcattacgtctccaccaactataaaaacgagtcagggtaattaacttgtttcacatcatagtaattagtgcagacagaattcaaacttagagcatgtgccatataaaatgaattttttggtcaaatcctttaacatttaccaaatgctttcccttacgctattcccttcacgcattgtccaaaagtaagccctaaagtgcttaattttcattcagtctcaagggcatagagttagaagatcaccagtgttaggagatcaatcacagccttcctgaagtccagataaactgaccttgacttttctttgtgctaagactagcttttgtccaaagctactgagttgaaaatttatcagatcacaactaatttgactagagaattctactggtgtatgcatcttcctaaaaaacaaaagaatacacttggtccagcaagtttatttttgcattatgcaatgcagccaatcccatactactgggcctgctttctgtatgcagaaccatgagtgacacagtgggtttccatttatggaaattcattaaaagaagcccacacaaagtctgaaataaccacttggtttgggagttccttttgtgatccctcgtcatgatctttgccacaaagaactatttgaggactacccagagttagctaaacttctggtcagttttaaaaccatgtcagtttacagttcgtcttagccaagaaaggaaacatccaggatatatactatggtgaatttactaaagatctctcggtactatgagttatgaaagttatcaaaaactgtcttcctgtgaaggtcagtttatttgattttttatttatattatacctcctctccccttttcctccattcctcaaataattcatttattcattcaacaagcacttattgaaacaattgctatgttctgagaatatgactaagtggagttgaataagttaatgtaagcatgcatccaaaaacccattctgatttaaaatactcacagatcactgcaaaacaattggaggcataaaaggggagaaagagcaagaaaagactcaatagagaaacaggttggaaattgtgaggggcactggtaatggagaatgagaggaaagaataggtatgacgtgttggctggttgcattgggagggggtggtgctaggaagcaatcgaagagcacatccatgaactctagccagtaggtatgtggtgttgccattaattactgacagcaggaagagccaataactatgaagaaagagaaggaatttggtttggaacatctatctgccttctatatgagactcaagtgatgatgtctggtagacaattaaaactatgtattgggaactcaggacagaaaagcagctgaagacacagctttcgtggttatgagcacataaattgctctagaagcagagagactggagtgacattacccaaagaaattgtgtacaagccaaaaaggacaaaagtgttaacccttgagacttataaatatttggtgagctaggatgaaaaagcaaaggattaaataaaagagatagcacagataattttaaaaagggtgctaagtgcatatacactatggaatactatgcagccataaaaaaggataagctcatgtcctttgcagggacatggatgaagctggaaaccatcattctcagcaaactatcacaaggacagaaaacaaaacaccccatgttctcactcataggtgggaattgaacaatgagattacttggacacagggcagggaacatcacacaccagggcctgtcgtggggtggggggagcagggagggatagcattaggagaaatacctaatgtaaatgatgagttgatgggtgcagcaaaccaacatggcgcatgtatacctatgtatcaaacctgcacgttgtgcacatgcaccctagaacttaaagtattaaaaaaagaaaagggtgttaaatgggtaagatctgaaaagtgcacagcttggcaatttggtcaataaattaacaaaagcactttcagcttggaaacctgcatttagaatatgcataccacaattccaaattgagctccaccactacttagtaaccatgatcccacccctacaataagaataagacttatttttacctacctcactgcaattgttatatttcaaatcaatgaagggacacaaacatggtaagaaataagggtcagactatcatgagacattattacacaaagtaattatacaggaggtaggaagtggaagacatttcaaatcagactcatttctggagacattttaaaggttcttgttctgtatgaagtaagacacctaaattgtgccctaagttcattatctactctgttcttgtctccagaaaaaaagcaccttggacatgttgataaaattagtttcagtatcttcccaattggcatcattttcttggtgtagaacaaatgattcaaggcagttccatgactttgtttagaaagctcagccagaaaataatttgtctccatatttcttaaatgcttagcatggtgtcttacacatggcaagtattcaatatatcttttttcaaatcattagacatattgattatctactgtgtatcattaggatcattggaattatacagatgcaaataaatattcaccatgtaaaggatacatttgcaaggacaagcacaaagcctgcagttttctcatctgtaaaatgatagtgatgaccgaatttgcctaaaggaagagattttttaaagcatctttcatctcacatggtgttttgtatgtactgttccatttgttcttaacttccattttaaaggtgaatgtgtgaaaagagcagacaattcatgggagaagtttatctactgctgccagttccccacctgagagtctaccactgcttaatagttttcacaatagccagttgtttggcctaggattatgtctctaggtaaggcaggaagggcaaatgaattaaatctgttcatctatacagacctgatttgcttctagcctttttcctaggcaaacaggggaaaagaagcacaaacaattatgatttattagatgagtcactgggccaaattccacacaattttgcttcccttgaggctgaagaattgtcttcaggtaaaatttaactttcagtgtaatttttgttcccttcagaagtttcctttagttgtctgaaggcttttaaattaattagcaatatcttgtttgtgtttggaatcaatcataaatgttaggttgaatttgcttatgatgttttttgcttcttcaggggaattttatagacaattaatatttgacagattaacaaatgaaggcaaaaaaacaaaaaacaaaaacaagaaaatctctgagaaaagagaacttgtaatgcaggcatatgcttaaaattttctgaagaagatatacggaaattgcacatattttggctcacagatcttaatatttcttcctttgggcttctgttagtcatcagatttgagaattagcatcaggtttgaaagccaattcaacagcagggatggccgaatttttcattgtaattatctcattcaggcccacctgacaagcacaagggtagcaccgctacctcagggtcttccagctacaatccctggcattctggcccagaactggaaggatgtttttgtatgttgatatttttgaacatcaatttttgaattatactttaagttctagggtacatgtgcacaacatgcaggtttgttgcatatgtataaatgtgccatgttggtgtgctgccctcgttaacttgtcatttacattaggtatatctcctaatgctatcccttccccctccccccaccccatgacaggcccccccgtgtgtgatgttcctcaccctgtgtccaagtttgaacatcaatatttaaattccattttatttctacagttgcttttctttgaagataatgcattgctcacattaccttatgaatccttttggttattaatgacctgtattgaagcccaatcaatatatgacaatggacagctagtgcaaattagatacgaaaagccatgtggtgatgaaatggaatagaaactagaagaaatggactaaaacagaattcaagctaaacctgtagatattgactgcatgtctatgatgtgcgaaacatcatattggaagccctgagtgatatggcaaaaaataatagcttagtatactctattattatatatggggctatatactcagccctttcttcacatgctattatcattccatcccctgcaaccatctctaatgagatatgattatccccattttacatataaagaaaccgaatctcaaagaagttgagtgacttttcaaaggtgtcagagctagcacacattcaagctgggatttaaatcctatcccgtctgaacctaagcctttaacaactgacttttccctctcggagcttgcagttatgaagaagattgacatataaatggtcaactgcaacacaaaactcaatatgatttactgtctatctatccatctacctaccttcctacctacctacctatttgaccatccgtctgtccacctacccacctattcatccatccatccatccacctatctactcatactggtgaataaatgcttctcccttcctctctcgtcctaaaatacagtactttacacaacctctctggtagttattcctatgagattgagtaatcagttgtaatttatactaagcagtagcttctcagtaatttgctcccttgaatttgttctccttccttttctatgttactcatcatacacttattcctgcatccccaggattgtactttctaaaaggtactaaaacagaaagttttttgttttatgttctgttacctagggaatctgggctcatgtccactaaggcaagagcatttaattgctaaagaaaagaattatggtaaacacctgaagctgaaggaggagctgaaaaaaggatgagaagtatactaaaatcacttcacccaaggatttgaccctcatgagcctcatcctgggcattcttaatccctgtggaaaactctgggttcagggtatccacagaggctttcctctgattaatgggtattttttactggactcagctaatagatatatactagtatagagcagaaaaatttctcagctgggtaacattagggaaagttacctaacttctctgaacctcaatttccttatctctgagatagagatactaatctctgcatcataggctttttgtgaaaattaagtgaaatatggtatgtaaggtccaaatacagtacctattctaaaaatgattagcgtctttctattttatggcttcctctttttggcttggcttaaatgggtaaaagttgtagatgaagataactgaacttctacaaacgaagggtcaactggaagcaatgaaaagcatgatccctgtttggttactgtcacataatagggtgtttgatttggagtctactggtgcctgttgaccttcccactctgcagcccagctaaccctttatgtaatctaaattttgaattttcgaagtttcagcagcagaagacagaagagatccttcttcatgaatccttctaacaatagctttgatgaagaaggagttgaagaatctaaaatcacagatttagtcttttggggtttgtaaatgttctttgcagttgcttaccctcaatgatcagatataactgggatttggctactgaataagtcaaggctggttgggtcttatgtcatgccaataaacaacttcaaccatctaactggcttaaaaacagcacaggtttatttctcagacatagtcaagtccctagttggtctgctgaagactcttaccattgtcctctgtccgggacctaggatgatatagcaaccaatacctgaaatattgctgatttgctgtcaaggaggaaaagggaaaaaacaaacaactttgggagggctgtatacatcaactattaagtgctctaatttgtaagtgacttacatcattttaactcatgagttactggccagaactattcacattctccccgaccccatcctcaccaggaggctaggatacacaatcccaccaagcttctggaaggcagaagaactgggaacaactggcaaagagcacaaacaagtacatcatcctcataaacattgctcatgctttctattggcatttattttagcacaatctagtttttttttcttttttttacattttttactggatattaaaagaagagacaggaaacagagcgtgggtgcagaggtctctgtctatcagcctggtgtattattcaagtgtagttgttaatggtcatgccaacctacccattatcatgcttattctgcctgaaggtttgacgtgtattccaaataatggtgtgcagttgtcaagtacttccttgtgaatacaaattcaaagaaaattccactcaatgcatctaaggagactgcaagtgaccataattatatctcttcagtaagtcctgaggggatgtcttgaacctggcttttaactaaatgggatatgaaaaatatgcacattcataacttctatgcatattggctaaagacaaggagaatgtgtctcagaatgagaaaatcttttttggcttaaaagaataatttttgactctaaaatatataagtcatactacctactatctaaaggtaggtaacatttcaaaagctgcttcatcttgtggtctcactgatttaaatagaatttcttatacatgaaccaatggggcagaataaactttgacaaaggcaacaaaatagaatattttaaaacattcctataatgttttttatagacaagtctgtttgatatttgcatgttttgagcgggaaataatgcacaattgtgtgtgtgtttaattcagatggcaaaatctttaaactgcatcagaccttccacatatgacctattctaacctctattttagagatgctggaagtaagacccatagaaatggtgtcacccattggagctcagagactaaatacaactgagaactttggaacctggcttttaactaagtgaaatatgaaaaatacacacattcataacttctatgcatgttggctaaagacaagaagaatgtgtctcagaatgagaaactcttgcctctcaccactgccattgcaaaagtattgtcaccatgacccacaactgaattgttaaattacattttttggtgatggtggtggtggtgaaattgatgcaaattgatggtcaggagaattttttaaggaatagagtgctgatattcatatttctaagaataaaagaaatcatttttttggaacaagaaagtagtattacatggcaagagaactgaggtttctggatcaaagaccagagaagaaaattggatttactaaaggcagccacaaagcttagatgagtcactgtcttgtcttgaatctaaattcatcttgacacctattttcctattttattggtgattattgaagaggctattatagaaaaggtccagtctgaattggagtagaaatcttaaagctattcattttatttttaaagaagatggcttcaaggaaattaaatattttaataggtattaagactataaatctagagaggtgaatttttttaaaaatcacaacaataaagaggtaaatcaaagccattatcagcacattactttttttggaagggctttaggaattacatttcatttcctcttgcatcctctatccatttatggtgtggctgattcaggtgcttctgagaaattggggtgaaaaaaactactcaagcacctcggaaattatgccaacttgtagatggaaagaaccattttagtgtgtctgtagactgttctagcctcagaacgttcatttagagaggccaggtaaatgtgagagagagtgggtaccactcagtttcttagctaatgtgttgtaacactattcttatcccttacaactgtctaaaaggattctttttttagactttctctgctagttaccccaaaatattctgtggtagtgagttccaaaaactaattacatgtcacataaaaacaccgtccttgtatctatttcaagttggccatacctcactctttcttctagcatagatagtttacggatgttcctaggatttccgattcactagttcctgctattgtgggttgctaagttttattttgatttttgttttcttttctaaacatggctgctactgctgttcatatttgcattttgtttaccagactatcgatatcagaattgtgctctgggggcggcttcacactcttctctcttggcttgtgaagtcatccatctctatggctccaaaaatcttctctaggctgttgagacacattttttaaaaaaatctccagcccaggcttctcctgcactctaaaatattttatatctaaatgcctacttgacatctctgagacatgttacaaacacataaaatttatcaaaccaaaaatgaacacttgatgtccaaacccaccatcatttgttctccactcagtagctgtgtatacctgtattctctactcagtagatagcacacagtcccaactggatgggaaggccagaaaactggtacagccaggcttagattgcactccaaatatcaatatatgaatctggtacatttttgttactggcttaagaatgggcttttgtgaaggtattgatatgaacctttatagtaggaatatataaatgtatttaaaatattggtcaggtgggtagggtgttatgtgtatcttttcaaagagatcaaagtcaacattagaagtgaactatctggcagtaagctaaattctgttggaacatccatggaaattgccagtggcagtaagctaaattctgttggaacatccatggaaattgccagtagacgatccaacaccctagcaaatctctttatagctcctttaactcaggaaacacaccttattgtcatgcattatggagatcttggggctacaaatgaacaagatgaaaatctgcgcttgcaaagagcccatactttgccacagaggtggtgctatcccttaggagaagttctaggaatctgtgggggcatttctctggtcataatgactgtatgctgctggacatcctgaacaataaagaataatcccacgtcccacacacattcatgtcctattgaccactgatataagaaatctaagtaaaaaaatctattatctgagtctagatcagaactccattttatatacacacacaaagtgctttttgcataattgttatacaaacttaatttttcaggaatttaacaagataaatttgatagaagattattaaaatttgttctgtttaaaactctagcaacatttgttcaccatttcagaaaatcatagcaccaaagccaatgctaaccatgtttttgagtcaccaatattacacgtgttccccagtctttattcctagtggtgtgtttatggcaattttacaaaaagatgtcagcatatcactacttctttaagtcttcaagtgaagcctattttattataaattactttctttttattacttctttataatatagttatgacagtatattgatttttaaaaattatatgtgtaggtaaaatatatgcactctgaatttcatttcaggagagcaaggaggttgtttcaaaggatttattgtaaaagtgcatgaaagaaatctgatataattgagaactactgccctacagggtaaaccatacaaatatcctgataattttggcatctctgctccattgtagcaacataaggagcagctagacatcatcagtcaaggctttaatgcaaacaaatttttgtaagatcactgtttcccttcaatatattccccagccttttttttttctttttcttttttggctgcaaaggagaaactcaaactaaaggaaatgctatcggttaatgagatgctagagaaaataatgctttttacaaaaagctttcacacaaatggaacatgccagcagtggggggctgacggttgccaagagcaaaacccagcaggcaagttagtggctaggagagcaaaaatacctgagtgtgtgtttagttccttttgatcagcactgccatagctctccttctagaactaaccggataaaccatctggtgcagaacgcttacttcctcaatcagtggaatttcacagctgtagtttcagcttaagtaaaatttgaaactagattgaaattagaaattgtgctggaggttgctaggtgacccgggccaggaacgttgctacggacagggatcaggactgttttggattgagggtatgtcagattttcctagaaacttcagagtattcattctcttaaaacaaaacaacaaaaaaacaaacaaacaaacaaaaaaaaacttaaccactagggggagggagaggaaaccaaaataacaataaaacaacaaaaagcccccaaaggcattattctacaggaaaacagacagaccagacatttttcctgagaaaaaaataaatctacccctccctgcccacttctccaccccaactcctagtatcataacattaattcagaacttagctttgagaagttcaatggatggttccgatactacttgatgggaagtttcagccatcagttaaaacctaagcctgagtgaagcagagcaggcctctgcttaactgcattaaggaacattccaggaaagcccatgtctatgacattagtactaatgacaacatcccatccctacctccttccctgcttgcctaccagcataccctttgcactcacaaaaagaatctagaattctattttgctacacaatcttgccttctctcacttctttggtccaagatgcctgattttaaatctccaacaatgaaacgtcatacccctcctccaggatgacggtagatggccatctctccctcctctgagtatcatcagcacttcgtttacataattcacttggatctagattgtcctaaagttagttatctgtgagcatcatgctaggagctagtgttgatatgaagcagaaactttatgtgggcatcttggatatatgcatatcattattatcattttatagaagacaaaactaaaactcaagaagtaacttggccacagtcatttctcaggtaagtggtggtactggtatttgatttttggtccacatgataacactgcactagcagcttcccttataaggtgctatatggcagaatcttttatattcccaagtcacccagtagtttctttctttgcaactctatatacacaattacttgcccaatatctgctttctccattagactatgggtccatggtgaaaggaatagtgtctatcttgcttttcacactgtcctgatgcctagtgccagtggaatgcccattataaagaaataaatatctgtggtgcttctagttcctacagtggcaccttggttttacaaaagggcatctggactctatgtgtaaatacaaagtgtccatttgcaatcattttcaaaataaagtaagtctcagaagctaaagaaaggggaagcaaaattcttcctatataaagtatttactgtgttcaagacatatacgaagtcttatcttctgataatgctgtatcatctaaaattagtattatctacatgtttgtctatcttcctgtacagaccacatataaaaatattttactatttaaatttatggatacttctaaatagaaacatatattatttagtggaaaccctgaaatttaactcattgctagtatgtttgttattaattaaatctttgacaaaataaaaagggctaggaagaataaaaatgtccccatattaacggcagcattatttatactagcccaaaactaggatgattaaatcaattgtggtgtgtccatacaatggaataccatacagcaatgacaacggacaaattattctatatcctacagtagagatgaatctcacaacagaactttcagtgaaagaagtcaaatgcaaaaaattgaataagttccatttataggaagttcaaatacaagcaaaattcatctatgttgttcaaatcagaatactgattgttctggccatagacacagtagtgatggaagctcttgaggtgccgataatatatttcttgatctgtgtgctagctcacaagtgctcacttagaaaaactgcattaggcacttaccacttgcacaattctctatgtgttatattttaataaaggtttacttttttaaaagcactccatagtatctctagcgatgaagttatacacacacacacatacatacatatatattttaacatacttatgggtagattcctatccaacttacctgttctttagtgtctttactatttatttacttatttatgtttctgtatcctaggaactaagtagaagactacctagccttctattcattatttgtgggttggaggttgaagttcaaacatttactcaaacacatccaaaacacatatgtggcttaaatatggcttttcctagccttgcataaatgtctgattcatatcttgatgtactctacactctagtgtcatagagaaaataagtcattggtcatagaaaaacctacatgcaaatcttattaacttgatcaaaacctaagcttaaaaaaaaagctaagtcacagagattcctttcttttccaaataacattttaaacacaatttttagccctatttagtgaacttcaattctttagatatgttttagaacataacatactgccaatattctccacagtatattgaagttgagaagtgaaataattttaacaataaaattttattaaaacattacacagttaagaagtgtgtgtgtgagagatcttttctcctaattattcaaaatttcacataatatttacattagaaaaatctatcatgtcatattctaattataatggttttaagaagactaacgtcttcttccaacttactctgaatctaagggaccacttctttgccactaataataaaagttcaagttcattaagcaaagatagtatggactacatgagggcgttaatattctgagatgaagacagaaggttaatgactaaaactttcaaacaagtttctctctctctctctctctccctctctctcgctgtctgtctctctcttgctgtcttccataaagtcagcaggaactttgcagcgtaaaaggacaccctaggggaagcatggcataacttgaaagcggtttcctgctccagcctaaccccaagcctctcctgggagggagcgagtggagccttctccccgccggtccgctgggaggttgggagaccaggtggcagcagcctccccaggcgccgggcacccgtcggctggcccagggacttaccacgagcgcgcagcacagcaagttgttcattgtggtccccggaaacctcaggggcttggaggcggcggctgggcgagcgctccggtgcgtctccgcagcccgtgcgctcatcacgttatatatagcgtcccggcaacaggaagtatcgcctgcctttgatcagtcatttttctatcctggaccaaactttgcacctttcttttttaggaagcttgggcgggagcggtcggggggtgtgcagaaagctccagggttaacgctttcagggctggggcggaaaggatcccccagggaggtggggcgtgaggggtggggcggtggtgtctggcccctgggagagcaggggaaaaaaa

SEQ ID NO: 2103 - DNA, 33005 bp, Homo sapiens
  source 1..33005: mol_type = genomic DNA
tgaggaagggcagctgccaaaggttttattctccaggaggaggggctctcgggggctgtgagcagcaggcacgaggactttattgcacgtgtggttaggtgatgacgacctacagctgcactgggaactgggactcagagtgccccgacctcctgctctatctctctctgtccctctctccctctctgtctctctgcctctctccctctctgcctctctccctctctgcctctctccttctctgcctgtctctttccttctctgcctctttccctctctgcctctcttcccctctgtctctctctccctctgtctctctctccctctctgtctcctctgtttctctccctctctgcctcctctgtctctctctcctcatatctctctcccctctccccacctctctttctctctcccctcctctccatctctctccctcctcctttccctccctgacccccatttatgcacctgggcccccctcctgggcaggcacacacacaatgccaaggccactgtctgggatgtgtgggcaaggctgcaggactgtggtcctggtgtggcacccccaccttccagcacaagtggggtcgggggtcccaggcgtgactgcgctctcctgcgtgggcgccctgcactcagggaagcagaagctgcaggtctccactggctcgggggatgtgctcacagggctgccggcttccatcgcgtgatctgcagaggcgagagtggagggcgtgggccaggcctggccctgcactagggtaggggtgacggtgtgggcagccgcactctcccccgacccaggagctaagggcaatcaccagcgtagaacgcccccagacaggtgtcagtgtccgccagttgctgaccagaacctgtgccggggcaggggtgggcaggcaattcttggctctcacttctgtccagcaccgagcctgccacgccccccaaggggacacctcctcctgggcttagccctgaaggctctgcatctggagaatcctgggcccaggcaaacctgaagaccggcaccccacacccacccttcccgggtgccactctcccagttatctgtctgccaggatgtcttaacctgattttatcaaggtatagcaagtaacagggatgagccctgggcctctccacctagaagcaggggcagtgacaggaccgagggatggcccgaggcttgtcacccaagcagcgagaagggcgaggaccccagtttcatgcactcaccctgggaagacttggccggactttgacggggccttgagcggggctggcaggagcagggatcccccctcttcttgaggaagcaggccaccgccaccaggaagcagcagaggacggcacacaggcagagccccagcgtgctgtagaccagggccacctgatctgcactcagcttcagccccgggagagctgcaagacagcatgagacccctctctgcagtgccttcttctcttcccgtcattaggctcaagcaatccacatccccccatccccctgctgtgagcctgtctggctcctggagaggctgggctccttttctgaccctgaggctgctgggatgctctctggatcctggaggaagttgatccactcccccatcctggcagcaactttctaaggcctcaaagctggaaacgtgagctaggccttcttgttgtctccacttgctagggctgtaattgggacagcgctggagatgggctgatgggtgaatcgacagacgaacagacgatgctccagggagcatgtctctgtgcatcctgaactgggcccttcctccaaggagaaagcttcctgagtgagcgtttacagtcgtcccttggtatccatgggggactggttccaggatcccctacagataccaaaatccgcggatgtccaagtgcctgatacaagacggcctggcatttgcatataacctatgcacatcctcctatacaattagagtcatctctagattacttataataccaaatacaatatagatgccatgtagaagggtgttatactgtattgtttagggataacaatgagaaaaaatggctgcagaggttcagtacagatgcaactatcccctatcttttctgagtattttccagctgctgttggttgaatccacagacatgggtcgcacgacacagagggcccactgtgtttgagagtaggacaggcgacgttacactgagaccaggacagcaggtgccaaccaggagggctttgggcatcagggcacctggccaccctatgactcaggacttgtgcctccaggtttggatgccagagacagactcagcccaggtgaaagccctccccttggaagttctccttatcccaaaagctcttccttgtccctggagctgggcatcctctaggcgctgggtggaaagacagatgagccagatttaagatgacacgtcaagaagagcgagtcccacttcgtgccgggcacttcccctacagcacccccttcatcttcccgctctgatggcagacaactacccccattaaaaatactgagaatttgtataccatcaaatttgctgtattaaagtgtacaaccagtggcttttagcacatcacaaggttgtgcagcaatggcaactgtctaattggagacaatttttatcaccaaacagaaaccctgtctcatcagcagtcactccccattccctcttcccagcccctggcaactgttcatctcttttctgtctctgtggatttgcctattccagacatttcatattaatgaaatcatacaacacgtggtcttttatgcctggctccttgcacttggctttgagttttcaaggtccaccatgtcctgccgtgctgtgtattagaccttcgtttctctttaggcggaatggacagaccacatctgtttacgcattcaacagggaatgggcatttgggttgcttccactttctggctattgtgaatgacgttgctgtgaacattcacatccacatgtttgtgtggatggatgttttccattttcttgggtgtatacctaggagaagaatggctgggtcacataatagctctgttttgttttttgaggacctgctggactgcgttgcacagcatctgccgttcacactccattttacagatgacaaaactgagtgtctaagatattgttctcggtcttagacctgcacccgggagccggtctcaccaattcccaggccggtgctccaagcccgcgggccacacagcggccccagggctggcactgcccgtcttcctcacacacgcttttagattcaggaatctcataaagtgacagagctgccaggactcttaggggtcatcagtgtcactctgacatttacaggggggagatgggaacttggggtgagttcgtgtcactccgccagtcagtggctgtccttctgtccagtgcccagagctcagagaggcctaacggaggaaagcaaagaccccaggacctgcaaacttggtgccacatatccaaggcttacctgctcctattcacctctcaaatcaaatgcaaacactgccctggaggcatgagcaggggagacgctaccagccctcagagcacagacagaatgccaggctacaggttgttactaagcggaaatgaacggcgttgattcaaggaggaaaactaaacatttgtgcatatttcaaacatttcatcataagattctgaaacccagctttcagagaccatgcaagtgttcagagaccacacccagagcacagtcacctgacatcatgccctgtggaccttctgggctggactgggcctcatcctatccaggagagtgccatgggggcgaggttgtgccactccaggcctctgcctcaagaaggcctgacagcctcggtgtttgctcccttgggcctgagctaccactcgagaagtccaactggagagtcccagtggagaggggcaagccctgagatcagctggaggggaagcaaggcctgaatatcccagcatcagagtcaagcctccaatggctctatccccagcaccatctgcatgacagaccccaagcaagagcagcagaagacccgcctagctgaaccctgcctccccacagagccacgcagggtcacaacatgaagatgaggatctggtgccaagtgtccagatccagtgacaagtgtccttatacaagaagagaagggaagagacacaggcacgagagagaagccatgtgaagacagaggcagagatgggagtgatgcagccacaagcccaggaggcctagttctgaccttattcccagaaggggtcacgggcacccccagtgtctgcaggacacagaggctgagcagttccatggctgatcacatgccagcacctctccctccagttctaatctcatgccaatgcactgtccttctgtccccctcccaggtctctggttcctattattgccagaagtagcctctcacagggcccctgctgctatcgccaccatccaggggcaacagagagctctccccacagccctgctctgacccccttctcccatggctgcccctgcccccagcaggacatcagcctcccagcctggcacatagggccctctgtcatctggcatctggtccctcctagtgccatctccagctgcccctgaatccttgctcttcccaactcagtcctctgcaacccccatgttgggggacagggtcctgcccttggtgcttttcctcgtcttctgccggacagatgagcagccccacccagtagggcaggctgcctgggccacctgttcccctcagggagacacacacactccctgcacctgccccggagcccgggcaggaagctcctcgcgtcggcctggagtcgtcgcagtagaaccccacgccagtctcctctcctgctcaacatctcaagccattttcagtccagcttgggagcctgccctcctctccccaccaagcgccatgtgtgagcagcagggctttctgtgctctcttggtgagcatgtggagcggtcagtctctaccttcaaagcagatctggggtggggtccctcctgcttctgtggagtggccaccacactcctgcaggctgggagcccgagaggaagggatttatcccagcctccagcacagagcccctcacagcctcccaacggcacagttctctgctcctagcagcacctgtacatgctgttgcctctgtctggaaccctgtctccaccgtgtggcttcaacatagttgctttttgaatgagcagttccagcgcacagagcacatgctcccccaaaaacatattctcccaaatcaccctcacagcagctctatgaaggcgaacaactccagcctcacagaactaaggctcagagagggtcggtagcttgctccaggtcacacagcttgtgagggacataactaggggtctggctccacactccacacccgcaccccagcctgccctaaagactcctcctcggggaagccttccttgtccccgtgtcacctgcagctgggttacgtggctcccgtgcactgagaggaatttgtcatctgcgtggcttgtccactgcctggccttccacgagacagtgagctccatgggtctgggacaggaactgcctcattctccccactccccatgcacagcaagcctgccacagttccaggtcccactaaggagtggcagttctgaatgggatgcaagagaaacctggagtcagggtgaggtgggacctggcagggctggagacagggaacggcagaattcagggagcccacggaagggggcagagaacaggtgagcccttccaccgtgtgcagctggacaacttggtcacatggtgtcctctgctctctgcccttgaataggtccacctctgggtccctcccctggccatgtggctctgtacttcctgtttgcaatccacagcaagctcccctcctgccccaccagcccatgcaggcatcagaagtcagaacagaacagaccttaaccctgggcccctggagaaataaagggcagggtagggcagtgcacagcgacagtcacagagccaccaaaagccgcgccatggcacaagtgtggcagctgatgtagggtgaggcatggtaatgccgaccccactggcaccaacacatcctcacacagcccccaatgctcacagccttgggctccatccctggagccaagatgaggctccaaggttctgcccagtgccctctggcaagggggcttggctgatggtcacacacatgaagtggctaaccttgtcccaggggcaacagttcaccgccaaggagcaatagcctgcagacgccactctgggtcattttgctgttgcagaggggacaaactttggaacccccagactgtgctcaaatcccagctcactcacgcattccctgtgtgactgtcagcaagtcactccaaatttgagactcactctctagatctgtgaggtggctaggaatgacccacgggggaatctgttgcatcagaggtgggcaatgttccaggtttgcaggaagtttcaaatgcatcactggatgcagggaaggtgcgcaggtggccagacaccagggcggcaggcatggcccctcgcatctgtggctgggctcttcagcccctctgtatccacaccccctccatgtgaatctgcacttcttcccctcaggagaggctgtgctagattaaaaatggccttgaattcaccatggctacaggtttcccccctcccccagcttgctccttccaccaagaggtggcgtctgtttcccctcccctgaatccgctggcactgtgaatggaaagaaatgcagcggtggtgatgaagtgtaagttaccagcctaggtggcgagaggactgcgtgctactgtctgctgcactcctgtatcgtcatgagatggacgcacctggccagcccacttgtcccaggaggaggatgagaggcacatggagcagagccagcctggcacagctgagcccagccaaacccctgactcgggagaaagcacacacctccgcatttggggatggcttgttaggcagcagcagctaactgacaggagagcaggagatgccaggctaagcagggacaacagggtgctgggcaacctccatcatcaggcacacaggccctgcccatgggaccttagccctgggacctggcctcatggaaatgatgttatcacaggaaagtcactgcaaaggaaaggaaccaatcagccccaagaagagcaggacaggccgagagcagggcagatgccatcgctagtatttatggatccacacggcatccctcttctgtcctttctgatgccacagagcagggcaggtgcaaaaagaggtgtttgctgggatagggttaattagatcatttctgatgcctggcacttaccagatgcccagctcaacaggacccttcttgccatgtccaaagtggccatctccagccataagttttttcattttctttacttattttttattatttttatttttatttttatttatttatttatttatttttttttgagacacagtctcactgtgtccctcaggctggagtacaaaggcacgatcttggctcactgcaaccttcacctcttgggttcaaacaattctcctgcctcagcctcccaagtagctgggactacaggtgtgcaccaccagatccagctaatttttgtatttttggtagagatggggtttccccttgttgatccggctgatcttgaactccgaaccacaagtgatccgcctgcctctgcctcccaaagtgctaggattacaggcatgagtcaccatgctgagccttctctttttacaattttttttccctctggcagttgttaatgaactacttaaacattttaagtgatacctttcccttctctttcttaggaagcctcttttgcctctaaatggaatctgatgaattcacagccagattctagcagatgcacaaagaagagctggtaccaattctactgcaactattccaaaaaatcaaggagggtctcctttaactcattctggaaagccagcttcactctggtaccaaaacctggcaaagacacaacaacaaaaaaaagaaaaccacaggccgatatccctgaggaacatagatgcaagatggattacagatttaaatgtaagaccctaaactataagaatcctagagaaatcctggaaaataccatcctggacattggccctgggaaagaatttatgactaagtcctcaaaagcaattgcaacaaaaacaaaaattgacaagtgggatctaattaaatgaaagagcttctgcactgcaaaataaactatcagtgtaaacaggcaacctacagaatgggagaaaatgtttgcaaactatgcacccaacaaaggtctaatatccataatctatgaggaagttaaacaattcaaaaagcaaacaacaaataaccccactaaaaagtaggcaaaagacatgaacagacacttttcaaaagaagacatgcaagcagccaacaaacatgacaaaatgctcaacatcactgatcatcagagaaatgcaaatcaaaaccacaatgagggaccatttcacaccagtaagaatggctattgttagaaagtaaaaaaacaacagatgctggtgaggctacagagaaaagggaacgcttatacgctgttggtggaatgtaaattagttcagccactgtagaaagcagtttggagattcctcagaggacttaaaacagagttaccgttcagcacagcaatcccattactgggtatatatccaaaggaaaataaaccgttctaccaaaaagatacatacacacgtatgttcatcacagcacaattcacaatagcaaagacatggaatcaatctgggtgcccatcgatggttggataaagaaaatgtggtaaatatacacaatgaaatactacacagccataaaaagaaaaatacgttttttgcagcaacatggatgcaactggaggccattatcctaagtgaattaatgcagaaacagaaaataccacatgttctcacttataagtgaaatgctaagtgtcgaatacagatggacataaagacaggaacaacagacactggggcctactagaagggggaggcagagagagagggcaagggctgaaaaactacctattgggtgctatgctcaccacctgggtgacaagaccatttgtacctcaaaccttagcatcaagcaacatacccatgtaacaaaccctacacatgtacccccggatctaaaaaaaaaagttgaaattataaataaaataataatagaaataaatggagtctgcagcactggtggagggcaggtggtggctgctgctcaggtgctcacacaggtgggtctgctgcttacttgtgcctgtgcttcaatgactggcacagcctcggcagcctctagtgcaaggctcttcctcacacggcaggtcctttctcctgctttcttcttgtccacagacttctggaaatgttgcctacattgttttttttatcctgggatgatctccctggcttctggccatttgcttggactctgggcttcatgcattgtggactctcctgttctaggcctggcatcaggcctcccacgctttctcaccctgcgtgacaccatgcaggtttgccttgggtggcttacctggacttgcttctgagcctctgtgctccaatccttggtaccttcccgagttgtctgaattgttttcaacttctccactccgctgtctcctgagctctggtggaaggttcactgggctcctgagcttgttctcacagaagtatgcacattgcttagggtgctgtccacagatggaggcacagctgatgcagtccctcaggagatggtcatagaacttgccttgctccttgcggcagctgagtgaccctgggagagagaaattcatgatactgctgggtgacacagactagcaggaactctgggtttgaccacaaaggacatcaaagttaaaaaaaaaaatacagtaaaattccagaaggcaattccagagtaagccaagtacttttacaatatacacattgaagactatgcattgtcctctaagtactattttagctgcattgcattttgatgtgtagtatttttcctctacctagatcaaaatgcacttatttttcattattatcttttctttgacctatgggttatttacaagtgcatttcttagtttccaaacgtatgaagattttcagttatcatttaaaatttagatctggattacattgttacataagacttttacttgcatttttcaagcctcatcaaggagaaatatatttcaaatcagcataaggaaagaaggggaaaagccagaatcctctttgacaagctgggggagggggctggaaggaaggtggaaaagttcacatgaatagtgtttcttctgtcttaatactagatgagaattacagcagcttacacaagtatcagtgccaaggcacagaagccaaggaaactaaagccaaatcacacttgccttaagagagcacagtggacccaactttgaatgcataaagaaacctatttggaacaatcaattatcttatctaaagtctcagaatatttctaattttttttttttttttgagaaggagtttcgctcctgtcacccaggctggagtgcaatggcacgatctcggctcactgcaacctctgcctcccaggttcaagcaattctcctgcctcagcctcccgagtagctgggattacaggcgaccaccacaacacccggctaatttttgtatttttagtagagatggactttcgccgtgttggccaggctggtcgtgaactcctgacctcaggtgatctgcctgcctcggcctcccaaagtgctgggattacaggtggcatgaaccaccgcatctggtctagcctccgaatatttctacatggaagtttttacgtgaaaaaggcaagtttcctttgtatttagagtaaggtatggcttttgagatgtcctgacttcgtaaatatgaataaataaataaataaatatgtataaataaaatatatgtggctcacacatatattttaaggacacattttggagacagtgcaggatagtggataagaacccaaatttcagaaccaaatttcagttggggccatccctggctgtaccacttgcaggcagtgtggtcttagcctctccgtgcctcagtttcctcatttccaacatagggaaaataacagtactgacttcttcgtagggttgttggcagagttgtagggcccagcacagtgcctggcacatactaaatgctcacgtaatggaaagcttaagtagaatattcatttgagcctcttcacaaagcaaacagatccgttcttgtgtctttgacagagtaaaggaaggaactaaaagatcacggaattgggaccttagggaaaactcagatggcccacatagggccagtgacctcccctgctctggccctgccctatccccagggcgcccctgaaccgcacagaaactgacacctccactctgcatcacacagggttagcccagcattggtgtccttggggctttctgtgacctcctcccctgttgcaggtggtgctgttgcaggtggtgcctgagtgccccagcccactgaccctccctgcctgacctcacacccctccctgcctgacctcacacccctcccctcccccgcctgggactcagtcctccccactgtgtttccctcctctgagcctctgctcatagtgccctttcttccaggtgcccatctgatttccgcattctgtgacctcttaacaatctgcctctgatggtgcttcctctagggacacctccctgctccccagccctttagctgaagggggtctctcccaactgtggctttctaccttgacacatagtcatttctcccattagatgacactgtctttgaagggccacggcagattcctatttccatggggctggagcactccatctatgtttgtgggatgaaccaatgaatgttctaattcattaatgggtagtggttcaggtcatgatttaggagtcggagtcctgggttcaaaccaggatgtcgctgtgacatctccacttttaaactgggtgatcttgggtgagtcactcagcctctctgagttccccgcaataagtattcatgaaggacttactatgtgtcaggcactgtgctaggctcaagtcagacatggttcccctgccagggagctcccagtctagtggttgagtcagacataaaacacatacacatgaaagaacaaaacagcaaattgtggtaagttctatcaaggaaaagaacaggttatgaaaaagaacagcaagcaacgaataattttcaagacaatcagggaaaactggatattgcctgagtattagatgatgttaataaattattgctggcagtgataggatatttggattatgtttcacaggttttcgtggtccagtatctgcaggtaaaattatatgagatcttggctgtgctttaaaatacacaaggcaggctgggtgcagtggctcacgcctgtaatcccagcactttgggaggccgaggtgggtggatcacctaaggtcaggagttcaagaccagcctgaccaacatggagaaaccccatctctactaaaaatacaaaattagccgggtgtggtggcacatgcctgtaatcccagctactcgggaggctgaggagggagaatcacttgaacccgggcggtggaggttgcggtgagccaagatcgcaccattgcactccagcctgagcaacaagagcgaaacttcatctcaaaaaataaaaataaaaataaaaaataaaataaataaaataaaatacacaagtcaaaaaaattggttgggaaagtacaaggcagaatttaaacaatttgtgaagctggtgatgggtgcagagggcgtcattgtgctgtcctctctatgtacatgtgtgataagttctgtaataaaaagtttcaaaagaatgtaacaacacacagtgacaagggagggcctagttctactgggtggtcagaggagacccctgacgtttgggctgagacctgaaggttgagtaggagggagctgagggaagatgatagagggaatgcattccaggcagcgggaatagcatgtgcaaaggaactgaggcaggaaagaatggactgtgtttgagacaccgaaaggaggttgtgtgaccaaagcagaaaggtggaggggtaagaggtgccacactgtacatctcctcctgccaccctttcctcagccacctgactgtggggccagagggtgctctagggagaaaggaggagggtgatcacactgtcccctcggctcaggccccagaactcactgcagaaggctgcacaggtgcgctggctctgatggttgcaaatggttttgcaggacatgcaggtacccagcagaggatcccagtactgctcttcggggcaggatctcatagccacccccgtccacaggccctgtggaactgagagaccaggagagtgagggcagctggcaggcggccacagcccggcctcttgtccctgatgggaaccaagacggcctctcctgcccacattcgcacagacaacctttctgtctgaggagcagagagggcagacaaagttggcttctagcccccactgcacttgctaggggcctggggcagccacctcccctctccagcctcagtttccccatctgcacatggttgttttcaggccccctgctctctcacatcagcagtgccctactgggccctgttccctgccctccttaacgtgccacgcctctccctgccacagggtctttgcacctgctgttccctcacatgacgtgcccttctccccagcccctgcccctcagctgtttattccttctcagactgagacctctgtctaaacctgatctccaagggaagcctttctgactcaccccctagactaggacacggtccttcttctacacactcgcactgccctttacctgttgctgtggtcactttccttctatgcatgtggttatttgatgctggctcctacactaactgtgagcaccatctggcagggactgtgcctaatttttcttattaattgctgagtcctcagaacctagatagtacttaggacacagcacctgctcattaagtgaatggtttctttaagtacggaccaactcagtgcctagcacacagcaagaaccaagaatgtcaatttccttcttgttttcttttttactaaagtatgaaacaaccacaatgatgtgtgtaaagtgcacaaaaagctgaagaatacagcttggtgaaatttgatgtatgtatgcacctgtgtcattacagcccacatggagatgtaggacatttcctcacccctgaagcctccctggggtcccccgacacccaatgcccatgcctagagggagctactgttctgttgttaccctcataggctaatattgccccttctggtacttccgtgtctggttttgttcctccacttggtgcctgagactcatccatgtgggcgctctctgcatgtctggttttgtgttactgtgaatcttccactgtgtgcatgcatcaccttctccatcctcttctgatttcatgacatttgcttcccccaataacttctccttaaaaatgcttaaaagcattttgcaaggcatatgtttgttcttttttttttcttagatggagtctttctctgttgcccaggctggagtgcagtgggtgtgatcttggctcacagcaacctccacctcccgggttcaagcagttctcctgcagcctcccaagtagctgggattacaagtgcatgctaccatgtctggctaatttttgtatttttagtagagagcgggtttcactatgttggccagtctggtctcaaactcctgacctcgtgatccgcccgagtcggcctcccaaagtgctgggattataggcatgagccaccacgcccagtggcatgtgtttgttctttaacgaaagcaagctgagggaagaccagaggtggctgggcaccatggctcatgcctgtaatccgagcattttgggaggtagaggtgggaggatttcttgaggccaggagttcaagatcagcctgagaaacatagtgagatcctgtctctacaaaaggatttttaaaattagccacgtgctgtagtcccagctattcaggaggctgagacaggaggatcgcttgagcctgagagttcaaggctgaggtgagctatgaccacatcactgcactccagcctggataacagagtgagacccagtctctaaaaaaggaaaagaaaaaagaccaggggcctctcatttaacacggcagcttaaacacaggggtttatcttccttccctcctgaaaccatgcaaagctgacagtcaagtccatctatcttcagagatcaagggaatggcagaggtttctacagcaaagaacacatgtctctaacattctgggagatggaggaaccagagtgcctgactgcctttgagaatctctcatcattgatgcctacatgggaaggaagttgttctgagtcacagaactcaaggaagtctccagatttggaggcaccacgtatctctgacggcagggctgggcagaaggggtgaagctctgtaagaggattggttggaaacttacataaagagggtgtgaccccagcacatccccattccaaggcaggtgccagtccctcacccacccaggcataagagtggggtctccttggacacagctgagggtagcaacgtggtccttcctggcaacaggggaattgtgataatcttcctcctggacagccagtctcccctctccttacccaccccagtttctatctaaggagtgtggcaaccaggtttttaaagatgcctccctccctaccctgcaactggcaggaaatcagaagtctctgctctgggaaaacagacccaaaggaaaagacccagaggcactgacagcgggagattctctccagaaaatgtccaagtccctgcctgatcccactggggcaaagcttctacgtcagtgagcccaactgcttacccagaacttccaggcagctgtcagtgcctcagtctgacttgtgaaccaatggccaagggtcacctgatatgggagcactgcctctagcaggaaagcaaactcaaaccaaacagaaggcagacacctggtgccaacgaagacacgcgggaaacagaagagcattttaaaacaagagcagcaacagttgagatccccagaaatataagagaggattgtgtatctaagaaacaaaacagcagactattgtaaaggacgttcgtagaacaaatgagaattgttagaattataatttatagccagaataaaaacatcagtagaagggctggaagatgtaatcgaataaattgtctagaaaataagagacaaaagataggagattatggaatcatttcaggagctccgaaggttgactaatgattggaaggacattggctccagactgaaggagtcaatcaagtatcagtgcaatacagtctcacaaactagggtacatcatcatatttacgaagtcaagacatctcaaaagcaatcctgggatgtgaggagtgacatggaggaaagcagtaaagtggcaagctctgggaatctgtgcctcctgctaaatgactacggagctgccagccactgtctgaagtcactatttgggaactgtggagttgtccaggggagagcttgatggtaaattttaggaatttcagcctatcacatggtagtggctacttactattccatggcagtgccacttggctagagccaggataagcaagaaggacccttgtccgccaaatattgaggttgtgggttctgattgctgatggctacctgtgaccactgaggggccggcacaaaggacattgtttcaaccctcaagggctgaagtggcttccacgggatttaaagagacagtatccttctctggtctgggagccaagcacttaaggaaatctttgttgggtcactggttgactgcagagataaaagaacagaaacttcagtgactacacacaacaaggaatacatactgtgcaaaaatacaaattaaatttggaaaaatacatagcttaaaactaaaagcttggaaaagtcacaaacagatggcttcagcccttaacaggcaagtttcagcaatccttgaggagtggtaaggttagatttccagtcaccacaacgtaacactcaaaatgtccaggtctcaaaaaaatattacaaagcatacaaagcagcagttttgccacatttacaggaaatacagactatgacagaaaccatttccagggacgtctatatattgggattactagtcaaaggtgtgaaatcaagatttgtgttaggcatgttcaatgagcttaaggaaaccgacagagaactaaaggaagtcaggaaaatgttgtgtgaacacaatgagcacatggtaaagagaaagaagtggtaaaaaaaggaaccaaaacttggaagcaaccaaaatgtccttcagtaggtaaatgtataaataaagtgtggtatattcaaacaatggactgttattcaatactgaaaaatgagccatcaaggcattaacagacatgcagtaacctcaaatgcatattactaagtgagagaaacaaagctaaaaagtctactgtatgatttcaactccatgacattctggaaaagtcaaaaactatggagacaatacaaaaatcagtgattcccaggggttggaggatgggagggatgagtaggtggagcacagaggatttttagggcagtgaagctactctgcaagatactccgatggtggacacatgtccgcatacatttgttcaaagccatgtacaacactgagagtgaaccctaatgtaaacgtcggactttaaatgataacgacgtgtcagtgtaggttcactgattgtaacaaatgcaccatctggtttaggatgttgctagttgaggaggctgtgcggggggatgtggacagggatgtgggaactctctgtacttttgctgaatttttctgtgagcctaaaaatgctctaaaagtagtcttttttttttttttaaagaaccatacagaagttctggaatgaaaaagttcaaaaagtgaaatacgaaccttaatggaagggaactatcgcaaatttaagcaagcagaagaggcaattggcaaacttaaaacaattgaaataatagtctgtgtagcaaaaatgaaaaaagattgaggaaaattgaacagagccaaatgtactaatgtatgctcatagaagttacagaaggagaagggacaaaatggcagaaaaagtatttgaaggaataatggccccaaatttcccaaatctgagaagacgtgaatatactcattcaggagtctcaataaatttgatgcaggaaaacctcaaagaagcccacaccaggacatattacaataaaatcaaggaaacccaaggccagagagaattgtgaaagcagcaagagagaagcaacttcttgtgtacaaaggatcatcaatacggtaacagctgatttctcctaagaaaccatggcagccagaaggtagtgaaatgatatatttaaagtcctcaaagaaaacagtaagctgtcaaccaggaattgtatataattttaaatcacctttcaataatgaaggagaaattatgacttttccagataaacaaaatctgagcagtgcattatcagtaaacttgccctacaagaaatcctaaagtgagtctttcatgctgaaataaaagtactctagacggtaccttgaagacataagaaaaagtgaagtaaatataaaggtaactaaataagtaactataaaagccagaattattttacattttgcatggtttgtaactcctattttttttctatatgatttaataggcaatgagttaaacagtgattgcaaacctatgttagtggtcatagagtgtacaaagatgcagtatgtgataatcacaatataaagggaaaggcagggacatacaggagcaaagctcttatgacctaccgaaactaagttgatattattcaaactaggacgtcataagtttaagatattaattgtaatccccaagaaaataactaaaatatgtatagaaaaagaaagaaaaagggactcaaagtggcccactacaaaaaaaatgaacaaaatacaaaaatgaagtaattgaagaaacaaaaacatgtaagacatacataaaacaaatatataaatggctgaagtaaatctttatcagtgatcatattaaatgtaaatgaactaaactctgctagtaaaaaaaaaaattggcagattggatttaaaaacccacaggcttcatgtatattcagtgtataagagacttactttagattaaaaaaaaatacaaagccagaattattttactttttgcgtggtttgtaactccaattttttcctatatgatttaataggcaatgagtaaaatagtggtaaaatagaagttgaaagtaaaagaatggaaaaggtattttatgcaaatagaaagcaaaagagagctggggcagctatactgttgtcagacaaagcagactttaaatcacaaaaaaattacaaaagacaaagaaggacaatatatattaataaaggggatacagcataaagatgtaacaattataaatgtatacacacctaatgacagggttccaaaatatatgaaacaaaaattgacagagttgaagggagtaatagatagtcctacactaatattgggatatttcagtacctcactttcaataataagacagaactaccagacacataaataagaaaatagaggacatcaagaacactataaaccaattagacatcacagacatatagacaacgctcaatgcaacaacagcagaatacacattcttttcaagtgcacatggaacattctccaggatagaccttatgttcagccacaaaacaaggctaaactttaaaattttttaattttttaaaattaaaattattcaaagtttcttttctgatcatagtggtataaaactacagatcaataacagaaggaaaattggaaaattcacaaatatgtgtaaattaaacaacacgctcttcaacaacaaattggtcgaagaagaaatgacaggggaaattataaaatatcttgagacaaatgaaaatgaaaatacaacataccaaaagttatgaaatacaacaaaagcaatgcaaagagggaaattcatgtaaatacatacactgaaaaagaagaatcataacctgatcataactaaatcataacctaattatataccttgaggaaataaaaatagaacaaaccaaatccaaaaatagcagaaggaaagaaataatgaatactagagcagagatcaataacacagagaatgaaaaaacaatagagaaaatcaacaaaaccaaaagctcctctttgaaaagatcaacaaaattgacaaacctttaggtagactgactatgaaaaagagagatgactcatattattaaaatcagaaatgacattaagaactttattacttattttacagaaataaaaaggattataaaagaatactataaacaatggtacaccaacaaattggataacctagataaaaatggacatattcttagaaatacacaatctaccaaaactgatgaatgaacagaaaatttgaatactcctataacgagattgaatcagtaatcagaaacctaccagtgacaagctcaggacaagactgctttactagtgaattctaccaaaacatttaaaaaagaatgaacaccaattcttctgaaactcttcccaaaaaccaaagagaaaagaacacttcctaactcattcatgaagtcagcattacactaatacaaaattacaataaagatgtcacaaggagagaaaattacacacgaatatgtcttatgtatacaaattgaacccaatggcacatgaaaagtttattcaccataaccaagtgggatttatttttggagtgcaatggtagttccacactaaaggaatgaataataaaacttagtggtcttctcaattgatgcagaaaaagcacttgactaaatccaactttttttaatgataaaaacacttgagaagctaggaatagaaagtaactttcctatcatgataaaggccatatttgagatcccacattctcaatggtgaaagtgaaagctttgccctaagatcagaacaaggccaggatacacacatttgccacttcttttcaacatagcaccaggagaactagccagagcacttagacaagaaaaagaaatagaagtatccacagtggaaaggagagcataagattatctctgttcacagataacccgatcttatatgtagaaaaccctaacaattccattcaatggggaaaaggacagtctcttccataaatgatgctgaaaaaattggatattcacatgcaagagaatgaaattgaatgcttacctaatgccacatacaaaaattaactcaaaatggactaagtgctaaaactataaaacttttggaagaaaacataggggaaaatctccatgcactaaatttgacaatgatatcttggatacagcaccaaaggcataggcaatgaaaggaaaaaattagataaattggacttcatcaaaatttaaaacttttgtgcaccaaaggacactattgagagagtgaaaagacaactcacagaatgggagaaaatatcttcaaatcatatacctaatatggggttaatatccagaatatataaagaactcctaaaactcaacaacaaaaaaccaaacaactcaagtcaaaactgagcaaaaggcttgaatcagcatttctccaaataaaacattcaagtggtcaacaagcacaagaaaagatgctcaacatcattagtcattagggaaatgcaaattaaaaccacaatgagatatcatttcacacccattaggatggctattattaaaaatggaaaataagcagcgttagagatctgaagcaagtggatgtgaaggcactgctcatgggaatgtataacagagcaacagctgtggaaaagtctggcagatcctcaaaaagacaaacataaaactaccacaagacccagtaattccactcctaagcaaacatccaaaagaactgaaacagggatgtgaacagatacttgtgccccaacattcagaacagcatattcacaacagccaaaggtggaaacagcccaatcgtttatcagcacatgaatggacaaagaaaatatgttacaggtacacaggatactatgatgttattaaaatgaatggaatacttatacatgctacaatgtggataaactttgaagatattatgctaagtgaaataagacagtcatagagagacaaatattgtacaatttcccttacctgagggaagtagaagaggcaaattcacagagttagagagtaaaatagaggttagcacaggcagccgttattgattaatggggtacagaatttctttctggggccataaaaaagttttggatatagatagtggtgcttgtgcatgtacgtaatgccacttcattgaatatgtcatgatgattaaaatgataaaagtttcattatatatattttaccagcaaaaagtggaagtagaaagcagaaagtaagcagaaaatggagcaatgccttaaagtttaggatagaaagttattttcagtctagaacattgttatctatcaagtgcgaggtagaataaagacgttctcagacatgcaagatcttggaagctactggagggcttgctccactgaatctggggagtggccaaaaaaaccacgggtagaacaggacccctgtcagcagagaggaagatggacattctcagcatgatggtgaaggacttccccagtgacagctgcttgaaggtctagagggtactctatcccagctaaaatggaagaagggtaaatgtcaccagtgaaaatacagaagtgataagtgaggatgtctgaccaactgacagggtggatttgtcccagagctggagatgaattacctgcatggaaaacagaggagttaccaactccagggaaacaaaagacattactgagaaaagaaaggtaggccaggtgtggtggctcatgcctgttctccaatcactttgggagaccaaggcaggtggatcatttgaggtcaggagttcgagaccagcctggccaatatggtgaaaccctgtcttcactgaaaatacaaaaattagctgggtgtggtggtgcatgcctgtaatctcagctacttgagaagctgaggcaggagaatcacttgaaaccaggagacagaggttgcagcgagctaagattgtgccactgcactccagcctgggccacagagtgagactcggtctccccccccaaaaaaaaagaaagaaaaaaaaaagaaaggaaaagaaaggtaatcataggacatgtacagcagctcagctgtgggcaatatttatattgtcataaataaatgagccatctgagtcaacaaataaggtggagatgtggaattattccttctgtaaaagagtttactcactgtgagagccattagaccattgtcagtgagcaaaggcaaaaacaggctttctaggagagagcaaggagaaggggaagaacaaaactgcagaggagttgacattctggagcagagccggcagccagcaggtctatcttgactccaactgaaaacgcacccctccttcaccgggggccgggggaggggaagctgcatgcatgcagatagtgacgtccaagttaagttctcaccttagaaagtggggaatcaatccagagcgtctaaaatggacaagtcaaggaccagcagggggagtggaccagattctgagccactttggggatgagcctggggaaagccacagggcagccctgcttggaaccctgggctgtgagtcatggggctggtactccttgctgtgtgaccttgggcacgacttctgctcttggacacccagcgtcctcccctgtaagatgaggatgctgttgcttactcacagaatcactgtgagcagcatatgcatggcaggtgcctagtatggtattgagcacgttagtaaagacaaccccctgagctgctgcccttattaatattgccatttcttatgataaggagtgctgtgctggacaaggcctacacctggatcgagacaacaaaaattttaggggccaattcctgttggcgtgagccaactccctcttttcctccttggtggggaggtgtctgtgcaggagtgaaggagcagggttggggcgatgggtgggctcctcattcttgccctttacaatttcaccaagaaaacctgtagatgtgactgaaagagaaggaacagtaaaagcttggcagataggaggaatttcttatcaagttttgtttttgtttttgtttttgtttttttggttttttcgagacggagtctggcactgccacccaggctggagtgcagtggcaccatctcggctcactgcaagctccacctcctgggttcacgtcattctcctgcctcagcctccagagtagctggcactacaggtgcccaccaccacgcctggctaatttttttgtatttttagtagagacagggtttcaccgtgttagccaggatggtctcgatctcctgacctcctgatccacccgcctcggcctcccaaagtgctgggattacaggcgtgagccacagagcccggcctttctcatccagtctttcaagcaaacactgactgcaaacttgggctgggggctatgagttgagctcaccagtggggtaggggcaggagaggattccagcgtgcagagatagggtgtgtgccccgataaggctgcagcctgagacctgagggatgtgcatgggaatggatggtgaccttacaacctggcttctgctaactgggaaggagaaggaggaagaaatggaggaggaaaagaaggatgaggaagaggaggcagaagaggagaagaagggaaaaagaagagagatgaggaagacagggaagagaaggagagaaggaaggaggaggaggaaaagatggcttttggtttctgtgagctgtatatgctttttccccgggctattttgaaatactgaaaatggctctaagacccccctgcctgctcccacctccactcagaatgaaccttcagagatgttcaaggttgagagtccaccatctccatgccttttttttttttttttttttttgagatggagtttcactcttgttccccaggctggagtgcagtggtgagatctcggctcactgcaacctctgccttccgagttcaagcaattcttctgcctcagcctcccaagtagctgggattacaggtgtgtgcccctacacccggctaatttttgtatttttagtagatgaggtttctccatgttggtcaggctgatctcgaacccctgacctcaggtgatctgcctgcctcagcctcccaaagtgctgggattacaggcgtgagccaccacgcccggcctcccatgctggttctaaaggaagaagaacttagttaggtcctgggaaaactggtcaagtcaccttctcagttttctgtttgtgaaatggggacagccacttctacccatcataattttcacctcctgccagctcatgttgaaaacggattcgccatggttcagtgacccagagtgtgccggagtgaagtgcccgtggtggggaaagcacggctgagtcatcttgggaaggactctggctgtgcacaacctcagttttcctgacctgtaaaatggacactctagactttcttttgtagatcttctcaagggtgtgtacatgacaagcatgtaactggcccaagacatggctgctgctactggtataataactaccagtagtgatataaatagtatgaaatataatgggttaatagttatcattttataataatttataataatgtaaaataattttaatattagtgataattaacattttcttttgtagagacagggtcttgctctgtctctacaaaattacagtggtgcaatcatagctcactgcagccttgaactcctgggttcaagtgattctttcccctcagcttcccaattagctaagacaacagctgtgagcccctgtgcccagccaatgataatcattaataatgatagtagcatcaaattagtgctctgggctgggggaactacccccagaacctgaactcccagaacccactgctgggtgacatttcttgttggtaatgtgacatttcagggtatagccattctgcctccccgtactgtctcatttgtctctgaatccagtgccttccaagatagcaggcacacagcaggtgctggataaatgctaatcagtagctggatatagttgtactcagtaaagacttgcggaaggaaaagcaagccgcattcttgcactgtgctgatagacagctgggcagggatcatactgagtttcagcagcagctccctccctgcctgcatctcctccatccagggaggatgcagggagaggtggcctggtggggaaaggtgaaagtcctgggtgttgctttcaacacttgggagagaggattcttggcacaaagtgactgggccagaaacgagcacaggaaataatttccctcagatcgaaaagcaacccgctaaaatatttaaatgtgaaaagaataaaaacatgtaaatttaatagagaagaaaccatttcataatttttttacatcatcaaagtgtgaaaggtctttctaactatgacccaaaatctctaaaagaaaagacgcataacatagaatccacaaaacaacaggcaaacaaaaaaacttttttatggctggatgcggcggctcatgcttgtaatcccagcactttggagcccgaggtgggtggatcacctgaggtcaggagttcgagatcagtttgaccaatatgaggaaaccttgtctttactagaaatacaaaaattagctgggcatggtggtgtgcgcctgtaatcccagctactcaggaggctgaggcaggagaatctctcgaacccagttgggggaagttgcagtgagccgagattgcaccactgcactccagcctacgcaacagagtgagactccatctcaaaaaaaaaaacaccaaaaaaacaaaaacaaaaaacgacaacaacaaaaaccccaaaacttctctatgacaacaaacacccaattccaaagacatatgaaaaacaggcacaaaacctttgcaactcagatctaaagaataagcagaaaaataaagagctacccatgagaaaaatgggcaaaggtcatgaatagacagttcacagtcagggaaatacaacataaggatgcttggtctcattcaaaagagacaggcaaattcaaactacactgataccatattcatgctgagattgttaaaactccaaaagtttagtaaaaccttctattggcagagcctgtggggagagtggcattcttattcattgtggaaggagagtaaatagaaataacccccatggagggtaatttggcaacatttgtcaaaattactgatggatttacccactgacccagtgattaaactttgaaatttatcccgaagtgtgaaatgataaatttattacagcaacatttttttttttagtatatgtgctgccgaagtgagcacaacatttggttttttttgttttttctttttcttttttctttttttttttttttttgagatggagtctcactctgtctcccaggctggagtgcagtggtgcgatctcggctcactgaaacttctgcctcctgggttcaagcgattctcttgcctcagccttccgagtagctgggattacaggcactcgccagcatgcctggctaatttttgtatttttagtagagatggggtttcaccatgttggccaggctgatctggaactcctgacttcaggttatctgcccacctcagactttcaaagtgctgggattacaggtgtgagccaccacgcctggccaattgcagcaacatttgtaatagcagaagattaaaagtaacccaacatccatcagcagggaattgactgagtaaattacagtacatttatacactagattgttctgtagctatcaacaaaagtaatgaggaagctctctgtatgttgctgtggaaagaacagcaaggcatattaactaaaaaacaaaaataaaaacaaaacaaggtatataacggcatggctcataggccctgtttttgttttggaggttatttttgaaaaaagggggaaattctaatcatatttgtaaatggtcatgtatacattaaaaaattgtgttaaaaataagaaaccaggccgggcgcagtggctcacacctgtaatcccagcactttgggaggccgaggctggcggatcacgaggtcaggctaacctgacctaacatagtgaaaccccgtctctactaaaaatatataaaaaaaaaattagccgggcatggtggtgggtgcctgtagtcccagctattcaggaggctgaggcaggagaatggcgtgaacccaggaggcggggcttgcagtgagtggggatcacgccactgcactccagcctgggcgacagagtgagactccgtctcaaaaaaaaaaaaaaaaaaaaagaaagaaagaaaaaaaaaagaaaccaaacacactattttaaggaaaatatttaagaaaaaatttaataaaagaaatgcaagaaggccaggcatggtggctcacgcctgtaatcccagcactttgggatgccgaggtgggtggatcacgagatcaggagattgagaccatcctggctaacacggtgaaaccgcatctctactaaaaaaaaatacaaaaaattagccgggtgtggtggcggatgcctgtagttccagctactcgggatgctgaggcaggaaaatggcatgaacccgggaggcggagctcgcagtgagccgagatcgcaccactgcactccagcctgggcgacaagagcgaaaccctgtctcaaaaaaaaaaaaaaagaaaaaagaaaggaaaagaaatgcaagacatacatgaaaactaaaaaacattgctgaaggaaattaaggatttaaataaatggaaagccatcccatgctcatggattgaaagaaaacaaagcatagttggaagactcatgtttccctacttcaaaacttattgcaaggcaatgctaattaagatagggtggtactggcatcagacaggcataaatcaacagaatataattgagagcccaaaaataaagcctaacagttatgatcaatggattttcaacaaggatacccagactattcaatgggagaaagaatagtgttttcaaaaatgatgctgggtcaactgggtattcacatacaaaagaatgaatttggaccattatctcacaccacacacaaacattaactcaaagtagatcatagacttacatgtaagagctaaaaccacagaactcatagaagaaaacatagaagtaaatcttcatgatttgaggctaggcagtgacaccaaatgtgcgtgtgatagaagagaagattgatcaaaattggacttaatcaaatgaaaaacttttgtgttccaaagcaaatcatgaagaaagtaaaaagacaattcactaacttggagaaaataggttcaaatattatacctgaaaaggagcttgtatccaaaatatataaagaatgcttataacagaataatgaaaaggcaacccaatttttatatgggctaaatatttcaataggcattttccccaaaaaaaccatataaatggctaaagaagcacatgaaaagatgcttaacatcatttgtcactagggaaatgcaaatccaaaccacagtgagataccacctcacaccccttgggatggctagaatgagaaagacagtcaatgacaaatgtcggtgaagatgtggagaaattggaaccctcatgcatgaagtgaattataaaatagtgcagctgctttggaaagcattttgcagttccttaaaatgttaaacatagaatttatcatatgacccagcaattccacttgtaggtatctatctacttaagagaaatgaagacatgttcacccaaaacttgaatccaaaagttcatagaagctttcttaataatcacagtgacaaaaaaagtagaaacaacccaaatgtccatccaccgatgactggaaaagccacatgacatatccataaagtggaatgttacttggccacaaaactgaagcaagtactgatacctgctacaacatggacggcccttgaaaacattatgccaagtggaagcagctagtcacaatacatcacatatgattccatttatggaaaatgtccaaaacaggcaaatctatagagacagagagtagattagcctggggctagggaggaatgaagactgacaaagtttctttttggggtcatcaaaatcttccaaaattagcttatggtgatggttgcacaactctgtaaatatactaaaaacacagacttgtatgctttacacaggtgaatttcatggcatgtaagttatatgtaaataaagctgcttattctaggggaggtgggaactgggcagatggaggacaaggaggaagaaaagactttctattatatatctttcaatactttctgggtttcaaaccatctgactatactatctattcaaaggcaaatctaaaatcaaaggatcaaacaaaattaaaggcagacccgattctccccacttttgggttggggagcaaagagggagaaagccaccacccgccgcatatcaccgtgaagggttggttgagtggaaggtgggcaggacgttctatgtgacaagggcagccttggagatgttccaagacccattcattgcctggaccaaagccaccaaaagccactggacctgacagagagacagtgcctgactgaccagacagcagatgccaagctgaccagagggcctgtccccgccccctcctctaccaccatgtggacctacataaaatcccagaaccatcatcaagtgccaaaggagggcaggaaaaccccatgactgacaccagccaggcagaatagaagcttgagagagaagcttcgttgatggaaagggaagaaagggaacacctctctgacactagctgtgtgggctgggctcagactctgggccgccacaaatttggatgcaggatggagactctctcctgcaccccgagaccagagagcagccaaggagggtgattctcagagccctctgcttgtgcctcctcacgggcttggccggttaacaggtgctgcaccaagaaagagctctgtggtcggattagtttgaaaaacactgggttaaagaaagtcaaggcagttttttaaccgcagggcttctcagagcctttcctcatgactccccaagagggggtctggtagtttcatcaaagcacttttgtgtgtttgagggatgtctggtaggaaagacagtcttcttcattttacactgaggggaagcggctcagccaaggtcccagagtgggccagtggacaaccggccagggctgattcggcagcaccagacagcttctgccactgccaggtcacagttctagctgggtcctgactcgtggccccagagcactgggcaatttcatcctgtgttaaggcagcctctggtcactgccttgtccaagtctctcagaaactttacatatttgagcccctggctgtgtagattctggggacttggtggctggacacaaaaaaggactgaagaacaaatttgctccctgcctgaggtgtgggacagagcagcaggcagaggctgtgaatctaggctgtgccccgggtccatctggccatgggttctgtctgcactaaaggacctggggccctttcataaaaccttagaaacccaccctgatgaaaatgctatacgggccgggtgccgtggctcatgcctgtaatcccaatactttgggaggctgaggcaggtggatcacctgaggtcaggagtttgagatcagcctggccaacgtggcgaaagcctatctctactaaaaatacaaaaaattagccgggcgtggtggtgggcacctataatctcagccactcgggaggctgaggcaggagaatggcttgaacccgggaggcggaggttgcagaaagccgagatcatgccattgcactccaacctgggtgacagagcaagactctgtctcaaaaaacaaaaacaaaaacaaaacaacaaaacaaaaaaaaagaaagctataggataaatataaatataaatatataacagaaaaaatgggtggaaactgttatagattaaaacatagccaaaagtctaatgtgggacaggctgatttgaacaagtcaactgagaaagacattggtgagacagttggtacagtttgaaccctggcgggctatgtgatgatgttcaggaattgttgtttcagcaggggtgaaggtatgatgcttagttttttgttttgtttttagggtttgtgttcttaaggaataaatcctgtggtctccacaactcaaacaatctggtatttgagattagcattaaaatggtccagcgggcatgtaagggggaaaatgggggctgtgcaggggccatggtgacaaagggaattcctgccggtgtggccaaccctgcaacctcagtggcttctgtcacggaaggcaagccccacatcccagaggcatccagactcggggctctccatgtgcaggagcttggggaggctgggactgccccagtgtgtggatctgctgtgggctttgcacctgctggaccttgcaacccccacggcactcaggcccaaccctcctcacacctcccacctgccctcctgccctcctgcccggctactcacagcgctcctcctggtccacacggctccggccacctcgcctgctccggcccaggccactcattactcaggatgct

SEQ ID NO: 2104 - DNA, 2843 bp, Homo sapiens
  source 1..2843: mol_type = genomic DNA
tgccggtcggagactcccgtctgccaaggtttttattgtggtcccgcggggcaggaggtatgcatggcatacgtaagcagagagccggaggcagccatcggcacctagaacggtgcagagttggcccaggagcgtggcggggcaggcggcctgcacctgccctgctcgcccagcagaccctccgggctccagcctggcggggcccagcgtccaccttggtgggcccaggtcagatcttggccagggtggagtgggcgtcggcctgctcctcttggatgggggtccggaaactgcctccccctggggaggaaaaaaggagagattggtgggtgggcctcacccgccaggagcagtgcggcagggccatgaggcactcaccagggggcttgtgggcatcggggggcagcctctggtccctccggagcaggtacagggccagcaggatggccagggggcccagcagccccagcaccaggcccaggcccaggatggcggcaaccgcacggcctgcaggaaggggtctgctgggtggggtccacaggaggggcccccatgccgccctccccttctcctattcgggttgggggccccgctgggctgggccaggcgcccttacccccggggacctccacgggccgggtggagggtccctgtgaggttctgggccaggcttcagtgggctggacagtgatgggcctggccggggggccctgggtctcctggggctgcgtggctggggggtccctgtcctcacagattgcgtccgagctattgctggccggctgcagggtgtgcttcccagccaaggtgcagctgttggggaacaggaggtgttgctcaggccagaaaccccctgggacccgggagatgcggtggggataacagggtccacgctggccagccacaggcagcatctaccacagacaccaggccagtgacagccaaggacgctgcccagccccacgtgccccccacaggggcctccaaggccacacacccttctcccacatctacaccccccaccagcacctccctgtcctgtgcccccagggcctcccagctgcggagggtgagggtcccacacacccagctccacccacagggaaaggctgcccccaggcagcagcttcctgctccccaaccaggtccagccacatagccaggcccccagggccaccagcacctccccttcccccaaaactgcccccaccccacctgcccccccagcccctcccagctccccagctcctccgccctcctaaccaccccaacccccccccagcccctcccagcccctggccaggcccctcacttggtccagggcttgcaggcctggttgtcgcctggggagaagtgccctggagggcagggggcacagtctgcaacaaagatagggtggtcaggggctgcccacaggccccgggtgctggggacatggggcagagcctgtggggcaggcacttgccccccatggctgggtggtgggtttggcctctggaagccctccctgcccacatcccacccgtgggccctgacccgggagctcggtcttgaggatgccagaggaggcaccggtggggccaggtccctgcggcccacggcccatctgcgtcacagacagccgctatgcacacccccaaccgccggccgcagccaccgagctcaccaactccaggcttgtagctgtccaggggctgggtgcccgcccggcagcggcagactgtgtcctgtgtggccgtgcacagctgcttccgctcactcccacttcctgagcaggggccggatgggggggtggtcaggtgggggctgtggacagggtcctcaggaagcgtgggcactggaggacaggttggcctccccaccacacagagggccgtgggcaggggtctgcggcctcccctgagacttggagcccctgcagcccccgaggctcctgggccctcccttcctggccacaacctggggctggttccgtggcagccccagccacccttccctacccctccaccgcctccagccgccagccccgcctgcggcagggtctccatggcccaaccccccagcctcactgctcaggccagcaaggccaggccacatggccagcgtggtctccccgactccacgtggcctgggccgagtctgggcccccggagggagagggggtgcccctgggagacgcctcagctcctcgaaggacccctgtggcggagcagaccccgctgtggtttgaggttcgtttctgcggctgtgggagccccatgctgctgcgtgggaatgtgggtgccaggctgccgccccctgtgctgggtggggctgtggggccaggtgggagctcactgaggttacaccacgtgcagggcttgcacggcttggagctgaccacgtcgttgtagaagcccggcccgcacggacggcacaccgtgttctgggagcggctgcagcggctcaccatcccgttgcctgcagcagaggccggcgtcaggcagcggtcaggccccaggcttgcgcccgtggacccccccaggcggctcctctgccaggcttggccggcccctcacccgccccctccccaggaccagcctcctggctggcccatccctgccccagcccccagtccctggagtgcccgtgcgtggcgacccctcctgaggcctcacctggcctgcactcgtggcagcaccggtcgttgctggggtaggtgtccccgacacagtggagccccgtcacggtgctcagccccaggcccaggaggagcagagccgcacacggcccgcggcccagccgccgagcccccacgcacatcctcgtctctgctgtcgccagagtctgggttttccttgcgg

SEQ ID NO: 2105 - DNA, 80831 bp, Homo sapiens
  source 1..80831: mol_type = genomic DNA
atacgggagaactaaggctgaaacctcggaggaacaaccacttttgaagtgacttcgcggcgtgcgttgggtgcggactaggtggccgcggcgggagtgtgctggagcctgaagtccacgcgcgcggctgagaaccgccgggaccgcacgtgggcgccgcgcgcttcccccgcttcccaggtgggcgccggccgccaggccacctcacgtccggccccggggatgcgcgtcctcctcgccgcgctgggactgctgttcctgggggcgctacgagccttcccacaggtaagcgggtgacgggcgcctggggaggtgccggcggtccagagcccggacagtgtggggtgcgtgggacgcaagggaggacactcctcaccccgttccctgcccagctggagtgagggggcgcgggtgacaagcaggaacaccggaatatgctagcacccacaggtgggaggctggctgaagggctagtggtggggggcgcctccttctcaccccgcgatggctgggactgattcattcattcagtgtgaattggactgagagcactgccatacgcgggaggcgctctttagcccgcctacctgcgggcccgtcggggtcctgggcagatcaggtgaggccgtgggagtagtgggcaggccagatggggcctcccttagccatgggaggttggtcgtccgcgctctaccctgttgtgtgcgcggtcccgtttgcccccttcctaagctggccactggctggagggtcaaggaaaggagggagagttggctgtgggtgagagtggggtgagggtgcaggaccaccgggattagcttccccaatccgcgtccggcaaagcaacgctgtggattgaattcgctggagcacgtggtgggcatttgcccctggaagaaggtcagtggtggggctgaagtctatggtgggttgcctcagaattgagtttggggactgctttaggaaaactgagcacttaccagtggccagcgccaaattaatcactgtggggagaatgcaaagtaaccaggcgtgtttcacggagcccaggggctgctggagagagaggccctcagctgacccaggaccccggtggacccctgcatagaaccatagtaggtgcgagtggatgcctgctgaatgatacagagggaaaggaaggagcaggctgttagtccagcggtgggtcacggtgggggagagggaagacccagttcccctttaatcctacaggaagagaggactccatgctatggatcaattctagtcatctgaaccttaggcagtgggaggagagtggcagagtgggctttaggcaggagggaggaactatgcagcaaaggaggaactatgccctcttccatttccaatgggcaatgtgaggtattccccctttccccccaagagggcagaggggacaaagccctggctagagacaccctgtcccagctctgcaagccctcacctgggggaaggtaagagtttggagtgccaaggtcttggggagatgaagggaaggaagagatgtgagaggtgcttggggggctttgctggtttggtttggcagctgaagctcatgtgcttcctttctgtagagtgaagccccctccactttttttaatgttagagacagggtctcactctgttgtccaggctggagtgcgatcataactcactacagcctgaactctcataccaaaccttttttttttttttttttttttgagactgagtctcactcttgttgcccatgctggagtgcaatgctcgatctcggctcactgcaacctctgcctcccggattcaagtgattctcctgcctcagcctcccaggtagctgggattacaggcatgtgccaccacacccggctaatttttgtatttttagtaaagatgaggtttcaccatgttggtcagtctggtctcgaactcctgacctcaagtgatccttccgtctcggcctcccaaagtgctagggttacaggcatgagccaccacacccagcctcccataccctttttaaaataaaaatactatatatttaattgcacaaggaatatataaatatattctcaaagcaaaactgtaaacgctacagataaagccaagtcttttgacaccgcctcatcctgatcccttcaaagatataaccaccataattgatttggtgtgtttcctttgcagacctttataaatgcatgtccatatttatattgttttaatagacatatatatagttttccatatactataccctacagtacatatggttcttcatttggctttataatgtctatgaggcatcttggtgagctttccatgctgaaacttacagatcctctgcctatcttttaaaatgctatgtgatcttttgccaaatgggatgtttcatagtttatttatgtcctggatggatgggtgctaaggttgccaccattgttctttctttctttctttgttctctactacagtgcacagccctatatggatgcttttggaaataaatgtctgtgattctttcctagacaagagactgagaagagaatactgaggttgcagggcgaaaatgcattcaaattaaaagacaccaccgaactgccttccagggtggctggacaatttaccctcccgctagcagtgcaagagagtagtaactttcccacatcctaaccgacatttgatcttatcagcattttaatttttctcaatgtgattagtgaaaagggttatatccttgttgccttaatttgcatttctcgcctaccggggaagctgagcatctctctgggctcaggcactaggtcatttcttggcaggagtcagggagtccttggggaagggactacctgcccaacacagtactcctttttgcccctcaagccttctcccacttctgttttttccagtaaaggttcgggaagctcgttattttaaaaaaaaaatcccaaattagggcttgaatttccttgagtttaaaatttttttttttttttttgagatgaagtctccctcagctgcccaggctggagtgcagtggcacgatcttggctcactgcaaccaccctctcccaggttcaagtgattctaccgtctcagcctccctagtagcttggattacaggcacttgccatcatgcctggctaatttttgtattttagtagagatggggtttcataatgttggccaggctggtcttgaactcctgacctcaggagatccatccacctcggcatcccaaagtgctgggattacaggcgtgagccaccgcccccggcctaaatttttttttattttttgggacagtctcactttgtctcccaggctggagtgcagtggcgcaatctcagctcactgcaacctctgcctcctgggttcaagtgattctcctgcctcagcctcctgaatagctgggattataggtgcctgccacctcacccagctaatttttgtatttttagtagagatggggtttcgtcatgttggtcaggctggtctcgagctcctggcctcaagtgatcctcccacctcggcatcccaaagtgctgggattacaggcgtgagccaccgtgcccatcctgaagttcttttttcatctctatttgatttttcccaagacgccatcatttttcgcctggtattctgaggcaggaatgctttcttgctagctggcaccatctgagagttggcctctgatgcttcgtatcactgtcttgtccaattgtgtttttttgtaatatgacccaggattaactggtgcatatctgcagagaaaaatttattcccccatagctccatccttttcatccaggcaccatgtggtggggttgcggggcgggggaagccccagctttcctgtgaactctgtagacttagaaattccccaacatcatgttccttgccagtgctaaggctaaacaagccttcctcccacatccatgtacccccaattccagccagatgtaagcatctttgctctgggttagtgtgcaggctgggaccaggaaggttctcatgaaagtatcttagctggggccgggcgctgtggctcacacctgtaatcccagcactttgggaggccaagacaggcagattacttgaggccaggagttcaagaccagcctggtcaacgtggtgagaccctgtctctactaaaaatacaaaaattagctgggcatggtggcaggcgcctgtaatcccagctactcaggaggctgaggcaggagaatcgcttgaaaccagaaggcggaggttgcagtgagccagcactcccgcctgggtggcagtgagactgtatttaaaaaaaaaaagaggaattttagctggggtgatagaaaagctctatgtgtgactcctccatctagcaatttaactttaaaagcttagctagttactccatacagtgtagtgctaatcgtggaatttcagggagtggcaagagggcaggagagattttctggttttgttttgcaaaagggacatttccagggctgctcaaatcctgcagggaggcaaggacggcgggggggcgggggggggacctggagaggaggggaccctgaaggagtggaaggagggtctggcttgtcttaaagccatcccttcccagggcggcactagtgctctggggtcagggagtcgtgttactcagcttgagagcagtgagtgccggaaggaggggcgtttactgtaagtttctgcttctgctcccactcatatctgacttagactcgtttcttgagcagattgtgattcattctaaggtttttatactccctcatcacccttcttcacatcaggacaatcatcagaaggaaaatggggctgaaggatgactgtgtctggcccgggggagtcctggaggcttgagggtccttggcaatgacagtagatcagcccagcctgggccagcttgtccagccggtgcactgaccctgggtgtggcccatctgggatcacagtcctcatttcacagacaaggattcagtgcagaggcccagaggtaggggagagtcttgcctacagttccaggactggtcggggtagagcccaccacagactagacacgcagaatgtcaaaaaaaggcagctctcggccataccagttctccacttctctctctcccctcccaggtccacccaggggatactggggtgggggtgggggaccttcttccggtatctatggttgaaaaccactgggcattctcgtggccttgctggtggggagggactttttatacatggctcagtctagttactccctgaatgcctaagtcttttggtgacatgcaagtattcatgcatgcatgcatccagcagatctgaaatgagcagctgttctgggtcaggcatggctccagggacttgcattcagcctctgcctgtatgccccccgtgacaggatgcttgctccttgctgaggcagctcacaccatcctgggttagctttggcatttagatgatcttcatgatatgctgaaatctagtttctttttctttctttttttttttttgagatggagtctctctctgtcacccaggctggagtgtagtggtgcgatctcggctcactgcaacctccgcctcccgggttcaagcaattctcctgcctcagcctcccaagtagctgggactacaggtgcatgccaccatgcctggctaattttttgtatttttagtagagatggggtttcaccatgctggccaggctagtctctaactcctgacctcgtgatccacccgcctcggcctttcaaagtgctgggattacaggcatgagccactgcacccggcctttttttttttttttttttttttttttgatggagtttcgctcttgttgcccaggctggagtgcaatggcgctgtctcagctcactgcaacctccatttcccaggttcaagtgattctcctgcctcagcctcccaagtagctgggattacaggtgtgtgccaccacgcctggctaatttttgtatttttattagagacgggatttcaccatgttagccgggctggtctcaaactcctgacctcagacgagcccccccgcctcagcctcccaaagtgctgggaatacaggggtgagccaccacgcctggcctgaaatctagttttgaaaatgagtcacctccctgttcttcagaagcgcctctggcaatgtgaagactgtgactttgggtccccggagtctctcagccagtcacacacctgtcctccaacatttattcctcacgtagcgtgagctcaaggctcctcatctgcctgttctcttcaattcattcattccacaaacacttattgagcaccttctgcatgccaggaagcactccgggtgctgcgagttcatccatgcaccgcatagcagggtctctgccccacggaactgacattccacaggggtgacagtcaacagactgctgctagttgcaatgagaggattagaatcctgtagtgtgagagagacgggcggctccctaagatggggaaaacaggacttgcagacggtaacatacacacggaatgaaaagagggaggcagccagtgggagattagcagaaaagcatccaggcccagggggtaaaagccccaagaggctagaggaacaggaaggaggccggggtggctggagggaagtgagtggagaggggtggttaggagaaggtggcaggaaaggtggtagatcgtgcagacctttgtggactgtggtgaggtttttggcaggggagcaatactgcatgatagatttaaagttccttctgtctgctgtggggggctgggggattggggggagcaggcaggatgggagcaggaagccaggtcattgcattgatccaggggaggggtgagcagaggtgggaatgtgctttttcttcttttcttttctttttttgagacggagtcttgctctgttgcccaggctggagtgcagtggtgtgatctcggctcactgcaagcttcgcctcccaggttcaagccattctctcgccttagcctcccgagtagctgggactacaggcgcccgccaccacgcctggctaattttgtttttgtatttttagtagagacagggtttcaccgtgtcagccaggatggtctgatctcctgacctcgtgatctgcccgcctatgtagagacagggtctcactatgttgcccagtttggtctcaaactcccagggctcaggtgatcctcctgcctgcgcctcctattgctgggattacaggcatgagccactgtgcccagctggaatgtgctttcaagctagaatcaacaggacctgtggatgggtctggtgggagcgcagagggcaggagggaaatcagggatcctgtccgtatttgggagctcagaatctggctgcatggaggtgtcattttgggatgtgggaaaaaacaagcaaaggatagaacaggggttttggagaaaagttctattttgcccatgctcaagtaccagtgggggttgggtgttgaaatgtggagctctctacagagttcaagctgctgatatgaatctctgggtaccagagtcaactgtagaagtcctggtgccacctgggccaaagaccactccccagtagactcaccttacttctattaaccaagcccaagaccccctttttttggcccccacattatctgttcattcgttccaacccaagcctaggctcttttattcagcctggttacagtatatgctagttttcttttgctgctatagcaaattagcacacatttggtggcttagaacaacatgaaggtattgtcttatagccctggtggtcaaaagtctatgacaagtctgtaatcccagcactttggaaggctgaggtgggcagatagttggggccaggagtttgagaccagcctggccaacatggcgaaaccctgtctctgctaaaaatacaaaaattagccaggtgtggcggtgtgtgcctgtagtcccagctactcgcgaggttgaagcacgagaattgcttgaacctgggaggcagaggttgcatcaagctgagatcgcagcactgcactccagcctgggtgacagagcaagattctgtctcaaaaaaagaaaaaagtctatgataaggcagcagagctatttttcttctggatatgctgtagcaaaatgtttccttgcttttttccagtttctagaagctgcctgtgttccttggtccctggccctgcatcactctgaactctccttccatcctcacatttcctctctctcttttttttttgagctcgatctctcggctcactgcaacctccacctcctgggttcaagtgattctcctgcctcagcctcccaagtagctgggaccacaagcacccgccaccacgcccggctaatttttgtatttttagtacagacaggtttcaccatgttggccaggctggcctcgaactcctggcctcaagtgatccacctgccttggcctcccaaagtgctgggattacaagcacgtgccaccatgccagctaatttttgtatttttagtagagatggggtttcaccatgttggccaggatggtttcgaactcctgacctcaagtgatccacccattttggcctcccagagtgctgggactataggcatgagccacctttgagagacagtagagcatttcgttaaaggtatgaacttttttgtcagcctgtcaaggttatcccttgcttctgacactagatggtgacttgagcaagttaagttacctctgtgtgcctcggtttccccatctataaaatgggctaataacagtagctaccttgtattgtagggctggtgtaaggatgacatgagttaatatgtgtcaagtgctgagagcagcttctggacacagtgagtgctgtgcaaataaaggtgagccttattaggtgcctgttgtatgtggggcattatggatacagccatggagatgaaccagttccagtccttgccctcgatggggggcagtgtgggaaggggaatacagaagagagggtggccagtactgcgtaggggactgtctggggcctgcgggagtccagaggagcccatctttacttctgcctgggtcagtaggggaaggagcctccagagtttgcagtgatgaggctctgcaccacagatggtgccattgtccttgccagctttgcccagggctctggaggcagcagaaggggtcagaggttaaacagcacatcagtgctggtggttggggcgagcctggggcctgctttggaagccccacccagcaggttccccttgggttcttgggtcctccagggggctaagaactcctagaggcgtcgcccacagcttcatttcagccatcaactttcttgacggattgctgcctgccaggtacggttcctgctctcagagagtgcgtgcacagataatgtggcctccacacagtttactgaaatggttccaacctgctgagaccaggaaactcctaaaccccaccttcaccttcccagcctgggcaggcacccttcccactcttgattcgggtgagggaggccaggacgcagcggccaggccaagagtttcctctctctccaaacggtctggggggcatgtgccctgccccttccccacacatagtctgggagagggaggtgggcaaggaaacacaccaggctgggcgccaaggctcacgcctgtattcccagcattctgggaggccaaggcaggaggatctcatgagcccaggagtttgagaacagcctgggcaacaaaaaattagccgggcatggtggtacacacctgtggtcccagctactcaggaggctgaggtgagaggatcacgtgagcccaggaggtcaaggctgtagtgagccgtgttcatgatcgcaggactgcactccagccagggtgaccgcaaggccctgtcttaaaaacaaacaaacagacaaacaaaaagtaaatacacaagccccttctgagcaactggcctgaggctggcgcaggaacctaaggcacctccaagaggatcagaaagtcgaatactcccagggagctgggccccgcttccttttccttcaggtccactatatccatctctctctctcttttcttccttccttccttcctttcttcttccttcttcttttcttcttccttccttccctccctccctccttctcttctttctttctccctttccgttcctttccctttcgttttccctttccctttccttttccctttccctttttctttttcttttttttttttcattttcttgacagagtctcactctgtcgcccaggctggagtgcagtggtgagatcgtggctcaatgcaacctctgcctcccgggttcaaacgattctcctgcctcaggatcccgagtagctgggattacaggcgcccaccaccacgcctggctaatttttatgtatttttactagagatggggtttcaccatgttggccaagctggtctcaaacgcctgacctcaaataatctgcctgcctcggcctcccaaagtgctgggacttcaggtgggagccaccgcacccagcccactgcatttttctttgtagctgccattgtcccgtggcggctgttgctgcccgggaacgtacttcagggctgggtgggttttaccttgtctgagttgtagctaaggatgcagctccaacacttgcttcggccctggaatcttcaggatccctgcagtctcaacaattggctcatggagccggcacgggattgctgggaggcaggagggatttcttggtgggaagtgaggatcgaccagttgctaaattcggactcaaggcgtgatcttgctaaaacggactcgctctcctccatcctgtccacctccccaccacattaatgaccctgaaaccctttaatgcttccctagtgccaaaggcaacatgtcccaaagtcaccttctttctttctttttttttttttgagacagaatctcactctgtcacccaggctggagtgcactgatgtgatcttggctcactgcaacctccgcctcccggcttcaagagattctgctacctcagcctcctgagtagctgggattacaggcgtgcaccactacgctaggctaatttttgtagttttagtagagagggggtttcgctgtattggccaggctgttttcaaactcctgacctcaagtgatccgcccgcctcggcctcccaaagtgctgggattacaggcatgagccaccaggcccggcctcaaactcactttctggcaatggcagttctgagaaaaaaaggttctatggccaacgaagtttgagaaacattgcagagttttctgactagctcccatacccttccttggagaatcaaagagtaagtaaccacatcaaaggttctgagaagccccgtgatctaaaatggaaacctctcgaatggactccagtgattatttgtgtttgtttgtttgtttatttatttatgagacagggtctcactctgttgcccaggctggagtgcagtgttgcaatcatagctcactgtaacctcgaattcttgggctcaaacaatcctcccaccttagttccttgagtagctgggactacaggcacatgccaccatgcccagctaattaaaaaaaaattttgttaggccgggcacagtggctcatgcctgtaatcccagcactttgggaggccgaggcaggtggatcacttgaggttacgagtttgagacatggtgcaacccaatctctactaaaaatacaaagcttagccaggtgtggtggcacatgcctgtaatcccagctactcgggaggctgaggcaggagaatcgcttgaacctgggaggcagaggttatagtgagccgagattgcaccactacactccagcctgggcgacagagtgagactctgccaaaaaaaaaatttttttttttttttaaagagacagggtcttgctatgttgcccaggctggtcttgaactcctgggcttaagcaatcctcccaccttggcttcccaaagagctgggattacgggtgtgaaccgctgcgcctgtccgtgttctgcctatcatctgttaccatccggtagccccagcatttgatgaaacgctgtttgggaaatgacagtgaagagcttccatactcatctctttttctgactccctgactctctcttctgcctccctcttgcatttttaagttcccttaaattgcactgggctcccctggataatccagaagaatctcccatctgaaagtcagcgggttcacaacctcgatgccatctaccaccctgattcccctttgccatgtaaggagacgtatatgagcacatatgtgaatatatcaccctaggtcctggggacccagtgaggatggtatgattcttgctaactgacagagcaggagcgtcaccatcttggacaagcatcgccgttttaaattctccttgattaaaaaccgcctaaatccagccccaaaacatcagcctaacggctaacgtcagcatgaccataaaccacaaatgacacctccaaccagaaacattccaacacccccatccgactggagacatgccagccctgagataacctcccctctgaccagagacattcccagcatacagtaaaactctcctccacacagaaacattcctagcctgcgaaaagctcccatcccagaacccttaaatacccttagtccataaaaacaatgctgctgaacgaaattggccagaaggccttcttggttttattcttttttttttctttttcttttttttttttttgagatggggtttcactcatcttgcccaggctggagtgcagtggcgtgatctcggctcaccacaacctctgcctcccgggttcaagcgattcttctgcctcagcctcccgagtagctggaattacaggcataagccaccatgcccggctaattttgtatttttagtagagatggggttttaccatgttggtcaggctggtctcaaactcccgacctcaggtgatccacttgccttggcctcccaaagtgctgggattacaagcgtgagctaccgtgcccggcctcagttttattctccaaaataaacctgtctttggtaagccgcttttcatatttttttcttctttcttcaactcttacacaaaaatcatttcaaggtgcttgcctgtccctgagttccttccagccagggactccaggctccaccctctatgctgtttccgtgtccactgtctttgggttttatctccaaccctggggccaggcagcatggggccctgcacactctttctcagctgtgcaggaactggggaaaactcaactcggcacctgcttgcagtgggacaactgtgagaggtgctgcctgtggccagggatggagcctgtggccagggatgggtgtgtttaaagaggtggaggaggaggactttagtttcaggtagtctcttggtctggagctcaagtgagcactgagtgtggagagaggggttcagagtcctacagttaggaggtgactactgagttcggcgtgtggtggtatagtctagtggttgcttaggagcgagggtgtggcggtagacgcatagtcccctaaaacgtccatacattctacattgttaatttgggacagggtctcaccctgtcacccaggctggagtgcagtggcccaaccacggctgaagagattctcccatctcagcctcccgagtcgctgggactacaggtgcattccaccacaaccagctaatttttgtatcttttgtagagacgggtttttctcctttgccgtgttgcccgggctggtctcaaactcctgagctcaagtgatcctcctgcctcagcctcccaaagagctgggattataagtgcgagccacttcgcctggccaaatgtccacacattctaatccttgaaacctgatactatggatcttgagacaggaagatgatcctggattatcagggcgggcccaatctaatcacaggagtccttaaaagcagagaacccttcctggctgtgttagagagagatgatagaggcaaagagagagatgtgatgtgagaaggactcagcccaccattgccggctttgcagatggagtaagggggccatgagccaaaggatgccacagtccctagaagcagggaacagcccttagttggctgtcagcaaagaaacaagacctcagtcctacaaccacaaggaactgaattctgccaacaaccttagtgagcagggaaaccaacagtcccttaaagcttccgctaggcacacagcacatgacctggatgggggtgatcagagagggcttcccagaggaagtggcactcatgagtgaggtctcaaggatgaatgggggtacactggatttagggaccagtgcaggcagggaaacagcacgcacaggctgctgcagggagtggggtgcccgtggggtgccagtggcaaaaagaggctggtaggagagagtaccaggggcttcacaggcaggcaaggagggcagggcttcttgggccactgttaagactttggttttttttttttttaaatatggaccgtttcatgaatttccgtatcatccttatgcaggggccatgctaatttctgtattgctccaattttagtatatgtgctatcgaagcgaacacaagactttgggctttattcatagctgggttggaagccatctgagggtcttcaataggatggaggggaagacagtagatcgtgttttcaaaagatcagtctggtgtctgcactgtgagctgggcgtggtggatggggtagacgagaggagaccctcgggtggtcactgtcaagtccagatggcgggaaggtgaggaagagctggtagatgtgggggtaaaactgcaggttaaacagacagaactagtgataggttgggggccagggagaagcaagcatttcaaaaagcagtcagtctcggccaggcatggtggctcatgcctgtaatcccagcactttgggaggctgaggtgggtggctcatttgaggtcaggagttcgagaccagcctggtcaacatggtgaaaccctgcctctactaaaaatataaaaattagccaggtgtggtgccaagcgcctgcagtcccagctacttgggaggctgaggcaggagaattgcttgaacgcgagaggtagaggttgcagtgagccgagatcgcaccactgcactccagcttgggcgacggagcgagtactctgtcttaaaaaacaaaaacaaaaaaaccctcagtctcatggggagtggggagcagggatctcagagccctgaactacagcacccccccaccccaggcagcagaagctggcggatcagagcacgtgccaaatcctggccctaacactgaccagctgtgtgactttgggcagatttctcgtccttacgtctcagtctcccccatctgtaaaatgggctgacagttgttggctattagaattactttcgctatggaaagcaaaccgttccagcatttgcacttctttctgctcagcttctgctaggtcagcgcatctcaaactccctggggctcttgttaaaatgcagattccaattagggaggtctggggttctgcattttgagaaagttccaaggtggtgcccctgctgctggcccggggcctcaccttgaataacagagcgcacagcggtggagatccccaggagacagggaggggaggggtgcttacctcgctggccctgctcagctctggccccttcggggattttgcatttgatctaactccccgctcaccccacaacttctagactcgtctcccacaggtatggtccggctgagaccaggtggggctttttgaaagtgaactttaactggtcttgtagggaaaaccaaaccaacctgaaaatagacagacctgaaaatggtaaggttttaggccaccctctctttatcttgatgccactaaggtggggcggagggcctccggttgcacagctcattaccttgtggacacctcactttgccttgaacctgcggggaactccacccaaaagccccccctccagtccttgggcttccccctcccactcttcgctttctgatccctccttccctcccaggcaagggcccgagcacatcccagctcccctctctctcttccccagggcagcaggagctgatgagccaggcagggtgggcctggaaattcacagggccagacttctccgggcagcggcagacgccccggcccttgcctccttctccaccgggagctgggacaggtgaagggcctgtgtaaggggaagggggtgccccttcctcgctcagctccacatggaaaatggggccctaagtcctctgctcctccttccaaggggatttgagaggcacaggctggccatcccaccaggttgagatcccacagcccctccgcacagcaagaagactgccctccggtggcaagctatggatttaccgagaattattgctgaaaagaagccaccacctcccagcatttcgtgtccttgagatgctatttacatatgtggctttgtacatctgtgttctcactctctttacatatacttatcactactttatttttatcactactttattttttaattctctatttttttttttttttttgaggcagggtctcactctgttgctcatgctggagtgcaatggcgtgatctcggctcactgcaacctccgcctcctgggttcaagggattctcccgcctcagcctcctgagtagttgggattacaggcatgcaccaccatgcccggcttatttttgtatttttagcagagacggggttttgctacgttggccaggctggtcttgaactcctgacctcaggtgatctgctggcctcagcctcccagagtgctgagattacaggcatgagccaccgtgcccagccaagatgatcccagttttgttggcaacatccaaagcattgtaatcaggagccagtggaacatatgccttcttctctccatccggccgaatcagggtgctgaccttggccacatccatgccatagagctttgtcacagcctgtttgctctggtacttgttggctttaacatccacagtgaatacaagtgtgttgttgtcttctatcttcttcatggcagactctgtggtcagtgggaacttgatagcagagtggtcgagcttgtttctcctgggaacgctctttcgaggatatttgggcttttaatacctatttttatttatttttttgagatggagtttcacccttgttgcctaggctggagtgcaatggtgcgttcttggctcactgcagcctccacctcccagattcaagcgattctcatgcctcagcctcctgagtagctgggattacaggcacccaccaccactcctggctaattttttcgtatttttagtagagacggggtttcgccatgttggccaggctggtctcaaactcctggcctcagctgaccctcctgtctcattctcccaaagtgctgggactacaggcgtgagccaccgtgcccggccctgggatttttttattttaaagatgggtagcctgtggcccagagatgggggagaattggggacacggtgaagctcaaacctctctgcacttagttgctgtgtgaccttgggcaagtggctacacctctctgggctgcagtttcctcatctgtaacatggggtagtgatctggccccaaagagctagcagtgtgtaaaggaggagttgtgtgaaagcaggcacccaaggccagactcgggggagtaatgtgcaataccatgggctccccattctctgcaccccctacccctccattgacccaggtgtgatggcaggagggaagcataagcagccagagccccccaggtgtgccccaggccccagcagagtgagcagggcctgggcccatggtccccatagactccgtagctgtcagtgagattagcaggcaggccgggaggggagaccaaggacaaggacccagaatgttcccacactcagcaggccttgccagtgagccctcacacctccagccagccccaggcccaggctactgaactcacccagtgagatgctgtgggttaggagcacttcgggtgtcctggcaggttcctgcccccctggagaggctcccaggagccctctgggtgacttaagagaggacactctcctctcctactggagggaggagggtgtcctcaaggcccggggctctggattaaataagaagggagacaactcaagcgccatgtgactattgggcaaatatcacgttcatgtattatttcaaattaatatggtgacatgtttcagacatgcaaaaaaaaaaaagaatgatgtaaccaacaccccatttatccaccttccagccacgctgctgctttctgctgcttcctgaacatgccggaagcttcactgctccctcgagtggagagaagagtcaggcagccctttaggccagccaggcctctctcctggggaaaagtggcttctgcttccttccctaaaccaagaaagccccacatcgcaccaggggccacctcctttctgccaggcaccatcttggatgctgaagacatggaaatgctacaaggcttcctccctgcctcttgcctcacttcctgcttcccttctcttgcctcacttcctgcttcccttctcttgcctcacttcctgcttcccttctcttgcctcccttcctgcttcccttcttttcccttttgctccaccctagaagtttcacatcctggatcaccccagaaaagtgcaatggcgttcccctgtcattccatctggaaagacaaaactccttccctggaatctcaacaaagaatttcctctcttgaatcctttcttatgatggtgcttcactttcaaagaacccttgaaacacatggggggcttggtaaaaacatatcttcctgaggccgggccaggtggctcacgcctgtaatcccagcattgtgggaggctgaggcaggaggattacttgacctcaggagtttgagatcaacttgggcaacatagcaagacccagtctctacaaaaaaataaaacattagatgggtgtgggggtgcatgcctgtggccccagctacttgggaggctgaggcgaaagagaggactatttcagcctgggaggctgaggctgcagtgagccatgattgcaccattgcactctagcctgggcaacagagtgagaccctgtctcaaaaaaaaaaaaaacaaaaacaaaacaaaaaaaacccccacaaaaacccacaaaacaaaaaccacgccttcctgaaaagagtgagcctctccgacccctacttcacaccatgtacaagaatgaaacttgaatatgaacgattaaacaatctcatctaggagttaatgtaggagaatatctaagtgacactgagtgggcaaatatttcttaaacaggacaaaaaaaggcattaaccataaaagaaaagattagtatatgtaatttattaaagctaagaatgtctgttcatcaaaagcctccaaaaagaaagtgaaaaggcaagccagaggatgcgagaagatacttgcagtacatataatcaacaaaagccgtgtatctagaatatgtaaagaaccctacacatcaataagaaaagccagacaacccaattaaaaaaaaatggccacaagacctgaataggcatcttacaaaaaagaatgcctaaatggttaataaatgtgggaaaaggtgcccaacaacattacttatcagagaaatgcaaataaaaaccacaatgaggtatcactacagatccaacaagatggctaaacttttaaaaactgataccaccaagtgctgacaaggatgtggagcaattggaatcctcagacactgcagggaagtgcctactagtacgactactttagaagcctggatggagaatctatcagaactgaacatgccttatgccccagcagttccactcctaggtatatagccaacaaaagcgtgtacgtttggacactaaaacgtgtgtacaggaatgttcccagcagcactatcataataaccaaaaagtggaatgtctatcgagagcaggcccggagtggtggctcatacctgtaatcccagcactttgggaggccaaggcgggtggatcatttgaggtcaggaattcaagaccagcctgaccaacatggtgaaactctctctgctaaaaatacaaaaactagctgggcatggtggcacacacctgtagtctcagttacttggcaggctgaggcacaagaatcatttaagcccaggaggtggaggctgcagtgagttgagattgcaccactgcactccaacctgggcaatagagcaagactctgtctcaacaaattaaaaaaaagagagtagactagacaaataaattgtgcatatttgtgtgatgctatactgcaaagcaatggacagaaatgagcaactgttatttgcaacagtgcgaatgattctcacaatataatgctgaattaaagaggccgattgcaggggaatggactgcgtaattctactttatgtaaaatccaaaagcagtcaacactaatagagcgatagaaatcagccttttgggaggagtgtgtgggaggggggatgacggaggagctggggctggcaaggtcccatttgatgagttgggtgctgattgcctggtgcgttcatcttgtaaaaatgcagttggctgtaacttgagatctgtgcacttttttgtacgggtgtgttagacttcaacaaatacgtttaccagaaatttgtattgttgggcccatcccagagacaaggtaggaagcaattatgttaatcccagggcaaggggatggtgactagccccaggtgaaggtggtgatgattatggtatgaaaagggccaggagaatttgctgataggttgtttgagaggagagagtcaagggagacgctaaagtttctggcctgagctggagtagcagggggaagcgtaagggcggtgtgggtttgtggaatcaggagttctcgtcctgatttctctcctatattacaaagctccgtctcaggcctcctgggactggtggggacagagggagtatggatatctgggatccacctggcctcaccagcttttctgacctgccaggatcgacccttcgaggacacctgtcatggaaaccccagccactactatgacaaggctgtcaggaggtgctgttaccgctgccccatgggtgagtgggggcgttgggggtggggagaaggggggaaatttgtcctcaattgatgaccctcttgggggattgatgagtggggaaattggagccaaccgtcatcgtcataattggctacagttttctgcaggtcattcctagtgtcgcggagtccaaggactctctcggaaggctagggctgtagaattgagactgtgtttcttgctgccaccagaatgtccatctccatgagtttttatttttaacgtagagctgccctttattggacacttactatccatgagtccgagacctttatatgcacggcatcatctcattaagtgcttgcaatgatcctttattacactcaatttgcagatgaggctactggggcttggcagggttaagttccagctacttcccttgatgaccagggtcacacagttgggaaatggtggaatgatcagggctggggcccagggctcagagacctcaaagcctgggctgtcaacatcctctgaccacccttcatttctggggcccagaagtcctttgcagttctttcttttctctcttatttttatttttattttttttgagatggagttttgctcttgttgcccaggctggagtgcaatggtgcaatctcggctcactgcaacctccacctcccgggttcaagcgattctcctgactcagcttcccaagtagctgggattaccggcatgcaccaccacacctggctaattttgtatttttagtagagacagggtttcgccatattggccaggctggtctcaaactcctgacctcaggtgatccacccgcctcagcctcccaaagtgctgggattacaggcatgaaccaacgtgcccggcctaatttttttatattaatttaaaatagagacaaagtctcgctatattgcacaggctggtcttgagctcctgggctcaattagtcctcctgcctcagcctcccaaagcactgggattacaggcatgagcctccatgcctggcctctttgccgttcttgactgccccagctcaggacaggtgtttatcctgggacaacctggacaatagatttctctgagaccagtctcccagaccagagctccctttctggaatgttcccccacccccagcaccgtgattgacttctagtcaattaccaggaaatccttctggagctggggtgagtgttgttccttccattttgtagatgatgcttaggcccgaggagataagcagctggaatagggtcatgaggcatttctgcccctgtggttattatcaaaagtcccaaggcaccaccagtggtcttagatgggcggggcaggacataacgatgccctcgtggtctctgacctccaggaacagagattgtcacggggacatcagcctttagctgtgccagcaagggtgggagggagtctgtgtgtgtctggttcatcatcgccacttcttgctttgaggacagcaggccattgcaagtgggcgggcatcgtctggagggcttccgacagtgggggcggaggggcccatccacccagctgtactgtctggagggtggtgacaggttatggccatcagggctattccactggagctgcgcgggaacccaggtcagtcagttcctagacttgtggcctcaactcccccatgagatgcagaccaggctcgtgctcaggccaccaaaggacagagggaaacattcttggaaagaatttgatgtttttgtatttgattttgatttgtatttccaacaatgattcaaagtattcattgtatgggcaaaagtagtgggttggatgctattggactttcttgcttttatttttggtttagtgttgattttgaatgatctattaggtgggtcccctggttttttcagtgcttcactggtcggccatccacccacccatccaagtacctgcccccctcacccacccacccatccaagtacctgcccacccacccatctttttaaccactcaccaacccacccctcccatcccctttccatttttcttcccatctagccactatccatccatccatctgtattagtttgctggggctgccataacaaaatactgtagtctgggtgacctaaacaatagacatttatttcttacagttctggaggcttgaaggtccaagatcaaggtttttggaggatttggtttctggtgagggctgtcttcttggcttgcagatggcagtcttctcatggtgggaagatcgatctctctctctctttctctctctttccccctcttcatatatgccaccaatccccctggattagggccccatccttatgacctcatttaaccttaattatctcctaaaagtcctatctccaaatacagtcacactggggttagggtttcaacacatttaacatatgaactttgtgggggacacaattcagtccatagcaccatcgccttcccatatccctccaattatcctcccattcaccgcccccatccatacacccacccctctcctggccattttctcatctacctttctatccatccatccatccatccatccatccatccatccatccatccatccatccatcatccatccaacaaatttttatttctctctctctctcttttttttttttttttttttgagatagagtctgtctctgtagtccaggctggagtacggtggtgtgatcttggctcactggaacctccgcctcctaggttcaagcaattctcttgcctcagcctcctgagtagctgggattacaggcatgtgccaccacacccagctagtttttgtatttttagtagagatggggtttcaccgtgttggccaggctggtcttcaactcctgacctccagtggtctgcccgccttggcctcataaagtgctgggattacaggcatgagccactgtgccaggcctagtttctgggcctttggacatgcctgtccccatgtgggatgccctcccctccgtccctacctgctgcaattctggaaccccttcctccatgaggccttcccttgctagcctgatggttggtggtggttcccactcagttctctcagggcccgcttgctgtggtttttatcctctggaatggagtggcccacagtgttctatgacttttcatgggacccacaatcccagccacaaggagaaagacacttccttctcatcctcttctggcccctttgactccagcctgaaagggccttgatggggagtgggtggagagaaaaatgacatctcaggtcccaggctccctccacttaaaagctgtgacttaggaagagggggctccctcctccccacttcccctctctaaggcccagtgctggctggggctgaatactccatattggtgtggtgggtggggcattttactggtgttttattgaccttgtgcttccgtgtagccagagaagaaaaaagaaaaacccacaaaaaccccttctttgatctctcggggaaatttcttgacattttgcctgccctgtgcagccagcactcagctgtgtggccgggtttgcttgtgggcgggttggtggaggaaggaagctgagggacctttgagattgaaaaatgtagatgtcatcgaatccctccttgcacccaggcctgtgatgccctctccagcattcctgagagcaggtccccagccctttgcttacatactcttggtgacggggagctcattcactgactcataacaatgaccacgattcataccgatggagcacgctatgtgctggccactgtgctgggccctttaccgaccttaagttccttcaatcctgataagaaatccagagaggaaacttggacaccgaggggttcaggaatttgcacaaggccacatgcgtatcagtggctcagccgggccgtgaacatgaccaccgagtgcagtctcctgagctcttcaactgtagttgatactgaccctcaaggcctcgaatttgggaggcagaagagtttacgagtgaagagctaatgcgggggctacaaagcccttcctgttctccatcttcctggactaccctctctttgtgtgcagactcgctccccacaggaaggggtctctcctgcagatgtttgaggcctgcccaggttcaggggaaggatgtgaggccaggccaagtgttaggtagggagcatggcaggtgtatcccatcttgtcccaggagctgagggttcctccgaaggctgtgaacaggaaggaggaggaggagggggtttgtgggttcccccagcttccgctgcccttgggtaaagctcagctttgtgcatgggcacgcccatttggcatgacagctgctgcccctgccgcctccccctcccccgcccagtccctcttcatcctgggcttcagctgagtgtgctgggctcccctgtgccctctgacactgtcccagcagagccccctcacagcacctcctggccccccactgtccctgtgtgcttgactcacacctctgcattcctcagggtccacttaagtgtaggccctccctgaccccagcctgggccacagagcgagattctatctcgaaaaaaaagagaaataaacatttgttggatggatggagggatggccctccctgaccccaagccagctcagaggtcttggctctgggctcttggtgcctcccatggttccactttcctaacactccttccatgtgtcatgacttgtctatcgtcttcctgcaggatccccagccctgaccccagggcttggcacatagtagagtctcaatttttgaaagaataggtgaatgaatgaatatggctaacttgccccgcatactcttctgtgacagccagccattgcctcacagggccaagcttccattgtccccctggcacctccctctgctgaagtcagaccagcctctctctcctgtccatcccactcgcaggtacatcctagtcttttctttaagcctgaaaaatccaccagggttcttttgtataggaggaagtatgtgggcgtggaagggaggaaatggaaggcagtagaaggaaataggactggcccaatgcagcaagcatttattgagctctgttggatatagggttatttgggggagagaaggacaaggtcctgcctcctgggagcaacccactagtaggggaggtgacatgcttatatatatctgatactccagagggtatctgtgctaagatagtttcaaaggaggaagaatgggagcttacagtgaggaaaagcccctataccactggtctgcatccacccatccatccatccgttcatctacacatccatctacccatccacccatctacccactcatccactcttccctaacccatccatctatccacctatctacctgcccatccacccttccccatccatccatccatccatccatctacccatccacccatctacccactcacctactgttccctaacccattcatctatctacccatctacccacccatccacctttccccatccatctatctacccatccatctacccatccatccatctacccactcatccactcttccctaacccatccatctatccacccatctatccacccatccacctttccccatccatctatctacccatccaaccatctacccactcatccactcttccctaacccatccatctatccacccatctatccacccatccacctttccccatccatctatctacccatccaaccatctacccactcatccactcttccctaacccatccatctatccacccatccacctttccccatccatccatccatccatccacccatccgtctacccatccacccatctactcactcatccactgttcctccacccatccatccatctacccatctacccacccatccacccttcccccatccatccatccatccacccacccactcatccatccacgtacccactcatccatccacccacccactcatccatccacccacccactcatccacctactcgtttatccattcacctatgcactcactcatccatccatccacccacccacccactcatccatttacccacccatccacccactcattcattcattgattcacccaatatgttttgtgtatttgcattctatcagaccctagagattcaaccatgggggggcagctatcatcttgccctcacaaactcaatctcaataagacaaatattataccaatttgagacttttctacctgcttgtaagaaaagggggtgccatagtttgaattcccccagaagtagactgttatgggctgagtcatgcccgtatcccccaaccaattcctatgttgaagtcttaaccccagaatctcagagtgtgaccttattcggagatggggtctttaaaaaggcaattgagttaaaataagttcactaggataggcccaaatccaatatgactggtgcctttataaaaggaaattaggacacagatatacacagagacaagactgtgggaggacatggggaacacagtccatctgtaagtcagagagaaagagctcagaagaaactagccctgcccataccttgattttggacttctggcttcaagagctgacaattaatttctgttgtttaagccaccctgctgtctgtcgtagtttgttatggcagcctgagcagactgatgcacagactttgaggcaatgatctgagtacagttggtgatgcctggaaacaccaatttggaagtagggaagtggcagacggaagggaaggcagcttataaagttgtgttagaaagctagttactgctgtgggcaactggggcttaatccctctgggggcctctgggagccagtgcagaacagctgagggtgagggagctggggtatttatatgccaatgtccatcaaacattggtggaactgctcctggggtggtacatcttggtaggtctggcctgccacaccctggcagagcaggctctgggtgctctgagagggtgattttaaagggacccagagagaggatctgggtggggtcagatgatcaggaaagttccatgagaagatggtatttcagcctgatctggctgggtgtgaagggttcccagtgggtggaagatggagaagccacttagcctgcaggaagaacatttgtgttagtttgctggggctgctgtaacaaagtacctcaggctgagtggcttaaaccagtggtccccaacctttttggcaccagggactggttttgtggaagatgattcttcccatgaaggggggtcagggatggttttgagatgaaactgttccatctcagatcatcaggcattagagtctcatgaggagcatgcaacctagatcccttgcacgtgcagttcacaatagggtttgcgctcctatgagaatctaatgcagttactgatctgataggaggtggggctcaggaggtaatgctcgctcaccgtcactcacctcctgctgtgtggccccgttcctaacaggccatggactggtactggtccccggctggggactggggtcgcctggcttgtggcagcataactccaatcttcacatggcattctccctgtgtgcacatctgtctctgtgtccaaatttccccttttcttatttattttatttcatctgtactgtattgtattgtttcagagacagggttttgctctgtcacccaggctggagtgcagtggcatgatcatagcccactgcaacctctaactcctgggctgaagtgatcctcccacctcagcctttctgagtagctaggagtacaatgtgacatcacacctggctaattttctattgttgtagatggggtcttgccttgttgcccaggctagtctcaaactcctggcctcaagtgatccttccatttcagcctcctaaagtgttgggattacaggcatgagttaccgtgcctgaaaatgtccaattttccccttttcttttatttttcttgtcttttttttttttttttgagacagagtctcactctgtaacccaggctggattgcagtggcgtgatctctgctcactgcaagctccgcctcccgggttcacgccattctcctgcctcagcctcccaagtagctgggactacaggcgcccgccaccacacccggctaatttttttgtatttttaggagagacagggtttcaccatgttagcgaggatggtctcgatctcctgacctcgtgatccgcctgcctcgacctcccaaagtgctgggattataggtgtgagccaccgcgcccgacctctttttattttttttgagacagagtttccctctgttgcccaggctggagtgcagtggtgtaatctcagctcactgcaacctccacctcccaggttcaagtgattttcctgccccagcctcccgagtagctgggattacaggcacatgccaccatgccctgctaatttttgtatttttagtagagacggggtttcgctatgttggccagggtggtcttgaactcctgacctcaggtgatctgcccgcctcggcctcccaaaatgctgggattgcaagcgtgagccaccgcaccggccaagtttccccttttcatgagaacaccggtcagattagattaggcccaccctagcggcttcattttaactggattgcctcttcagagcccctacctccaaataaagtcacatcctgaggtactgggggttaggactccagcatatatatttttttggggagacacaatttaatccataccaacattcaggatgtatgaggggtgttagagaaaagatcaagatacccagactggctgtagtagagagtgcatgaagtgagcaatgtactagaatgccagactgggaagatggagacacagtgtgaggcctgggagtgcaggctggggaatgccgtatgaactaggttgacagaacatgttttaatgaaatatgtgtgaggccctatgataggggaggcattggtgagtggacatagaaagactcatcctcaaggagctgacttttttttttccttgagacagggtcttgcttcgttgtccaggctggggtgcagtggcgctatgcccgctcactgcaacctctgcctcctgggttcaagtgattctcctgcctcagcctcccaggtagctggtattacaggtgtgcaccaccacgcctggctaatttttgcattttcagtagagatgaggtttcaccatgttggtcaggctggtctcaaactcctgacctcaaatgatccgcctgggctgggtgcggtggctcacgcctgtaatcccagcactttggaaggccaaggcgggacggatcatgaggtcaggagatcgagagcatcttggctaacacggtgaaaccccgtctctactaaaaatacaaacaattaaccggtcatggtggtgattgcctgtaatctcagctgaggcaggagaatcacttgaacctgggaggcggaggttgcagtgagctgagatcctgccactgcactccagcctgagcaacagagcaagactttgtctcaaaaaaaaaaaaaaaaaaaaaaaatccgcccacctcagcctcccaaagtgctgggattataggcgtgagccaccgcacccgatggagctgacattcttatggggaatttagacactgtgaagattgagctcacaaataaatgtgtgattacaacagttaggtgttgaagggcaaggaaatgagtctttgtttttattggggatcacgaccaaggctctgagacagtgatgctttgatcatgatgtgaaggctgagtgggagttactaggggagaggagcattcggggcagaggaccagcttgtgcaaaggccctggggtggcagaagggagcattgcccctttggggaacagggagatgccagtgtggctagagatcagagggcaagggggacataggtgagccgaacctcactagccatggtaaggacccatcctgggagccatgagaagcctttgaaagttttcagcaaggagtgaaggggtcagatttacctctcagactactggggaactactgaagtgtctgagttaaagagtgacagccatgaagctagtttttttttttttttttgctttttttttttgagacggagtctcactctatcgcccaggctggagtgcagtgacgcgatctcggctcactgcaacctccgcctaccaggttcaagcaattctcctgcctcagcctcctgagtagctgggattacaggagtgtaccaccatgcccggctaatttttgtatttttagtagagacggggtttcaccatgttggccaggctggtcttgaacttatgacctcaaatgatccatgcgcctcggcctccgaaagtgctgggattacaggtttgacccaccgcacccggctcgaagctagtatttttgagaggttcttgcgtgttgttctagggcagaggtgcttaccctggggtccatggactcaaaggtagatttcacagggttcatgaacctgaatggattcaattattttaattagcttctagctaaaattcacttatgaattccgcccattatgaattaaggcaacaaagcacagtggtaattgtagtacacggctttgtcctcagcggaaatcatagatattctcagattatattacagtagctgcagatgttgtgaaatgttgtctgggctcatcattgctttgaaactgtggagttattttaccctattatttaatgagtttacaaagaatcacatgttactgtatctttttttttttttttgagatggagtttcgctcctgttgcccaggctggagtgcaatggcacgatctcggctcactgcaacctccgcctcccgggttcaagtgattctcctgcctcagcctccccagtagctgggattacaggcgcctgccacgacacccagctaatttttgtatttttagtagagacggtgtttcaccacgttggccaggctggtcttgaacccctgaccttatgtgattcacccacctcggcctcccaaagtgttggggttacaggcgtgagccaccgcacccggcctgttactatatgttattttgtttaatgctttgataaccatattccaaggtagttggattcctctgcattcctgcatattttattcatgaattcatgattctgtgcagtgtccacaggcttccttagaatgattaggggcacaagaaatattgggaaccccctggtctattttcattgtaactggcagaagggctcaaataagacaaaagagaaataattggctccctaacagagaagtccatggacaccctacattcagatgtttgaacgatgtcctcaggagcccatttctctccaactctggcttctgctggcttctgagtcacctccttcttaggcaagtcctgcccacaccatgcccacgctcaggctgtgatgacctgggcagctctgggcttaactagccctttcagccaggaatccagtagataaacggaggacatctttctggattgcttttgtgaaactctcagagatgaggcttattggctggcatgcctgggtcatgtgcccatactaaactaatcacagtggtgaggaacatggagtactctgattggcctgcttgggtcatgtggcaatcctgagccaattatattgatgggaagaagtattctgattggcctgcttgggtcatgtgctcatcctggaagcaaggtaggcagcgattgctgggtgacttgtttatctcgaaatcaggctggattagggtcttagtggcaggagtgtccaatctttcggcttccctgggccacattggaagaagaagtgttagtgtggaagaagtgaatttagtctaacactaaggatagtgttttagcttatagctgatgagctaaaaaaaaaaaaaaaaaaaatcacacacacgcaaatctcataatgttttaagaaagtttatgagtttgcgttgggcctcattcagagctgtcctgggccgaatgcggctagtcgtgggttggacaagcttggtctagactttcatggtctaaagttatggctctcctaattcctgcagtgagataagacccctgcagagaatgatgacaaccggtgctcatatagtgcttgttgggtgccagggactgctgtagtactttatacatatttatcttcacagtccattcagtcctttcaagaacactaggaggtgggtcctattactaacttaatagtgctaaatatatacacgtactatgtaccctcacacacacacacacacaaatagtgctgacaaggtcattatcacgcaattggcaaatggcagccctagaatcccaggcccagctcttctctataactatgttgcttttccttgcctgctaggggaccttaggcgagggttgcccctcctgggtgtcagtgcttccatccataacacaagaattggactgacagttttcgggggttggaggtggagctgggaggggcgtcagggatgagaggtgtggggcattgggtcataaggcctttgctaagtcagcctggcttggagcttctctgtttcttttcccagggctgttcccgacacagcagtgcccacagaggcctactgactgcaggaagcagtgtgagcctgactactacctggatgaggccgaccgctgtacagcctgcgtgacttgttctcgaggtaagggccttgttctctctccagggcctccttctagggagcatgaggggtcctcagaggagaggtgaagaatctggaaggtggagagcatcatgatttgatgtctgttctctgaattgtcctcctggtgcctcagtttacctctctgcatttgtgatttgatatcagccatgaccttttgcatccatactttcacagagacttaacatgtttcctgaaggagaggactcacatttttttgagtttaatcctcaccacagccctaggggaggatttcttgcttatccttactttacaatgaggaatttgaggatagggaggttaagggcctttccaaagttacaaaactctggtaagtggcagaactggagtttgagttgtggcctgacaccaagagctgtgttcttttcctaagatcacaggacttccaggaaaactgtttcagtatgaccttttattgttagtctcttattatggttagagaatgcagtctgtgtgctatctagtgtttatttttgtgtggatttttttggggggtagggtgggggaaatttgttgagatctttttgtggtctaataaataataaatgatcatgtattttcagagtgttcagtgtatgggtgttttaaaatgtgtattctgtttgttgcgtataaagttctctacatatctattaagttaagcttgttaattgtgttatttaaataatgtgtacccttatttacttttatcacctttatttctgagagatgtgttaaaatcttatctcccagtatacttgttcatctattagattttcattgtgttctttctatttttgcttcatatatgtcaaagctatgttattaggtacataaatgttcatgaatgttatgtttttttggtgggttgggctttttatccacatgaatatacctctccattccttgtaatgccttttcccttaatttcacatttgtttggcattaatattgctattccttcctggaagaagtagcaaaggttaaaaagaaagaaaagtaataataatattgccatttcttctttctttttattagcatttatctggtgtatctttgaatttctaaaagtaatgactgcattttatgaaatgaaaattataaacatttattatttaaaattcaagcaatacaaagagtgtaaggaagaaaacaaacattgccctccccagccctccatctatagataactactattatcattagatggctgacacgcctctacctctctgtataaagatgggtaggttagtaaccagacagcctgtacacacttacaaagaaggaattttaagagaatggcaacatatttatggcattaaaatgataatatttaattttagtcaaaagtatcagaaaaagaaagcgaagtgaaacagaagaatgccaaacctcagtcagattaatgtatcttcagcaaaagatactgcaattcctttaaaaaaaaaaaccctctaaaattaagaaaggaggttatgaaaatcagtaagtggttaataatcatttcagaatctactatctcttgcagtaaaggcaaaatctgcttagtttgagttttggacagtagagaatagattgactccctgtaatgaagaacaaagtaattatttttcccacctcctcatcctcttcctgacttttattccttacacaaattttactttgtcataatctataatgtttatattctcatctgcaaccataagtcccttggcatgttagccttaacattttttattattcatgatgagtttatttggcacagcttctctgttcctgagtttttcactttgattcatcatttgagtgattggattacactgtcaggtggatttttcaagaagggctcgtctttgcaatattctctgttatttcatgtttgaggatgcttgtctgttgcctatatttttgttttcttttttttctttttgagacagagtctgactctgtcgcccaggctggagtgcagtggtgcaatctcggctcactacaacctctacctcctggattcgagcgattctcctgcctcctgagtagctgagattacagggatgcaccaccacgcctggctaatttttgtatttttagaagagatggggtttcatcatgttgcccaggctggtctcaaactcctgacctcaagtgatccagccgccttggcctcctaaagtgttgggattacaggtgtgagtcaccattcccggcccaatttcttatctttaaattttaagacagggtctcactttgttgtccaggctggccttaaactccagggcttaagtgttcctcctgcctcagcctcccgagtagctggggctgcacttgcatgttactgcacccaacttacaatttttttgtgtgtctctgaggatataaattatagtcatgtattgcttattgacaggaatacattctgacaaacgtgtcattaggcaattttgtcgttgtgcaagcatcctagattagtgtacttacacacacctacatgatgtagcctactgcacacctaggttctatggcagatccttttgctcctaagctacaactctgcacagcatgtgactgtcctgaatactgtaggcagctgtgacacaatgtgagtatttgtgtatctaaacatagaaaaggtgcaataaaaatacgacataggccgggcacagtgactcacacctgtaatgccagcactttgggaggccgaggagggtggattacctgaggtcaggagttcgagaccagcctggctaacatggcgaaaccccatctctactaaaaatacaaaaattagctgggcgtggtggcacgtgtctgtagtcccagctactcaagaggctgaagcagaagaattgcttgaacctgggaggcggaggttgcagtgcgccgagatcatgccactgcactccagcctgggtgatagagtgagacaccatctaaaaaaaaaatatgatatgaaagataaaaaaaatggcacacttgtacagggcacttaccgtgaatggagcttgcaggacacgaagttgttctgggtgagtcaatgagtaagtggtgggtgagtgcgaaggcctggggcattactatgcactactgtggactttatcaacactgtacacttaggctatactaaatttataagacacatttttctttcttcaataataaattaaacaactttttcactttataaactttaactttttaaacttttggctcttttgtaataacacttagcttaaagcacaaacacatcgtacagctgtacaaaaatattttctttatagccttattcattacacttttttctactttaaaattttattattttattatttttaacatttttaaattaaaagctgagacgcaaacacctacattatccgaggcctacacagagtcaggatcatcagaatcaccgtcttcctcctccaaatcttgtcccattggcagcgtgcagtgactcacacctgtaatcccagcactttgggaagccgaggtgggcagatcacttgaggtcaagagttcaagaccagcttggccaacatggtgaaaccccatctctactaaaaatataaaaattagccgggcacgttggcatgcgcctgtaatcccagctactcaggtggctgaggcaggagaattgcttgaacccgggaggcggaggttgcagtgagctgagattgtgctactgcactccagcctgggtgacagaatgagactctgtctcaaaaaaaaaaaaaaaagaatcctgtcccattggaaggtcttcaggagcggtaaggtaacatgcatggagtatcgtctcctatgataacaatgccttcttctggatacctgcagaaggacctacctgaggctgtattacagttaacttttgttttaataagtaggagtacactctaaaataatgataaggccggcttggtggctgatgcctgcagtctcagcacttagggaggccaggctgggagaatcacttgaggccaggagtttgagaccagcctgggcaacacagtgagatccccatctctacacaagataaaatacattagctgggtgtggtggcatgcgcctgtagtcccagctactcaggaggctgaggtgggaggatggcttgagcccaggaagttgaggttacagtgagctgtgatcatgccactgcactccagcctgggcaacagagcaagaccctgtttcaaaaaaaaaaaatgataaaaagtatagtacagtaagtacgtaaaccagcaatatagctttctatgatcattatcaagtattacatactatccataattgcatgtgctatgcagcacttttatacaactggcagggcagtaggtttgtttataccaacatctccacaaacatgggagtaacgcacgtgctacgacattgccgtggctatgacatcactaggcaataggaatttttcagctccattataatctcttttattgttttttttgtttgagatggagtcctgctctgttgcccaggctggagtgcaatggcgcaatctcggctcactgcaacctgggttcaagcgattctcctgtcttagcctctcaagtagctgggattacaggcatgcgccaccatgcctggctaatttttgtattttttttaggagaggcgggatttcaccatgttggccaggctggttttgaactcctgacctcaggttatccgccctcctcggcctcccaaagtgctgggattacaggcgtgagccaccgcgcccggcttccattatgatcttgtgggaccatcatcatgtacgccatccattgttgactgaaatgttgctctgtggtgcgtgaaggtatcatttctaatgttttgttctgttttccctcttttctgcctccttgagtgttagtgctctttgcattcagagctcctcttccttggcgctggttttcctctgatgtttggcgacttctagttctgtgcacatcatatctcatgatgccggtggtctgcgaatggggcttctgaaacccacctctgagggcaatggggctcaggtggggctgcaacagtctctttgcgggaagacgcgtggcctctggctctgtggcatgagtgatgaggagctatccagagcctttcccccttcttcagagagtcccccttggctgcattctgggctgtggtctccttcactctgatcttatctgtcctctgccttccgtatttcggggagttgtcttcgtttctgatctgccaagcttgccccttcttggtctccaggcctgttacacattaattattagttttaccagtgctatttttgttttgttttgttttgtttgagacggagtctcgctcttttgcccaggctggagtgaagtggggccatctcaactcactgcaacctccacttctcgggttcaagtgattttcctgtctcagcctccccagtagcttggattacaggtgtgcaccaccacacctggctaatttttgtatttttagtagagacagggtttcactatgttggccgggctggtctcaaactcctgacctcaggtgatctgcccacctcggcctcccaaagtgctgggattacaagtgtgaaccaccactccccgcctagctgtactttttatgtctgttaaccaacctgtgatttcctgcttttcctgccagcagttgttattatctgtctttttgattcgagtcattctagtggttgtgaagtggtatctcactgtgattttgacttgcatttccctaatggctaacggtgtgggacatttttcatgtgtttattggccagctgtgtatcttctttagagaaatgtctattccagtcctttgtccattaaaaaaattaataaactatttctggctgggtgcagtggctcacgcctgtaatctcagcactttgggaggccgaggcgggtggatcacctgaggtcaggagtttgagaccatcctggccaacgtggtgaaaccccgtctctataaaaatacaaaaaattagttgggcgtggtggtgtgtgcctgtaatcccagctactcaggaggctgaggcaggagaatcacttgaacccaggttgcagtgagccgagattgcgccattgcactccaacctgggtgacagagtgagactctgtcttaaaaaaaaaaaaattaataaactatttcttagagcagttttaggtttacaggaaaattgaacagaaaatacagagttcctatataccctcaacccccttcccaatctcccacagtttcccctattttttgtttgaaacagggtatcactcttttgcccaggctggagtgcagtggtgcaatcacagctcactacagcctcaacctcctgggctcaagcgatcctcccgcctcagcctcccaagtagctgggactacaggcatgtgctaccatgcctggctaatttttgtattttttttttgtagagacgggatttcaccatgttgcccatgttttatagagatgggatttcactatgtcgccatatgagggcaaatgatcctcctgcctcggcctcccaaagtgctgggattaaaggcgtgagccactgcacccagcctcccctgtcacgaacaccttgcattagtgtggcacaattgttagcattgatgacctgataatgatgcattattattactaactgaagtccatagtttacagcagggttcactctttgtgttgcccattctagggctttagacaaacggatgatgaccacgtgcccaccatcaccgtggcatccagaatattttcactgccctaaatgtgtcctgagctcgttggttcacctctccctccccctgaacctctggcagctactgatctttttactgtctcgatagtttcatcttttccagaaatgtcatgtagttggaatgacagtgtgtggccttttcagactggtgtctttcatttagcaatatgtatctaagtttcctccatgtcttttttttatttttttgcattttaaaaaattggtacattaatttaatttttaatccaattttagtggtcaccagggggttgagctgggaggcggaggctgcgttgcggactgcacctgccctctccccctcatctcaagagctatctggagagacgccttccttctgttcccctctgtgacccctgtctgtgtcccttagacgacctcgtggagaagacgccgtgtgcatggaactcctcccgtgtctgcgaatgtcgacccggcatgttctgttccacgtctgccgtcaactcctgtgcccgctgcttcttccattctgtctgtccggcagggatgattgtcaagttcccaggtcagtgtccccacccttaactcaggacagagatctatgctgttgctgctgcaccttccgcccaccccagtgcactgttgacttccgacctcccgcttcccggagactgttggacagatcatgtctcctttggcgatgggccagggatgtacccagcacccagcccttctgctgccctcccccaccttgtgttccaggtgcagagagaccctgctgtcccctggcatagacctggctggaggaggtcttgctttggtttgaggctcaaggcagaagttatctgatgccccataaacaagaagggaacctcaagtctctgtcctgggagtttcctagaagattggggttggcttccccctttcaggttcagggcattgggagttagaggtgctgagagatctggccccaggctcaagacttgagaaacttgggtttcttttccaacttatcgtgtgacctcagacaagtttcttacctctctgacttctacttctctgatagtacaaggtgtcagggctgcttttaaccagagaaggggtatgggccacagaacctgtctgggtggagttgggaccatcttccagaagggaggcatgaggagtgggtgggctttggagcacagcacagagtggctgccgcagttgcagactgtatggagccggggagatgggctcagaggcagccctgtgtccactgtccactgaggagaaaagtgccacaaagtgcctgtggtccctcccccaaccaggtccttctctggagtcccatgccctgttgtgcaaacctggggattggcagtcacccccatcgctaccactgcctgccccttttatccttccctcgttccctcatccttcacagccagcccatcctcgagtcctgtagatttggcctccaattatcttccccaccttctcaccccgaataccttctcttatacagcccccatggcagacagccagaatgacccttgcaagaccaaatctgaatctgatcctctctctctctctctctctctcactcactcactctctctctgtctcacacacacacacacacacacacacggatatatacctgaaatgcttcagtatcttcctgttactctaaagataaggacacaaggccaggtgtggtggcttacgcctgtaatcccagcactttgggaggccaaggcaggcagatcacttgaggtcaggagttcaagaccagcctggccaacatggtgaaacctcatctctactaaaaatacaaaaattagccagccctggcagcaggtgccctgtaattccatttactcaggaggctgaggcaggagaaccacttgaacctgggaggcggtggttgcagtgagctgagattgagccattgcactccagcctgggtgacaagagcaagactccgtctcaaaaaaaaaaaaaaaaaaagaaaactccagggactcaccacggtgtccttcaggtcccaaggcccccagttgacctgccttcttctcttcatgtttcagagccttcttacatttattttgtacataatgtccagggcttttagcggttcttggcgggaggatgaggggaaaacgtgtctaagccatcttcccagaatcagagtctcaggatgtgatcccaacacagccccctcctttctcccagcttcagctctcagcaccaagccctcactctctgggctccacctgcgctgcccttcttccaggttggaggacgtgtgtgcttctctgtcccacccgccctctgcacgtgctgttctctctgtcggagacacccttccctccccattcacttagtcaaatcctactcagccctgagctctccaccccacttcctcaagaggccttccctggcctctcactagggaagctggtagcactgtgtcctttgcaaatgtggatacatacctctctctgtctcttggcttgatcaatgtctgtctccctccctggctggaagcttcctgagggcaaagaccatgcccctggtgtccatcaacatctccccactgcctgatcaaatgctaggcatggcacctgctccccatagagattcattgaattaagatatggggacacctgacagggagctccgagctggtgggggggtggagttcaaatctggtcaaattccagggtcgggggagagcgctctgctaaggaatgatggaggcctccacccataagcaggggagagtgctggagtggactgggcagcagatacctaggattttgcaaagatttgcaactgtggggcatgttcccacccgcctctggacctcggtctccccatctctcaaatgaggaggtataactgaaggccttgggggcctctccaaaaaggccaaacttcccaaaagtttccagctcagaaacttctgcatctttgtgaaaaacatcttgagttcagttgttccagccaaggcttcctgctggagggactgtctgggcagtgttcctgagactgccacacagcggcgccagaggcctccctttgctgcccctggaccccagctgcccaatgcagtgcccctggcccgtggcacgtggccacgcacttaaaatgcagctaggggccgggtgcggtggctcacacctgtaattccagcattttgggaggctgaggcaggcggatcacttgaagtcaggagtttgagaccagcctggccaatgtggtgaaacctcgtctctactaaaaatacaaaagttggccaggtgtggtggcgggtgcttgaaatctcaactacttgggaggctgaggcatgagaattgcttgaatccgggaggtggaggttgtagtgagctgagattgtgccactgcactccaacctgggcgacagagttagactctgtttcaaaaaaaaaatccgataaaaaataaaaaaaatgcagatacgtctgcattgagaagtgctgtgtgtacaatatgcactggatttcgaaaacttagtataaacaagaatataattaattattttttatattgattgcctgcaaacatggtaatattttagatatactgggttaaataatgaaaattaattgcactgatttctttttaccttttaaagtgtggctcccagaatatttgagctggcctgtgtgactcgcatatctctgttggacagcactgttttagaagtgttctaatctcagctgccaaaccctggttaatctctggggtcccctgtggactcacccatggggcagctctccggggttgttgttttttttccagctgtaaaatagaaagcagtttctgcctccagtcagccaagccccacgctaagagccttcactggctgtctctcctgaaattctcacgtctccataagacagacagtattagccccattttccaggtgtggaaatcgaggtccggagatgggaggtaaattgcccgcggagacagagcaggaaatgtctaagcttaggtgtcatcactccaccatgccacagaacacgagaggtcagcattgctcgcgctcacctccacggaaagcttcagagcgaagtcccacacatacaggccaccatttttttattttttttttttttgtgatggagcctcgatctgtcacccagactagagtgcaatggtgtgatctcagctcactgcaacctctgcctcccggattcaagtgattctcctgcctcagcctcctgagtagctgggattacaggtacctgccaccatgcccggctaattttttgtaattttagtagagatggggtttcactatgttgtccaggctggtctcgaactcctgacctcatgatccgcccacctcggcctcccaaagtgttgggattacaggtgtgagccaccgtgcctggcgacatacgggtcaccttctaagtgttgggatgggagtccagatgggtgtaaggacatagcatttaccatatgtcatgcaatgtgatgggcacctcacgtgcactcttctgtttatcctgacgacagcctggtgaagagtgtatgattatagtcatttgactgggctgggcacggcagcttatgcctgaaatcccagcactttgggaggctgaggagggtggatcacctgaggtcaggagttcgagaccagcctggccaacatggcgaaaccctgtctctactaaaaattagccgggcgtggttgcaggcacctgtaatcccagctactcaggaggctgaggcaggagaattgcttgaacctgggaggcagaggttgcagtgagctgagattgcatcactgcactccagcctgggcgacagagtaagactctgtctcaaataaataaataaacaagtaaataaaatggactttcctggcacagttaggacatagcaggcaaactgaggggcactggctagacgatgtgtgtgttttcttctccactctgcttctgtccagcattcttcaggactccttggattgcatgtagcaaaatccccaattttttagcacatgtagcttaaaagtctggggatagctctgagaagcttcaggcatggctggatccagggctccatcttgccccatctctcacctctatttccctctctgttggttcatcggcaagatacttacaagcagctctgcccagcgccagtgggaagacagcttccctttcttacatttttaatatccaaaaccaaaacctttaaatcccaaaccagaatctttaaattctacctcacaggcttgggtcacatgtccgtccctgaactggctcatcgtggccagaggaatgcaacggattgattggtccagcctggtctcatggccactcgggaaagggggttcagtcggtcccaacccctaaccacagatgctgagatcagagggagagtaattccccagggaaagataggctgctttactctgaaggggaacgggtgccaggcgggtgccacctccagatgactgctgtgttttccaagggccccatctccgactctggcctgtggtagtgaagggtgtattccgggagactttgggtccccaacactgattctgaaggcactgctgtcccccctgcaggcacggcgcagaagaacacggtctgtgagccggcttccccaggggtcagccctgcctgtgccagcccagagaactgcaaggaaccctccaggtgactccctggctttgcctcctcctcttcccccaagctggctttcagatgaggctgccccaccccacaggacgcccatggtacaactgggctgggggtgtaagcgggattcagcccatggtgtcagcactttggggtgcctctctgccaagcccctcagatcatttgaggccctagggtgtgcccagccctgccctgagcacatgggagacccacagggcttagaaaacacaggccttgctcccaggagcttacagtgggcccgccagaggcagtgggccaagggcctgggaccccatctctgtggaaactgttactcgtgagcacaggcctcccttgccccattggcagaattatcagtcccatctctggcttcttccccagtggcaccatcccccaggccaagcccaccccggtgtccccagcaacctccagtgccagcaccatgcctgtaagagggggcacccgcctcgcccaggaagctgcttctaaactgacgagggctcccgactctccctcctctgtgggaaggcctagttcagatccaggtaatttccccatgaagctgtgggtcgtctccctggggtgctcgattggtggatggcccatgagtgggggtgtttggagcaggcgggcagtgatctgtggtcttttcctggtggggagagaagacggtggtaaggtatgatctagggctgaaagcattgaggggcagaggtagacaccagagggctcattcatttgccagcagtgcagagggcctgccttgtgccggacacccgtgccccatctctccctctatttccctctacgttggtttgtcagagggaaatgggtcccactctgctgttgtgacacttgcgactcagctggccagcctctgcacgtgtccatctgatgccctcctggtctccatggcgaagggtcgaccctcagtcatttttctttttcttttttttgagacggagtttcgctcatgttgcccaggctggagtgcagtggcgcaatctcggctcactgccacctccacctcctgggttcaagcgattctcctgcctcagcctcctgagtagctgggattacaggtgcccaccaccacgcctggctaactttgtatttttagtagagatgggatttcaccatgttggtcaggctggtctcgaactcccgacctcaggtgatccgcccacctcggcctcccaaagtgctgggaggattacaggcgtgagccaccgcgcccaacctagtcccattttattactgaatagccctccatggcgtagatatgccgagctctgtttatccagtttttgaatatttgggttgtttctgccttttgactataatgaagaaagaaaaatacatctttgcgtgtatgtgctttcctttctcttgggttggttttgtaaaaaaaatggatttgtgggacttctaacaattttgggttggagctcttttcctatagttgtaccttctcccgctccatggctttgcttattctctctatgatgtcttttgtttgtttgtttgtggtttgtttttttgaggtgagtcttgctctgtcgcccagactggagtgcagtggcgtgatctcggctcactgcaacctccgcctcctgggttcaagcaattctcctgcctcagcctcccgagtagctgggattacaggcgcctgccaccacatttggctacttttcttttttttagtagagacggggtttcaccatgttggccaggctggtcacaaactcctggcctcaagtaatccacccgcctcagcctcccaaagtgctgggattacagacgtgagccaccgcgcccggcccacaccagtctttaaaagagggaggcaggaggcacccagcccctccctgcccaataccattctgaacaggagttacgctagtgtgctgagctctcagggaagctgttcccaaagttttgagcaggggagtgacagagccatgagacagggttgggggaagctgtggcatggtggcctcaggaggaacagtgggcaggggctggttggggggcaatgagtaccctcctctcgtgtggaatgcacgcagcattcctgtcctctctgagcctcaggactccctctgaaaggctggactgagctgacatgcggagtttgggagctggccacggtgagggatggggggcttcagggttgggtggggagtgaggcctttgccaaggcggcctggcctgcagcttctctgcttctttccccaggtctgtccccaacacagccatgcccagaggggtctggtgattgcagaaagcagtgtgagcccgactactacctggacgaggccggccgctgcacggcctgcgtgagctgttctcgaggtaagggcctcgtccctccccgggcctcagtttacctctctgcatttttgaaccgtgaacttccagtaactactcccccttatgtttgtgggtttttgatgggggtcgcctcttttcagagggcttccattggcatattatttccttccaggaagcgtttgtgaatcacccacctgttccaaactcggctcatcaatgtttgtaactactctgtgattcaagcattgtgatcattccccttttacagaggaggaaacggaggctttgggaagtcagggaacttccaagggctgtgggctggagtttgaacccagacaggtgccaccaggttccaggttctcgtccactccactcgctgcccctatgagccacttattctttttttttttttcccagacagggtctcactccttcacccaagctgcagtacggtggtgggatcatagctccctgcagctgtgacctcccaggatcacatgatccttttgcctcagcctttcaagtggctgggactataggtgcacactaccatgcctggctaattaaaaaaaattttttttcatacagatgggggtctcactatgttgcccaggctgctctcgaactcctggactcaaatggtcctcccaccttggcttcctaaattgctgggattataggcatgagccaccatgcccggcctgcgagctgttttgacaagcacttactgagtgcacagacacagcacgatgcaggtgtggggcttccctgtgcccagcccatcacaacctcccagcgccagcagcaccccgaggggcatgtgggcagggggtgttgctcaggccacaggctgctgtgactgttagaggccctggctattcacggaggccactgggaatgtgtgtctgtctccttgtccagagctgcttttgggcagcaaagcagagtgaagggtcaggggaggccaaaaagaaccacagacactgtttgttgtcattggaggtctctgtcctagttactaaggctgcatagcaaattttcttaaaacttaattgtgaaaacaaatcattctttgtactcacagattctgtgagtcagaattcagacagggcactgcggggacagcttgtctctgctccacaatgtctgaggtcttagctggaaagcccaaaagctgcagatcaggaacttctgaagcttcattcattcacctgccttggggttgatgttggctcctggctgcagccttggttcccttccatgtcggcctcttcgtgtcttacctggggcttcctcatggtctggtggttaggttctaaaggcgaagtctttttctctttttttctttttttgtatttttagtagagacggggtttcaccatgttggccaggctggtcccaaactcctggcctcaagtgatccgccggccttggcctcccaaagtgttggaattacaagcatgagccattgcccccggccataaaagtcttgagagagagagacagacagaaagagagagtgagagagagacagaaagagggagagaaagagtgagagagagaaagagagagacagagagaaagagacagaatgagagggagagagagagtgagagagagacagaaagagggagagagagagacagaaagagaaagagacggagtgagcgagagagagagagacagaaagacagaaagagagactgagagacagagagagacagagatagagtgtgacagagagaaagacagagaaagagagagagagagacagaaagagagagagagagacagacagaggcagcagccacccctccttttatgacctggccttggaagtcacacagaacttctaccactttctgtttgttgaggcaaccacaaatgtcacttgagaccaagggaaggaaaacagttgtacttcttgacaggtaggtggcaaaggctctggaagggccagaacatcactgcagccatgttttggggaaatacagtctgccacaaccaccatgtggacatatggagaaagaggtgttggctctgggcccagtaattccttcagctctcctaactgaaaccccacgaggcagtggagtggtgtattagtagctaaaggcatgagctctagaacccgagtgccgggttcagatcccgcctctcccacttgatagcctataacctcaagcaggtttcctaacctctctgtgcctcagtttcctctgctgcaaaatgggcatagtattatctatctcagagaaccatgtgagaattgaatacatgattgtaggttaatctgggtagagtgctgagactactgtctcacacatactcagttatcttaagagctataataataatgataatagctgccattgtcccaaatggtttcattcattgctgagctcacacacaccctttgcacaaattccccaaatcctgcccagttcccttgctctggatgttgtaagaagagactgtccagcccttatcattatcatgctgggtctctaagtatcctgctgattgagatctaccctcgcggagaggtcccatttgcctaatctactgatgcagtcgttctgtatttacctctaagtggagcgttgcaaaatattcccgaatacgtacaaatgcattattacacttattaaaaataatacctctaacatggtttttttttgcttttggaggaaaaaaaatctttttttttttttttttttttttttttttaaatagacagagtcttgttctgtcgcccaggctggagtgcagtggcactatcttggctcactgcaacctctgcctcccaggttcaagtgattctcctgcctcagcctcctgagtagctgggattacaggcacgtgccaccaggcatggctaatttttgtatttttagtagagacggggtttcaccatgttggtcaggctggacttgaactcctgaccttgtgatctgcctgcctcggcctcccaaagtgccgggattacagtcgtgagccaccgtgtctggccaaaaaatctttttattattaaaaatttcaaacatattcagatgtagagtgagtcagagatggctgcgtactatcacccagctttaaacggttatggagtcatggccagtcttggctcctctgcacccatgcccgctcaccccgtcccctggaggactttcttttaacagctttagggagagatagtgggcatatggtaaagtgcatagattaaaggatgcaatctgataagttttaacaaatgcatgcagctgagcaaccagccatccccctctaaaagttacctcgggttgcttgtcaccatttcccatcccctgcttatggtcaccatgcaatagcttgcatgtaaatgcgacatacagaataccctcgctttttgcctgccttctttcaccctgcagaattattttgagcatgctgggagagctgctcaacggcatagtcagacgagcatttattttcttgttggatgacccttggacaactgcttctctgtcttcctgggggctctctggaccccctgcccttgccatactgatctttctccgtgatcctcatctgtgtcccttagatgaccttgtggagaagacgccatgtgcatggaactcctcccgcacctgcgaatgtcgacctggcatgatctgtgccacatcagccaccaactcccgtgcccgctgtgtcccctacccaatctgtgcagcagagacggtcaccaagccccagggtaagcagttcccaccccaggcctcgaccacagggtggagtctgtgcccccactgttgtgcctctccccaccaacagccaggggtggaggcaaatgacctacaccctcggctgttcattaggtcaggtttgggttctggttatcctttgagtagtcagactcagtgaatggaatgataaaatccagttttagcattttggcaagagattctgttgattaaaaaaaaattcttcctgaaattattgggctggtaaaatctttatatttttgagatggagtttcgctcatgttgcccaggctggagtacaatggctcaatctcggctcaccgcaacctgcacctcctgggttcaagcaattctcctgcctcagccttctgagtagctggggttacaagcattcgccaccacagccggctaatgttgtatttttagaagagatgcggtttctccatgttggtcaggctggtctcgaactcccgacctcaggtgatccacccaccttggcctctcaaagtgctgggattacaggcctgagccaccatgcccagccccgggctggtaaaatcttgacctgtttgcaaggctgttttattgacttagagagatgaatatcaagtttctgaagagatttctaacaggacggttggctttaccagtgtgcaggaaactaaaaccctgacagttttttgttgttgttgttttttgttttttaagggctttgagagattttaacaaatctccaggtggtttaaaacagatggaagagtggtgacaaaaccaaggggaatggccaggcgtggtggctcacgcctgtgatcccagcactttgggaggctgaggcaggtggatcacttgaggtcaggagttcaagaccagcctgaccaacatggcaaaaccccgtctctactaaaaatacacaaattagctgggtgtggtggtgggcaccgtagtcccagctactcaggaggttgaggcaggagaatcgcttgaacccgggaggcataggttgcagtgagccgagattgcaccactgaactccagcctgggcaacagggcgaaactctgcctaaaaaagaaaaaaaaccaagtggagggaaggtcacccaatgtgactctgtgagggctgccagagaagtgaggggtgacttgcttctaggacccccagagaggctctgggcttggaagaggcaggcagatgaagagcgggagggaagttgagaggtgtgaggtgtagtggcctgggactactaaatcttcaaacacaacttcaaaatgtattacaatggcatggcatggccactgaccagtttgcacagatgatgcctgagtttttaatccccagtattgtctttttttttcctctttttttagagatggagtctcgctgtcttgcccaggccgatgtgcagtggtgtaatctcagctcactgcaacctccgtctcccgggttcaggcaattctcctgcctcagcctcccgagtagctgggattacaggtgcccgccaccacacccagctaattttcatatttttagtagagacggggttttgccatgttggccaggctggtctggaactcctgacctcaagtgatctgcccgcctccacctcccaaagtgctgggattacaggtgtgagccaccgtgcctggccaacaattgtcttcttgagtcagaacattgaaggaatatccggggaaagttcgggccactagtggggtgctgtcactctgtttgtaaagccctctttacttgggtatttggaagtgcacctgtcaacaggctagccacaccccatcaccctgaaatggaggctgccagctcacactctccgcccatgggcccagggttccctggccaacttcctactcagggaagagacccattgtgaacaggacatactaacacagcagaagaaactgtccccgctcagtgactggaatattcagtagagtccttaggattttattttgtttgcataaatgtatggggtacaagtgtaattttattacatgcttagattgggtggtgaactcaggacgtttagggtatccctcacccaaatagcatacattgtaccccttaaataatttctcatggtccacctacctatacctcccaccccctcacccttctaagtctctgttgccttttattccactctccagctccgtgtggacacagtatttcactcccacttagaagtgagaacaggcagtatttgtctttctgtgtctgaatgtctgcacttaagaatatggccttcagttccatccatgttgctgcgaaagacttgatttctttccttatgatggctgagtagtattccattgtgtatagatgccacatttatctattggtggatgcagcataaccctccccccccacccttttctttttgagacaaagtctcgctctgttgcccaggctggagtgcagtggtatggtctcggctcacggcaacctctgcctcctgggtttgagctattcttgtgcctcagcctcccaagtagctgggattacaggcgtgcaccaccacacccggctaatttttgtatttttagtagagacggggtttcaccacattggtcaggctggtctcgaactcctgaccccaggtgatctgcctgcctcagcctcccaaagtgctgggattacaggcgtgagccaccgcacccggccaagcataacccttttaaaataaatatgaatgagcaaagatttgtaagaaaaaccagccctacaaaggagaataaaaagatacgaaaccagaaattcttaccacacatgaagctttgataaatccaggaatagaagagtacttagcaacattaaattcgtgtctgcagaaaaattcacgaagtcgttacatccataaggtgggcacagaatgctatgaaaaggaacaatatgggatcagagggcaagaaaaggctttttagaaagtgtgcttgtgatcagcccatcatctctaggttctccattcacctttccatccctgccctgccatcaacgatggctccgcctttctcctctgtagggagcatgcagttaagccttgccagcagagggcgctagagggccatcgcaggaggaaggaggcttctggttgcatttgtttttttgtttgtttgtttgtttcttttctttttttgagacagagtctcactctgtcgcccaggctggagtgcagtgacgcgatcttggcccaccacaacctccacctcccgggttcaagcagttttcctgcctcagcctcctgagtagctgggattacaggcacgcgccaccacgcctggctaatttttgtatttttagtagagacagggtttcaccatgatggtcaggctggtctcgaactcctgacctggtgatccgcctgcctcggcctcgcaaaagtgctgggattaccggcgtgagccactgcgcccggccatttgtttcttcttgctcctgctgcctggcctggtgaccaccttgatgtggctctcccaatgcagacattggcacgtgccaggcctcatgtctgcaaaagtgtcctgactccctgattccctctgtgcatcccccaccagccacaggtctttggcaccccaaagtgctccaggcgtctcccccacagtggcagcctcaatttctctgtgcacctgaccagaagcatagacttcaggtcaaaaggacctaccaagagcaaagcaggattaatggaaattacccacgctacatgtaatagatgcaccaccatgattttatctacctgccggttgatggcatttgggttgtttccagtttagggctattatgaatgaaaacagctgtgaatattctttttttttttttaacatgtatgaatttatcttatatcttttattattatttttattatttttagagacagggtctcactctgtgttccaggctggagtgcagtggcatgatcttggctcactgcagcattgaactcctgggctcgggcgatcctcccacctcagcctcccacagtgctgagattactggcatgagccaccatgactggccgattcttgtacaagtctttgggtggatgtatattttcatttttcatgggtaaatacctaggaggagtggctaggtcattgtgctggtcacatagtcagaatgtttttgaggactagtcaaagctggatacctctggtctgatacaaccccttcgttttacacccagagagaagcacagggccgaagctagaaccagaatgcagggatcccaagggtcagcccagagtacttccactggaagacaccacccacccacctccttcttagttctgaacctagaatttacccagctaaattacagtcacttcagctaaattacaatcaagtttgaaggcagcataaaaacattttcagacataaaaggtccagaaggcttttcttcctatatcctctcctaggaagatatttgaagatgtaattcagctaagtgagggggcaaaaaagaaaaacaacaggaagccatggaatctagagaccagcactccatcctagcagagcaaggaagggaagtcccagaatgatgtggtatagaccagttgagccagatcagagcaggaaaatggaaggaaggctccgaggaagtgttcccaggaatagaagagagaattgtagtaaatttcatgattagtagagttgaaaagcctgaggatatggtgagggcacactgtccttttatcaacaagaaaaagaaaggcaattgaaaactcccgggaaaagaaaaagatgacaagaaatatacagtccaaatatgaagatgaaatttcacctgattttaagcgattgctggatgtacaaaaagagaatctgtttggccttgatgctgagacaattctttaaatggcccaaggactgggtgtttggatttaaagagaagtatatccatctggtaaataatattttttttagttcttaaatggaggctgagtaggcaggttcttttcttctcttccagtaggccattaccagagaacacaggcagaccaactaggggctagacaatgccttctcctcaccttcaaatccaaagaggaggaaaaggggaggatcactgactcagggaggaagaaggaaagttacaagttaggtatagtatattcagagaggggatgagaggcacccaagggatactaggttccccccttctgcacatacaggagggacagcagatctgtcgctggatttcagcaggtgtttcagcagcagctgagaccatgggcctgtctagttacatcaggctgccttggagagcaggcagggggctctctcctcatgatgctgactgggaatagccacagttaatgggtttgagcatcagagctccagtccactcaaagtaagtgttcactgaaacccaatgacctttcaaacactgattcaaatactgattaacgagcatgtaggaaccatcataacacatcgcatcatcttccccatagtctccaggctccagctaattcaggtaagagtccagtgaccttccccaaagaggggggttcctcagaaccctacaatgcaagaaataaattaatcctggctttacttttttgtctatttgaggaaaaatctgagaggcgtcacgaacactttgtagaggggagatgtgggtatgtgtgtggggttgctttgtaccacatcaaaaaggggtgcctccaccagggctctgggggtggagaggtgtagtgactgagcataacccacttctaatgtgggccaaattatcctgccccagaaaagcaggaagctttgaagaaggtgcccagtccccaggcaggaggcagtgccatccagaggagagtgctctgggctggaactcgccatctctgtttcctggctgtagctccagccctgcggctctctccatctgtaaaacaaggtagctgggtcagaccagtggtggccagctatgaactggccttcagagacattccgtctggccagcatagcaatccagccacccttcctaggcactcaagaggaatgaaattatacgttcacacagaggcacgcacaagaatactcacagctgccttgttcgtcatagttcaaactggaaacaacccaaatgtccatcaactagcgaacgggtatgtaaacagtggttcatctgtacaacagaacgccatttggcaacagaaaggaatgaagctgaatgaatatcaaaaacattatgcagagtggaagaagccagaccccaaagagtacatactgcatgattctgtcgacatgaaattctggaacagatacactcctctatagtgacataaagcagatcggtggttgcctggatctggaggtgggggcagagtgagtgaggaggggcactagggaaccttctggagggatgagaatgttctgtattttgattggagttagttacctttgtcagaactcatcaggctgtacacacttagggacattttctttttttatttttacttattaaaaatagagacagggtcttgctatgttgcttaggctggtttcgaactcctgagctcaagtgatctgcctgcttcagcctcccaaagtgctgggattacaggcgggagccaccctaccctgccaggggatactttcttgtatataaatgttgccttaggctgggcatggtggctcacgcctacgatcccagcactttgggaggctgaggtgggcggatcacttgaggtcaggagttcgagaccagcctggtcaacatggtgaaaccctgtttctactaaaaatacaaaaattagctgggcatgttggcaggcacctgtaatcccagctactcaggaggctgaggcaggagaatcacttgaatccgggaggcagaagttgcaatgagctgagatcgtgccactgcactccagtctgggcagcagaggaagactcaatctcaaaaaattaaacataaataaataaataattccttaataaagttgatttaaaagaaaaaaactttaaaaattgaggctgtatttaaacattaggcgatttcagttttctcttaaaagcaaaaggtctagcgtcactgtttcaccttcctgggtgaccacagctgttagagacaagtagcaacttctccactttgttttatttattttgagtctttctctgtcgcccaggctggagtgcagtggcatgatctcagctcactgcagcctccacctcccgggttcaaacgattctcctgcctcagcctcctgagtagctaggattacaggtgtgtgccatcacacctggctaatttttgtgtttttagtagagatggggtttcaccgtgttggtcaggctggtctcgaactcctgacctcaagtggtcctcctgcctcagcctcccaaaatgctgtgattacaggtgtgagccaatgtgcctggccagcttttccactttgatcttttgaaacacaaatctgactgtcttagctcccacggtgttgcctcgctggaagccaccagtccctgctggttaactctttcctggagacaccagcctccttggcgctggttctcagatgttacgtcccctctgcagatatggctgagaaggacaccacctttgaggcgccacccctggggacccagccggactgcaaccccaccccagagaatggcgaggcgcctgccaggtgactcccccaccccttctctctgtttggctgctgcaggagggagctgtccctgccatgcccaggggatgcctgggaggcagctgggctgggggtggaggtggggcctgggctgctcttttgttaaatgtgtgcccatctctttgctgacaccattggaaagccagaaggccttgaaacccagtccctgccctcaaaatgcctggcagagactcggggcagaggatctaggggcccaggctctggttgcgcagtctccagagaaagggaattattcctgaagacccacttccctcttcccatcttcatcactcctgccttgggcttctccccgcagcaccagccccactcagagcttgctggtggactcccaggccagtaagacgctgcccatcccaaccagcgctcccgtcgctctctcctccacggggaagcccgttctggatgcaggtaatggtcccagcccactcacccctactcccagcaggggcttcctcctggggaagtgtggattgggggagccaggagggagcttctcctttgtgggtatggtctgagaagggggattaaggttgaccccaggtttctggcttcttgagttggtgctgtggctctggcacttgctagtgactattcttttctttttgaaacagtctcactctgttgctcaggctggagggcagtggcacccatcttggctcactgcaacctccacctcccaggttcaagagattctcctgtctcagcctcccgagtagctgggtttacaggcgcttgccaccacgcctggctaaatttttttttaatttttagtagagacggggttttgccatgttgtccaggttggtctcaaactcctgacctcaggtgatccacctgcttcagcctcccaaagtgctaggattataggtgtgaaccactgcgcctggctgctagtgactattctttaattcttgtaggcaggaatttttttcacagcttcatcctcgtggcttataattgctactcagaaaataggtctttgttgattgatttcatgactttgactagttgttcgagcctttgagcctcagttgtctcatctatacaatggtaatggcagagaccgtgcagggttataagcagtgtagcattgtagacggcctctgtcagagttagctcttaggctggacgcggtggctcacgcctgtaatcccagcactttgggaggccaaggtgggtggatcacgaggtcaggagtttgagaccagcctggccaacacgatgaaaccacatctctactaaaaatacaaaaattagccaggcgtggtggcgcgcgcctgtaatcccagctactcaggaggctgaggcaggagaatcgcttgaacccgggaggcggaggttgcaaggttgcagtgagccgagattgcaccgctgcactccagcctgagcagcagaatgagaatcagtctcaaacaaaacaaaacaaaacaaaacaaaacaaaacaaaacaaaacaaaacaaacaaaacccccaagagttagctcttagggaaagatgccaggttactcattttaggacttgcagttctagtggctgacacgaggtggcagtagtgctccggccagagtttctgaaagtgcggtcccgtctggcagcattggcaccggctgggaacttgttaggaaagcaaattatgggccccatcccagacctagagaatcagaaactgcactttaacaagatctccagggcactcatgtgcacattaacgtttgagaagcacttaactggcatatactactttttaaacatctaaacatggacttcaataaagtgcaatcactagctctatgatctctgtaagtgacaaaagggaaaaacgaagcgagtttagtaccgaggtgtgaagaagtagatctagataggggttaagagcgtggccctgcagtccccccggcctggcctggcctgggctggggctctgccacttactctcagggtgaccttgggcaacttaacgaactttcgtgagcctcagctcccctcatttttaaactgaaggtagtgacggtgcctagggcatagggttggggatcattcattcagggaacgcttgtggggtgtgtttatgtgcagtggggactccatgcctgccctcatcaagcaggtctagagggttggccgggaggggactgggttcaacctcttccttcccctcactgcttggccctccccaccctgactccggccacaccagcagtgctgccagatgccggtcacaccgggccctcgtccacagtccccaaattttggtctattggacctcaattcctttgttctggctcctagacgcctcaatttctcactctctagacacagtttgcccttctctcagccttcaatagttgatcagcttcctggagccaggcgagggagggctggatgagataagagccttggcttggaaaggacctgttgttgttagccatgatggaagctgtgtcccaggagaaggaggaagtcgtctggggctggggctgtcttgtgtggttgcagcaaggcaaagagtgtggggcgtctctgtgttccagggccagtgctcttctgggtgatcctggtgttggttgtggtggtcggctccagcgccttcctcctgtgccaccggagggcctgcaggaagcgaattcggcagagtaagtggctgtgtccttggggccttggggaggacaggttgctctctgccagcctggcctgggttctttccctgcctgctcctgctctctgaggccgccacccccagccttcctcctggtgtcgtttcagagctccacctgtgctacccggtccagacctcccagcccaagctagagcttgtgggtgagtgtccagccgtccaaaggggctgcccgagccagaggaacacagggcagctctgggcccggggcgtgggctccagagactgaacttctaccccagcctcgaagctccctgtctgtggctcctgtcgcattctgtacatctgtagggatgcaatgtgggtgaaaactcatgcgtgtggagaatgcaatgaggtgaagactgtactgggtgtgacgactgtgtggcttgcccagagcagcacctggatggatgctggcatgaacgtttaaaagtctatcttgtctgtcactttttcctccagtacccccagggggcattcctgccagccttgccttcctctctacattctaccctccctttctccctctccctccttctctttctctttcccctctctccccctcttctaccacctggcaagtcagcccaggggcaggaggggaaaggagcacatggggcaagagggaccctggttctgccacttacaagctgtgtgaccctgggtgagttactgaattgtcctgtgtctcagtttcctcatccggaaaatgcagatggtagaatctacttcagaggcttggcctgtggattcgtcgaggtcgggctgttaagcgcatcgtggagtacctgcctgcaatcggtggctgctgcctattgacaggctggcctgtgcctggggctttttccttcctggaagcttcaggccttcctgagtcctgggtgcttctgaccccctccctggtccctgcactctgatccctgcccagcctctgggccagctcttccaggcagcccttgggagctggaaccctcctcacctgtccaggcagggtcgtctatacagcgtgtgtcttctagctctcacctggggcagggggctcccagctatcttgtgccaagcaccttctctctcctgggcagccccttcaaggcaggccagggtcttcctcagcactgcatggcatggattgggtgcctgctctgtgctgggctctgatgggggaatcgtctgagccttcgtttctgatttgcaaggtgggctcccatacaggcttcctgtactcccccagtgatgacctttgttctgcaaggaggaggcagggctcagcaaggtggacggctggcccagggccacacagcctggcagtggcacagccagcctcaggcactggtcctaggggttttggtttgtaaagggctcagccctgtcccctcttccttccccctgccagctctgtccaccatcgcaatgcctacccaagagccacgtgctcagcctaaggccaggccctggcccgtcccctgatctccccaggacccttgcagaggcccttgcataggctgactgttgacttgggcacaaaaacacagtccactgaggcatgttttgaatttgacgagtttcacaagcaagcactgtggtccctgtgcaaggggggtttttgtgttttgatagtttcaagcctgtttccatgacctgtcaggctgagtgtctcattgaaaccggcgtttgctttcttgacatttttctagtattagaatttccattgccgtcagtttattttttttcttcaaacctctgtgagagcagttttgttacagaagaaaaaaagaaagaaagaaagaaaacaccttcccctaagaagccaggtctacaaagaactgagccctgagactcaatggtggacatcttatctcaggtcgtttttgaccctctagcttctggtgggaccttggggtctgggttccgaggctcaagatggacagaaagtgaagccaagacaggcaagctcacagagcaccgggtgagaatggaccgagctggccggatgcccctttccctcctgagccgtgggtggtgaaggagggaaggagcactggtttattggcactggtttattggttcgttcattcatctattcacatggtcttcacggagcacttcctccttgcaggctctgtgccgggcccagaagctgttctagctccctccaagcttttagactaattccgactgcccgcagaggccaaaggcagacgggaggggagtgtgcgccccttggcctcccacatcccagacctggggcagagggtgctcttggttcctttgagcagtgagcacatcagggatctgtggtccgtgcaggtgcgatgagaggcccaccaaccagccctcgagtggatcgaccttcccgtgtgtgtcctcggtgacaggcatttgcaaagcacacacgtgatctcatccactcctccggtggcctgtgaggtacttactgttatccccgttgcacagattagcagcctaaggcacaggatggtgaagtaattcgtttaaggccacgtgctgggtgagccgtaggacggggattttatcgtggttgttgagatgtttgtaaaaagatttttcacccttggcaccattgacatttgggaatggatggttctttgctgtggagcgctatcctataggacgttgtacagcccctctagatgccagtaaccttccctacttgggacaaccaaaaatgtctctagacattgccatgtggcccctggggaaaacctcctggttgagaaccactggtctaaaattctttttttttttttttttttgagacagagtctcgctctgtcacccaggctggagtgcactggtgccatctgggttcactgcaacctccgcctcacgggttcaagtgattctcctgcctcagcctcctgagtagctgggattacaggctcctgccaccatgcctggctaattttggtatttttagtagagacggggtttcaccgtgttggccaggctggtctcaaactcctgacctcatgatccgcctgcctcggcctcccaaagtgctgggtttgcaggcatgagccaccatgcctggccttaaaattcttttaatccttcatttttatgagcacttgagtcattttctattattccagggagatttaggttgaaagaaattctttttttgttttgaaacagtttcaaacttatagaaatggtataagtatgaagaattcattttgacctgaaccatttgagagtaactgactgactggatgtctctcaccccgaaaacttcagtgtgtgtttcagacagacaagggtgtattttacacgatgtggtaaggatcgtcagaattggaattcacactgatacatgacccacaatgaattctcaggccctgttgaagtttctttatttgtcccaataatgtcctttatagcagaggactccagctcagggccacgtgttacatttgcttgtctggtttctcgagtctccttctgtccggatccgttccccaggcgtttctttcacttactgggaagagcgcaggctggtgatttcatggatgctccttgctttgggtttgtctggtgttttctcccgagtggattcaggtcatgcatcttgggctggaaggtcccaggaatgatgctggcctcttctctctcagggcgtcctgccaggtttcgatgtctccctttcctggtgctgtgtactttgagcgctcgacggaggtgatgtcctgccgggcctctccactgtgacgtctccatttgctcctcggtcattactaagtctttaggggcgttacttgagactatgtcaatagcccattcttcagcagaccttcattttctctatttatttgtttatttttttgagacagggtctggctctgtcacccaggctggagtgcagtagtgtgatctcggcttactgcaacccccgcctcctgggttcaagcaattctcctgcttcagcctcccaagtggctgggattacaggcgtgtgccacacaatgcctggctcattttttgtattttcagtagagacagagtttcaccatgttggccaggctggtctcgaactcctggcctcaagtggtcctcccgcctcggcctcccaaagttcagggatgacaggcgtgagctgccaccgcgcccagcccagaacttaattttcttcacttacatatttatatctgtatggattcatggggccctgttctgttcaatgggttgtaatctcttaccatcattttttattttggtgctcaaatggtcccagatgaggtcagggagagcccctttaagctggctcttgtgtgctttggtgtatcctcatcctgtgctttgagcacgtcccttattctgagatgttcccagcttaacttgtgtgctcctgccccggccctggaatcagctgcctctccaaggagcccggggtttgcatctcggggtacctgttgccaaagcctagctgaacctctgtgccaaattccccccttgggcctgttctgcttcccacagcactggggaatcacaggccagagaggggaggggactaaaagtggagaataacagggatggaagggaccgagagctttacatcgcatgtgagaacgcacgtgctccgtgagcgtgggcttcagagcagcctgtgacaccgtgcacttgtgcaagggggcctgctgctgcccagcatggtcctggacttgtgtccctgggggtaccagacaggcttacaagaagacagtggttattccaaaaggcaaggaaaccaacaaataagactagcagatagaatcaacatttttaggggaagagcagttatgaaatctgacctctgtacttggcaagatttgttctgggtctttatcaaaatcctcatgggttgtaacacggctcttgtcaatgtcagagccttccagattccgcctttttacctctgtgattttacacttgtttgggagagtcggtattgaactctgactttccattcagtgtgacggagtgcagagccatgttacttaccatcctgggcttttcctgaacctgctgtgtgctcaacagcatcctggacaccttctttttaaaatagtttaatttttaaaaattctaagtaggccaggtgtagtggctcacacctgtaatcccagcactttgggaggccaaggtgggtggatcacctgaggtcgagagttcaagaccagcctggccaacaagacaaaaccccatctctactaaaaataaaaaaattagccaggcatggtggcacacacctgtaatcccagctactcgggaggctgaggcaggagaatttcttgaacctgggaggtggaggttgcagtgagctgagattgcaccactgcactccaggctgagcaacagagcgagcctccgtctcaaaacaaacaaacaaacaaacaaaaaaacattctaagtggccttcatttttaagttttttgttttttgttttttgttttggagacagggtgtcactctggagtgccatggtacaatcatggctcactgcagccttgacctcctgggttcaagtgatccctcagcctccccagtagctgggactacagatacacaccaccacgcccagctaacttttctattttttgtagagaccaggtctccctttgttgtgcaggctggtctctaactcctgagctcaagtgatctgcccacctcggcctcccaaagtgcttggattataggcgagagccactgtgcccagctagtcctcattttttttttgaggcagagtctcgctctgttgcccaggttggagtgcaatggcgcaatctcagctcactgcaacctctgcttcccgggttccagcaattctcctgcctcagcctcccgagtagctgggattataggcgcgcgccaccatgcccagctaatttttgtatttttagtagagatggggtttcaccaggttggccaggctggtctggaactcctggcatcgtgatttgcccacctcagcctcccaaaatactgggattacaggcatgagccaccacgcccagtctcatttttaaaaatagttttagatgtacagaaaattggagaagacagcacaggagttcccacatgccccacacccagtttcctctgtgattagcatcttaagccagcatcgttcatttgtcaaaatatgtgaaccattattgacacaggattacaaacgaaagcccacactgtgttcagggttcccttgcattgcctaaggttccaggatcccatccaggagccacgtcacattcagtcatcatgtcgccttaggctactctggcctgtggccgtttctcagatcttgtttctcaagaccagtttccctgatggccttggcagtttttgagtattgatcaggtgttttgcgggacgcctgtctcctgggatctgtctgatgtcttccccatgattagactggagttatgcattgggggaagaagaccacagaggtgaaacgtcatgctcatcacatcaaatcttggctgggcgcagtagctcatgcctgtaatcccagcactttgggaggccaagcctggcagatcacctgaggtcaggagtttgagaccagcctggccaacatggtgaaaccctgtctctaccgaaaatacaaaaattagccgggtgtcatgacacgcacctgtagtcccagctacttgggaggctgaggcaggaggatcgcttaaaccccagaggcagaggttgcattgagctgagaacgtgccactacactccagcctcggtgacagagcgagactccatctcaaaaaaaaaaaaaaaaaaaaaaaaatcaacctgatttaccactgggcaccttcacttttgatatctcttttaatcttctcaacaagccccaaagttgatgtgattcatcccattttccagctgggaggacagaggctcggagaagggaagtaatattgtgctgagtttcaccgccaaggaggcccctgctccagggtggctaagcggcctcattgtttttgacatttggctggttttcaatttgagggttattataaacccgctgctgtgctcggcctttttgttttctttcgggttatttcctgagggtgtgttccctcaagagggatgactgggtaaagagtgtgaggtttttgttgccagatggctctttagaaaaatggaaccagcctgcagggtatgggcagctctgcgatcccgttcacccacttccccttcaaggccgagttgtgtcatttttatttattttgttttgttactttgtcacacttttttttttttattctgttggccacccccagtgacttggtaccaaagaacagttggctgcttgtaaaactcaaaatcactctggagggaccatgatttagtttcactgacgtcattgaaaagaatgtgcctcggccgggtgccgtggctcacgcctgtaatcccagcactttgggaggccgaggcgggtggatcacgaggtcaagagatcgagaccagcctggccaacatggtgaaaccccgtctctactaaaaatacaaaaattagctgagcatggtggtgcgtgcctgtaatcccagctactcgggaggctgaggcaggagaatcgcttgaacccaggaggcggaggttgcagtgagccgagatcgcgctgctgcacttcaccctggcgacagagttagactccatctcaaaaaaaaaaaaaaaaaaaaaaaattacccctggccgggcaaggtggctcatgcctgtaatcccagcacttcgagaggccgaggcgggcagatcacctgaggtcaggagttggagaccaacctggccaacatggtgaaaccttgtttctactaaaaatacaaaaattagccgggcgtggtggcacatgtcggtaatcccagctacttgtgagaattgcttaaacctgtgaggcagaggttgcagtgagccaagatcgtgccactgcactccagcctgggtgacagagtgagactctgtctcaaaaaaagaaaaaattacccctaagagtgtttcccaaactcacctagtgtccacacagcgtgttcaaatggtcagtcttgcgtatactttatcctacttgttgactgagcactggtgagcatatctgtgaggactcagggctggtggctctccagagctgctgaagtcagagatgtgtgcaggaggcggcgtggctgacatacgggcatcttggtggcagatttgtctagccagggatgtgtgcctgacaacagcatattccagatctccgtaggtagcgttctcaggagtggttaaaagctgggcatccctggaggatggtctgctctgggaactgacttgctccaggatgagttagatgcccggatgccctctcacctttctcagatggccagtgagccaaggttaaatgttaaatgtcaatatgtgcttgggcgtgacctggcccctgtttaatatgggagaacaatgggagtggagggtagaggtttgagatgagaagatagaggttgtgcgttgagaatcattgtatcagcacctcctgagcctacaaaaggatgggattgaaggaaatgagatggcccgagagcagttgtcctcctcgaaggctgccacctgggtgctttcaggcacaagaaagagaaaatcgaagtccagctggagtcagaagggctccacagcagactggcttcgggcgtgtcccaggcagggtccaggtggcatctgcaggatccatcatcctgtctccatgacctgccttgaggtcctccatgtgggttttgcctggtattccagagaattcggggctctccacaccctggagacagtaaggtgggcgcagcagccacagacgagcctctgacccagtggaagcctcctgggctctggttgggcctgtgcttctcgtgaaccaatccttgcatgtgcgcgggggtgggggttgggagagtggttcagtgtgttcattggtttagtcattaggaatgagagtggcagccaggtgtggtggctcacgcctgtaatcccagcactttgcaaggccaaggcgggcaggtcaggaggtcaggagtttgagaccggcctggccaacgtggtgaaaccccgtctctactgaaaatacaaaaaaattagctggggttggtggcacgagcctataatcccagctattcgggaggctgaggcatgagaatcacttgaacccaggaggcggaggttacattgagccgagatcatgccactgcactctagcctgggtgacagagtgagactccatctcaaaaaaaaaaaaaaaaaaggaatgagagtggccaggggatagaggtggtcccctgtcctccatctgccactggagaagtgagcctccttgccttgagctggggtgggcactgactctgaaacccatcgagggctctccagactgaggacctgacccctgggctgagttcagcaccacctgtgatccaggaggaccatttgccaatagttggggcgggtggggccgggggctgccagactccttggtgaagttgctgctcttgctttttgcagattccagacccaggaggagctcaacggtaagtacccctcccttgcccccacctcagcttcgtgcccctaaatctgactccttccctaacagatctgaagttttgagagctgctgggggaagggagagggaggggacggactggccattcccctcccacagtgcccagggtgcaggcccgtcctgcaagttcaggctgagtctgacccaccacagggacctctgtgcacagaggcctcgcctggggcctcagccaggccttggctaaggatggagagccccaccctcatagcagcctccagctcctggctcagcctgccgggaatttccagaagggcctgcacacagtggatttggtttgggccacttttgggtaccaggtctggtcaggaggaagactgtgttcattttccccttttctttactcttccatgaatctcatcctccaagctggatgacagagcaggtggctatggtccattcctttttttttttttccccatctgtcagttcttccattactttcttttaattcaagcattcatacattaagaagggtttctatcctttcatttttcaatataatatacacaaccataatgctagttcagtttcaaattatgggggatcacattcgaatatgcttggatgtgacaagtggctgttacaatactgagaaatttcatgaaagaggtattcaacaatttgtaaggtaatcaaatatgtttttgctgcataggccaatgcattaatagtaacttgttttaaaatgcagtcttttggccggatatgatggctcacacttaaaatcccagcattttgggaggctgaggcaggcggatcacctgaggtcaggagttcgagaccagccttgccaacatagtgaaaccccgtctctactaaaactacaaaaagtatccaggtgtagtggcacacgcctgtagtcccagctactcaggaggctgaggcaggagaatcgcttgagcctgggggacagaggttgcagggagccgagattgcaccactgctctcccagcccgggtaacagagtgagactccatctgaaaaaaaaaaaaaaaaaaggcagtcttttagccttcatattattatgaaagagtattcaagagtatgtattaaggttggtgccatttgccattaaaagtaatggcaaacctggtttaacccttctgataggtagttgtggatgttggggttgagaacagaataatctttgtctggagtgacaccacactctagaatttccactttgaaaaatactcagttctttttttttttttttttttttttttaatttttttagtatttattgatcattcttgggtgtttctcagagagggggatttggcagggtcataggacaatagtggagggaaggtcagcagataaacatgtgaacaaaggtctctggttttcctaggcagagggccctgccgccttccgcagtgtttgtgtccctgggtacttgagattagggagtggtgatgactcttagcgagtgaagaatactcagttctaagctgtggttcctggtagaacaaactttatttttctagctcagcagtgatctggaagctgaggaatctcagcgccttttaaaagttattatgtggttttgttttaaaaagctcctgttttgggaaagtagaatttatgggtataacatatgttcattatttgtacataaaataaaaccatttaaaaagtaaaaaataataataataataatggcaaagacgtgattacttttgcaccaatctaaaagatacgccctctgtgccttgagaatcattgcgtcagcacgggcatccctgcctcctctgaattactcacactcactccattttgaaggcatcaggacatttcatgaggccacttctttgcccttacctgtaaaaatcaaaaactaaactgacactttcctcatgacatagctgtttttttgtttttttttgttttttttttgttttttttttagcatttagaaaatatttattaataatatacatgaatttagattatatagtatagaggtcaccgggcttgtcacttgaactaacagtagtctgtttttagaatgcttgagtgtgatcataaaagactactttccaggatgtcggggctggggagctggaggggctgctccaggaggtgggggacctggagctggtacttacagacttgggtgcttatgagtgtgggttatggaccagatgccagggttcaaatcctagctcagatacttattgatggtataaccctgggccaattactcgactcctctgtgcctcagtttcctcatctgtaaaatggggagtgggctgttacccacctcatacagtggttgtgaggattaacatatgtcaaggactttaggacagggccaacggacgtggcgagcaccctgtgagtcgctgactgttacccctactatttagtacaaattaaaagcaacagacttcacccagaaagctgagaagcccggggcagctcatggcagcttttaaagcagaaagggggactcactggggtctgtagagatgaaaaaaaaaaggggcctcccagttcagagactggtggggaggttgggggtaccctgcagcagcacccattcccgtcccacagcagctgaggagtggtgcgtcggtgacagaacccgtcgcggaagagcgagggttaatgagccagccactgatggagacctgccacagcgtgggggcagcctacctggagagcctgccgctgcaggatgccagcccggccgggggcccctcgtcccccagggaccttcctgagccccgggtgtccacggagcacaccaataacaagattggtgagtcagcctgttttgggaggtcccctgcagcccaggggcagatgggagatgaatacggggccctgggccctggaagggacctggagaccctggagttgaaaggcccaggaaaggagaggcatagattcttcaccccaattgaagtttctgtaagtagggacagcgagggtacttacctcgtaggccattgtgcggattcatgagccagtgtgcatgagatgcctgctgttactcataaaaaacgaacaccaccccagcccccaacaccgagcacccgaggggacaggaggaagacgtgccagtggtcacaggacctgccacttgtctggcgcattccgggcactgtgtaggtgccatctcttcatctctgatggtctcaccaccttctttggatggtgtctttctccccattttacagttggggagaccgtggctcagagggtgaagtgattttccccattgcatggctactaagtggcacagctggaactcgtcccgcatctgctgggccttgaagcccgtggtttgtccacgttaccacccaccctctgcagaagcaggaggacagatggggcccagatgttcagagcttcccaacggcagctgctgccagcctggacagacattggctttggcctcctgtgggcctccctgcctcctctcttgcttctcatcaccttggtacggcattttccccaaaatgtatacctgaccctattgcactcctgccgagaagcctccagcagcttcccattccctatgggatgaattccagcattcttattccagcactcaaggctgacagcaagttgtagctccccgaccagactcacctaccttctgaccccacagtctgtccctccccctcatggcagtctcccaaatttacagacccctctgtcacttctgagcttctcaatgggagctaccccctcgcctgaaatagccaactccactgccttgaatccagttaattctggatatcctggggaccctgcttatttgccccttcctccaggaagccttctgtgccctctccaccatgctatgctccctaagaacccaggcctcccctacccggtgtcctagcacccagtggtgtgactgcgtgtttatagccttcctccacctccacctggctttgtgctccctgtgggcagggccttggtggaccccacctctgtcgcttctggaagggtaactggcactgggataatactgaagagtcatttgtaattgtcctgtgcatttctatggcagacagtggtggccagaactcttcagggcagtcatcttctctttttattttttcagcctcctgagtagctgggattatgggcgagtgtcatcatgcctggctaattttttgtatttttagtagagatggggtttcactctgttggccaggctggtctggaactcctggcctcaaggtgatctgcctgccttggcctcccaaagtactgggattataggcatgagccaccatgcccagcctgggcagtcttttgtaacaaactgaagcttttgaaatggtagcttttagtaagttttatttgaaaagtatgtattttgggaaataccatcaaaggcttcttcagaattcctaagaagtcctaactggaacttctgagtccacactgagtacagtgcctggaatcccaggggtggggttcagagggtgtttgatggggaggagaaggaagtaccaggctcccaggcagctggctcaggtgtgggctgccctcccctggcatggcctgcaggccttgctggtgagtggatcgggggccacctccgccatggtggaaagggaaggccttggaggttctcttgggcacccaagacacaggcaacccccttgtcctcctaatgccagcccagggtagcgttcccccttcccatccagttcccaagaggggtcacactggggtctgtacatcgtccctcttcccctgggaaccaggcaagggaagaacccctttccccccaacttcctcacctgccctccccacatagccaagatgaattccctggactctggagctctggggagggggcaggaaatccatgcagcccttggaagccacccccacagcctggggagtaggcagcctgtgatgggggcagagccagagcggggcagacccctcatggccggctctgaagtttccagacccctctttcacttccgagctcagtgggagctgcttcctcacccagagcagccaattccaccgctttgaatccagttaattccagatttcctggggactcctgcccatttccctgaggaatgtgaggggaccagcctgtccccagctgtggctccttctccctaatccagcacccccaccctcacttccctcccacctgaccccacccgcctctcatcttctctgcccatccccctctgggccttctctcccctcctggggtctcctctctcaccacccccggcccccatcttttgcccagccctctatagggctcctagggctgggagcccacaagcctgatggaggtgtggggagtgctgaggccctgctctgttttggggtctgtgggggcgcccagcccatagcctgtcccgcactctgggccttctcctcttgctgccgtttggcgcacttctctctttcctgggggtgttcaaaaccagaatagaagaaccagcgtcatgcaatagggttgagggtgtgggggactcgagaacctttttggggttcctgaatccgaggggtataactgcattacccagaaaggcaggggtccctgcacccccaccccaccccagctctcaagttccctcttgagcttccccattctggcctccagagtccagcgcagaacagctgggagccagcccaccctgagccagacaccatcagctgggcggaggccaggcttccccactccccagctcctcgggccactgaacctgagcccccatgtcccctctatcagaaggccacaccagaagcccccacatcagactgtggcgaggaccggccctccgtccaagctcccaccatgtgctcacagcacagccatgcacgctgcaggcaggagaccggctgtgagcagtaagccccgaaattcacggcctgagccaggctgtctcaatcatgggctgccgagacctattgagggggccgggttttctgcaggatgtgacaggctggctgagtttgcccggaccgaggggactcccaggacacgggacttgcagtagtagaaccaggaatgttcccgggcaagctggacaagttggtcaccccgggttttggctgcaggcacacagataggagcagaaagggccaccaggcggagtgggtggtttttttttgggggatttctcctaactacgtggcgaccttgggcaggtcatttaacctctccaggcttcagattcttacctgtaaatgggaatcttgatggggtccgccttgcaggagggctggggacccaggagtgggggtgtggaaactgctcagctctgctgtttctgctcgtgctctggttacccacggctttgcctgtttttgtccacagtttgctttctgtcccaccctgtcctcttcttccctacccatccgcagagatgtgctgagaaaatcctaagtacaagtgggctggttcttaactcctcaaggcccagctcctagctgttctatttcctctgagcccccaggatgcctgtaaggtacatcagagaggctgtgccatcagcctgaagccacccggcaggtgtaccagcactgggcctcggcccttctctgcctctttgctcccatcctggctggtgctctggcctccctcgctcacccatccttttgccttgcagagaaaatctacatcatgaaggctgacaccgtgatcgtggggaccgtgaaggctgagctgccggagggccggggcctggcggggccagcagagcccgagttggaggaggagctggaggcggaccataccccccactaccccgagcaggagacagaaccgcctctgggcagctgcagcgatgtcatgctctcagtggaagaggaagggaaagaagaccccttgcccacagctgcctctggaaagtgaggcctgggctgggctggggctaggagggcagcagggtggcctctgggaggccaggatggcactgttggcaccgaggttgggggcagaggcccatctggcctgaactgaggctccagcatctagtggtggaccggccggtcactgcaggggtctggtggtctctgcttgcatccccaacttagctgtcccctgacccagagcctaggggatccggggcttgtacagaagagacagtccaaggggactggatcccagcagtgatgttggttgaggcagcaaacagatggcaggatgggcactgccgagaacagcattggtcccagagccctgggcatcagaccttaaccaccaggcccacagcccagcgagggagaggtcgtgaggccagctcccggggcccctgtaaccctactctcctctctccctggacctcagaggtgacacccattgggcccttccggcatgcccccagttactgtaaatgtggcccccagtgggcatggagccagtgcctgtggttgtttctccagagtcaaaagggaagtcgagggatggggcgtcgtcagctggcactgtctctgctgcagcggccacactgtactctgcactggtgtgagggcccctgcctggactgtgggaccctcctggtgctgcccaccttccctgtcctgtagccccctcggtgggcccagggcctagggcccaggatcaagtcactcatctcagaatgtccccaccaatccccgccacagcaggcgcctcgggtcccagatgtctgcagccctcagcagctgcagaccgcccctcaccaacccagagaacctgctttactttgcccagggacttcctccccatgtgaacatggggaacttcgggccctgcctggagtccttgaccgctctctgtgggccccacccactctgtcctgggaaatgaagaagcatcttccttaggtctgccctgcttgcaaatccactagcaccgaccccaccacctggttccggctctgcacgctttggggtgtggatgtcgagaggcaccacggcctcacccaggcatctgctttactctggaccataggaaacaagaccgtttggaggtttcatcaggattttgggtttttcacatttcacgctaaggagtagtggccctgacttccggtcggctggccagctgactccctagggccttcagacgtgtatgcaaatgagtgatggataaggatgagtcttggagttgcgggcagcctggagactcgtggacttaccgcctggaggcaggcccgggaaggctgctgtttactcatcgggcagccacgtgctctctggaggaagtgatagtttctgaaaccgctcagatgttttggggaaagttggagaagccgtggccttgcgagaggtggttacaccagaacctggacattggccagaagaagcttaagtgggcagacactgtttgcccagtgtttgtgcaaggatggagtgggtgtctctgcatcacccacagccgcagctgtaaggcacgctggaaggcacacgcctgccaggcagggcagtctggcgcccatgatgggagggattgacatgtttcaacaaaataatgcacttccttacctagtggcccttcacacaacttttgaatctctaaaaatccataaaatccttaaagaactgtaa

SEQ ID NO: 2106 - DNA, 33859 bp, Homo sapiens
  source 1..33859: mol_type = genomic DNA
cgctcgcccgcgcgccccaggacccaaagccgggctccaagtcggcgccccacgtcgaggctccgccgcagcctccggagttggccgcagacaagaaggggagggagcgggagagggaggagagctccgaagcgagagggccgagcgccatgcgccgcgccagcagagactacaccaagtacctgcgtggctcggaggagatgggcggcggccccggagccccgcacgagggccccctgcacgccccgccgccgcctgcgccgcaccagccccctgccgcctcccgctccatgttcgtggccctcctggggctggggctgggccaggttgtctgcagcgtcgccctgttcttctatttcagagcgcaggtgagtggccaccttcccaggggatcgcggctgagagcgcccatctccttcccccgcacttggaaactgagtctggcggcagggctgggccacccagagcttgcatattccggaagggaaagtgactccagaagggagagaggaagtgttgagtttggggacaacctggcgcagggctgtcgggcgcaccctgctctctctccgcccacgcaccccagcttctcggtgctctgggggcggactcccctggccggacgatgggtttgaatctcaccccgtcccttcgctgggaaacaacactggcctctcaccttttctggtagtgattgcatactttttctccctgtcatttctcacttgaagttaagaatcaacttctgttcacgtaggaaaaaagatgagcgccttcacttgggcatctacctttcccttcccgcccaccacccggcgggtttcggttcctgcgcctggctgctctgcaggtgtgctggggccacggtgctggagggctgcgcggagcgggaggtcgcggtgctcgtgcccaggtcgcccaatgggtgggcagaatgacacggcgcgaccagagaggcgcgggctcgggatgggggctctgcggctgtggcgctgtcctgtgggggtgaaggaagagggacagccccacgtgcctgctagggatgtgggcggaggaaggaagcgaggtgagtgtgatggcacagtgttactacagtctagcaaataaccaaccttcggaaagatgaagaggttttttgcacgacggctaggaactgcagagagatagtaggaaggaaggggtaaatttgtaatattatgctttctggtggtttatgctcttgtgttttcttggaaattgcagtgcagttggttggattcattcaaatattcttgtctggtgctgtgaactctttctcagaggaagtggggggctgactgtgcatttttttttatgggaaaagaaagttgggtttggactacattcgttttcagattcaaaggtgattactaaaccaaacgggatgcatcaaaacatggcattgcttggattgtatggttttttgacatgtgccaatgtctcgaactccattacttttaatcataggctttttgttaagtattcattatccgctagtttgcattttctagaactagtgtgattacctacttaaagtagaaatgcaatgagccacacttcagaaaatctgcattaaatataatctactcattgagagttttgttgtttctaaaaagacaacttttgagtggtttgcttgcaacacagataacaaatctatatgaaagtgactaaacgtctttctttcattggagtgtgttgcaataagaatggcttacccattttctcatccagcattttgttaataacccccatttagtgcttgtgcatggagtgccagcgttgtgcgtggcaccgtcacctgcgatggaatgagttaagaatcatttattcaacagacagtgtccacttactatgggcatggagccagatagcagagtggcctaataaaaccattaaaattcttagtcaaacaaaagagcaacaatcagaaaagggatcaaagatgcagtagttctccactgtttatcttttctaacaccttcgggatatggcattttcattgccataatagtgaagagagtgtccaatgttgaacgagcagtaggaaatgaaggagttctaggaaccatgaacagcttggcttggcaggagctgtggaaatcggtggcatggctgtgtaggaaagagtgacctgctgggctcttgttagagttgttcagcttttccctaggaattctcggtggtccccgtgggtgaggagtcagggctttcagtgatctcccatcatcctttagcagtcttgatgctgtatggatgatagtgaaacattcagaaccccttttcaaagtaaacgtgtgagttagtaagtctagccagaaaatatacctttgaagaagttaatgtcatcagacttctgggtacggttttcttaaataccatgaaaattcggttcctttgacttgtgcaaaataatttagctattattctgaacccaattttgtattgcattttaaaaaggctatctccttcagtaaagaaaaaatattaggaacaatgtgttcatatgaatataccactagatcgggatgcattttactggatattgtgtctacaattgttacccaaaggagtcctaatcattttgagatacattctgaaatatttacagataaaactgctttggtgtctggaatttgtttcaaaataatttctggttgcttacagatgaaaaaagatttgccatacattggtaatagctgaagcgctgatgcgtgcctaggggttcactctgtaattctttccccttttatgtgtgttagagatcttctttcaaagtcttagctaagagaatagtctccatttgacttgccgctgatttaacattttcacttatatcggctcttttggattggaacttggtaccaaataaatcagtagttttttgattcccactaaagttgtgaatcaactatctgaggtttctaaatgcatttgaatgagaacaaactatctagtaacatgtttgtagtttacagttaaaaatgacgaattagttttattgtttttgtttaaaggtggagaaaagaaggtatgcaagtcctcaaggaaaagcagtttgagtttttaaatgcatttaaaagaatgcccagaatagtgtaaaaattacggtgacggttaaaaagttttgttttcttaaatgtttgaatagataaaattgaatcagcctcctaaatgtttgcagattgcatgtgcctagatgtaaaaaatacatatctactagatccggtgtagcttggcttttcccccaccaccctgccaaagagaaaatagtgtgtggcttctgctatatatttaccacatagtattcatactttggtttacaaagaaaaaaaataaaaaccctttcaaaaagttgctctgtgtgtgtgtgtgcatgtgtatgtgtctttaacatccatataaccatattcaaagcttagggtttagctataaagataaacttttcagaaaactgaagatgttttgcccttttaacttcttccctcgatcccccaatatgcacaaaccaacctccctggttgtttgttacccaggacagcagtcactactgaaaatctgatgtagaggtgtgcactgcctgtttgaaaacacagataacgaagtagcacaaacgtcaagcatcctgcctcatttaaccctacaaatgattaagtttcaaggaagttaaaaaaaatgagacagtgtatttcgtaggcacattatctgacaaatgcattttaacagtccattttaagtcagatattcaagatttacttaatgttttcagacgtgtctaagtacaatgaattcattggttactcagtttactgtgacttttggttgaatttctgtgttcctcaatgaagtgtaagttccatgaagacagggactgcttgctttgcacaccaccttattcatagcatctagcccagtgcctggcatgtctaatttactgcaaagtcttttctaatgatttgcaacactacagatatgcccatttctgattgtaatatgcaaattatcagattagtggctaaaatagtatcatttttcaatcatgcaatcctccaaccagactaatgtgtgctagtaggtaggttgttgggtaggcgatacattcgttcagtcagttcgtgggcatttgctgagggtccagcatcagtctggctccctccctgctctgcagttccttcagcttagaggccctcatttacctgtgtgtgtggctggccttgcaccctgaacctctcctcctccgttttctcctagtctccattttcaggaaaggagagctgcaagggcattggaatgagaaagacatgtggttgtaggttaaaaataaatttctaatgtgtgatccttgagtaaacaaaataaatgagtatattaaaagcaattattccatgcattcttgatttcttttgggaaaaaacagtggatggggttttatacatattttagctataatgctgccttccaaaacagtggttctcaactgcacattgaaagtatttgggaagaggttcaatgattggacacttcccttagggatgttgatgaaattggccagtgaggggtggggtaggaatgagatgggatctgggtgtgggcatttttttaagagaaaggggacaaaatctttgcattgtacttatttgcatcaaatcagtaaccattattaactgtttcagtatctttgtactaattgatgttacttgtgaaacaattttaaaattggtgtcagggaactttggaatcgtttcaatagcagaaaatctatattttaaagcatgacttctcaaactttaatgtgtataagaatcacctgggatctagttaaaatgcatattctcaggcagtatgccaaagtaaagcctgaaattctacatttctagcaagccctcagggagcccacgatgctactcattggactaccctgagtatcaagaatatagggttcgggtgcagtggctcatgcctgtaatcccagcactttgggaggccaaggagggaggattgcttaagcccaagagttcaagacaagcctgggcaacacagcgagaccccatctctaccaagaaaaaaaaaggaagaaattagccaattagccaagcatggtggcctgcacctgtagtcccagctacatggaaggctaaggaaggaggattgcttgagcccagggatttcaaggctgaagtgagctatgattatgccactgcactccagcctgggtgggggtgacaaagcaagaccctgtcttcaaaaaaaaaaaaaaaaggaaaagaaaaagagaaagaaaaataataaaggggactgctgcttctcttagacagctcttagcttgtcagcaggactccagcttaacctagggtccccaggcatttccccactaaggccacattattcctttggctcagcagttttctggtggtgcgtcagttcaggcctttgcatgattcttctttcctgaggtctaaacccagtgacccttcatatcagttgcctggacttttctggtcttgtgggatacacaccggcataagtaagcccttttttttttttttttttttttttgcaaagtgtctgattgaaaactttccttgtataaaaattcacatattatgacttgtattaattattctaaagaatataggaaaaatacagattgtacacagttttgcttcacggtggtatctcttccatgatgattataggtagtccttatatgtgcaagactggaataataaaatttgtattagtgagtgtacatttgttaaaaggctgtcatttcattttgagaatctcagatatggataggctctttttagtttatttctaatggttggttaataaactaacacatcattctgattaatttttaaaagagagaaagagacttgtcattaatttgactgagctttgtaatctcacgtagcttttctttttcgcttagtttgtacatgctaataagaaaatgcaggtgaagtaccttgaatatttaacaaacaaagaggacaagttaaattctcattattaaaacagatgatagctaattattgttaccctttacttcacagttgaaaccaccacaaaggcttggaaggagcaggcagacaattttaaagagtagtgattaaagatattctaatgctggacacctattcttaacaggcaatcagctaattactcaatgggtatattttgggtgggacaattccttacattacaggaatcttagcatccctccagcacacgtctgtaatatctgttcatgcagcctccccaccctaacgtgatgacaccaaatatcacctgcatccattcccaaacacccgctgacaggtataccattccagcttgagaaacactgatgagagggtcaacaaaaaagacagatgacacgtctgacttcaagttttgtttggaggtaaaaaagtggatttttctctcccttctttggctgattaaggaaaaaaggccaggccaacatggtggttaaagatgatgttgatttcgcctgttttatataggtttcatgctctgaatttcaaagtgggcctcataatcccatctagcatgttgcatatagttgatttaaagacaaaaagcttcctctgccttcagtgaccacatgtgatttccttggtgcccctcccctctatgaacactttcatgttgttagacaagtttgacaatttcccccatgaatcacgcacatacacttctgtcattgttaaaagcccatcgcaggactaactgtgccttgtcctgtggatgatagtcagttactcgttcaaatgaattagaagtcaacgttttcaccatcttgaggttcattgtattaactattcattgttggggacataaagactcttgcgagtatgaattttttgttcttaagtcacactgtattaaatagcaggatgactagtgataagcactctaacgtccttactgtttctcctcctcagatggatcctaatagaatatcagaagatggcactcactgcatttatagaattttgagactccatgaaaatgcagattttcaagacacaactctggagagtcaagatacaaaattaatacctgattcatgtaggagaattaaacaggcctttcaaggagctgtgcaaaaggtaagtccacatcgaggctgataagtcaagggcccttgctgactctaccaatactgaaaattaaaactggctaagtgctgttgactctgctctttttattctaataatttgtaaaagagctacagggaatgctttaaagagattagcagaattattttgaagttggtagtgattgattatggcaatcagggacgttcatgcaaatattcttttctttcttttcttttttcttttaaagaggagggatttaaattcacacttaaattcacaccttaagactaaggtggctgtggcctgtctgtgagtcagtatgctagtttgaattccctgacctaaaaaccatccgctcagttcacaggactttctggtagctgtttcctttctgtttggcttcgtaatggcagggccccttattccacatctgttgatccagggctctgatgagaagcagttgtaactcttggtcctttgctgtcatctgtggtgaagtaggcagagcaggaaacaatgtgagatggagattctgtgtccgtgttctcattttctgggagagctgagtgacaagagaagagttagggacagagaagaccaatgacttctcttacaccgacagccccagttgggaaacactgtaataactgccagttttactttcctggacaaagccacttgagaattctgcagcccaagaattattttactcactgactccaccaaaacccgggtagaacacaaacagtgaccccagtgcaaaacctgtgtgtacgttatatacctgcatgcatgcatccacttctacatcccagcctctgtgttgcaactccctgggtctctggtcattccagagtaactcttgaagttctcaaagcccttacctctaaatttaattctaatgtagtttattttttaaaaatccacatatagtaatataattatttaaaaagaggacatgtgtcagaggtagaggtaggaagatgtagctgttttgtaaagccagctaacaaaggtgaacgtctgtaataccatcagaggtagaggaaggaagatgtagctgttttataaagccagctaatgaaggtaaacgtctgtaacaccctgatagttgagatttgctgtattttatcgaatctaagttaccaattttcagcctactttgttatttcatgcatcactaagaaagaagaaactgttgattaaaaaaattaaacatgatcatcataggttctagaggttctagttgtatcttaattccagagatatcaaaacgttaaaaagttgtgcattatggaatgcatgaagtacctattagtttaatgtgtctataagaaaacacattgcttatgaaaattactttttcattatcattagtgtgtaggtgtttggcttcacgcagaatagatgtatatgtttaaattcagtgatccttaatgttacagtgtaatttttgagcaacagcaacagcaattctgttaatctattcatttttattgttctgttttatatttcattttcattcgtttgcttattgtcccacttgtgaagcttatctcttaaatactgagtaatctgtctttaaacaacctattcacatgcactaggggcaatctgctagttcaaaatggcatttcatattaaggtaattctggttgggcaaaagattgtgccctaatgttctgtttagattgactcatgttgtaactcctcaaaatgatgagataaactttttatttcattggtgtgctggttcttaaaagttaccctttgagttccttatggaagaataagtatggaaaatcagccaagttaattctgaaaataaataatattacgaacaagggcaggcacggtggctcacacttgtaatcccagcactttgggaggccgaggtgggaggatcacgtgagtccaggagtttgagaacatgctgatcaacatagtgagaccttcatctctacaaaaagtaaaaaaaattagctgggcatggcaacctgtgctgtagttccaactgctcaggagactgaggtgggaggactgcttgggcctgggaggtggacgctgcagtgagctgcggttgcaccagtgcactccagcctggcagcctgggtgacatagcaagaccctgctaaaaaaaaaaaaaaaaaaaaagaaaggaagaaaggaaggaaggaaaaagattattaacattatttatgagactgcaagagtggttcaataccaacgggttaaaggaaaaaaatatattatcatcttatagatcctgaaaagtgattgacaaaattttgcactatttctgatgtttaaaatccattagaaaacagaactggatggattcttgatgttattacgaatgtaataactttttatgtttttacataaatgtaaaattttaaataacattttacatttagttttaactaaaagttacctaatgattaaacataagagcatgtttcttaaagtcaggaacatgaccaagatgcccactgtccctacgttatttagcgttgttctgaaggtgccagctaatgtaattacacaagagaatgaaataagaaaatatatatagagaaaagagggcagaatttgcatgtgatataattatatacttaggaaaattcaaaagaagctgaaatgctacaagcaggataaaataaatcagtttgtaaaaattaataagtaataatcactagctgtccttatttcaaataactagaaaacatgagtgaaagatttcactcataatttttaaatgctctaaaaataaacataacaagaaatgtacaaggcttataggaataaaactagaaacctctacagaggcatttaaaatacaattggataatgtaaagacataactatgcacagtcataatttttgaggtataacttgggccaaggacagcagacaaatccatggaagagaacaagcggcttactgtgtgtctctctgtgagtgaatgtatgtgtgtatataatttaatataatacaacattactttaaataagtgaacatattctgaattcttaaaaagcatattgttcatccttttttaaaagttatagtaatttctcttgtcctaagtaaaaataaatcccagattgagagagtacttggtagccaattgttgctcactggcagtagtgtcccttaacacttaatgtggcttcactgaacttttctgccacctcctgcctcatcagaacattatcccacttcgtttgcgatttctaagtgactccttaggtagtatggaaaagcaatttgtatgtaaaggtgttagtgagcaataatggcagaattttcactattttaggatccttttggagacatgatgcctcattccaaatgagtaacactaataatgagcgattcactacttggcaaaccataaggagaaaattggtggtcaggcaagaataatcaactgcgcttattaagggcacgtagtcttaattatactgataggttattatgactcacaggatgagtagaactttatttcatcaatttcacatttgcttttgttttgttataggatcttagcctttttgcataggtaataatatcagacacaagtaatcctttttaaagaattataaattaaagctgttataccaatgtgtgtttggaggtagaagatgccatttcttccccttagacaggatctttaggaaagagacaagtcttatttataccttatcattagaatcaatcagtgttcattaagtgcacgtaatgtgctaggcaccttgccatgtctttccctatgcccaaggatttacccttctcttactctattcagataattgtttgccaaatgtgttatcctttgatgaggattatcggttaatgtgacattctacacatcttgccaaaataatcagatttctcatttctcttgccaatgctaaaaataggatggatgcattaggcattcttaagtaagtttgtaccttagttttatttctaatgtagatattgagtgaacccttaaaacaaaattacatgtgtggctgcaatcattattgggagatcaacccctccagtggtaacagataccagacataagcacaatatcacattatatgtgtgcgaaaagtggtgtttacccaacatgtctttggtcagacatgtaatgctgtttttttccccatttttgtttgtggctgggttttcttggcttcccccaccccctttagcacagaactctgaaagcctctaagtgatccaaccctaccaaccacaatttataaagtctatcataacagtctatgacaataaagaaaacactagtacaaatatggtgtctgatttataaagtgattcttgtttccagttttggcagcctccctgcttctgccagccggggggtgaggaaggagtgaactcagatccaaacgaggactcccaaaatggcagagaggacactcagcccatagaccccctggccagactgggtggaaagccatctgtttatgcacttactatacattctgagcacttgagctgtgactgcacttgactttagtgtgctggcttgttaatttcacattgggtacctgtttgcagataccttcctgaaacttacttgcaaaggcatttgaaagaataatgtgcaggagaaaggtcaataaacaaattgcacaaatcacattcttctccaaaatgggatgttcagtgcattaaagatgatcccctgggatgtgggaaagaagcatagggactttctgtatatgtattttttaatattagcttttaaaagctgtgctttagtaaatattttggaatgtacaaatatacgagagtgattttatttaatatttaaataaatacatatgtacatttcagagcatgaaaaattttttccctgatggagctgcacagtcagccatttttgaagatcatggagtgaagctgcaagctccatcaggacaagggccacagccatttcgcgcacatctgaatatatcacacttagtttattctcaggaatgaatggagaaaagcatgaacaaatgatcaatgacttattgaactctgtaaactaatattttacatcaacgaactcataaagccattcagaatgttacaagccttgttcttatttatacgatgctgtcttaccagtcctacaattgataattaggaatattatggcctgaggcagtaatgcttcagtacaataataacacaggtttatttttgttagaagttacccccagctggccctctcacatcagtcacattttcatcaggcttctttgttctgcataacctgactgctatgtagaggtgggcttataatgtgaactaaaaacatgattctggctccatatatgagttaaattttataaaactctctaacttccctccaaaatatgaaaagccaatggtattgtaatgactgctgataagttatcttgttgtcatatcctcaacaaaccattccctggagtataagcctttgagtctctaaagacttaactggagaacaggaagtaagaccagggagccataattattaaacaattcattcttacctgaaattcttttttattccctgggaatcaggtacctatttggcctcatcttcagaattcataatgtagaattcagaattcacaatatcctctgatattaagattaatatacccaaagatttgtagcactttgatcctcaatgaagtatttgctgttatttggtatagtctgagctgggtaacaaacagacccatccattcagtgaactaactaagaaactttttccctctcacataacaatccagacgtgagtcatccaggaccagtagggatgctcctctgtcctcagcatgaaccttccatctctgtttctaagttggcttctccatttgctgttatttctagataggggaagggtaaaagaaaactgaagacagtacctggaagtggagacatcacttccagtagcatcatatcggctggaagttactcataaaccacatcttgctgcaagggagactggacaaggtagtctctagctgagcagccatttgtccacaaagcttgaggaagggagttgcctataactaataggcaaaaaggagtggaaggagatgaggggacaatgagcagtctctgacattcactaaaccccatttaggtaggaaggaggactcaccatatataagcaagagttaactctgagaacacataagtctattaaaaattttaatggtcaagattgtattttcaaaaggtcaaaatactttgggattatttagattgcaagagagtgagagaaatttgaaagtagattcaacagcattcatctttttgaggaagtttcaaaggtctgtttagagattgcatctgtgattgtggaataaaccttgattgtcacctgcaccgcttttgctaggttttgtagattaaaaagagcattaattaaaaactagaaagttcaccagattaagtgattgtgttttctacatatgggaaacagatccccttggattgcaatctccattattataaggagctcattcctatttttgaactaatgtaaataagaaatcaatgaaatttaaatagattgtaactgcttgtgaaactgtaatcattgaagttgttatatgccactatttctcatttgcctattagttaaaaaaaggagaggagggattaaaccccattcattgcctctttccctttgtatacaagagtatgtgtccgaagaaagtttctcataaacccacaagggtacttggtttttggagcactcatgttcccaagtcacgatgttagtcatgtagtggttttccaataggatttcatctctgtttgccataatagttttggaaactgcaattcaaccccaatcacatttagcgtttataaaagctgtctttatgggaaagctgaagtaagacccacagagttttcctacaaaaccaaggccatctattggctttagctcaacaataagttattggcttgtactcaatttcaggggagacccagggaagaaggtaggaagcaggagggtttgcaagaggaaaataaccggtgagttatgtcagaggtgggcttttctttgtgttacaagtaccccaggatggaagaaaagatattctgcatgacatctttaaagaaacagagagctggaaggacatgcttgaaagaggagccttcattatgtggcctgggatcttgggctaaccttccagaagtggatgaaactgagggtccttggttggagagcatgacagcaagggatagattggattgttctaccagcagcggcaggagaggtacagcctgtgtaattgaagagcgggatgtgccttagagcagtgtttccaaacctcctggatcttaagactcagttggggcccttgttttaaaaagagaagagaaaagtcctccagatctatcagtggggactctgatttggcagttcaggggtggactctgtgatttcttcaaagcatcctaggaagaggtgagagccactggtggacagggaagccatggtgaatgaagtgactatatttgagaaggagtgtgaagcctgtgtggtatgaaagaggtgggtcccggaaattgtcaagagctgtctgtttctgagatgaccagacaacaaatgcttgctcaaacttttggaagttcagggtgttggggagttccattctcacttagcttctgcatcactaggctgctactcctgtcctcagtctttgcccttcaagaacactaggtagcggcggcggtggtggtggtggtaccagtaaaaataatcatcataatgataaaccctaaggctcatattcatcaaaaagtttgaaagcactcagaactcttctcttcagtgcctgtggctgcttctcatttgatctagtttttcatggtgaatgacaataccattatctccaccaccccaaactggaagtcagaagatggtcttatccttttattcacccactcttcacctctcccccatcctgtgaattctaccgccttacaaaaccttcaagtattgtctctactctgctcactgtgtggtcacatgaacagaggtcatcatcctctcttgcctgcatccttgcatctggccaccccctcctggcctcactgccactggcccatccttcccatagctgagggacttcgaaaatgcacatctgaacaggtcatttcttttcctgcttaaagcatccttcagtagatcgctgtggttgtcaggatgaagtctgagctgctgaacatgtaacaaaaagtcctctgtattctggaaagcctcgttccagcccctgcctcttcaggcttgttaccttgaatgctccatgtcatcgcctccatcgcaacttgtactccacggcctcaccacagtatggtgctgaactctcccgacctggccataccctttcgcctctctgcctctctgcagtaatcagcaagtgcagagagggcaaagggcatgtctgtcctgcgaacagtgtcctcagaaacccacaggactcctgactcctagcctccatcggtaaactttgttgaatggatgaatggatgaatggatgaatgaatgatgagtctttgtgcatagtcctttgtatgccactccatgcccttctttgtgtagtcggttttctaattgtcttttaaaatccaactcaggcattacttcctggaggaggagcccacagatgcccgcccacccacctgtgggggtaggtgcccctcctgggcccacacggggcttcttgtaacagcagtaaccacacggacctggggtgaactggctcacttgaatgtgagcttcccaaggacagggtctgtgggatgtttcctttctacatttccagccccagtggcaagcacatagttggtgctcagtgaaagtttaaagaacaagtttaatgaatatgtgagtgacctgtgccctatgtgtgcacacttggtgtgctcaggtggcgagttgtttaatattgccagaagctagccagccatgtgatcaatccataggattcttaaggggctggaggtcactcgcaagctcagtgttttcctgcttctttgagaggagagctcttttcctctttggagcgtgaacacgttagggaccttggggttgggggtgctccttcactggtagccttggcccttttcttcctggcctcatggatctaaagcagctggcctggtatctctgaccccctttgcgtctcattcttagggagaagtctgtgagagcaaagtcttttccagaagagatgaggatttgtcaatgtagaaagcactgccaatggaaggtggcattatttttcaagtggcagaggaaaacagagacatggtaaatagcacaattagcccaagatgccacactgcagttactctgccaaacttttagatgacactttttaaaccagtagtatagtataagacatttgaaaatcgggctctttatgaagactaacattgctgtcataagactactttatgaaaacccaaggggacctttatctgtagcagaagctttctcatttaaaccatgaaggttaaacaataaaaactaattttctattcccagcatacccatcgcactcccaggaaaagcatcagtctgctttatgaaaacaaggacatgctattctttagctctttggtaggtagaggacatgaactgtttgcaaaaacgagtctcttccaattagcagacttcttttggaagaaatgatccaccagtgactgtatttggggtttggggaggaggccaactcacatcttggtaaagtttttcactgagaattttcactgatgggcatgggatggtggccgctgattcagtaggagctggagcaattaggaggctgagtgcagtggtagtggtggtgcggagtgtgtagaattcatgttgacaagagtttggctttgggagaatttgattagtcagtacttttatattaaaaataaagaattatagggatcagaatgttaagttacaaatttaaggtgaggatggcttttaccttcgggatgagtggggtctataccctacctaccttcgctcctcctatctgcctgctgggccactggaccccttgcccacctcatgatttttcccctctcctctggggagggtgaggacctgccctctcacctcccccagtgctcctgtcctctcccttcctggtgtcttatagggctctgctctacggaacctaggctgagaagggcaatccaccatgatcttttataacatgtattcaggcaacagagaactcaatgaatcctgctcttaaagttctttgctttgggtgtttttgcactatgggctcttcataaggaaccaggggtcaccagctccatccaggtgcatatatgtgttcccccacatcctgtggattgcaaggtcagtgtgagctttaggggagggaggaaagcgagaggctggggcagcgatactaaagcctatctcattagctattgcacaacacccagtggccactctttctgtgccttgttagccaagaatgccgtggaaataagagcgttgcaattaaggatgagctattgatgaaacactggctaaggcagctttccaagggagcagtgtgtgcaaaagtctgcatgtacaggagggcagagttcttgcaggtggaactaagagtaatttcatgaggctggaacctatggcatcccagagcctccttccaggtgatgaggtttgggagtacaggggaagaatattaggggatttcggagtggtaaccagactaagtgaaaaactaatgtttttctctgtactctcataacctgtctgacaccaaatatgtggcgtttgccctcacacaaagcagttctccaactcttcaggcactaattggatgttctgcaattcaattatgatactaactattgggaggtaacacagccccaacaggttaaaggctcagccccacaagactgtcccacttcagatgccattcacaagtgctaggttgttgcctgtatttctgaccaaccagctacaaatcgggggttcccatgacctcctactcaggttcggtaatattcttgaatggctcacagaactcaggaaagcacttgacttactatgaccagcttattataaaggatacaatcaggatccacccaatggaagagatgcttagggccaggtatggggatggagagggtcgtggagcctccttgcctctcagggcatgccactccctcagcacctggcatgttcacctgctaggaaggcagtggttaccctggctcaagcccactgttgagagtttttatggaggcttcattacatagacatagtttattaaatcattggccattggtggttgatgtcaaccgggaggtcaggaagtcaaggggtgtgatatggtttggctctgtgtctccacccaaatcttacctccaattgtaattcccataatccccaagtgtcaagggtgggaccaggtagaggtaattggatcatggggggtggttcccccatgctgttctcatggtagtgaatctcatgagatctgatggttttataagcatctggcatttcccctgcttgcactcactccgtcctgccaccctgtgatgaaggtgcctgcttctcctttgccttccaccaagactgtaggtttcctgaggcttccccagccatgcggaaccgtaagccaattaaacctctttcatttataaattacccagtcttggccagttctttatagcagtgtgaaaacagactaatacaggctgggactgaaagatccaatcttctaatcacatgaccggtccctctggaaaccagatcccattctccaagggtcacatcattagcataaactcaggtaaggttggaaggggctgattttgaataacaaaggatgcttctgtgacacctgtcatgcgggaaattccaaaggctttaggagctcagtgctaggaacctgggatgaagacgaattgcatatttcttattatattacaatattacacaggcccagttatgcagggccttctaagccctggtaaggaacgtggacttgaacctgaagtctggaagcagcccccagaggattttaagaagggacatgtactttaggatgcactctaacctcagtggatcactttgaggagggcaggagacaggaagaggaggtaggaagctattatgctagtcctaatgagaaatgatgaaaacttgaaggaaggcagtggtacccaggttggagaggagggaatggatttcccagctatttacaaggtggaaatctgcaggacttctctgcaggaattggaaactggctattcattttcagaaataacccatgtgtggcattcatgtgctaactcggctgatgaatgcactattcttgtaactaggttggagaagaattacatgaagggtatcattaagatgttaaaatgaatgcattacatatgttaacaagtgtatgaaccctgtattatatctggcaaacggggtgttaaatccttgttcaaccagccagatgtctctgcagctgctgctggtattgcagagggaggcagccacctgagaccccagctataagctggtgccagtgatttccaaagcatctggctgtacaaattccttcttctgtgctctgattgacaggtaccacatggatcacacaattcacatcacaatgcacaggtgagattttcagtctgataagcccagactccagcaacttgaccttttcagaatatctttgcagctgagaatgttctcagttggagctgaaatctatttattattattattattaatttattttttttgagatggagtctcattctgttgcccaggctggagtgcagtggtgtgatctcggctcactgtaacctctgcctcccgggctcaagcgatctcgtgccttagcctcccgagtacctgggattactggcaactgccaccatgcccagataattttgaaaatatttttagtagagacgaggttttgctgtattggccaggctggtcttgaactcctggcctgaggttgatccacttgcctcagcctccgaaagtgctgggattacaggtgtgagccactgcaccaggcctatttatattactttgtaagttgaaaaaaaaaacactgtagtaaaacaatcttaaaaacaacttaataacattctctcctgaattggaatgttatcaaagtcttgtttggggcagttattcagctgaatttacaaagaggggcgtatcctttgctgtaaatgtttaaattgcctgaagcaaaattcccataactacttaaaggagttgaaaatactcctaagtgtttatacttattcttacacagtaccatctctcctgagtggccctagtttactgagattgagccagctctgagacatctccctcctccttaagtttggcaaatatcctaaaacgtttgaaaagatgtttaaaagatctgaaggaagctggtctcaatggaccagagacaaagtctgcacagccaggctcctgggaattgcacttcttggatgttgagttcaggagaggcagtactagagaccacagttacacaatcacattgatcttttgtgtactttgtttcctgcagaagaaattgtgtaatcccagcatttttttatgagttaaatagaagttgaaatttaaaaaaaaaaatcacattggttgttttcctgtctgtttaaatgtactctgacagcaaagatgaaaagttaatgcagtctaaatagaaaaataccacaatgagaagattttaaaaaaatattgtgaaatatcctcatctctattgtttttagacgttggggtttcaaatctgcaaaggctgactgcggcgttgtcaggattgtcaatgttggacagcgtccactaggtggcagtatctcagaaggtttcttttatccttgaatgggcagagatttctttggttgctctctttggtagttcggtttcctttttttgtcttgttttgaagggttaaatgaagctatcataatttacttatctaaaattgcacttatctaaaaatgcataaattcattgcaaggcctacttgttacagcgtgaccataaatgagtttattcattcatgtgaattttcttggtaacttattattaatgatcctagcgtgtaacagatgatgaatatgccgtatcctgagaaggtagatcacaaatcctcctgggaagctggacatgggtgctcattagccaagagaagaaaataggggcgtcctttgcccagcttcctcagcctggtaactgtttctggcttctgctccaggctgttcgctgagaggtttgttgaagttacctgcacttctctacgcaaatctacaggcattctgatggcgtaggtaacatgtggttgtgttggatgtttattcagagtgttaactaactggtttttgttaatttacagctggcttaaaataagataaaatgtacatacattttttaaaagatctctttcatgtgaataatttgttcagaagaaaggagtcgggatattcttttgtagtattttcccaaaattagattatcagaactttctgaattcaaagaaaccggcagtgccgtctgaatgataagattttggaataaagaactatagaaattttaaaacactctaattaatctgacagatgtagaggactaatgtggatgaaaagaaatgtaaatgcaaagcttagaaaataaatggaattgtcaattggggtgaagtttgggttcgtcttcagaaggactcctataatcctgaaaatgaaaaatattagggggctatcaaaaggtctgtgtttggcatgtgcatagcaaggtctctgatctttgagaagatggcaacatggaatggctccagctttgtggagtggactcgatagggtcatgtttggagatgcaatgtcccttatccatgtcctgcaggtcttagtcttgggggttcatcagccaagccataaacatgggttggccagttctcagccagttgttttctgaagcccctgggaattctgagatcatattttctgatgtcccggctcctttttgtcagatcccaggatccccagcagccagatgccagtcaaggtgagccaccttttcagagttactgcttcagggagggagtcacgctagggattcctgggtgggctagtggtattttgtcccagctttcaggagtgtattttatgacgatggcttgtaaaaggatatgggcatacagatccagagaccaaagttcaagtctcagctttattaggtgaagccttattctctctctgcctccatttctcagtctgaaaaatgaggttagtagtagttatagttttccaggctctgattctaacaaaagtcaaatatggtaacagggaaaatactttgctgtctacaaatgtaagaggttattaaattttcaatacgtggaatatatatgcaagtcatgagactatagtaaacccttaactaaattgagatgtcaccaaacaactattcatgggaacacttaattagtaacaatgcttctcaatacctgctacatattcttatcatctgggagcatctttaaaaaactacccagtcactatcagactaattgggttcattatcctggctgaggttggggtcagggtatgggtatcttctaaactgcctaggtgtctctgctgcgcagccaggtccctcactggaatgcatcaagtactgcctacaaaacttcagttacaatctcaaggccagaagacaccctaaaagtctagtcttagaagaatgttatttttatgattgatatctgtgcacataaataacaatggttttagagctcaaaaagctggggtgcagatacagatattgggaatactttctttgtaccttgaggttatagacagtcatgcgctctctttttgactctgaaacttacctataaggtttctgaggggaattgcaatccttcaacacccaaaaggtataaaatgagagcagcattacctcttgggtctctagctagagttttaattcatcctgggtcatgaagccttttgttctttttttttttttttttttttaaagcagacattgaaagtgcatctgagaggtgctgctggttactgaattttcctgaaacaaaatgggtccgtagcaactctgacctagaagtttctgattaaatgggaaagaaaagttcatagttcattcccgggtagaagaggacaaactttccctgtccgttgcatcggtggcttgagtctgctgcttctttggcctggatatcaagctcccagaaaatctccagtctgtgcctctgtgaatctttgaggatgtgaaagggattgtcattctcagatgaggccccaggccagcaacaccagctcactggtgctgaatgcaaattctcaggccccaccccaaatctactggatcagaaactctggggctggtcccagcagcctgttttaacacgccctccaggaggtggtggtgcaatgcatacatgctcaagtttgaggaccactgagctaggacaaaggcacttttcttgtttttctttttctttcttttcttttcttttttttagacggggtcttgctctgtcacctaggctggagtgcagtggcacgtcacagctcacttcagcctctacctcctgggctcaagcaatcctcctgcctcagcctcctgaagagcacaggtggatgtcgccacacccagctaattttaaaaaattaatttttatagagatgaggtctccttatgttgcccaagctggtctcaaactcctaggctcaagtgatcctcccaccttgacctcttaaagtactaggattacaagcatgagccatcatgcctggcctggctttcttgattataagtgtgtttgtatagaaaatcacaaaacaggcatttgtaggtatatgctagacttagttctgcttccttctccccttccccatctctcctctgatggaaaggcagatcagagctagagggaaaatgaggggtagcgttcaatctcagaattactctgtcaccaaggttcctcttccaatcttttaagagccagtaatcaagtaaagatatactgtgtatatataaccatataaagatatacacaatgtttagagatatgctgcatatccagctttgctggcaccaaagtgaagaagagatgaacagaggaaggtctattccctaaggccacccatccacctgcctgacaagaactgggaaataagaaactgctatcaaggcatgtccctgttacatgtcagacccctccacacactcccacacttccgcagcacttggcacctgctgcagcaagaaaaatgcccaaaagccaactaaacaagcagtagcatttgaaggataaggggcccaatggctgggaaactgctgatgtgagaaagaccgcacagttacactcacatttgcagcaggtagtagagcgccatgagcagcttaataatgaaattttcctatagccttaagggagaaaataaaaacctgcagaaagaaagaaagaaaaagatgcactgtgttatctataagtctgttgtgaaggcaggggagacaaaactaggaaattccagaaattaggcaccattgagaacccggaggtcttgaggaaatcttggaagactggaggttgacatgagtggggaagaaaacgaggcctgggaagggccactcaacccaaaaggggctaccatgtgcctaaatacccgccctgcacacggcactcccagagctgtgcagtgtagtgccctgggtctaggcaacagcagaaagtggctttgagtgagtcctagggtttctttctaagagtcagccgcactgtgactagaacttcagaacaggtcagtgaagacagctgtgctatctcctccaacggtcattaaaaacaacgtagattcttatctctctctcagaagtttggaagcagaaagaagaataaatgttatctccagaatccttccagctaataacagttgaaattatgttattgcctctatctatctatctatctatctatctatctatctatctatctatcatctatctatctatctatctatctatctatctatctgtctatctcaaagccctcctctctagacacttaaagaacttaagctgcatggcctatctttcaaacaccgtggggagaatggttagcatgaatagttattccagtaacaggggaaattaggaatctctccagagtggttttttttcagtatccttataatagatatctcttttgttttttgtttttgtttttgttttgagatggagtctaactctgtcacccaggctggattacagtggtgcgatctcagctcactacaacctcccccgcaacctcccggttcaagcgattcgcctgcctcagcctcttgagtagctgggattataggtacccacaaccacacctggctaatttttgtatttttagtagatacggggttccactgtgttggcccagctgatcttgaactcctgacctcaagtgatccgcccatgccagcctcccaaagtgctgggatgatgggtatataatagacatctaaatttaccaggcactctgctaagtgcctacacacattatctcctttagtcttcacaagcaccctgtgatggggtgctgttaatatcctccgtttatgcaggaacttgaaccaaggtgaaagcctgagctttcatcccctccaccttactcttgccctaagatgtgacattttagtgtcagctaatgtctggatacaggtgggcatgtggttacctatttcatcctttattctcagggttcaaattgagatatgcaattacctatactctttatgttttttcttttttctggcttgtgcttctaatcctctatttgtggccatattttaagttaattgttggtactctaaaggctcttagacttccatatagtgctttaagtacactgtaactttaaagtaaaaaattaaccactgggagctaagcatcgttctctttcctgtgggctgagctttagtattataacagaaattcactaatgaaatagacatgaaaagagccttccagaagatttaagagggtcatatattctgtgtagttgttattttcctagttaacttcatctccatttgtgtacctgctacagatttttaattatgttcaattacgccatggtttataatctacatcgtcttttacttcctcttaccgtccaaagtattttgtttgaagttgggtatgatctcaaacacatcaacaccaattcttttgggggaacttccattgatagccacctaatacatataggaatttcactgccaatgttactatggcacctttggaaggaaaagagggttaatttgttgcatatgtaacagccctgaattcttattgctttacagaaagaatgattttataaataaaattatttttcctttttatttcaggaattacaacatatcgttggatcacagcacatcagagcagagaaaggtaagcatggatccatacatctgtatgaaatcccacagggtcactactattttggctataataatatggtttctctcatctccagcgatggtggatggctcatggttagatctggccaagaggagcaagcttgaagctcagccttttgctcatctcactattaatgccaccgacatcccatctggtaagctctatctgcatccagcctgaaaaatattttaagagtcatttatcagcccatttcaatactgaaacctatttttagtctgtcactgaatttttgagagcccttacttcaaagccaaaggaaagaccattcatcctcaggtgatgattcacatcctggaaactgtgattctcaaaaatgtcagaatggacatcatcaccctattcattttcagatcatcagaatggatgcttattttaaatgactgccagctgaaagcctgtaacctggaaggacaatcctttgttatgctcatctgtactttcccaagctaaagttgacacagccctgctgctgacctcagaggtgaatgaattcatcaggtagtcacatactcagctatctcctgcagaggtccagggaggacactttagacccccgttaagatctttaagagacagtaaccctctagaaaatgagatctcctcccccttctccaagggcttatcattttctctgagtaaatgcttagcttgatggactagagacctgattatcttgaaaatgaagaaacccggagctctctgcctacagctactgtaatacaccagttattccatcatacaacccccactggttacttcaccatgggctagatagctatcaaaaagataacagaactttatgatacagtgacaattgaacattcttgttatcatcatgccactaatggaacacttgaagatcttaaagggggatcttcaggtgtcctccctggcactctactggagatggctgagtctgtgactacccgatgaactcttccacctgtcaatcaggtgttttccccttcctcaatacctctcatccttactgcaatcctgcaaggtagggattatcacgcaaattttgcagacagggaaactgaatgatacataggttgtcatttgttcccagtcatgatgatgataggattagaagtagaattcccgtcccgttgattgctaagtccgtgctttccatgctctctattatcacataagcaggccacaaggtacttgtggtcagttggcttggccagagggaaagaattcaaagcccttatgtttctcttttcctgtgagaagtagattcatgtgacgtctaataacaggggtgctaaaatctgactgcctgggtttgaggctccattgtcctggctctgtgaccttgtacaatttattgcaatcacatatgcttcagcttcatcatgtctaaaatggggatgttgatagcatctgcctcaaggggtagctatgaagatgaaatgaggtagactgctaacattcttgtgtggaagaacggccatagtaagcacttgggagtgtgatttgttatttttgagttcaattaaataattatacatattccacctttttcctacaaataatttaaggcaagtttttctcggagttaaagaaagaaagttcaagttttgctaagttatttggaaaactttgttacggcatggacaagggggaatttttcctgaccgaagacacagaaagggagaaaccaattctttggcttttagaggattttccaaatgacctctcctgtcccagacacttgcttcataaataatttgtctcactgtgtgtctatgcatgtcttgtggtggagctacactaattttctctgagtggaaaactgttttgcatgttagcaaaggcaatcaaataaatatggatgcatctgtattaatttctctgagtggaaaactattttgcatgttagcaaaggcagtcaaattaatactaatgcatcagctgtgtgtgctattaatgttccctacatttatcttttcagttcactttaaatggcatatgataaatattgcattagaccgtttgccaaagtctgtttggcaatagcaagcatgttttagttataaaactctctctgcaggcacctagcatcaaatcattgccaaaaacacaaggcaaaactcctggttattttctgacagttattgagtttgtgactgagtgagatgagttagtgtatacttctgtttaagaaaatagaatttgtggctctggctgggcccacaactccttgagtccatttattacccagttttggccagtactggaggtttcagaggaagtggctttaaatttgcatgttcattttggggctctgttttatacttacttacacaagtaaaatcagaatctgccttatatggactgataccacttgcattttcaaaatatcttagatgaaatgcgttgggaagtatttagtgaggtcagaatacatggctttctttaggaggatactcaggctaaatatttgcagagacctcttctgcggtacttagcagcagggactgaagtgtagggcaggggaggctgggaaagctggcaggctggagtcaggggttgtcagtgtgcctcagtgatgaaaatccaggtttccatgtgaggcctgctgtgtgatcactgcatatttttctcatgtttttacctggtattatctgcttctgagtcctctcttcacactgactggctctcctccttttcccccatacgtgccatgcatattccattctttgctcagtttccttcactgacaataccctcccttttctcagcccatccaagtctgacccaaggccccactgtcctctggcttctctgccccttcctgagctgagctctcctgcttgccatgaatttctgtagctgtctcttggcagttgcttgtaactgaatgtcaaccatgtgctatgcaacatgcagaagtgaaaatgcatattttatatgctcattttctattttctctactattagtggtgagtgccattaaggcacagttggttgatgtaattcttaattacgggcagactgcctgttcctaaaaacaccacgtagatattgtgtgactgatcaaaagcatgaaccagtgaatgtatgagtaagtcaatgcacaaaaatagagagatgtttagtaggaaataagggcacttcttccacatgacttacctaacaatgggaatggtaatcggtcaaggttcctctcttctcctgcctctctatttcatattctttccttgccttcctaggccatatcttgctctaacgccagctgatccatcccattgagagggtagacttctcttctgttaagagataactataagaaaaatcattgattgaacaacaaattgactgcaagagtgggataagaatgaaggcagcatgggataacttgagatgggaaacatcttgaatttcatggattttgtcaatggattagaggaattgcttttactagtgttcatgaaggtgtgatgatcatgctcactcacttggggccagatgatggtatttatatctggggtgctttaatctgggatgacctgaaataagacctccgatgaaaaagaagggtgtttattgtggtgagcccaggaggcaagagggcctgtgatgaccccgctgcagataggttgtggagttcaggaaatatcctgtttctggacagagggattggaaccattgaattcttggtcttctcatgatgggttgccccaccgttggatggcccttgctgcagtttttctcccaagtggttgaaagaactgcctgtttggttcctacagcctagttttgaggctcccagatcatatcccaggctcccagttctttagagataaaattgtagaacattctctatcttgtgggcctctagagaaggatgtagatgttcaaggcccaccaaaccagactaggctgggaaggtaactagtgtgtgtttccttttttttgtttgttttgtttgtttgttttttgagacagagtcttgctctgtctcccaggctggagtgccgtagcgcgatcttggctcactgcaacctccacctcctggattcaagtaattctcctgcctcagtctcctgagtagctgggattacgggcgcctgccaccgcgcccagctaattttttgtatttttagtagagatggggtttcaccatgttgaccaggctggtctcgaactcccgacctcatgatccacccacctcagcctcccaaagtgctgggattacaggcgtgagccaccgtgcccagccatgtgtttctttctcgatgaggctctcataaggattcactctaatcagagagctgtcagttttgatggatctctggaatccactataagtcttcatctctgggctaatttatctccctcagcatctcagggcctgacctaagttgtggttgggtgtgacaggcagcaatgaacttcttgtggctgcaggaactctctcaactccagtctgagactcaactctgctttgttttgctgatttcaaactgctgaccaccttagtttagtataagtatttacaaaatcctctggaagaaaaatgtatttttgtactttccacagtattacaactttcccaccattagttaccagcttttccagttgaacaatagtgtccacatcaatacaaatctttgattaattgggtttatcacagaggtattgccaatttttaatgacccaggaaaatacaccaaaggacctgaaatatgaaaaggattggacacactgctggtttagaaggttctttagaaatttttactgctctgaagctgtagcaagaggaccaggtgtcacctcatttcaggggtgagtagggctaaatgagaattctggtcagtcaggagaagctttacagacctttggtcagaaggattgtgtgaagttgttaagctagggagtgcaatgctaagaatatgttctttttgagcttctctggagttagcttttcagttgtgcaagctaaggtgggagacacttgggctactggaggtgaagaaaatagattatgagaattgagtttagacgtctgacctttcagccaaagttactgtgacccagtttttcatctcctactttccctcttcatgagttaaaagagaaggttgagacttgtgacatgtggaaattgtcttcctatcctagtttcttgctttcctgtctcagttgcctttggcttatctcttccttcaacctggaatgacctttctgctcctgtctgtgtggctgaatcccatttctcttaagttctcaggcttagcagcaactccacaaaggcattctttacccttctgggtggaaagttgttcttgtctctccgtcctttgagctcccatgggagttactgaaccttgcctattgttactcatgccttacttctgctctgaacacatatcgtacttacccctggtgcactatagacgccttgagggcaggaaaaatgagtttttgtcttcgtagcctctactgtgcctaacagaatgcaccaagtacatctgaatgtattctccccttctagaaaagaaatgccaataagttattctccctttgaaataatgactgctatactattttttctccctaacctcatagaattgtgaagacgtccttctcatttaaggactgactttcaaatcttatgcctctcttctccacaggttcccataaagtgagtctgtcctcttggtaccatgatcggggttgggccaagatctccaacatgacttttagcaatggaaaactaatagttaatcaggatggcttttattacctgtatgccaacatttgctttcgacatcatgaaacttcaggagacctagctacagagtatcttcaactaatggtgtacgtcactaaaaccagcatcaaaatcccaagttctcataccctgatgaaaggaggaagcaccaagtattggtcagggaattctgaattccatttttattccataaacgttggtggattttttaagttacggtctggagaggaaatcagcatcgaggtctccaacccctccttactggatccggatcaggatgcaacatactttggggcttttaaagttcgagatatagattgagccccagtttttggagtgttatgtatttcctggatgtttggaaacattttttaaaacaagccaagaaagatgtatataggtgtgtgagactactaagaggcatggccccaacggtacacgactcagtatccatgctcttgaccttgtagagaacacgcgtatttacagccagtgggagatgttagactcatggtgtgttacacaatggtttttaaattttgtaatgaattcctagaattaaaccagattggagcaattacggggtgaccttatgagaaactgcatgtgggctatgggaggggttggtccctggtcatgtgccccttcgcagctgaagtggagagggtgtcatctagcgcaattgaaggatcatctgaaggggcaaattcttttgaattgttacatcatgctggaacctgcaaaaaatactttttctaatgaggagagaaaatatatgtatttttatataatatctaaagttatatttcagatgtaatgttttctttgcaaagtattgtaaattatatttgtgctatagtatttgattcaaaatatttaaaaatgtcttgctgttgacatatttaatgttttaaatgtacagacatatttaactggtgcactttgtaaattccctggggaaaacttgcagctaaggaggggaaaaaaatgttgtttcctaatatcaaatgcagtatatttcttcgttctttttaagttaatagattttttcagacttgtcaagcctgtgcaaaaaaattaaaatggatgccttgaataataagcaggatgttggccaccaggtgcctttcaaatttagaaactaattgactttagaaagctgacattgccaaaaaggatacataatgggccactgaaatctgtcaagagtagttatataattgttgaacaggtgtttttccacaagtgccgcaaattgtaccttttttgttttttcaaaatagaaaagttattagtggtttatcagcaaaaaagtccaattttaatttagtaaatgttatcttatactgtacaataaaaacattgcctttgaatgttaattttttggtacaaaaataaatttatatgaaaacctgc

SEQ ID NO: 2107 - DNA, 45278 bp, Homo sapiens
  source 1..45278: mol_type = genomic DNA
ctgaaagcaaatggtgtggccgaagctgcctctctggtggcatagctaagaccaagctgcacgcagtgaaaacacagtttgttttcactgacaacaaggcagaatgtgtaccagggatgtgacgtggggaaccaggaagaggacagtctgaggatcattattaaagggactccatccaagaaggtttccagccagaggcaagctgtagccagaagaaaagaatgagaggtactattagttgcagaaattgaggggagaactgtaaacagtcagctagggagagggagtttcagtcagatgtttccagtgggaaaatctttaagaaaatacaaaagagtaccatgaatgaaagagttcactctgaacattttaccaagctcagagagcaccaacccaggttataactttactagtcaaataagtcccctccagttccatcccacccacagcaggctccccttcccatggtaaagttttcagactgaaagttctgaattgaaggagggaagaagatttaacttgaaattgaatcaaagcttttgttattaacttgggcctcctcttttaatttttgaaatgagtgtgttctcaggactaaaagtgaccagaggactttttatcatttaagtaagaacaaagaagttaggctggacggggtggctcacacctgtaatcccagcgctttaggaggccaaggcgggtggattacttgaggtcaagagttcaagaccagccttgccaacatggtaaaaccttgtctctaccaaaattacaaaaattagctgggtgtggtggcggacacttgtcatcccagctactcgggggactgaagaagaagaatcacttgaacccaggaggcggaggttgcagtgagctgagattgcaccattgcactccagcctgggcaacagagcaaaaactccgtctcaaaaaaaaaaaaaaaaggaagaaagaaattttgaaacctacctgagatttccagcctgagggaaaatatatggactacttgttggttttaaggtttttttctttgtctttgggtttcagcagtttgattatggtttggctaggtgtagatttctttgtacatacccactttgtgattttctgacattttgagtcaatgagttaatgtctttaatcagtttggaaagttctcaccataatatacttctatgttccttctgttgcattttttccctgtccttctggaactccaattacacatatattagaccttttgataatgtcccatgtatttctcatgttctcttctgtttaattttctaaatattgttcctctattttagacattttctattgaattggctttgaattcactattttttttattatccagtctgttattaagttaatctagttaattattaattttagatattttatttttttgttctagaatatccacatgcttatttttaaaaacattccacttctttgttgcagttctctatctcttcatccattttgtttacctttgcctctgttttctttactatatgtaaaagaattatttaaaaattattgtaggctgggcacggtggctcacacctgtaatcccagcactttgggaggccaaggcaggtggaccacctgaggtcaggagttcgagaccagcctgaccaatacggagaaacctcgtctctactaaaaacacaaaattagccgggcgtggtggcacatgactgcaatcccacctacttggtaggctgaggcaggagaattgcttgaatccagaaggtgaaggttgcggtgagccgagatcgcaccattgcacttcagcctgggcaacaagaatgaaactccatttcaaaaaaaaaaaaaaattcttgtctactatttccaatatttgggtcatctgttggtctgtttttaattggatattttttccctcttcattatgaaccatgcatttcagcttcttgtcatgtcatgtgattttgaaaattgtataccaagcattgtatataaaagaactaatgtagatattattttgcagctaaggtgaggacttcaatcagaaactgagctggattgcagctttaagtagtttcagtgcaactcttgtttcaaatatcttgaaggaaatattttttgtgttcttattttgttctctttctctgacaagtttctctcatacactagaagatctctctctaccttcccagcccagttcaccagccactttgccagtactcaacaaaatctgtgggggaagaagaccagtaattggagaaaatagttgggcatttgtagattttaatctgttacatcagctccagtaaaatatctctgcctacagcaaactcaacactacacctatctgtgtttatgcttgacaaatgttccaagggaggaaagggactgttaatctttcttatctagaaaagaatgttcatgtggaattccatccctttagatttttttcattatcagctcatcgataacttttaaaatatatatatatatatatatttttttctttagtttatctggtggctttgtctagttgttatggttatggtaatgccatggtctactgagatcttccatgtaataaataaagcagtttactgaatggttttaaactctcattgctgggaggaaataatatgctttttctctttgcatcttttaggttctattttttcaatgttactacaacatttgccttagagtgtaagctttgtggggacaacaattatctattttattcagcattatatctcttatgcctaccatagtaccagactcatggttggtatgcagtacatgtttgttgaatgactaaattatgagcatgaacaagggaatagaggtttgaaataaatagtatgatgtacaagaaaattacaagttattcttatgttctaaaactagaactttaagtgcaaggcagtgatggatgttgaggctaaagacagagatgggaaaaaattaagagtttgtaaagagcctggactttatcttaagtgttggtaggctgctgagtggtttcaagaggggaagttatacatccagttgttcgtgataaatggatcaatctggaagatgggtttaagtgagaggagactgctggaaggaggatgaaagggaagccattttagtacttaggcaggaaatgatgagaggctcatttacagacaagaaggaaggaaaaagcactctgggaatatggcagcacaggcttatttcttgacaccctcccactcccatctcaataacacagagagtatgtggggatgggaagtctacctgaggctttaggacctaaggagacagtataggaatagaagagcacgggccaacttctggacaaaattatttacagcaatgagcagacctaagtattagtagatttggggaagtctgaaaacagaattaatcccatagcttcttgggagactataatcacttggccaggtaatcccatgcatcctgacagacatatggaatctacttgaaatttccagccatgagagatccccagtccttcttatgctgccatcctggtgaggaagcatcttccctacccctcacttcatggatgtctaccattgcctaagacccttctaataatctgacatatccagaagcaatggggactgacaccaatggacattggtaggaaaagaagggtcaggtatcacccaaagggtctcaggagcttgaaagagggacttgaatcaaataaactcagcagcttgtttacagagaaagtttggtaaagaaacagaggtgaatttataaatgattgtaagaagaattattgaggaggtacaagaagctattgtgaaagatcaattgaagggaaaaaaggatttcttgaaataaaatttaattttggactttaaaatccaacagatcacctgaataatagaacagaaactgctgaaatattgaacacagatctagatcaaatgaaggaacatattcaggatgaagcataaataaaggccaggcgtggtggctcatgcctggaatctcagctctttgggaggccgaggtaagcagatacttgaggtaaggagttcaagaccagtctgggcaacataggaaaactccatctctagtaaaaatacaaaaattagccaggcatggtggtacatgcctgtaatcccagctactcaggtggctgaggcaggggaattgcttgaaccggggggcagaggttgcagtgagctgagattgcaccactacactctagccttggtgacagagaaggactctgtctcaaaaaataaataaataaataaataaataaataaaatgaaactgcaagttaaacaatgtattatagaagacctaatatggcaaaaataagagtttcaaagaagaaacaataaaaaattattttctgaggaaaactgaagtggagacagattcaggaaacatttaggaaatgaatacaataagaccctttgatattatttaattatgttttcagaaacagctacaatctccctaattaatttttgtatttcccaaaagtttatttaaaagctctaatactttagattaattttattttaggaataagtctgagataatattaatgaattaaaaacctgtcaaacagagttgctttctagaaagtaagagataaaattactctaaatatttctagcattgtgcacagaagagataaacagttatggacaggtttacttccttcatacatgaccaagatgtttttcctcttccacctcccatccagttttccgtaatgtctgataatttgccattagaaatgcactcctttaggggtgagagctaaaccaaaccaaccaaataggccctgtttggccaggaggacctcagagaaaccttaaaataataataattaaaaaaacccacctgagttcccaaccatgatgggatggtaggtcagatgcctcattatatccctttctttttgctgtttagacacaacagctgacagcattaatgttaaaacagagatcataagactgacagaatagactgtttatggcaataagataccaaattgtaaacaagagctatggccatgccaggcaagggttaagtcacacactttacacttaacaaataaacgatgttctaattcccacagggtttcttctccctctttctccagcagctaaacaacactagctttgagataagtgatgttgaagcagttgcagctccccagctatcagacaccaaataactgagcccccacctgttacacaagccacagtgacagctttgattggacaagagagtgatttctgtaactttctcctgataagagaccaccaaccatggactacttctggctggttttacagcagatgcacatttgagtgacttcctgtcccttcttcacctaattgtgtacatttaaatgttaaatctccatcccaatggaactgtgggacgcacgtaacatgcatgtttgcttatcatgcatgcttacaccctttcatgaatattcatagctcttcctatgtcctgttgaatatgtatgctttgccaaccccttcagcttaaattcctgtgttactcttccctctgttgaagggcttgctttaggttttttccagtggcaggctgcccttcctgcctgcaggttgtaattccattcttaagaaataaaactcacctttctaaatttattaattgtgtgatttaagttaagggggtaaggcagtatatttccagaagactgccaacataaaattttaattcaattgtccattgacacagtgaatgttaatttgtcatcacatactagttaatttgttagctgaagggaatgtaataagaccaagttgcttgtaaagggtaatgggtaagctggattagattattagggaggccggtcctaggtgagaagtttcattaggttttcagtgagcagcatatgagcctggaccggagatcagaagacgcgggaacagacagaaaaagaagaagagtgatcaaaggagaggtggcaagtacaaaagacaaagcccaccagtttcataaagttgctcaggctgaccccatttccagggtgagatattttcacagacttattacctatgattatacacattttaaaaattgttattagcatgaggggctgcatatatattttataatagccacacttataaattagttgcaactggcttcagatttagcaagtatcttatacagggtcctggcaggaaataggtggcaaatccaaggggtttaactgaaaagactttaatttgaagagttgaggtcagggttaagcaaactaagaagggatggtaaggaacccaggggccagcaaaagtgggttcgctttcccacactgcagtaggttaacgccctccgccacgaaggaatccatatcctaagccccagactccgtgactatgttacctcacatggcaaaacttactttgcatatgtaatcaagttaaggatctggagatgcagagatgatcctggatagtctgggtgggcccaatgtaatcacaagggttcttatcataagagggagatattagctgggcacggtggctcacgcctgtaatcccagcactttgtgaggccgaggtgggtggatcatgaggtcgggagatcgagaccatcctggctaacacggtgaaaccccatctctactaaaaatacaaaaaattagccgggcatggtggcggtcacctgtagtcccagctacttgggaggctgaggcaggagaatggcgtgaacccaggaggaggagcttgcagtgagccgagattgcgccactgcactccagcctgggctacagagcaacactctgtctcaaaaaaaaaaaaaagaaaagaaaagaaaagaaaagagaaagagagagagagattagagttagagtcagagagaagctgtgaggacagaatcagaggtcagagactggagtgatgaggtttggagatgaaggaaccaaggaatttaggtgacttctagaagatggatcctctccggagttcagcaaagtgaaacgtctgtcataataataacgaatgacttcctttttcattttcattcatatagtgaagttttctaaaggctgcatcatgtgcaatattgtaacagagtaagtgcaggactgaatgtgactctatcaggccaattgtagagatgtgaaaaaatgtaaaacagtggcacttttctccctacttttttttgaaaatctgtttttttaaataaaataattttataaaagtattatgaattatttataaaattatattaacattatgttaacatgctaatatggtaaaattttctgcttggagtttgaatacaccaaatatttataaatataactcacacaaataaaacctctttggtgttctcaaaattttgaagaatgtaaaaggtttgaaaattgctgatctagcaaatgactgaacatgaacagctatagtatttgtacctgcccagcagtgcagcaattccttatccttctcatatctgcactttaattttcctttgacaaatatctctccctcctctcagcccatgacatgaggttcacatggggttaacttaattccctggctcaaaggaaaggtattaaattcagacttgtatccaaccattcctgaagctagacttagccctatttttcaataacatgaaccaatcaattttcacatgagtccaaaataattctatgttaatacactaaggtactaggaaatatagtttgagaaatgttgatccaaacattgtgttatttacagtggagtattgacataaactttgaatcttcaaatatgttctggtgtcttggcatctcttaatacctattagcttacaaggctttcactcaactattttataattttgataatgacttaattgattagttgatatattgttaaaataaatatattaatgaatttatgataaataaggcagataaataagacatgcaattaggaagacatgttaaacaaattgttataataatacaatcactctcagcttaggatagctcctggccactttctctctgggtggtttttactctgggagtagtttaaatcattatctagtagtagtttaaagcattatctttgcctaagagctttcgctgactccccacatttgcattgtactaagagttttctctgactccccacataggtctagaccctagtattataagattctcattgtacttgcactttgccttcaaagtactaatcacggttttgttagtgatttgtgtgatgatttgttgaatctttttttttttcccactagggtgtaagccccatgttccatcttgatcaccatgtttctagcccagtgctggcatatagtgggttctcactaatatatctgtagagtaaatgaagaaatgcatgagtgacatgacaggagaatttaaggatgccatgggagcataaaacagagggagccacctgggtgaggagagctgagaaagacttctggagaggcgacatttgagctgagaaaggaaagacaagtgggagagtcctccaggtgtagaagttggagagatgagcgctccagttaggtagtatttgaagctgatgtagaaaaggagtcttgagccagcttgtgaaggactattggagagttttatttttatttttatcttttttttaatttttgagacagaatcttgctttgtctcccaggctggagtgcagtggcatgattgtagcttactgcagcttcgacctcctgggctcaaacaatccacctatctcagccttctgagtaactgggaccagagatgtgcaccaaaatgcctggctaatttgttcattttttgtaaagatagggtctccctatgttccccaggctattctccatctcctgggctccagtgatcctcacgcctcggccacccaaagtgctgggattatagaagtgaaccactgcgcctggcctattgaaggtttttaatcttcagagtttcgactttatcaacaacacttagaagccaccaaagaattgcaggtatggaaatgacatatacttttgcttttagaagaaaatcctgatcagtgtgcacagaattcttcagggggcaagtgtgattcattctgataagatatagcatggcttagactgggagactggcagaggctttgaagatttctttgctcaaattttattcagcaagtatttaccatgcacctactatagcaggcaacatttttaggaaatggtgaatgttacagaggtgaataatacagcaagagtcgttgaacatatggagtttatctattagttggggagtgaatgttgacaaaggaataagtaaatacataggcaagaaagatacattacctgtgaaacagcagcaggtagactgacagtggagtatctaatacagcctatggaagccagaagatagtgggatgacatttttggagtactagtagaaatgtcatatgaagaactctgtaggaatgtaacatacggtcccatatatgaagctcctgggtcaagtatacctgaacataattcagggatttgagggactttcttgtaacctgaggatcaagatgtcaaggaattaaaaacatgtataaaacattgttgtataaaaacccattaaaaagaatggaagacactatagtaaaatcattgtgggtttagttgttataacacattttaaaaatctttgatcccaatcaatatttataagaaagaagaaatatggaattatttcctgagtcaaggagcagggagagaatgaggaagaagaggaggaggaggagggggaggaggagacaataaacctacttcccaaagttaacaaacaaaaagtgggaagaggtcaaagactacaaggagtagaattaacgtcaattgtttctatgtttgagtctgaaaattttttgtcccttctccaccaacctatatattgatacacatataaatgctaaaggcatttttgaatttgaacagatcattttctttgtatggctgcctttaaaaaaaattcaacctggtcactcttcctcaacatttactgaggtctaagtgttcaatttagaacacatgctttaataactcagagacctgtcatttgtcacaaatcttgcctagagaaatactcattagcgaattaggcagaaagaggatgcaaaataaaaaggcacagtagtcccctgatatccatggaagactggttccaggacaccaccaaacccctccccgcaaataccaaaatccatggatgttcaagtttcttaacatatcatggcatagtatttgcatttaacctacacacatcctcttgtacacttgaaattatctttagattatttataatacttaatagaatgtaaatgctatgtaactagttgtgtatcatttaggaaatgatcacaagaaaaaaagtctacagatgttagtccagacacagccatcctttttttttttttcaaatatttttgatctgtggttcattgcatccacagatgtggaacccatggatactgtgggctaactgtattaataaaaaagtggaaacatcctaagtttcatgggtgtttaaattggtcagcaacttccttctgaagaagtatcagaatttgtgagcaatgttaatatttttgttttctcactaagagccacagttctgaatagaggtttttaaaaagccctagcaaggtttctttagcaatgaaactaacatttaactgtatcatcagcttcgtgttacatctctttcctgactgttgggtgagccctcctcggatgcttgcttctggctacacgcccctttacccttttctctgcactgttttcatctttataaagtcagagttggtgtctataggctctctactgccacattcaagacctgcctcgctcaatgtcaccttcaagatgcagaaatagggatttgggaaggggattgtgaaattttcgaagtcttccaaaatactttgagaaactatatttggaagcactttggggggagaggttggacaggaagggtcttcagagatcatcaaatttaactttctaaatcctaaggaggaaaccgagactccaggatgtgaagtcccttctctaccaaactagaatggatgcaggaggaatgtctgaggtgcaatccttatcctttagcaaaggtgtcctctgcgtcttctttaacccatctcttggacctccagaaagacagctgaggatggcaaggggagtctggaaccactggagtagcccccagcctcctccttggagggcccccatgaaggaggcccttcagtgacagagattgagagagagggagggcgaaaggaaggaaggggagccagaggtgggagtggaagaggcagcctcgcctggggctgattggctcccgaggccagggctctccaagcggtttataagagttggggctgccgggcgccctgcccgctcgcccgcgcgccccaggacccaaagccgggctccaagtcggcgccccacgtcgaggctccgccgcagcctccggagttggccgcagacaagaaggggagggagcgggagagggaggagagctccgaagcgagagggccgagcgccatgcgccgcgccagcagagactacaccaagtacctgcgtggctcggaggagatgggcggcggccccggagccccgcacgagggccccctgcacgccccgccgccgcctgcgccgcaccagccccctgccgcctcccgctccatgttcgtggccctcctggggctggggctgggccaggttgtctgcagcgtcgccctgttcttctatttcagagcgcaggtgagtggccaccttcccaggggatcgcggctgagagcgcccatctccttcccccgcacttggaaactgagtctggcggcagggctgggccacccagagcttgcatattccggaagggaaagtgactccagaagggagagaggaagtgttgagtttggggacaacctggcgcagggctgtcgggcgcaccctgctctctctccgcccacgcaccccagcttctcggtgctctgggggcggactcccctggccggacgatgggtttgaatctcaccccgtcccttcgctgggaaacaacactggcctctcaccttttctggtagtgattgcatactttttctccctgtcatttctcacttgaagttaagaatcaacttctgttcacgtaggaaaaaagatgagcgccttcacttgggcatctacctttcccttcccgcccaccacccggcgggtttcggttcctgcgcctggctgctctgcaggtgtgctggggccacggtgctggagggctgcgcggagcgggaggtcgcggtgctcgtgcccaggtcgcccaatgggtgggcagaatgacacggcgcgaccagagaggcgcgggctcgggatgggggctctgcggctgtggcgctgtcctgtgggggtgaaggaagagggacagccccacgtgcctgctagggatgtgggcggaggaaggaagcgaggtgagtgtgatggcacagtgttactacagtctagcaaataaccaaccttcggaaagatgaagaggttttttgcacgacggctaggaactgcagagagatagtaggaaggaaggggtaaatttgtaatattatgctttctggtggtttatgctcttgtgttttcttggaaattgcagtgcagttggttggattcattcaaatattcttgtctggtgctgtgaactctttctcagaggaagtggggggctgactgtgcatttttttttatgggaaaagaaagttgggtttggactacattcgttttcagattcaaaggtgattactaaaccaaacgggatgcatcaaaacatggcattgcttggattgtatggttttttgacatgtgccaatgtctcgaactccattacttttaatcataggctttttgttaagtattcattatccgctagtttgcattttctagaactagtgtgattacctacttaaagtagaaatgcaatgagccacacttcagaaaatctgcattaaatataatctactcattgagagttttgttgtttctaaaaagacaacttttgagtggtttgcttgcaacacagataacaaatctatatgaaagtgactaaacgtctttctttcattggagtgtgttgcaataagaatggcttacccattttctcatccagcattttgttaataacccccatttagtgcttgtgcatggagtgccagcgttgtgcgtggcaccgtcacctgcgatggaatgagttaagaatcatttattcaacagacagtgtccacttactatgggcatggagccagatagcagagtggcctaataaaaccattaaaattcttagtcaaacaaaagagcaacaatcagaaaagggatcaaagatgcagtagttctccactgtttatcttttctaacaccttcgggatatggcattttcattgccataatagtgaagagagtgtccaatgttgaacgagcagtaggaaatgaaggagttctaggaaccatgaacagcttggcttggcaggagctgtggaaatcggtggcatggctgtgtaggaaagagtgacctgctgggctcttgttagagttgttcagcttttccctaggaattctcggtggtccccgtgggtgaggagtcagggctttcagtgatctcccatcatcctttagcagtcttgatgctgtatggatgatagtgaaacattcagaaccccttttcaaagtaaacgtgtgagttagtaagtctagccagaaaatatacctttgaagaagttaatgtcatcagacttctgggtacggttttcttaaataccatgaaaattcggttcctttgacttgtgcaaaataatttagctattattctgaacccaattttgtattgcattttaaaaaggctatctccttcagtaaagaaaaaatattaggaacaatgtgttcatatgaatataccactagatcgggatgcattttactggatattgtgtctacaattgttacccaaaggagtcctaatcattttgagatacattctgaaatatttacagataaaactgctttggtgtctggaatttgtttcaaaataatttctggttgcttacagatgaaaaaagatttgccatacattggtaatagctgaagcgctgatgcgtgcctaggggttcactctgtaattctttccccttttatgtgtgttagagatcttctttcaaagtcttagctaagagaatagtctccatttgacttgccgctgatttaacattttcacttatatcggctcttttggattggaacttggtaccaaataaatcagtagttttttgattcccactaaagttgtgaatcaactatctgaggtttctaaatgcatttgaatgagaacaaactatctagtaacatgtttgtagtttacagttaaaaatgacgaattagttttattgtttttgtttaaaggtggagaaaagaaggtatgcaagtcctcaaggaaaagcagtttgagtttttaaatgcatttaaaagaatgcccagaatagtgtaaaaattacggtgacggttaaaaagttttgttttcttaaatgtttgaatagataaaattgaatcagcctcctaaatgtttgcagattgcatgtgcctagatgtaaaaaatacatatctactagatccggtgtagcttggcttttcccccaccaccctgccaaagagaaaatagtgtgtggcttctgctatatatttaccacatagtattcatactttggtttacaaagaaaaaaaataaaaaccctttcaaaaagttgctctgtgtgtgtgtgtgcatgtgtatgtgtctttaacatccatataaccatattcaaagcttagggtttagctataaagataaacttttcagaaaactgaagatgttttgcccttttaacttcttccctcgatcccccaatatgcacaaaccaacctccctggttgtttgttacccaggacagcagtcactactgaaaatctgatgtagaggtgtgcactgcctgtttgaaaacacagataacgaagtagcacaaacgtcaagcatcctgcctcatttaaccctacaaatgattaagtttcaaggaagttaaaaaaaatgagacagtgtatttcgtaggcacattatctgacaaatgcattttaacagtccattttaagtcagatattcaagatttacttaatgttttcagacgtgtctaagtacaatgaattcattggttactcagtttactgtgacttttggttgaatttctgtgttcctcaatgaagtgtaagttccatgaagacagggactgcttgctttgcacaccaccttattcatagcatctagcccagtgcctggcatgtctaatttactgcaaagtcttttctaatgatttgcaacactacagatatgcccatttctgattgtaatatgcaaattatcagattagtggctaaaatagtatcatttttcaatcatgcaatcctccaaccagactaatgtgtgctagtaggtaggttgttgggtaggcgatacattcgttcagtcagttcgtgggcatttgctgagggtccagcatcagtctggctccctccctgctctgcagttccttcagcttagaggccctcatttacctgtgtgtgtggctggccttgcaccctgaacctctcctcctccgttttctcctagtctccattttcaggaaaggagagctgcaagggcattggaatgagaaagacatgtggttgtaggttaaaaataaatttctaatgtgtgatccttgagtaaacaaaataaatgagtatattaaaagcaattattccatgcattcttgatttcttttgggaaaaaacagtggatggggttttatacatattttagctataatgctgccttccaaaacagtggttctcaactgcacattgaaagtatttgggaagaggttcaatgattggacacttcccttagggatgttgatgaaattggccagtgaggggtggggtaggaatgagatgggatctgggtgtgggcatttttttaagagaaaggggacaaaatctttgcattgtacttatttgcatcaaatcagtaaccattattaactgtttcagtatctttgtactaattgatgttacttgtgaaacaattttaaaattggtgtcagggaactttggaatcgtttcaatagcagaaaatctatattttaaagcatgacttctcaaactttaatgtgtataagaatcacctgggatctagttaaaatgcatattctcaggcagtatgccaaagtaaagcctgaaattctacatttctagcaagccctcagggagcccacgatgctactcattggactaccctgagtatcaagaatatagggttcgggtgcagtggctcatgcctgtaatcccagcactttgggaggccaaggagggaggattgcttaagcccaagagttcaagacaagcctgggcaacacagcgagaccccatctctaccaagaaaaaaaaaggaagaaattagccaattagccaagcatggtggcctgcacctgtagtcccagctacatggaaggctaaggaaggaggattgcttgagcccagggatttcaaggctgaagtgagctatgattatgccactgcactccagcctgggtgggggtgacaaagcaagaccctgtcttcaaaaaaaaaaaaaaaaggaaaagaaaaagagaaagaaaaataataaaggggactgctgcttctcttagacagctcttagcttgtcagcaggactccagcttaacctagggtccccaggcatttccccactaaggccacattattcctttggctcagcagttttctggtggtgcgtcagttcaggcctttgcatgattcttctttcctgaggtctaaacccagtgacccttcatatcagttgcctggacttttctggtcttgtgggatacacaccggcataagtaagcccttttttttttttttttttttttttgcaaagtgtctgattgaaaactttccttgtataaaaattcacatattatgacttgtattaattattctaaagaatataggaaaaatacagattgtacacagttttgcttcacggtggtatctcttccatgatgattataggtagtccttatatgtgcaagactggaataataaaatttgtattagtgagtgtacatttgttaaaaggctgtcatttcattttgagaatctcagatatggataggctctttttagtttatttctaatggttggttaataaactaacacatcattctgattaatttttaaaagagagaaagagacttgtcattaatttgactgagctttgtaatctcacgtagcttttctttttcgcttagtttgtacatgctaataagaaaatgcaggtgaagtaccttgaatatttaacaaacaaagaggacaagttaaattctcattattaaaacagatgatagctaattattgttaccctttacttcacagttgaaaccaccacaaaggcttggaaggagcaggcagacaattttaaagagtagtgattaaagatattctaatgctggacacctattcttaacaggcaatcagctaattactcaatgggtatattttgggtgggacaattccttacattacaggaatcttagcatccctccagcacacgtctgtaatatctgttcatgcagcctccccaccctaacgtgatgacaccaaatatcacctgcatccattcccaaacacccgctgacaggtataccattccagcttgagaaacactgatgagagggtcaacaaaaaagacagatgacacgtctgacttcaagttttgtttggaggtaaaaaagtggatttttctctcccttctttggctgattaaggaaaaaaggccaggccaacatggtggttaaagatgatgttgatttcgcctgttttatataggtttcatgctctgaatttcaaagtgggcctcataatcccatctagcatgttgcatatagttgatttaaagacaaaaagcttcctctgccttcagtgaccacatgtgatttccttggtgcccctcccctctatgaacactttcatgttgttagacaagtttgacaatttcccccatgaatcacgcacatacacttctgtcattgttaaaagcccatcgcaggactaactgtgccttgtcctgtggatgatagtcagttactcgttcaaatgaattagaagtcaacgttttcaccatcttgaggttcattgtattaactattcattgttggggacataaagactcttgcgagtatgaattttttgttcttaagtcacactgtattaaatagcaggatgactagtgataagcactctaacgtccttactgtttctcctcctcagatggatcctaatagaatatcagaagatggcactcactgcatttatagaattttgagactccatgaaaatgcagattttcaagacacaactctggagagtcaagatacaaaattaatacctgattcatgtaggagaattaaacaggcctttcaaggagctgtgcaaaaggtaagtccacatcgaggctgataagtcaagggcccttgctgactctaccaatactgaaaattaaaactggctaagtgctgttgactctgctctttttattctaataatttgtaaaagagctacagggaatgctttaaagagattagcagaattattttgaagttggtagtgattgattatggcaatcagggacgttcatgcaaatattcttttctttcttttcttttttcttttaaagaggagggatttaaattcacacttaaattcacaccttaagactaaggtggctgtggcctgtctgtgagtcagtatgctagtttgaattccctgacctaaaaaccatccgctcagttcacaggactttctggtagctgtttcctttctgtttggcttcgtaatggcagggccccttattccacatctgttgatccagggctctgatgagaagcagttgtaactcttggtcctttgctgtcatctgtggtgaagtaggcagagcaggaaacaatgtgagatggagattctgtgtccgtgttctcattttctgggagagctgagtgacaagagaagagttagggacagagaagaccaatgacttctcttacaccgacagccccagttgggaaacactgtaataactgccagttttactttcctggacaaagccacttgagaattctgcagcccaagaattattttactcactgactccaccaaaacccgggtagaacacaaacagtgaccccagtgcaaaacctgtgtgtacgttatatacctgcatgcatgcatccacttctacatcccagcctctgtgttgcaactccctgggtctctggtcattccagagtaactcttgaagttctcaaagcccttacctctaaatttaattctaatgtagtttattttttaaaaatccacatatagtaatataattatttaaaaagaggacatgtgtcagaggtagaggtaggaagatgtagctgttttgtaaagccagctaacaaaggtgaacgtctgtaataccatcagaggtagaggaaggaagatgtagctgttttataaagccagctaatgaaggtaaacgtctgtaacaccctgatagttgagatttgctgtattttatcgaatctaagttaccaattttcagcctactttgttatttcatgcatcactaagaaagaagaaactgttgattaaaaaaattaaacatgatcatcataggttctagaggttctagttgtatcttaattccagagatatcaaaacgttaaaaagttgtgcattatggaatgcatgaagtacctattagtttaatgtgtctataagaaaacacattgcttatgaaaattactttttcattatcattagtgtgtaggtgtttggcttcacgcagaatagatgtatatgtttaaattcagtgatccttaatgttacagtgtaatttttgagcaacagcaacagcaattctgttaatctattcatttttattgttctgttttatatttcattttcattcgtttgcttattgtcccacttgtgaagcttatctcttaaatactgagtaatctgtctttaaacaacctattcacatgcactaggggcaatctgctagttcaaaatggcatttcatattaaggtaattctggttgggcaaaagattgtgccctaatgttctgtttagattgactcatgttgtaactcctcaaaatgatgagataaactttttatttcattggtgtgctggttcttaaaagttaccctttgagttccttatggaagaataagtatggaaaatcagccaagttaattctgaaaataaataatattacgaacaagggcaggcacggtggctcacacttgtaatcccagcactttgggaggccgaggtgggaggatcacgtgagtccaggagtttgagaacatgctgatcaacatagtgagaccttcatctctacaaaaagtaaaaaaaattagctgggcatggcaacctgtgctgtagttccaactgctcaggagactgaggtgggaggactgcttgggcctgggaggtggacgctgcagtgagctgcggttgcaccagtgcactccagcctggcagcctgggtgacatagcaagaccctgctaaaaaaaaaaaaaaaaaaaaagaaaggaagaaaggaaggaaggaaaaagattattaacattatttatgagactgcaagagtggttcaataccaacgggttaaaggaaaaaaatatattatcatcttatagatcctgaaaagtgattgacaaaattttgcactatttctgatgtttaaaatccattagaaaacagaactggatggattcttgatgttattacgaatgtaataactttttatgtttttacataaatgtaaaattttaaataacattttacatttagttttaactaaaagttacctaatgattaaacataagagcatgtttcttaaagtcaggaacatgaccaagatgcccactgtccctacgttatttagcgttgttctgaaggtgccagctaatgtaattacacaagagaatgaaataagaaaatatatatagagaaaagagggcagaatttgcatgtgatataattatatacttaggaaaattcaaaagaagctgaaatgctacaagcaggataaaataaatcagtttgtaaaaattaataagtaataatcactagctgtccttatttcaaataactagaaaacatgagtgaaagatttcactcataatttttaaatgctctaaaaataaacataacaagaaatgtacaaggcttataggaataaaactagaaacctctacagaggcatttaaaatacaattggataatgtaaagacataactatgcacagtcataatttttgaggtataacttgggccaaggacagcagacaaatccatggaagagaacaagcggcttactgtgtgtctctctgtgagtgaatgtatgtgtgtatataatttaatataatacaacattactttaaataagtgaacatattctgaattcttaaaaagcatattgttcatccttttttaaaagttatagtaatttctcttgtcctaagtaaaaataaatcccagattgagagagtacttggtagccaattgttgctcactggcagtagtgtcccttaacacttaatgtggcttcactgaacttttctgccacctcctgcctcatcagaacattatcccacttcgtttgcgatttctaagtgactccttaggtagtatggaaaagcaatttgtatgtaaaggtgttagtgagcaataatggcagaattttcactattttaggatccttttggagacatgatgcctcattccaaatgagtaacactaataatgagcgattcactacttggcaaaccataaggagaaaattggtggtcaggcaagaataatcaactgcgcttattaagggcacgtagtcttaattatactgataggttattatgactcacaggatgagtagaactttatttcatcaatttcacatttgcttttgttttgttataggatcttagcctttttgcataggtaataatatcagacacaagtaatcctttttaaagaattataaattaaagctgttataccaatgtgtgtttggaggtagaagatgccatttcttccccttagacaggatctttaggaaagagacaagtcttatttataccttatcattagaatcaatcagtgttcattaagtgcacgtaatgtgctaggcaccttgccatgtctttccctatgcccaaggatttacccttctcttactctattcagataattgtttgccaaatgtgttatcctttgatgaggattatcggttaatgtgacattctacacatcttgccaaaataatcagatttctcatttctcttgccaatgctaaaaataggatggatgcattaggcattcttaagtaagtttgtaccttagttttatttctaatgtagatattgagtgaacccttaaaacaaaattacatgtgtggctgcaatcattattgggagatcaacccctccagtggtaacagataccagacataagcacaatatcacattatatgtgtgcgaaaagtggtgtttacccaacatgtctttggtcagacatgtaatgctgtttttttccccatttttgtttgtggctgggttttcttggcttcccccaccccctttagcacagaactctgaaagcctctaagtgatccaaccctaccaaccacaatttataaagtctatcataacagtctatgacaataaagaaaacactagtacaaatatggtgtctgatttataaagtgattcttgtttccagttttggcagcctccctgcttctgccagccggggggtgaggaaggagtgaactcagatccaaacgaggactcccaaaatggcagagaggacactcagcccatagaccccctggccagactgggtggaaagccatctgtttatgcacttactatacattctgagcacttgagctgtgactgcacttgactttagtgtgctggcttgttaatttcacattgggtacctgtttgcagataccttcctgaaacttacttgcaaaggcatttgaaagaataatgtgcaggagaaaggtcaataaacaaattgcacaaatcacattcttctccaaaatgggatgttcagtgcattaaagatgatcccctgggatgtgggaaagaagcatagggactttctgtatatgtattttttaatattagcttttaaaagctgtgctttagtaaatattttggaatgtacaaatatacgagagtgattttatttaatatttaaataaatacatatgtacatttcagagcatgaaaaattttttccctgatggagctgcacagtcagccatttttgaagatcatggagtgaagctgcaagctccatcaggacaagggccacagccatttcgcgcacatctgaatatatcacacttagtttattctcaggaatgaatggagaaaagcatgaacaaatgatcaatgacttattgaactctgtaaactaatattttacatcaacgaactcataaagccattcagaatgttacaagccttgttcttatttatacgatgctgtcttaccagtcctacaattgataattaggaatattatggcctgaggcagtaatgcttcagtacaataataacacaggtttatttttgttagaagttacccccagctggccctctcacatcagtcacattttcatcaggcttctttgttctgcataacctgactgctatgtagaggtgggcttataatgtgaactaaaaacatgattctggctccatatatgagttaaattttataaaactctctaacttccctccaaaatatgaaaagccaatggtattgtaatgactgctgataagttatcttgttgtcatatcctcaacaaaccattccctggagtataagcctttgagtctctaaagacttaactggagaacaggaagtaagaccagggagccataattattaaacaattcattcttacctgaaattcttttttattccctgggaatcaggtacctatttggcctcatcttcagaattcataatgtagaattcagaattcacaatatcctctgatattaagattaatatacccaaagatttgtagcactttgatcctcaatgaagtatttgctgttatttggtatagtctgagctgggtaacaaacagacccatccattcagtgaactaactaagaaactttttccctctcacataacaatccagacgtgagtcatccaggaccagtagggatgctcctctgtcctcagcatgaaccttccatctctgtttctaagttggcttctccatttgctgttatttctagataggggaagggtaaaagaaaactgaagacagtacctggaagtggagacatcacttccagtagcatcatatcggctggaagttactcataaaccacatcttgctgcaagggagactggacaaggtagtctctagctgagcagccatttgtccacaaagcttgaggaagggagttgcctataactaataggcaaaaaggagtggaaggagatgaggggacaatgagcagtctctgacattcactaaaccccatttaggtaggaaggaggactcaccatatataagcaagagttaactctgagaacacataagtctattaaaaattttaatggtcaagattgtattttcaaaaggtcaaaatactttgggattatttagattgcaagagagtgagagaaatttgaaagtagattcaacagcattcatctttttgaggaagtttcaaaggtctgtttagagattgcatctgtgattgtggaataaaccttgattgtcacctgcaccgcttttgctaggttttgtagattaaaaagagcattaattaaaaactagaaagttcaccagattaagtgattgtgttttctacatatgggaaacagatccccttggattgcaatctccattattataaggagctcattcctatttttgaactaatgtaaataagaaatcaatgaaatttaaatagattgtaactgcttgtgaaactgtaatcattgaagttgttatatgccactatttctcatttgcctattagttaaaaaaaggagaggagggattaaaccccattcattgcctctttccctttgtatacaagagtatgtgtccgaagaaagtttctcataaacccacaagggtacttggtttttggagcactcatgttcccaagtcacgatgttagtcatgtagtggttttccaataggatttcatctctgtttgccataatagttttggaaactgcaattcaaccccaatcacatttagcgtttataaaagctgtctttatgggaaagctgaagtaagacccacagagttttcctacaaaaccaaggccatctattggctttagctcaacaataagttattggcttgtactcaatttcaggggagacccagggaagaaggtaggaagcaggagggtttgcaagaggaaaataaccggtgagttatgtcagaggtgggcttttctttgtgttacaagtaccccaggatggaagaaaagatattctgcatgacatctttaaagaaacagagagctggaaggacatgcttgaaagaggagccttcattatgtggcctgggatcttgggctaaccttccagaagtggatgaaactgagggtccttggttggagagcatgacagcaagggatagattggattgttctaccagcagcggcaggagaggtacagcctgtgtaattgaagagcgggatgtgccttagagcagtgtttccaaacctcctggatcttaagactcagttggggcccttgttttaaaaagagaagagaaaagtcctccagatctatcagtggggactctgatttggcagttcaggggtggactctgtgatttcttcaaagcatcctaggaagaggtgagagccactggtggacagggaagccatggtgaatgaagtgactatatttgagaaggagtgtgaagcctgtgtggtatgaaagaggtgggtcccggaaattgtcaagagctgtctgtttctgagatgaccagacaacaaatgcttgctcaaacttttggaagttcagggtgttggggagttccattctcacttagcttctgcatcactaggctgctactcctgtcctcagtctttgcccttcaagaacactaggtagcggcggcggtggtggtggtggtaccagtaaaaataatcatcataatgataaaccctaaggctcatattcatcaaaaagtttgaaagcactcagaactcttctcttcagtgcctgtggctgcttctcatttgatctagtttttcatggtgaatgacaataccattatctccaccaccccaaactggaagtcagaagatggtcttatccttttattcacccactcttcacctctcccccatcctgtgaattctaccgccttacaaaaccttcaagtattgtctctactctgctcactgtgtggtcacatgaacagaggtcatcatcctctcttgcctgcatccttgcatctggccaccccctcctggcctcactgccactggcccatccttcccatagctgagggacttcgaaaatgcacatctgaacaggtcatttcttttcctgcttaaagcatccttcagtagatcgctgtggttgtcaggatgaagtctgagctgctgaacatgtaacaaaaagtcctctgtattctggaaagcctcgttccagcccctgcctcttcaggcttgttaccttgaatgctccatgtcatcgcctccatcgcaacttgtactccacggcctcaccacagtatggtgctgaactctcccgacctggccataccctttcgcctctctgcctctctgcagtaatcagcaagtgcagagagggcaaagggcatgtctgtcctgcgaacagtgtcctcagaaacccacaggactcctgactcctagcctccatcggtaaactttgttgaatggatgaatggatgaatggatgaatgaatgatgagtctttgtgcatagtcctttgtatgccactccatgcccttctttgtgtagtcggttttctaattgtcttttaaaatccaactcaggcattacttcctggaggaggagcccacagatgcccgcccacccacctgtgggggtaggtgcccctcctgggcccacacggggcttcttgtaacagcagtaaccacacggacctggggtgaactggctcacttgaatgtgagcttcccaaggacagggtctgtgggatgtttcctttctacatttccagccccagtggcaagcacatagttggtgctcagtgaaagtttaaagaacaagtttaatgaatatgtgagtgacctgtgccctatgtgtgcacacttggtgtgctcaggtggcgagttgtttaatattgccagaagctagccagccatgtgatcaatccataggattcttaaggggctggaggtcactcgcaagctcagtgttttcctgcttctttgagaggagagctcttttcctctttggagcgtgaacacgttagggaccttggggttgggggtgctccttcactggtagccttggcccttttcttcctggcctcatggatctaaagcagctggcctggtatctctgaccccctttgcgtctcattcttagggagaagtctgtgagagcaaagtcttttccagaagagatgaggatttgtcaatgtagaaagcactgccaatggaaggtggcattatttttcaagtggcagaggaaaacagagacatggtaaatagcacaattagcccaagatgccacactgcagttactctgccaaacttttagatgacactttttaaaccagtagtatagtataagacatttgaaaatcgggctctttatgaagactaacattgctgtcataagactactttatgaaaacccaaggggacctttatctgtagcagaagctttctcatttaaaccatgaaggttaaacaataaaaactaattttctattcccagcatacccatcgcactcccaggaaaagcatcagtctgctttatgaaaacaaggacatgctattctttagctctttggtaggtagaggacatgaactgtttgcaaaaacgagtctcttccaattagcagacttcttttggaagaaatgatccaccagtgactgtatttggggtttggggaggaggccaactcacatcttggtaaagtttttcactgagaattttcactgatgggcatgggatggtggccgctgattcagtaggagctggagcaattaggaggctgagtgcagtggtagtggtggtgcggagtgtgtagaattcatgttgacaagagtttggctttgggagaatttgattagtcagtacttttatattaaaaataaagaattatagggatcagaatgttaagttacaaatttaaggtgaggatggcttttaccttcgggatgagtggggtctataccctacctaccttcgctcctcctatctgcctgctgggccactggaccccttgcccacctcatgatttttcccctctcctctggggagggtgaggacctgccctctcacctcccccagtgctcctgtcctctcccttcctggtgtcttatagggctctgctctacggaacctaggctgagaagggcaatccaccatgatcttttataacatgtattcaggcaacagagaactcaatgaatcctgctcttaaagttctttgctttgggtgtttttgcactatgggctcttcataaggaaccaggggtcaccagctccatccaggtgcatatatgtgttcccccacatcctgtggattgcaaggtcagtgtgagctttaggggagggaggaaagcgagaggctggggcagcgatactaaagcctatctcattagctattgcacaacacccagtggccactctttctgtgccttgttagccaagaatgccgtggaaataagagcgttgcaattaaggatgagctattgatgaaacactggctaaggcagctttccaagggagcagtgtgtgcaaaagtctgcatgtacaggagggcagagttcttgcaggtggaactaagagtaatttcatgaggctggaacctatggcatcccagagcctccttccaggtgatgaggtttgggagtacaggggaagaatattaggggatttcggagtggtaaccagactaagtgaaaaactaatgtttttctctgtactctcataacctgtctgacaccaaatatgtggcgtttgccctcacacaaagcagttctccaactcttcaggcactaattggatgttctgcaattcaattatgatactaactattgggaggtaacacagccccaacaggttaaaggctcagccccacaagactgtcccacttcagatgccattcacaagtgctaggttgttgcctgtatttctgaccaaccagctacaaatcgggggttcccatgacctcctactcaggttcggtaatattcttgaatggctcacagaactcaggaaagcacttgacttactatgaccagcttattataaaggatacaatcaggatccacccaatggaagagatgcttagggccaggtatggggatggagagggtcgtggagcctccttgcctctcagggcatgccactccctcagcacctggcatgttcacctgctaggaaggcagtggttaccctggctcaagcccactgttgagagtttttatggaggcttcattacatagacatagtttattaaatcattggccattggtggttgatgtcaaccgggaggtcaggaagtcaaggggtgtgatatggtttggctctgtgtctccacccaaatcttacctccaattgtaattcccataatccccaagtgtcaagggtgggaccaggtagaggtaattggatcatggggggtggttcccccatgctgttctcatggtagtgaatctcatgagatctgatggttttataagcatctggcatttcccctgcttgcactcactccgtcctgccaccctgtgatgaaggtgcctgcttctcctttgccttccaccaagactgtaggtttcctgaggcttccccagccatgcggaaccgtaagccaattaaacctctttcatttataaattacccagtcttggccagttctttatagcagtgtgaaaacagactaatacaggctgggactgaaagatccaatcttctaatcacatgaccggtccctctggaaaccagatcccattctccaagggtcacatcattagcataaactcaggtaaggttggaaggggctgattttgaataacaaaggatgcttctgtgacacctgtcatgcgggaaattccaaaggctttaggagctcagtgctaggaacctgggatgaagacgaattgcatatttcttattatattacaatattacacaggcccagttatgcagggccttctaagccctggtaaggaacgtggacttgaacctgaagtctggaagcagcccccagaggattttaagaagggacatgtactttaggatgcactctaacctcagtggatcactttgaggagggcaggagacaggaagaggaggtaggaagctattatgctagtcctaatgagaaatgatgaaaacttgaaggaaggcagtggtacccaggttggagaggagggaatggatttcccagctatttacaaggtggaaatctgcaggacttctctgcaggaattggaaactggctattcattttcagaaataacccatgtgtggcattcatgtgctaactcggctgatgaatgcactattcttgtaactaggttggagaagaattacatgaagggtatcattaagatgttaaaatgaatgcattacatatgttaacaagtgtatgaaccctgtattatatctggcaaacggggtgttaaatccttgttcaaccagccagatgtctctgcagctgctgctggtattgcagagggaggcagccacctgagaccccagctataagctggtgccagtgatttccaaagcatctggctgtacaaattccttcttctgtgctctgattgacaggtaccacatggatcacacaattcacatcacaatgcacaggtgagattttcagtctgataagcccagactccagcaacttgaccttttcagaatatctttgcagctgagaatgttctcagttggagctgaaatctatttattattattattattaatttattttttttgagatggagtctcattctgttgcccaggctggagtgcagtggtgtgatctcggctcactgtaacctctgcctcccgggctcaagcgatctcgtgccttagcctcccgagtacctgggattactggcaactgccaccatgcccagataattttgaaaatatttttagtagagacgaggttttgctgtattggccaggctggtcttgaactcctggcctgaggttgatccacttgcctcagcctccgaaagtgctgggattacaggtgtgagccactgcaccaggcctatttatattactttgtaagttgaaaaaaaaaacactgtagtaaaacaatcttaaaaacaacttaataacattctctcctgaattggaatgttatcaaagtcttgtttggggcagttattcagctgaatttacaaagaggggcgtatcctttgctgtaaatgtttaaattgcctgaagcaaaattcccataactacttaaaggagttgaaaatactcctaagtgtttatacttattcttacacagtaccatctctcctgagtggccctagtttactgagattgagccagctctgagacatctccctcctccttaagtttggcaaatatcctaaaacgtttgaaaagatgtttaaaagatctgaaggaagctggtctcaatggaccagagacaaagtctgcacagccaggctcctgggaattgcacttcttggatgttgagttcaggagaggcagtactagagaccacagttacacaatcacattgatcttttgtgtactttgtttcctgcagaagaaattgtgtaatcccagcatttttttatgagttaaatagaagttgaaatttaaaaaaaaaaatcacattggttgttttcctgtctgtttaaatgtactctgacagcaaagatgaaaagttaatgcagtctaaatagaaaaataccacaatgagaagattttaaaaaaatattgtgaaatatcctcatctctattgtttttagacgttggggtttcaaatctgcaaaggctgactgcggcgttgtcaggattgtcaatgttggacagcgtccactaggtggcagtatctcagaaggtttcttttatccttgaatgggcagagatttctttggttgctctctttggtagttcggtttcctttttttgtcttgttttgaagggttaaatgaagctatcataatttacttatctaaaattgcacttatctaaaaatgcataaattcattgcaaggcctacttgttacagcgtgaccataaatgagtttattcattcatgtgaattttcttggtaacttattattaatgatcctagcgtgtaacagatgatgaatatgccgtatcctgagaaggtagatcacaaatcctcctgggaagctggacatgggtgctcattagccaagagaagaaaataggggcgtcctttgcccagcttcctcagcctggtaactgtttctggcttctgctccaggctgttcgctgagaggtttgttgaagttacctgcacttctctacgcaaatctacaggcattctgatggcgtaggtaacatgtggttgtgttggatgtttattcagagtgttaactaactggtttttgttaatttacagctggcttaaaataagataaaatgtacatacattttttaaaagatctctttcatgtgaataatttgttcagaagaaaggagtcgggatattcttttgtagtattttcccaaaattagattatcagaactttctgaattcaaagaaaccggcagtgccgtctgaatgataagattttggaataaagaactatagaaattttaaaacactctaattaatctgacagatgtagaggactaatgtggatgaaaagaaatgtaaatgcaaagcttagaaaataaatggaattgtcaattggggtgaagtttgggttcgtcttcagaaggactcctataatcctgaaaatgaaaaatattagggggctatcaaaaggtctgtgtttggcatgtgcatagcaaggtctctgatctttgagaagatggcaacatggaatggctccagctttgtggagtggactcgatagggtcatgtttggagatgcaatgtcccttatccatgtcctgcaggtcttagtcttgggggttcatcagccaagccataaacatgggttggccagttctcagccagttgttttctgaagcccctgggaattctgagatcatattttctgatgtcccggctcctttttgtcagatcccaggatccccagcagccagatgccagtcaaggtgagccaccttttcagagttactgcttcagggagggagtcacgctagggattcctgggtgggctagtggtattttgtcccagctttcaggagtgtattttatgacgatggcttgtaaaaggatatgggcatacagatccagagaccaaagttcaagtctcagctttattaggtgaagccttattctctctctgcctccatttctcagtctgaaaaatgaggttagtagtagttatagttttccaggctctgattctaacaaaagtcaaatatggtaacagggaaaatactttgctgtctacaaatgtaagaggttattaaattttcaatacgtggaatatatatgcaagtcatgagactatagtaaacccttaactaaattgagatgtcaccaaacaactattcatgggaacacttaattagtaacaatgcttctcaatacctgctacatattcttatcatctgggagcatctttaaaaaactacccagtcactatcagactaattgggttcattatcctggctgaggttggggtcagggtatgggtatcttctaaactgcctaggtgtctctgctgcgcagccaggtccctcactggaatgcatcaagtactgcctacaaaacttcagttacaatctcaaggccagaagacaccctaaaagtctagtcttagaagaatgttatttttatgattgatatctgtgcacataaataacaatggttttagagctcaaaaagctggggtgcagatacagatattgggaatactttctttgtaccttgaggttatagacagtcatgcgctctctttttgactctgaaacttacctataaggtttctgaggggaattgcaatccttcaacacccaaaaggtataaaatgagagcagcattacctcttgggtctctagctagagttttaattcatcctgggtcatgaagccttttgttctttttttttttttttttttttaaagcagacattgaaagtgcatctgagaggtgctgctggttactgaattttcctgaaacaaaatgggtccgtagcaactctgacctagaagtttctgattaaatgggaaagaaaagttcatagttcattcccgggtagaagaggacaaactttccctgtccgttgcatcggtggcttgagtctgctgcttctttggcctggatatcaagctcccagaaaatctccagtctgtgcctctgtgaatctttgaggatgtgaaagggattgtcattctcagatgaggccccaggccagcaacaccagctcactggtgctgaatgcaaattctcaggccccaccccaaatctactggatcagaaactctggggctggtcccagcagcctgttttaacacgccctccaggaggtggtggtgcaatgcatacatgctcaagtttgaggaccactgagctaggacaaaggcacttttcttgtttttctttttctttcttttcttttcttttttttagacggggtcttgctctgtcacctaggctggagtgcagtggcacgtcacagctcacttcagcctctacctcctgggctcaagcaatcctcctgcctcagcctcctgaagagcacaggtggatgtcgccacacccagctaattttaaaaaattaatttttatagagatgaggtctccttatgttgcccaagctggtctcaaactcctaggctcaagtgatcctcccaccttgacctcttaaagtactaggattacaagcatgagccatcatgcctggcctggctttcttgattataagtgtgtttgtatagaaaatcacaaaacaggcatttgtaggtatatgctagacttagttctgcttccttctccccttccccatctctcctctgatggaaaggcagatcagagctagagggaaaatgaggggtagcgttcaatctcagaattactctgtcaccaaggttcctcttccaatcttttaagagccagtaatcaagtaaagatatactgtgtatatataaccatataaagatatacacaatgtttagagatatgctgcatatccagctttgctggcaccaaagtgaagaagagatgaacagaggaaggtctattccctaaggccacccatccacctgcctgacaagaactgggaaataagaaactgctatcaaggcatgtccctgttacatgtcagacccctccacacactcccacacttccgcagcacttggcacctgctgcagcaagaaaaatgcccaaaagccaactaaacaagcagtagcatttgaaggataaggggcccaatggctgggaaactgctgatgtgagaaagaccgcacagttacactcacatttgcagcaggtagtagagcgccatgagcagcttaataatgaaattttcctatagccttaagggagaaaataaaaacctgcagaaagaaagaaagaaaaagatgcactgtgttatctataagtctgttgtgaaggcaggggagacaaaactaggaaattccagaaattaggcaccattgagaacccggaggtcttgaggaaatcttggaagactggaggttgacatgagtggggaagaaaacgaggcctgggaagggccactcaacccaaaaggggctaccatgtgcctaaatacccgccctgcacacggcactcccagagctgtgcagtgtagtgccctgggtctaggcaacagcagaaagtggctttgagtgagtcctagggtttctttctaagagtcagccgcactgtgactagaacttcagaacaggtcagtgaagacagctgtgctatctcctccaacggtcattaaaaacaacgtagattcttatctctctctcagaagtttggaagcagaaagaagaataaatgttatctccagaatccttccagctaataacagttgaaattatgttattgcctctatctatctatctatctatctatctatctatctatctatctatcatctatctatctatctatctatctatctatctatctgtctatctcaaagccctcctctctagacacttaaagaacttaagctgcatggcctatctttcaaacaccgtggggagaatggttagcatgaatagttattccagtaacaggggaaattaggaatctctccagagtggttttttttcagtatccttataatagatatctcttttgttttttgtttttgtttttgttttgagatggagtctaactctgtcacccaggctggattacagtggtgcgatctcagctcactacaacctcccccgcaacctcccggttcaagcgattcgcctgcctcagcctcttgagtagctgggattataggtacccacaaccacacctggctaatttttgtatttttagtagatacggggttccactgtgttggcccagctgatcttgaactcctgacctcaagtgatccgcccatgccagcctcccaaagtgctgggatgatgggtatataatagacatctaaatttaccaggcactctgctaagtgcctacacacattatctcctttagtcttcacaagcaccctgtgatggggtgctgttaatatcctccgtttatgcaggaacttgaaccaaggtgaaagcctgagctttcatcccctccaccttactcttgccctaagatgtgacattttagtgtcagctaatgtctggatacaggtgggcatgtggttacctatttcatcctttattctcagggttcaaattgagatatgcaattacctatactctttatgttttttcttttttctggcttgtgcttctaatcctctatttgtggccatattttaagttaattgttggtactctaaaggctcttagacttccatatagtgctttaagtacactgtaactttaaagtaaaaaattaaccactgggagctaagcatcgttctctttcctgtgggctgagctttagtattataacagaaattcactaatgaaatagacatgaaaagagccttccagaagatttaagagggtcatatattctgtgtagttgttattttcctagttaacttcatctccatttgtgtacctgctacagatttttaattatgttcaattacgccatggtttataatctacatcgtcttttacttcctcttaccgtccaaagtattttgtttgaagttgggtatgatctcaaacacatcaacaccaattcttttgggggaacttccattgatagccacctaatacatataggaatttcactgccaatgttactatggcacctttggaaggaaaagagggttaatttgttgcatatgtaacagccctgaattcttattgctttacagaaagaatgattttataaataaaattatttttcctttttatttcaggaattacaacatatcgttggatcacagcacatcagagcagagaaaggtaagcatggatccatacatctgtatgaaatcccacagggtcactactattttggctataataatatggtttctctcatctccagcgatggtggatggctcatggttagatctggccaagaggagcaagcttgaagctcagccttttgctcatctcactattaatgccaccgacatcccatctggtaagctctatctgcatccagcctgaaaaatattttaagagtcatttatcagcccatttcaatactgaaacctatttttagtctgtcactgaatttttgagagcccttacttcaaagccaaaggaaagaccattcatcctcaggtgatgattcacatcctggaaactgtgattctcaaaaatgtcagaatggacatcatcaccctattcattttcagatcatcagaatggatgcttattttaaatgactgccagctgaaagcctgtaacctggaaggacaatcctttgttatgctcatctgtactttcccaagctaaagttgacacagccctgctgctgacctcagaggtgaatgaattcatcaggtagtcacatactcagctatctcctgcagaggtccagggaggacactttagacccccgttaagatctttaagagacagtaaccctctagaaaatgagatctcctcccccttctccaagggcttatcattttctctgagtaaatgcttagcttgatggactagagacctgattatcttgaaaatgaagaaacccggagctctctgcctacagctactgtaatacaccagttattccatcatacaacccccactggttacttcaccatgggctagatagctatcaaaaagataacagaactttatgatacagtgacaattgaacattcttgttatcatcatgccactaatggaacacttgaagatcttaaagggggatcttcaggtgtcctccctggcactctactggagatggctgagtctgtgactacccgatgaactcttccacctgtcaatcaggtgttttccccttcctcaatacctctcatccttactgcaatcctgcaaggtagggattatcacgcaaattttgcagacagggaaactgaatgatacataggttgtcatttgttcccagtcatgatgatgataggattagaagtagaattcccgtcccgttgattgctaagtccgtgctttccatgctctctattatcacataagcaggccacaaggtacttgtggtcagttggcttggccagagggaaagaattcaaagcccttatgtttctcttttcctgtgagaagtagattcatgtgacgtctaataacaggggtgctaaaatctgactgcctgggtttgaggctccattgtcctggctctgtgaccttgtacaatttattgcaatcacatatgcttcagcttcatcatgtctaaaatggggatgttgatagcatctgcctcaaggggtagctatgaagatgaaatgaggtagactgctaacattcttgtgtggaagaacggccatagtaagcacttgggagtgtgatttgttatttttgagttcaattaaataattatacatattccacctttttcctacaaataatttaaggcaagtttttctcggagttaaagaaagaaagttcaagttttgctaagttatttggaaaactttgttacggcatggacaagggggaatttttcctgaccgaagacacagaaagggagaaaccaattctttggcttttagaggattttccaaatgacctctcctgtcccagacacttgcttcataaataatttgtctcactgtgtgtctatgcatgtcttgtggtggagctacactaattttctctgagtggaaaactgttttgcatgttagcaaaggcaatcaaataaatatggatgcatctgtattaatttctctgagtggaaaactattttgcatgttagcaaaggcagtcaaattaatactaatgcatcagctgtgtgtgctattaatgttccctacatttatcttttcagttcactttaaatggcatatgataaatattgcattagaccgtttgccaaagtctgtttggcaatagcaagcatgttttagttataaaactctctctgcaggcacctagcatcaaatcattgccaaaaacacaaggcaaaactcctggttattttctgacagttattgagtttgtgactgagtgagatgagttagtgtatacttctgtttaagaaaatagaatttgtggctctggctgggcccacaactccttgagtccatttattacccagttttggccagtactggaggtttcagaggaagtggctttaaatttgcatgttcattttggggctctgttttatacttacttacacaagtaaaatcagaatctgccttatatggactgataccacttgcattttcaaaatatcttagatgaaatgcgttgggaagtatttagtgaggtcagaatacatggctttctttaggaggatactcaggctaaatatttgcagagacctcttctgcggtacttagcagcagggactgaagtgtagggcaggggaggctgggaaagctggcaggctggagtcaggggttgtcagtgtgcctcagtgatgaaaatccaggtttccatgtgaggcctgctgtgtgatcactgcatatttttctcatgtttttacctggtattatctgcttctgagtcctctcttcacactgactggctctcctccttttcccccatacgtgccatgcatattccattctttgctcagtttccttcactgacaataccctcccttttctcagcccatccaagtctgacccaaggccccactgtcctctggcttctctgccccttcctgagctgagctctcctgcttgccatgaatttctgtagctgtctcttggcagttgcttgtaactgaatgtcaaccatgtgctatgcaacatgcagaagtgaaaatgcatattttatatgctcattttctattttctctactattagtggtgagtgccattaaggcacagttggttgatgtaattcttaattacgggcagactgcctgttcctaaaaacaccacgtagatattgtgtgactgatcaaaagcatgaaccagtgaatgtatgagtaagtcaatgcacaaaaatagagagatgtttagtaggaaataagggcacttcttccacatgacttacctaacaatgggaatggtaatcggtcaaggttcctctcttctcctgcctctctatttcatattctttccttgccttcctaggccatatcttgctctaacgccagctgatccatcccattgagagggtagacttctcttctgttaagagataactataagaaaaatcattgattgaacaacaaattgactgcaagagtgggataagaatgaaggcagcatgggataacttgagatgggaaacatcttgaatttcatggattttgtcaatggattagaggaattgcttttactagtgttcatgaaggtgtgatgatcatgctcactcacttggggccagatgatggtatttatatctggggtgctttaatctgggatgacctgaaataagacctccgatgaaaaagaagggtgtttattgtggtgagcccaggaggcaagagggcctgtgatgaccccgctgcagataggttgtggagttcaggaaatatcctgtttctggacagagggattggaaccattgaattcttggtcttctcatgatgggttgccccaccgttggatggcccttgctgcagtttttctcccaagtggttgaaagaactgcctgtttggttcctacagcctagttttgaggctcccagatcatatcccaggctcccagttctttagagataaaattgtagaacattctctatcttgtgggcctctagagaaggatgtagatgttcaaggcccaccaaaccagactaggctgggaaggtaactagtgtgtgtttccttttttttgtttgttttgtttgtttgttttttgagacagagtcttgctctgtctcccaggctggagtgccgtagcgcgatcttggctcactgcaacctccacctcctggattcaagtaattctcctgcctcagtctcctgagtagctgggattacgggcgcctgccaccgcgcccagctaattttttgtatttttagtagagatggggtttcaccatgttgaccaggctggtctcgaactcccgacctcatgatccacccacctcagcctcccaaagtgctgggattacaggcgtgagccaccgtgcccagccatgtgtttctttctcgatgaggctctcataaggattcactctaatcagagagctgtcagttttgatggatctctggaatccactataagtcttcatctctgggctaatttatctccctcagcatctcagggcctgacctaagttgtggttgggtgtgacaggcagcaatgaacttcttgtggctgcaggaactctctcaactccagtctgagactcaactctgctttgttttgctgatttcaaactgctgaccaccttagtttagtataagtatttacaaaatcctctggaagaaaaatgtatttttgtactttccacagtattacaactttcccaccattagttaccagcttttccagttgaacaatagtgtccacatcaatacaaatctttgattaattgggtttatcacagaggtattgccaatttttaatgacccaggaaaatacaccaaaggacctgaaatatgaaaaggattggacacactgctggtttagaaggttctttagaaatttttactgctctgaagctgtagcaagaggaccaggtgtcacctcatttcaggggtgagtagggctaaatgagaattctggtcagtcaggagaagctttacagacctttggtcagaaggattgtgtgaagttgttaagctagggagtgcaatgctaagaatatgttctttttgagcttctctggagttagcttttcagttgtgcaagctaaggtgggagacacttgggctactggaggtgaagaaaatagattatgagaattgagtttagacgtctgacctttcagccaaagttactgtgacccagtttttcatctcctactttccctcttcatgagttaaaagagaaggttgagacttgtgacatgtggaaattgtcttcctatcctagtttcttgctttcctgtctcagttgcctttggcttatctcttccttcaacctggaatgacctttctgctcctgtctgtgtggctgaatcccatttctcttaagttctcaggcttagcagcaactccacaaaggcattctttacccttctgggtggaaagttgttcttgtctctccgtcctttgagctcccatgggagttactgaaccttgcctattgttactcatgccttacttctgctctgaacacatatcgtacttacccctggtgcactatagacgccttgagggcaggaaaaatgagtttttgtcttcgtagcctctactgtgcctaacagaatgcaccaagtacatctgaatgtattctccccttctagaaaagaaatgccaataagttattctccctttgaaataatgactgctatactattttttctccctaacctcatagaattgtgaagacgtccttctcatttaaggactgactttcaaatcttatgcctctcttctccacaggttcccataaagtgagtctgtcctcttggtaccatgatcggggttgggccaagatctccaacatgacttttagcaatggaaaactaatagttaatcaggatggcttttattacctgtatgccaacatttgctttcgacatcatgaaacttcaggagacctagctacagagtatcttcaactaatggtgtacgtcactaaaaccagcatcaaaatcccaagttctcataccctgatgaaaggaggaagcaccaagtattggtcagggaattctgaattccatttttattccataaacgttggtggattttttaagttacggtctggagaggaaatcagcatcgaggtctccaacccctccttactggatccggatcaggatgcaacatactttggggcttttaaagttcgagatatagattgagccccagtttttggagtgttatgtatttcctggatgtttggaaacattttttaaaacaagccaagaaagatgtatataggtgtgtgagactactaagaggcatggccccaacggtacacgactcagtatccatgctcttgaccttgtagagaacacgcgtatttacagccagtgggagatgttagactcatggtgtgttacacaatggtttttaaattttgtaatgaattcctagaattaaaccagattggagcaattacggggtgaccttatgagaaactgcatgtgggctatgggaggggttggtccctggtcatgtgccccttcgcagctgaagtggagagggtgtcatctagcgcaattgaaggatcatctgaaggggcaaattcttttgaattgttacatcatgctggaacctgcaaaaaatactttttctaatgaggagagaaaatatatgtatttttatataatatctaaagttatatttcagatgtaatgttttctttgcaaagtattgtaaattatatttgtgctatagtatttgattcaaaatatttaaaaatgtcttgctgttgacatatttaatgttttaaatgtacagacatatttaactggtgcactttgtaaattccctggggaaaacttgcagctaaggaggggaaaaaaatgttgtttcctaatatcaaatgcagtatatttcttcgttctttttaagttaatagattttttcagacttgtcaagcctgtgcaaaaaaattaaaatggatgccttgaataataagcaggatgttggccaccaggtgcctttcaaatttagaaactaattgactttagaaagctgacattgccaaaaaggatacataatgggccactgaaatctgtcaagagtagttatataattgttgaacaggtgtttttccacaagtgccgcaaattgtaccttttttgttttttcaaaatagaaaagttattagtggtttatcagcaaaaaagtccaattttaatttagtaaatgttatcttatactgtacaataaaaacattgcctttgaatgttaattttttggtacaaaaataaatttatatgaaaacctgc

SEQ ID NO: 2108 - DNA, 8833 bp, Homo sapiens
  source 1..8833: mol_type = genomic DNA
ctctccccggcccgatccgcccgccggctccccctcccccgatccctcgggtcccgggatgggggggcggtgaggcaggcacagccccccgcccccatggccgcccgtcggagccagaggcggagggggcgccggggggagccgggcaccgccctgctggtcccgctcgcgctgggcctgggcctggcgctggcctgcctcggcctcctgctggccgtggtcagtttggggagccgggcatcgctgtccgcccaggtgaggccccgctgcgcaccccttcttgggcacatcaggagctgagactgcagaggggccgctgggggccgcgtgggctgaaggcaaggggaagggaggatgggtggagggtgagatgtcaggtggagcggcacagggtgacgctccctccttcccagcaggagcctgcccaggaggagctggtggcagaggaggaccaggacccgtcggtgagtgggcgtgggcgcggtctgcaggctgctggggcatgggaagtgtgcacagccgaggctgcaggtgtgtgcagctgtgccagccgtactcgaggtgtgtgcagggtgtgtgtgaacacagtgcgtgcatgggtgcgtgtctgcaggggtgtgtgtgcgtggtgacaactctgtgtgaggggtttgtgctggggttgtgccacctgagtctgaggtgtttattggctgggggtgacgtggttgtataagatatgtgagtctgcgtggaagaggggtgcggttgtgtacagggtgtgtatcctctgtgcgtggtgactgggtgcgggcatgtgtgcaatgtgccaattgaatgcagggtctgcgttggttgtgtgtgtgggtgggaaagtgtagctggtctagaggaaagggtgaggactggggcctgactcccagcttcacctttgcccggggccccagctgtagttggctgaggggcttaatctgtccctgacttctgtgtctattgctggctggtggctctcctgacaggccccgtatgtctcactttatatctctgggagtctgtggttgaaccctgccctaattcccctaggaactgaatccccagacagaagaaagccaggatcctgcgcctttcctgaaccgactagttcggcctcgcagaagtggtgagcatccctctatcccaacctcaggaagcgggcagagcaaaaaccattatccacagggagaaactgaggcacggagggtgaaaggagttcagagtcatgcagctaaccagccaagactcaaacctagggattctcgccctcctctgaagctccttctgtcatatggatgtgctccttcagaccctaccccaaacaggaaggcagggtggccatgagttagaagaactactgggatcctgatggagactaggcctggcagtcagaggcctgggccccggtaggcaaagagacttaggaatgggatgatggggtggccggatgaccacgtgtccaagtcggcatgcagttgtcctggcccccacctgttatctcggtgtgattaatagcagcttcccgttttgctctcagcagtatcccagtgtggatgacaaattatagtcactctacttactgaggaagatgaggcctgagattctaaggccaggagtctggacaagaataaggatgccagggttcctgagaggggaatggggctgggagagttgctctgggacccccactagggcccgctttgctcatctgtctttccttgatcctcagcacctaaaggccggaaaacacgggctcgaagagcgatcgcagcccattatgaaggtgggtgatgggtgagccatacccaggaggagaggggcaggtggcagagggtcagggcaggtctcaccagccttttcctgtactttacagttcatccacgacctggacaggacggagcgcaggcaggtgagaccccatcccccgacacagcactggcctcctgggaaaagggcccttgaaaacctttgacctcccactcccttcccggccatcagtctcagaaccacagaagccagttcatgaaggtcttggttctctctgtgacccaggcgtgggaccccatgaaagacccctactcttccccagaactctgcccagttcccccagcaaatcactgtcccagctctctccttcagccctcattcttctccaagaagcacttttcattcttttttcttctgtctcctccatattccacgttctgatgatctttttctctaaatgctgctagtgtctgctcatcttttccatttctaccccaccctctacctcagcaccgtgacctcagaacctcaaatccagcctcttgctgcttccccactccacaccctccctacccctccactccatctgacctgtgctgccatgctgagcccctaaacttcacttttcttgtggtattggctctctacatggcttccagtctcttcgtggtctggtctcaacctaatttccctgcactcttatgctgtcttcatgtttgctgcgctgacacccctgctcccggtgtgcctcttctggactttgcacataccatccccctcaccagaatgtctttccactgtgagaggcagggaggcatgaggagtgctcagccgaggggttcacagcagagatggtgagaagtggatgggttcagcctgtgtcctgaagatattactgacttatgggttggaggtgaagaataaaagaaagggaggaatcacagatgacttctagattttttattttttttaagacagtctcgctctgtcacccaggctggagtgcagtggtgcaatctcggcttactgcaacctctgcctcccaggttcaagagattcccgtctcagccttccaagtagctgggattacaggcgtgtgccaccacgcctggctaatttttgtatttttagtagagatggggttttgccatgttttccaggctggtctcaaactcttgacctccagtgatctgcccgcctcggcctaccaaagtgctgggattacaggcatgagccactgcacccagccagcttctagatttttaacttgggtatctctgggaagaatgatgccatttcctaagaagggattgaccaaggaataaataggttgggaagtatgtaagataattattaacgttgagaagtctaaaataaacaagcggataaatgacaataaagtaaattccagaaatggatggctggacattgtcgactagcttaggctaggtcaggacggataaagccaggagtcatggccatatggatggcttttttttttttttttttgagacagagtctcgctctgtcacccaggctggagtgcagtggttcgatcttggctcactgcaacatctgcctcctgggtccaagcgattctcctgtctcagcctcccaagtagctgagattataggcgggtgccaccacacccagctcatttttgtattttttagtagagacagggtttcaccgtgttggccaggctggtcttgaactcctgatctcaggtgatccgccagcctcagcctcccaaagtgctgggattacaggtgtgagcccttgtgcccggcctatcgatggcatttaaagccacaggattgggtgagacgccaggagaaagaagggccccacgaatgaagccctgagactcttgggcatcttgaagtggagctgaggggaaaaccagcagagactgaaaagaagctggagagagaggaagaaacccagggagggtggcatcctggattcggagaaaccactgtttcaaggaggatgtggctgtctgtgttgaatgcagctgagagatcacatgaaatgagaacagagaaatgatggctgggtttggtaacgtgaaagtcctgctgaccttaaagagggtggtttcagtggcatagttagaacaggaaggcagtgtgcattgggttgagaagaaaatgagaaataaggaactggaggcagggacaacctttttttttttttttttttttttttttttttttttttttgtgacagagtttcactcttgtcacccaggctggatccagtgcaatggcacgatctcggctgaccgtaacctccacctcccgggttcaagcaattctcctgcctcagcctccccagtagctgagattacaggcatgcgccaccacgcctggctaattttgtatttttagtagagacagggtttctccatgttggtcaggctggtctcaaactcccgacctcaggtgttccacccgcttcggcctcccaaagtgctgggattacaagcatgagccactgcacccggcctaggacaaccctttttagaagtttctctgtaacaaggagcagagaaataggccagtaggtggaggggtgtgtggaccaaggaaaagtttagttctgtgaacaatactattttcatctgatctaacatgtactgagggctttcttgagataggcactgtgtctggcacttgtgtttggtcttatctaatcctcacaacagccctaaaaggaagatactctaattacctccattttacagatggaggttacacaacttgtctgaggccatgagatactaagtggtggagccaagatttgaacccagctagaatgtgcctgtgtactggacatggtctgcatgaaaggcgaggtggctggtgcaggggtgaggggtccatgcaggggccacatccaaaaaggggagagggaagtttccagaaagaagagaggacacatctcccaccattaccagagggtcaaaggagaacaagagaccaggtgggtttgtagatttgctggggggagatgagggaacctttgctcgatgacttctaggtcctctggacaactagggagatggagacaggagatttgaggagaaatggtacaaaatctcaacttgctgattatgaaagcaagcttcgtgggggaatgtaagattgccaggcaggacggaatgtccaggtgaggtttgtggctggagacaagtgatataccaggcaagccctccgtgctcctgggcacaccatgcccttaggctacaagcagcctttgcttaggctggcttcgtagctaggaatgccctctcttctctgccctccctactcttcatgcccagatcagccttcctcccctctgtatagaccacttattttggcaattatccagacattcattcattcattgactcaacaggcattgaagacctactgtttgctaggggccaggctaggtgcccacagcaactaatatccagactcttttttttttttttttttttttttgagatggagtctcactctgtcgcccaggctggagtgtagtggcgcgatctcggcttactgcaagctccgcctcctgggttcatgccattctcctgcctcagcctcccaagtagctgggactacaggcgcccgccaccacgcctggctaatttttttttattttttagtagagacggggtttcaccgtgttagccaggatggtctcgatctcctgacctcgtgatccacccaactcggcctcccaaagtgctgggattacaggcgtgagccaccgcgcccagccggtcagacccatttttttttttgagatggagttttgctcttgttgccccagctggagtgcagtggcgccatctcggctcactgcagccttctcgggttcaagtgattctcctgcctcagtctcccgagtagctgggactacaggcgcctgccaccacgcctggctaattttttttttatgttttagtagagacggggtttcaccgtgttagccaggagcgtctcgatctcctgacctcgtgatccacccaccttggcctcccaaggtgctgggattacaggcgtgagccactgtgcccagcctcagaccaactcttaaggagtcactgtctaggagaggaaacaagcatataaatttgtaattacaggaacatacaaaaaaaattagccaggtttggtggcacatgcctgtaatcccagctactcaggaggctgaagcatgagaatcacttgaacccgggaggcggaggctgcagtgagccgagattgtgccactgcactccagcctgggtgacaagagtgagactccatctcaaaaaaaaatttgtaattacagtggaatatgacaagaacaataataaaagtggccaagatacctggcaacacaggggaagacagacatggctgtggagtcagggattctctccctgcatcgcaaggtgccgctgggccttgaagcaggagcgtaagacaagacaggcaaggggtcaagaatggtgggtgcaagcagaagcagcccctggggcaaaagccccgggtttgcccagagcatgatgaggctgggggactctaagttcagcgtggcagaagcagaaagtgctagaggagcgagatggggatgaggctggagacagaagccaggccacacggtggcatgtgggaactattctgaggtgagccatcggaaggaggaaggcgaggcgaggcgggcttacgtctgcatcttagagactcattctgtggctttgtgtagggaataaactggaggaagccagaatggaaacagggaatgctgtgaaaaccagacagaggcaccagatgggggagagaggggagagagctatttaggaggcaggatagataggaactggtgatcgattaatgatgtaggtaaaggagagggaggcttgaatatccccctggtggcaaaaccagaagccaaatgtggaaaacagacagtaaagcaagagtgggatgaggggggtcagctcagtgttggttgagatgagtttgaggggctattgctgttcagatggtgcagttggcagggtaaggaagggaaggaaacttcagggctggagactctgcagagcacaggttgtgggaacccattggtggaaataaaaatgcccagtgagcgttttttttgtttttttttttttttggagacagagtctagctctgttgcccaggctggagtgcagtggcatgatcttggttcactgcaacctccccatcccaggttcaagtaattctcctgcctcagcctcccatgtagctaggattacaggtgcctgccaccatgccctgctagtttttgtatttttagtagagacggggtttcaccttgttggccaggctggtctcgaactcccgacctcaggtgatccgcccaccttggcctctcaaaatgccgggatgacaggcgtgagccactgcacctggctgagcatgatgttttcaaggcacatctgtgccatagtgtgtatcagtacttcactctttttatggccaaataatattccattatatggatagacattttgttgatggacaattgggtttcattttattatttttagttgtactaattcagataatgtatgtttacatcctccatataaaagaagcaaataatatagatatccatgaagtaaaacattaaatcccctcacgcttctccttcagttctactcttctccccagaagtgactgcaggtgacaatctgccctgaatgtctctggccatatacattagattttttcacataacttcctagtcaactatgggcatcataggggatgggtcctcccttgcccggggtgatctatgtgtcttctgggtaaagtgggcgccgaatgttcatatgctcaatggatccctggggagtgtgggggagtcctgtagagagacgtttccttatctctgagcatccgtgttcaggtgtggacgggacagtgagtggctgggaggaagccagaatcaacagctccagccctctgcgctacaaccgccagatcggggagtttatagtcacccgggctgggctctactacctgtactgtcaggtaagccccatctggctgcatgggtaacgcagtaagagagtggcgaagggtttgccaggagagtgggggacaagctacagggctgggagggtgagttggggtttgggtgggatgggatgcctgcgtcgctgaggaaattggaaattgaggcgagggcaggcagaggcctggactcggcctgttgtccccaccccaggtgcactttgatgaggggaaggctgtctacctgaagctggacttgctggtggatggtgtgctggccctgcgctgcctggaggaattctcagccactgcggcgagttccctcgggccccagctccgcctctgccaggtgtctggtctgttggccctgcggccagggtcctccctgcggatccgcaccctcccctgggcccatctcaaggctgcccccttcctcacctacttcggactcttccaggttcactgaggggccctggtctccccgcagtcgtcccaggctgccggctcccctcgacagctctctgggcacccggtcccctctgccccaccctcagccgctctttgctccagacctgcccctccctctagaggctgcctgggcctgttcacgtgttttccatcccacataaatacagtattcccactcttatcttacaactcccccaccgcccactctccacctcactagctccccaatccctgaccctttgaggcccccagtgatctcgactcccccctggccacagacccccagggcattgtgttcactgtactctgtgggcaaggatgggtccagaagaccccacttcaggcactaagaggggctggacctggcggcaggaagccaaagagactgggcctaggccaggagttcccaaatgtgaggggcgagaaacaagacaagctcctcccttgagaattccctgtggatttttaaaacagatattatttttattattattgtgacaaaatgttgataaatggatattaaatagaataagtcata

SEQ ID NO: 2109 - DNA, 8833 bp, Homo sapiens; identical to SEQ ID NO: 2108
  source 1..8833: mol_type = genomic DNA

SEQ ID NO: 2110 - DNA, 19149 bp, Homo sapiens
  source 1..19149: mol_type = genomic DNA
cacccctcagacacacaggtggcagcaaagttttattgtaaaataagagatcgatataaaaatgggatataaaaagggagaaggaggggaagggtggggtgaaaatgcagatgtgcttgcagaatgtaaaagatgttgacccttccagctggacgtggtggctcacaattgtaatcccagcactctgggaggctgagacaggtggatcgcctgagcccaggagtttgagaccagcctgggcaacactgtgagaccccatctctacaaaacatgcaaaagttggctggccatggtggcatgaacctgtggtcccagctactccggaggctgaggcaggactgctcgagccggggaggcaaaggctgcagtaagccaagatcacgccactccactccagcctgggcaacaaagcgagacccagtctcaaagaaaaagaaaaaaaaaaaaaaaaaagaaaaaagaaattgaccctgagcataaaacaagtcttggtggatccagatcatcatatacaagagatgaaatcctccagggtgtgggatggggtgagatttccttttaggtactaaggttcaccaagaggttgtcagacagggtttggctgggccagcagagacttgacaactccctctacctaaccagctgcccaactgtagaaactaccaacccaccgaccaacagggagagggaacaagcaccctcaagggggtcaagttctagaccccatgtaataaaaggtggtttcaaggccagatgtacattatttcattaaccctcacaatgcactctgtgaggtaggtgcaaatgccagcatttcacagatatgggccttgaagttagagaaaattcaacagtgagggacagcttccctggttagtacggtgaagtgggcccctacctagaatgtggctgattgtaaactaacccttaactgcaagaacatttcttacatctcccaaacatccctcacagtaaaaaccttaaaatctaagctggtatgtcctactccccatcctcctccccacaacaaaacaccagtgcaggccaacttgttcagtggagccccgggacaaagcaaatggaagtcctgggtgcttctgacgcacacctattgcaagcaagggttcaaagacccaaaacccaaaatggcaggggagggagagatgggggtgggaggctgtcagtggggaacaagaagtggagaatgtcagtctgagtcaggcccttctgtcttgaacatgagttttttatggcgggaggtagactgaccctttttggacttcaggtggctgtaggagacagaagcagggaggagagatgacatcacatgagtgagagggtctgtgccccttttccctgaccaatgctttgaagggcctaaggctgggacaacgggaattcaaatcaagatggtggccacaccccatgcaaatatgtttactgagcacctcagagtattagtgtgtattagtctcgtaatcttcccttaccccattttactttatttatcttttttgagacggagtttcactcttgttgcccaggctggagtgtaatggtgagatctcagctcaccgcaacctctgcctcccgggttcaagcgattctcctgcctcagcctcccgagtaggtagctgggattacaggcatgcatcaccacgcccggctacttttgtatttttagtagagatggggtttctccatgttggtcaggctgggctcaaactcccgacctcaggtgatccactcgccttggcctcccagagtgtgggattcgtgagccactgcgcccggcccccttaccccattttatatataaggaaactgagtttgacgggggtcacctaggacctgccggtgcatggcagggctgagtatatgacctgaaactctggctgtattcagtattacacaattattaggcccctccttgagaccctccagctctgggctgggagttgcggagaatggcaaagaagtatccacactcgtccctgggtttggatgttctgtggatacactgaggcaagaatgtggttataggattcaaccggaggaagactaaaaaaatgtctgtgcagggctgggacccaatgagatggggtcagctgcctttgaccatgaaggcaggatgagaatggaatcctatggctttccaacctaggaaggcaggggagtagggccaggaaggggctgaggtcactcacctggagtgagccctgctcccccctggctccttcccagcctgggcatccttgagttccaaggcctcattcagctctcggaacatctcgaagcgctcacgcccacggatctgcagcaacagaggagggggagaagtaagtatatacacagtacctgagttaaaagatggttcaagttacaattgtttgactttatgacggtacaaaagcaacatgcatttagtagaaactgcacttcaagtacctatacagctgacttttaaaaatatttatttatttattttgagatggggtctcactctgttgcccaggcgggagtgcaatggtgcaatcttggctgattgcaatctccgcctctggggttcaagtgattcttgtgcctcagcctcccgagtagctgggactacaggcgtgtgctaccacacctggctaatttttgtgtttttagtagagatggggcttcaccatgttagccaggctggtttccaactcctgacgtcaggtgatctacccacctccacctcccaaagtgctgggattacaggtgtgagccactgtgcccggcccttttttaaattttagagatgatgtcttgctatgttgttcaggctggactcaaactcttgggctcaagagatcctcctgccttagcctctcaagtaactgggactacatgtgcatgcgactgtgcctcgtttcttttcttttttttctgagacggagtctcactctatcgcccaggctggagtgcagtggcgccatcttggctccctgcaacctccgcctcctggttcaagcgattctcctgcctcagcctcccaagtagctgggattacaggcacctgccatcacgcccggttaatttttgtattttagtagagacggggtttcaccatgttggctaggctggtcttgaactcctgacctcaggtgatccacccgcctcagcctcccgaaatgctgggattacaggcgtgagccagtgcgcctggccttttctttttttgagtctcgctctgcgcccaggctgtgcctggctcgactgtgcctcctttcatgcaaccatgctgtttctcactttcagtaacaatattcaataaatcacatgagatatacaacattttattactataaaaagggctttgtgttagatgactttgcccaactgtagggtaacttaaatgctctgaacacgtttcaagtaggctagggctgagtgtggtagctcatgcctgtaaccccaatacttggggaggctgaggtggaaggattgattgagcccaggggtttgataccagcatgggcaacgtagcaagaccttgacttcacagaaaataaaaaattagctgggtgtcgtggcatgtgcctgtagtcctagctacttgggagggtgaaatcaccggagcccagggaggtcaaggctgcagtgagctgagatggtgccactgcactctagcctgagtgacagagtgagactctgtctttaaataaataaataaaaattagccgggcgtggtggctcacacctgtaatcccagcactttgggaggccgaggcgggcggatcacatggtcagaagttcgagaccagcctggccaacatggtgaaaccctgtctctactaaaaatacaaaaattagctgggcgtggtagcaggcgcttgtagtcctagctattcgggaggctgaggcaggagaatcacttgaacccaggaggcagaggttgcagtgagccgagatcatgccactgcactccagcctgggcgacagagtgagactgagtctcaaaaaaataaaataaaataaaataaaaataaataaataaaaattagccaggcatggtggtgcaggcctgtagttgaagcaacttgggaggctgagctgggaggatggatggagcctgggaggtggaggctgcagtgagctgtgactgcactactgcactctatccagcctgggtgacagagcaagaccttgtctcaaaaaagtaggctagagaccagcctgggcaacatagtgagactctatctatctacaaaaaattttaaaaattagctgggtatggtggtgtatgcctgtggtcctagctactggggaggcagagttagggggattgcttgagcccaggagggtataatgagctatgatcacatcactgtaatccagcctgggcaacagagcaagatgctgtctccattaaaaataaaataaaagtaggctaggcaggccgggtgcggtggctcacgcctgtaatcccagcactttgggaggccaaggcaggcagatcacaaggtcaggagttcgagactagcctggccaacatggtgaaacctcatctctactaaaaaaaaaaataaataaataacaaaaaattagctgggcgtcggggcaggtgcctgtaatcccagctactcagtgggctgaggcaggagaatcgcttgaacccagaaggcggaggttgcagtgagccgagatcccgccactgcactccagcctgggtgacagagtgagactctgtctccaaaaaaaaaaaaaaaaaaagcaggctaggctaagctatgatgttccttagattaggtgtattaaatccattttcaacttacaatattttcaacttacgacgagtttatcaggaagtaacaccatcgtaagtcaagtagcatctgtatcaggcaaagtcatagaaccattttcatgctctctttaacaattttctttttgaaagctggtctggtcctttaaaatatatattatggtataagttggtgttctgaagttagttagctacaaccaggagccattgtctttgaggcatcactgccccctgatggcaaatgccccaattgcaggtaaaacagtcaagaagaaaacggcattttgagtgttagactggaaactttccacttgataagaggtcccaagacttagtacctgaagggtgaaatattctccatccagtggtttcttctttggctggggagaggagctggtgttgttgggcagtgctaggaaagaggcaaggaaaggtgataaaagtgaatctgaggcataactgcacccttggtctcctccaccgcttcttgtcctgcttgcttacctcgcttagtgctccctgggggcagctcgtggtgaggctcccctttcttgcggagattctcttcctctgtgcgccggtctctcccaggacaggcacaaacacgcacctcaaagctgttccgtcccagtagattaccactactcaggataggaaaagagaagcaagaggcagtaaggaaatcaggtcctacctgtcccatttaaaaaaccaggctccatctactcccaaccacccttgtcctttctggagcctaagctccagctccaggtaggtggaggagaagccacaggttaagaggtcccaaagccagagaaaagaaaactgagtgggagcagtaaggagattccccgccggggatgtgatgagaggtggatgggtagtagtatggaagaaatcggtaagaggtgggcccaggggtcagaggcaagcagaggctggggcacagcaggccagtgtgcagggtggcaagtggctcctgacctggagtcttccagtgtgatgatggtgaggatgggcctccggttcatgccgcccatgcaggaactgttacacatgtagttgtagtggatggtggtacagtcagagccaacctaggagataacacaggcccaagatgaggccagtgcgccttggggagacctgtggcaagcaggggaggccttttttttttttttttgagatggaatctcgctctgtcgcccaggctggagtgcagtggcgtgatctcagctcactgcaagctccaccgcccaggttcacgccattctccttcctcagcctcccgagtagctgggactacaggtgcccagcaccacgcccggctaatttttttttgtatttttcagtagagacggggtttcaccgttagccaggatggtctcgatctcccaacctcgtgatccgcctgccttggcctcccaaagtgctgggattacaggcatgagccactgcgcccagccaagcaggggaggcccttagcctctgtaagcttcagttttttcaactgtgcaatagttaaacccatttactttgcacatctcatggggttatagggaggtcaaataagcagcaggagaaagcccccctactgctcacctggagggccactgacaaccacccttaacccctcctcccagagaccccagttgcaaaccagacctcaggcggctcatagggcaccaccacactatgtcgaaaagtgtttctgtcatccaaatactccacacgcaaatttccttccactcggataagatgctgaggaggggccagacctaagagcaatcagtgaggaatcagaggcctggggaccctgggcaaccagccctgtcgtctctccagccccagctgctcaccatcgctatctgagcagcgctcatggtgggggcagcgcctcacaacctccgtcatgtgctgtgactgcttgtagatggccatggcgcggacgcgggtgccgggcgggggtgtggaatcaacccacagctgcacagggcaggtcttggccagttggcaaaacatcttgttgagggcaggggagtactgtaggaagaggaaggagacagagttgaaagtcagggcacaagtgaacagataaagcaactggaagacggcagcaaagaaacaaacatgcgtaagcacctcctgcaacccactagcgagctagagagagttggcgtctacacctcaggagcttttcttttttttttttttttttgagatagggtcttgctctgtcactcaggctggagcacagtggtgtgatcacagctcactgcagcctccatctcctggcctcaagtgatcttcccacctcagcctcctaagtggctgggactataggtgtgcaccaccatgcctggctaattttttgtatttttttgtagagacgaggtttcatcatgttacccaggctggtcttgaactcctgggctcaggtgatctgcctgccttggcctctttgagagtgctgggattgcaggtgtgagccaccaagcctggtcaggagcttattttcaaaagccaaggaatacacgtggatgaagaaaaagaaaagttctgcatccccaggagagatgctgagggtgtgatgggatggataaaagcccaaattcaaggggggaatattcaactttgggacaggagtcagagatcacacattaagtgggtaaactataaaaaaacactgacaggaagccaaagggtgaagaggaatcccaaagttccaaacaaaagaaatgcagggggatacggccaggcattgaagtctcatggaagccagcccctcagggcaactgaccgtgcaagtcacagacttggctgtcccagaatgcaagaagcccagacggaaaccgtagctgccctggtaggttttctgggaagggacagaagatgacaggggccaggagggggctggtgcaggggccgccggtgtaggagctgctggtgcaggggccacggggggagcagcctctggcattctgggagcttcatctggacctgggtcttcagtgaaccattgttcaatatcgtccggggacagcatcaaatcatccattgcttgggacggcaagggggactgtagatgggtgaaaagagcagtcagaggaccaggtcctcagccccccagccccccagccctccaggtccccagccctccaggtccccagcccaacccttgtccttaccagaacgttgttttcaggaagtctgaaagacaagagcagaaagtcagtcccatggaattttcgcttcccacaggtctctgctagggggctggggttggggtgggggtggtgggcctgcccttccaatggatccactcacagtttccataggtctgaaaatgtttcctgactcagagggggctcgacgctaggatctgactgcggctcctccatggcagtgacccggaaggcagtctggctgctgcaagaggaaaagtggggatccagcatgagacacttccaaccctgggtcacctgggcctgcagagaaggaaccccctcccccaacaccatgccagtgtctgagacagctcggcttcctgtggagcaggaaaagaatggctgcttcacattctctcttccaatgtttcaccacaacccaagcactcctgccccacccctcaccagccatgcacttctttgaggaaaagacaatcagagagggacttccaaccttcccaccactaaatccccaagacttcctaaatgtgcaccctattcccaactcccttcctgtattttttttttttttttgagatggagtctctctctgtcacctaggctggagcacagtggcatgatctcagctcactgcaacctctaccttccgggttcaagccattctcctgcctcagtctcccgagtagctgggattacaggcgagtaccaccacacccagctaatttttgtatttttagtagagacagggctttgcatgttggccaggctggtctcgaactccttacttcaggtgatcggcccgcctcagcctcctaaagtgccaagattacaggtgtgagctaccgtgccctgctcccacctcctgttaacaaggatatagtcattctcagcctgcaatctctgtatggggaaggacacccccttggcccccacccttccccacctgatacacggctccatttctttgattcctttcactgcaaagcttctggaagaacaactgtctcaccgctcacctgcccattctcttcggacactcctcagccctgcattacaaacccctcacgaatggcccgtctcggcttctttaatctcatctcttaacaaccactccctcttccccaaaagctctagctagactggctgcccttctctgctaatcaactggtggttccttggctagccaggaacatgggggtaggctccttcccgtgcagactttaagtcatcctattttaattcacatcacctcatttgcattctcatagcacttacattgtctgatacttttccttgtttattttatctgtttcctctaatagcatatacacttcctaagggcagggcagtgatctatcttgttgtcttgctgaccaaagtattagatcacaatgccttgcacctgcttgggctcaataaatgtgaataacacacaagcctgttatatgagaggttaagagagcgagaaagagcaaggggcagcccctgtgtggaccagcatcttgcacgaagttatgcaactatcatcgcaccttctcccagacaagctttcaaaggctttgccatgttttcttttgttttgtttttttgtttgttttttgagatggagtttggctcttttcgcccaggctggagtgcagtggtgcagtctaggctcactgcaacctctgccttctggtttcaagcaattctcctgcctcagcctcccgagtagctgggattacaggcccctgccaccatgcctggctgattttttgtatttttagtagagacagggtttcaccatgttggccaggctggtgtggaactcctgaccttgtgatccacctgcctcggcctctcaaagcgctgggattacaggtgtgagccactgtgcctggcccgccatgttctttctttctttcttttttcttttgaggcagggtcttgctttgttgcccaagctagggtacagtggtgcaatcatggctcactacagcctcggactcctgggctcagtgattctcctgcctcagcctcccaagtagctgggaccacagaggcctgcctggctaattttttagtctttttctttttctttttttttttggagacggagtctcgccctgtcacccaggctagagtgcagtggtgtgatctcgactcactgtaacctccacctcccagattcaagcgatcctcttgcctcaacttcctgagtagctgggattacaggcgcccaccaatgcgcctgattaattttttgtatttttagtagagatggggttttgccatgttggccaggctggtttcgaactcctgacctcaggtgatcctcccgcctccgactcccaaagtgctgggattacaggtgtgagccactgcacccggccaatttttgagtttttttgtagaggcagggtttcactatgttgcccaggcaggatgctctctttctttttctttttttttttttcagggatgctctctttctttatgccaaatttgtcatcagatttgctaagaaacatgcctactgtaagtgtttgttacacttttctgtttttttttttttttgagacagagttttgctctcgtccaggctggagtgcaatggtgcgatctcggctcaccgcaacctctgcctcccaggttcaagcgattctcctgcctcagcctcccgagtagctgggattacaggcatgcgccactgcgcccggctaattttgtatttttagtagagacggggtttctccatattggtcaggctggtcttgaactcccaacttcaggtgatccgcccgccttggcctcccaaagtgctgggattacaggcatgaaccactgtgcccagcccacttttctgttgtttgcactgacaaaacatcccctaccaaacagctcctttaatggcaggctcttttctttttttattttattttattttattttattttattttattttattttgagacggagtctcagctcttattgcccaggctggagtacagtggcactatctccgcttactgcaacctcctcccggattcaaatgattctcctgcctcagcctgctgagtagctaggactacaagcatgtgccaccacacctggctaattttgtacttctagtagagacggggtttcaccatgttggtcaggctggtcttgaactcccgacctcaggtgatccaccccccttggcctcctaaagtgctgggattacaggcgtgagccaccaagcctggcctacctagtactctgtgtattatgggaaatgtagagttgaggaaagtgctgggcacacagtaagagctcaacaaaggttagctctttctgcaattgttctatttcacttgttctatattattattctagagagaactgtgtgattgttagtgcggatctgtggtactgctcccacccccactccattaatgcaagtacacctccttcagggatctattcagtcaacaggccaggaggtgctgtcctgaaatggggggcccaaagtctcaatcccacttggagggacacaggtctacagacaggtctccctgtctttatctctcaaatcttcagtagcaactaaaatctccgtgtttttcagagcaggaccttcccaggggtaccagcatcagtgggccaggatacaaatgtgccaggctgaactaggccttccaaatggccagggagccaagagaaatgcaggtgcccttggctgggtgggaaggcaatgagatcaactgagaccccaaacaggggcaggcctgaccagaatcttaacagtggctgctggtatcagtcttgaaggcctatatgtccagtgattccctaaacaatatagtacaagtacttacatacatacttgcatgtacattagcattttcattgtatgggggtaatgtaagtaatctagagataatttaaactatatgggaggatatgtgtaggttaaatccaaatactataccgtcttatatatgggacttagacatctgtgggtttggtgtgtgaggagtcccagaaccaagcccctacagatagagggataactatattgccctgtaacctgcaaccctgctatatttatttattagttttggtagctttttatggattttccattaggacttttttttttttttgagatagagtttcactctttttttttttttttgagacggaatctcgctctgttgcccggcgtggtgtgcaatggcatgatctcagctcactgcaacctccacctcctgggttcaagcaattcttctgtctcagcctcccaagtagctgggattacaggcgcccaccactacacccagctaattcttgtatttttagtagagacggggtttcaccatgttaggttggtctcaaactcctgacctcaggtgatcggcctgcctcagcctcccgaagtgctgggattacaggcgtaagccaccacaccctgccggagtttcactcttgttgcccaggctggagtgcaatagcgcgatctcggctcactgcaacctctgcctcccaggtccaagcaattctcctgcctcagcctcctgagtagctgggattagaggtgcccgtcaccacgcctggctgattttttgtatttttattagagttggggtttcaccatgttggccaggctggtcccagggaagccacctgcctcagcctcctaaaagtgctaggattacaggcatgagccaccacgcctggccccattaggacatgtatgtatagaatcatactggctgtgaatgtgttttatttcttcctttctaatcgttattttttttctttccttttttttttttttttttgacatggaattttgctcttgtcgcctaggctggagtgcaatgggacaatctcggctcactgcaacctctgcctcctgggttcaagtgattctcctgcctctgcctcctgagtagctgggactacaggcgttcaccactacccctggctaattcttttttttttgagacggagtttttgcttttgtcacccaggctggagtgcaatggtgcaatctcggctcactacaacctccgcctcccaggttcaagcgattctcctgcctaagcctcccaagtagctgggattacaggcgcccgccactacgcccggctaatttttgtatttttagtagagatggggtttcaccatgttggccaggctggtgttgaactcctgacctcaggtgatccacccacctcggcctcccaaagtgctgggattacaggcatgagccactgtacccggccaacgcctggctatttttttaatattttaatagagacgaggtttcaccatctttgtcaggctggtctccaactccagacctcaggtgatctgcccacctcggcctcccaaagtgctgggattataggcgtgagacatcgggccactaatcattatttctttttctttttttttttttgagacacagtcttgctctgtcgcccaggctggagtgcagtggctcgatctcagctcactgcaagctccgccccctgagttcacgccattctcctgcctcagcctcccgagtagctgggactacaggcgcccgccactacgcccggctaattttttgtatatttagtagagacagggtttcaccgtgttagccaggatggtctcgatctcctgacctcgtgatccacccgtctcggcttcccaaagtgctgggattacaggcctgagccaccgcacccggccctcattatttctttttcttgcctggttaaaacctccagtatggtatcaacgttgtgagagtcaaatccttttctagttcctgatcttagaggaaaaagcgttgagttttcttttcttttttttttttttttttttttgagacgaagtctcactctgtcacccaggctggagtgcagtggcacgatctaggctctgcaagctccgcctcccgggttcacgccattctctcgcctcagcctcccgagtagctgggactataggcgcccgccaccatgcccggctaattttttgtttttgtatttttagtagagacggggtttcagcatgctagtcaggacagtctcgatctcctgacctcgtgatccgcccgcctaggcctcccaaagtgctggcattacaggcgtgagccaccgcgcccggcagcactgagttttctaccattatgtatgctgctagtggaactccgactgtggacgccctgttatcaaactaggttaagtttcctttccctagtttgctaggaggttggttggtttgtaatcatgcatatgtgttgaatatcattaactgcttttgctacatctgttgaaatgatcatagggtttttatgtttccctttgttaatgtggtgaattacacagactgatttttttccccccagtaaagaccagtctgactatgttgcccaggctggtcttgaaatcctgggctcaagagatcttcctgcctcagcctcctaaaatgttgggattacaggcctgagctactgcaccaggccaatttttgaatgttgaatcagctacaatcatgagataaacattatttggttagaatgtatttatcctttttctttttctttttttgagatggagtctcactctgttgcccaggctggagtgcaatggtgtgatcccagctcagtgcaacttctgcctcctgggttcaagcgattctcctgcctcagactcccgagtagctgggatttcaggtgcccaccaccatgcccagctaatttttttttttttttgagatgaagtcttgctctgtcgcccaggctggagtgcagtggcacgatcttggctcactgcaacctctgcctcccgggttcaagcaattctgcctcagcctcctgagtagctgggattacaggcaggtgccaccacaccggctgatttttgtatttttagtagagatggcgtttcaccacattggtcaggctggtcttgaactcctgacctcgtgatctgcccacctcggcctcccaaagtgctgggattacaggcgtgagccaccgtgcccagcctgatttttgtatttttattagaaacggggtttcaccatgttggtcaggctggtctcaaactcctgacctcaagtgatctgcctgcctcagcctcccaaagtgctgggattacaggcgtgagccaccgcgactggcctatttatccttttttctatattaccaggtttggtttgctaaaattggttagctgttgcatgtctatgctaacaggaatattggtctatattttcttttcttataatgtccttgtttggttttggtaccaggattatgctggcttcgaaaacaagttgggaaatattcctctattttttctttctttctttttttttctgagacagggtctcactctgttgcccaggctggagtgcagtggcgcaatctcggctcactgcaacctccgcttcccaggttcaagggattcttgtgcctcagcctcctgagtaactggcattacaggtatgtgtcaccacgcctagctactttttgtatttttagtagagatggggtttcgccgtgttggccaggctggtctcgaactcccgacctcaaatgatcccctgcctcagcgtaccaaagtgctgagattacaggtatgagccaccgcgcccagtctgttcctctgttttctgaagagtttgtgtaagatgggtactgtttcttcctccaacgtttaaagagagcagagaacagaggagataaatagaaaatagcactaagaggtcaggcatggtggctcacacctgtaatcccagcactttgggaggccgagatgggatgaaagcttgaggccagcagtttgagaccagcctgggcaacatagtgagatcctgtcaatacaaaaaaataaaatagttagctgggtgtggtggagtaatcccagctactcgtgaggctgctagaggactgcttgagcccaggggttcgaggctgcagtaagccttgattgtgccattgtactctagcctgggcaacagtgtgagtccctgtctcaaaaattaacaaagaaaaaaagaaaatagcactaaaatggtagccctatactccaactgtaaaataattaaaattaaaagcattcagtagagaaaggaagcctatttcaacaagtggagacagaataactggatttccatacaggaaagataccagagactgactcctacacctcacaccataaacaattaattttaagaattaattaatggctcaaggaccttactgtaaaacttacaaccataaaggtcctaaaagaaaatgtaagataatatcttcatgaccctggggttaaaaaaaaaaaaaaagatgtcctaaacaggacaaggcaaatactgaacataaaaaagataaatccactcctcttaagatactgtaaactctgtaaagcaaacaaataggcaagcaacagatcagaagaaaacattcacgacacatggatctgataaaggacttgtatccagaatgtataaagcagtcccacaactgaacaataaaaacaaacaaaaaaccaaaataacaggtaaaagactcgaagagctactttacaaacaaaatacgaatggccaataggcacatgaaaaaatgctgaacatccttagtcaatagagaactgtaaattacaaccacaaggatataccacattagaaagactgacaatacctaatgtccggaaggctgtggcacaaccataataactcccataccttgctagttggagtgtaaaatggtacaaccgctctggaaaactcagagcttctgaaaaagttcaaaatacagctactttttacttccaaactcgcaattcccctcctaagtatttctccaagaaacacgaaaacatatgatcacaaaaagaattgtacaagaatgtttatagcagctttatttcataaccgcaaatgggaaacaactcaaaaggccatcaaaaggacggatatacaatcgatggactatactaaatgaaaaggagcaaaatactgatatatacaacatgaacgaatgtcagacagtacattgaaggacagaagcccgacaaaaatgagcacataatgtatgattccccccttttttttgagacggagtttcgttcttgtcgcccaggctggagtgtagtggcacgatcttggctcactgcaacctctgcctcccgggttcaagcgattctcctgcctcaccctcccgaatagctgggattacaggcacccaccacgcccagctaatttttgtattttttagtagagacggggattcaccacgttggccacgctggtctggaactcctatcctcaagtaatccgcccgcctcggcctcccaaagtgcaggcgtgagccacagcgcccagcctgattccattctatatgaagttctccaacaggcaaaatggttatggagatcaaaataaaggtggggtcgggaatcgactgggaagagacgtgatgaaacgtttctgggacgatgaaaagggtctgtgacttggtaggcatcacggagcggttaggggccaaaactcatcttcctgtgcacttgctgtgtgcactggcgctgtgtgtaaatgccacctcgatttaggaaaaagatgacgtaagtacggcacaaagtggccggtacgcggcaggtgcatgggaagaaactgcggaatgaaacaaccgcgagctaagagatggggcagcgggagaaatgaattcgagttccgcctcctaccaggaagaaccggctcgggccggagggctgcacggaggaccacacggacgcctgcgggcccgccccttccgcttcacgacgttcagcctgcgtctggaactggaatggcctagcccaaagctagataacaggtagattgtttttccgacaaattatcaaacgacccatcattgcactctttcaaaatttgattctcagacgtacccattctttttttttttcctccgggaagatgagatatactcattcttgaaaatacctccgggcttgccttctgcacacttctttccctccctgtctcacgccatggtagcgtccgcctaggttgcaggcgacccgcggggtggggcacaccattcaaagaaggggagggattgaggtttgcatcaaaacaaatacccctgcctttgcaaaggccataactaagtaatccagaaaaagaaatgcaggcggagaatagcagcctccctctgccaagtaagaggaaccggcctaaaggacattttctctctctctcctcccctctcatcgggtgaatagtgagctgctccggcaaaaagaaaccggaaatgctgctgcaagaggcagaaatgtaaatgtggagccaaacaataacagggctgccgggcctctcagattgcgacggtcctcctcggcctggcgggcaaacccctggtttagcacttctcacttccacgactgacagccttcaattggattttctccatctagcggagccgggggctgcctggaaagatcgctccaggaaggacaaaggtccggaagttgtgggaccttagcagcttgggctccccggatcacccccaaatgatcatttcggaatggagccccagttttcactaggatgccatgggctctaaaatatacagctatgagttctcaatgtttcgagatccaaaagtctcagacctcaatgctttgtgcatcttttatttcagggattccctacgcccagcaccgggtggatgtgcaaagaagtacgctttaggccggctcaaggttccccaaagctccactcctctgcctaggcgttcaactttgagttcggatggtcctaacatccccatcatctacacccaggtctcccaacaatgcaactcctatgatgatccctctagccaagcttccatcccactcacccccaaactcgctaagtccccactgccccacccccagccccagcgattttcccgagctgaaaatacacggagccgagagcccgtgactcagagaggactcatcaagttcagtcaggagcttacccaatccagggaagcgtgtcaccgtcgtggaaagcacgctcccagcccgaacgcaaagtgtccccggagcccagcagctacctgctccctggacggtggctctagacttttgagaagctcaaaacttttagcgccagtcttgagcacatgggaggggaaaaccccaatcccatc

SEQ ID NO: 2111 - DNA, 19149 bp, Homo sapiens; identical to SEQ ID NO: 2110
  source 1..19149: mol_type = genomic DNA

SEQ ID NO: 2112 - DNA, 19149 bp, Homo sapiens; identical to SEQ ID NO: 2110
  source 1..19149: mol_type = genomic DNA

SEQ ID NO: 2113 - DNA, 19149 bp, Homo sapiens; identical to SEQ ID NO: 2110
  source 1..19149: mol_type = genomic DNA

SEQ ID NO: 2114 - DNA, 7092 bp, Homo sapiens
  source 1..7092: mol_type = genomic DNA
cacccctcagacacacaggtggcagcaaagttttattgtaaaataagagatcgatataaaaatgggatataaaaagggagaaggaggggaagggtggggtgaaaatgcagatgtgcttgcagaatgtaaaagatgttgacccttccagctggacgtggtggctcacaattgtaatcccagcactctgggaggctgagacaggtggatcgcctgagcccaggagtttgagaccagcctgggcaacactgtgagaccccatctctacaaaacatgcaaaagttggctggccatggtggcatgaacctgtggtcccagctactccggaggctgaggcaggactgctcgagccggggaggcaaaggctgcagtaagccaagatcacgccactccactccagcctgggcaacaaagcgagacccagtctcaaagaaaaagaaaaaaaaaaaaaaaaaagaaaaaagaaattgaccctgagcataaaacaagtcttggtggatccagatcatcatatacaagagatgaaatcctccagggtgtgggatggggtgagatttccttttaggtactaaggttcaccaagaggttgtcagacagggtttggctgggccagcagagacttgacaactccctctacctaaccagctgcccaactgtagaaactaccaacccaccgaccaacagggagagggaacaagcaccctcaagggggtcaagttctagaccccatgtaataaaaggtggtttcaaggccagatgtacattatttcattaaccctcacaatgcactctgtgaggtaggtgcaaatgccagcatttcacagatatgggccttgaagttagagaaaattcaacagtgagggacagcttccctggttagtacggtgaagtgggcccctacctagaatgtggctgattgtaaactaacccttaactgcaagaacatttcttacatctcccaaacatccctcacagtaaaaaccttaaaatctaagctggtatgtcctactccccatcctcctccccacaacaaaacaccagtgcaggccaacttgttcagtggagccccgggacaaagcaaatggaagtcctgggtgcttctgacgcacacctattgcaagcaagggttcaaagacccaaaacccaaaatggcaggggagggagagatgggggtgggaggctgtcagtggggaacaagaagtggagaatgtcagtctgagtcaggcccttctgtcttgaacatgagttttttatggcgggaggtagactgaccctttttggacttcaggtggctgtaggagacagaagcagggaggagagatgacatcacatgagtgagagggtctgtgccccttttccctgaccaatgctttgaagggcctaaggctgggacaacgggaattcaaatcaagatggtggccacaccccatgcaaatatgtttactgagcacctcagagtattagtgtgtattagtctcgtaatcttcccttaccccattttactttatttatcttttttgagacggagtttcactcttgttgcccaggctggagtgtaatggtgagatctcagctcaccgcaacctctgcctcccgggttcaagcgattctcctgcctcagcctcccgagtaggtagctgggattacaggcatgcatcaccacgcccggctacttttgtatttttagtagagatggggtttctccatgttggtcaggctgggctcaaactcccgacctcaggtgatccactcgccttggcctcccagagtgtgggattcgtgagccactgcgcccggcccccttaccccattttatatataaggaaactgagtttgacgggggtcacctaggacctgccggtgcatggcagggctgagtatatgacctgaaactctggctgtattcagtattacacaattattaggcccctccttgagaccctccagctctgggctgggagttgcggagaatggcaaagaagtatccacactcgtccctgggtttggatgttctgtggatacactgaggcaagaatgtggttataggattcaaccggaggaagactaaaaaaatgtctgtgcagggctgggacccaatgagatggggtcagctgcctttgaccatgaaggcaggatgagaatggaatcctatggctttccaacctaggaaggcaggggagtagggccaggaaggggctgaggtcactcacctggagtgagccctgctcccccctggctccttcccagcctgggcatccttgagttccaaggcctcattcagctctcggaacatctcgaagcgctcacgcccacggatctgcagcaacagaggagggggagaagtaagtatatacacagtacctgagttaaaagatggttcaagttacaattgtttgactttatgacggtacaaaagcaacatgcatttagtagaaactgcacttcaagtacctatacagctgacttttaaaaatatttatttatttattttgagatggggtctcactctgttgcccaggcgggagtgcaatggtgcaatcttggctgattgcaatctccgcctctggggttcaagtgattcttgtgcctcagcctcccgagtagctgggactacaggcgtgtgctaccacacctggctaatttttgtgtttttagtagagatggggcttcaccatgttagccaggctggtttccaactcctgacgtcaggtgatctacccacctccacctcccaaagtgctgggattacaggtgtgagccactgtgcccggcccttttttaaattttagagatgatgtcttgctatgttgttcaggctggactcaaactcttgggctcaagagatcctcctgccttagcctctcaagtaactgggactacatgtgcatgcgactgtgcctcgtttcttttcttttttttctgagacggagtctcactctatcgcccaggctggagtgcagtggcgccatcttggctccctgcaacctccgcctcctggttcaagcgattctcctgcctcagcctcccaagtagctgggattacaggcacctgccatcacgcccggttaatttttgtattttagtagagacggggtttcaccatgttggctaggctggtcttgaactcctgacctcaggtgatccacccgcctcagcctcccgaaatgctgggattacaggcgtgagccagtgcgcctggccttttctttttttgagtctcgctctgcgcccaggctgtgcctggctcgactgtgcctcctttcatgcaaccatgctgtttctcactttcagtaacaatattcaataaatcacatgagatatacaacattttattactataaaaagggctttgtgttagatgactttgcccaactgtagggtaacttaaatgctctgaacacgtttcaagtaggctagggctgagtgtggtagctcatgcctgtaaccccaatacttggggaggctgaggtggaaggattgattgagcccaggggtttgataccagcatgggcaacgtagcaagaccttgacttcacagaaaataaaaaattagctgggtgtcgtggcatgtgcctgtagtcctagctacttgggagggtgaaatcaccggagcccagggaggtcaaggctgcagtgagctgagatggtgccactgcactctagcctgagtgacagagtgagactctgtctttaaataaataaataaaaattagccgggcgtggtggctcacacctgtaatcccagcactttgggaggccgaggcgggcggatcacatggtcagaagttcgagaccagcctggccaacatggtgaaaccctgtctctactaaaaatacaaaaattagctgggcgtggtagcaggcgcttgtagtcctagctattcgggaggctgaggcaggagaatcacttgaacccaggaggcagaggttgcagtgagccgagatcatgccactgcactccagcctgggcgacagagtgagactgagtctcaaaaaaataaaataaaataaaataaaaataaataaataaaaattagccaggcatggtggtgcaggcctgtagttgaagcaacttgggaggctgagctgggaggatggatggagcctgggaggtggaggctgcagtgagctgtgactgcactactgcactctatccagcctgggtgacagagcaagaccttgtctcaaaaaagtaggctagagaccagcctgggcaacatagtgagactctatctatctacaaaaaattttaaaaattagctgggtatggtggtgtatgcctgtggtcctagctactggggaggcagagttagggggattgcttgagcccaggagggtataatgagctatgatcacatcactgtaatccagcctgggcaacagagcaagatgctgtctccattaaaaataaaataaaagtaggctaggcaggccgggtgcggtggctcacgcctgtaatcccagcactttgggaggccaaggcaggcagatcacaaggtcaggagttcgagactagcctggccaacatggtgaaacctcatctctactaaaaaaaaaaataaataaataacaaaaaattagctgggcgtcggggcaggtgcctgtaatcccagctactcagtgggctgaggcaggagaatcgcttgaacccagaaggcggaggttgcagtgagccgagatcccgccactgcactccagcctgggtgacagagtgagactctgtctccaaaaaaaaaaaaaaaaaaagcaggctaggctaagctatgatgttccttagattaggtgtattaaatccattttcaacttacaatattttcaacttacgacgagtttatcaggaagtaacaccatcgtaagtcaagtagcatctgtatcaggcaaagtcatagaaccattttcatgctctctttaacaattttctttttgaaagctggtctggtcctttaaaatatatattatggtataagttggtgttctgaagttagttagctacaaccaggagccattgtctttgaggcatcactgccccctgatggcaaatgccccaattgcaggtaaaacagtcaagaagaaaacggcattttgagtgttagactggaaactttccacttgataagaggtcccaagacttagtacctgaagggtgaaatattctccatccagtggtttcttctttggctggggagaggagctggtgttgttgggcagtgctaggaaagaggcaaggaaaggtgataaaagtgaatctgaggcataactgcacccttggtctcctccaccgcttcttgtcctgcttgcttacctcgcttagtgctccctgggggcagctcgtggtgaggctcccctttcttgcggagattctcttcctctgtgcgccggtctctcccaggacaggcacaaacacgcacctcaaagctgttccgtcccagtagattaccactactcaggataggaaaagagaagcaagaggcagtaaggaaatcaggtcctacctgtcccatttaaaaaaccaggctccatctactcccaaccacccttgtcctttctggagcctaagctccagctccaggtaggtggaggagaagccacaggttaagaggtcccaaagccagagaaaagaaaactgagtgggagcagtaaggagattccccgccggggatgtgatgagaggtggatgggtagtagtatggaagaaatcggtaagaggtgggcccaggggtcagaggcaagcagaggctggggcacagcaggccagtgtgcagggtggcaagtggctcctgacctggagtcttccagtgtgatgatggtgaggatgggcctccggttcatgccgcccatgcaggaactgttacacatgtagttgtagtggatggtggtacagtcagagccaacctaggagataacacaggcccaagatgaggccagtgcgccttggggagacctgtggcaagcaggggaggccttttttttttttttttgagatggaatctcgctctgtcgcccaggctggagtgcagtggcgtgatctcagctcactgcaagctccaccgcccaggttcacgccattctccttcctcagcctcccgagtagctgggactacaggtgcccagcaccacgcccggctaatttttttttgtatttttcagtagagacggggtttcaccgttagccaggatggtctcgatctcccaacctcgtgatccgcctgccttggcctcccaaagtgctgggattacaggcatgagccactgcgcccagccaagcaggggaggcccttagcctctgtaagcttcagttttttcaactgtgcaatagttaaacccatttactttgcacatctcatggggttatagggaggtcaaataagcagcaggagaaagcccccctactgctcacctggagggccactgacaaccacccttaacccctcctcccagagaccccagttgcaaaccagacctcaggcggctcatagggcaccaccacactatgtcgaaaagtgtttctgtcatccaaatactccacacgcaaatttccttccactcggataagatgctgaggaggggccagacctaagagcaatcagtgaggaatcagaggcctggggaccctgggcaaccagccctgtcgtctctccagccccagctgctcaccatcgctatctgagcagcgctcatggtgggggcagcgcctcacaacctccgtcatgtgctgtgactgcttgtagatggccatggcgcggacgcgggtgccgggcgggggtgtggaatcaacccacagctgcacagggcaggtcttggccagttggcaaaacatcttgttgagggcaggggagtactgtaggaagaggaaggagacagagttgaaagtcagggcacaagtgaacagataaagcaactggaagacggcagcaaagaaacaaacatgcgtaagcacctcctgcaacccactagcgagctagagagagttggcgtctacacctcaggagcttttcttttttttttttttttttgagatagggtcttgctctgtcactcaggctggagcacagtggtgtgatcacagctcactgcagcctccatctcctggcctca

SEQ ID NO: 2115 - DNA, 7092 bp, Homo sapiens; identical to SEQ ID NO: 2114
  source 1..7092: mol_type = genomic DNA

SEQ ID NO: 2116 - DNA, 7092 bp, Homo sapiens; identical to SEQ ID NO: 2114
  source 1..7092: mol_type = genomic DNA

SEQ ID NO: 2117 - DNA, 19149 bp, Homo sapiens; identical to SEQ ID NO: 2110
  source 1..19149: mol_type = genomic DNA

SEQ ID NO: 2118 - DNA, 19149 bp, Homo sapiens; identical to SEQ ID NO: 2110
  source 1..19149: mol_type = genomic DNA

SEQ ID NO: 2119 - DNA, 19149 bp, Homo sapiens; identical to SEQ ID NO: 2110
  source 1..19149: mol_type = genomic DNA

SEQ ID NO: 2120 - DNA, 7092 bp, Homo sapiens; identical to SEQ ID NO: 2114
  source 1..7092: mol_type = genomic DNA

SEQ ID NO: 2121 - DNA, 7092 bp, Homo sapiens; identical to SEQ ID NO: 2114
  source 1..7092: mol_type = genomic DNA

SEQ ID NO: 2122 - DNA, 7092 bp, Homo sapiens; identical to SEQ ID NO: 2114
  source 1..7092: mol_type = genomic DNA

SEQ ID NO: 2123 - DNA, 19149 bp, Homo sapiens; identical to SEQ ID NO: 2110
  source 1..19149: mol_type = genomic DNA

SEQ ID NO: 2124 - DNA, 19149 bp, Homo sapiens; identical to SEQ ID NO: 2110
  source 1..19149: mol_type = genomic DNA

SEQ ID NO: 2125 - DNA, 134022 bp, Homo sapiens
  source 1..134022: mol_type = genomic DNA
gggagcgcggcgcggccgccgcgtgcgcgagccggggttgcagcccagccgggactttccagccggcggcagccgcggcggccgccggctcttccccgccccccgccatggggcagcccggggagcagaacgctgcggaccgcggcggaggacgcgcccggcgcccctgagccggccgagcggcgacggaccgcgaggtaaggggccgcggcgggcgggcgggcctccggcgcgcggccgggcgcctccatccccgtcgcctccatcccgcgccctgggcggcggggcccgggggcctcggggctgcccggcgcgggcccggcgcggcgcaggcccggcccgtcccagcggcgacggcggggcgcggcttcagcctggccccgcgccccagccgggctgcctcccgcctccggacgcctcaacttcggcaaactttgtcccggaggccgggctcggggcccgagggggccggggcgcccgcaccttttcaggaaacggggcgcgcaggcctcgctacggccgtgacccccgctggcgttgaggacccggcaccccgcggggccgcgggtttcacgcggggggacgggcggctcaggggctgcgtggccgagcgcgctgcccgggccggccgggggggcccgggcgttattggaaagttggtcctgagtcattccgcctcagaggcgcctccgaccgcttggcgggcggcgcgggggtccgggtatgggcagagggcgcgaatccccctcgcgcggccgccgagggccggcgactcccggggcaccgggcggctcctggccgcgggctctgcgtcttccccgcgggcgccaggcggctctcggcgggctggccggttccacgccgccagccagccccgtgtggggacttcggtctagtatttggacccgaggagataattctgtgtggaaaattctctcccttcggttggaaacagtaacaaactggaaacggatgaggtgttatggacgtgcttggaaatgcaagaaaccttcagattacgagctgttgacgggaccagttgtatttcacgtttttcgaattaagctcagaatcagttttcagaatgacatgtgatgcgtggtgcgtggtgtgtgtgcctgtgtgtgtgtatggatataattcattcatttttgtggcgtcagaaaggttatgtcgagcgttgtagcggcttcttaatttacattcacggcatacaactgaagaggagccattatttattttttttcctagcatttgctgcgactacacactgccggagcgtttggaaatgttgtttgctgttaccctgtatttgtctataaaattcttactgtagggaatggccaagtggaccatcagttcgtcctgagatcttctcatgtctctcacgtctttgaaaatggcctgtgaacagactgcatcatatgtaggatgtctggcaaaatagtgtacagcgttcttttctcaaatgagaggaaatgtgtaccttttcgccgcgttgtgacaatgtaaatgttaagaattagtctaaagatgaaaattctttggccaaaacaagataagccttatcgatatgaaaactggaaaacatcacatgggactggaaatcctgtgagtgggtgctcatgacggaaaccctgacagaccttggattccagcatcgctggtgaaaatcagaccttatcatggataagggttaagatgtaaggtgtctcacccagacgccatctgttccagctgtcaatgcagaagccaggaaaggagagagagctggccagggagaattccagctttttttttttttttttttttttttttttgagacattcatgtgaatttctctgcgaggggaaagaagaccaattattttccttggatgctgtcccttcttttggaattaataagatggcttcactcagtgagaggctgtaaagacatttcactggaaacaggcagtaacagtggccagttgtttctgttaataccatcaaaatatccctactcttgtttgtgccttgaagaaagtccttcatttaactgagacatctgagcctgcgttgcggattctgattctctaaatactcctgcaagaatccctttaatttttcactgtgcaactcaagaaggacctttctagggtattgtcaggatacgtatgctaatgatattgtcaggttaggtgagaatgattgatcactcccttaaaatccttttttatgatgttaaagctgtactttaagaaagataaaactgccactgtggcgttgcaagtctgagctagctcaagcaaacaaaggaaattgcgttaaatttgcccaactctattttctcatcttcatatagcaagactctccaaacagcaagtgatctaacctatcaagtattatgcaatagctgaatttccttgcaatggtcagtttaaagaactgttaacttagcagaggcgacgtctcgtggccaaggcccttagggtccactccatggaatcaggaccccttgctgctgctttgcgagtgttcatggaggaagaaaaatcacttggtgttctttttttgcatggaagagtcataataactgacttcagatacagagaaagtgggaagagtgagaaagaaggaggtgaggccagaggatttggaaggctaccagagagaagcagccgaggcctgattgtggaaatgatgcttagacttgctttcagcaggagtgatgaagccagaatgagggaggcccagacgcccgggagaggtacaggggataggtgccatgtggtttgcaccaccgcagcaggctttgggtcccaaagacgcgaatggaaatagaagaaaatgcagttttaaatagaaaagaaaaaaaaaaccgagaaaatgttatgtgtgcttgtgtaaaatttattattcataattaaaatacaaaatggctttctcatttgagaaagcctttattgactaagttctgcacaacactattccaggaaagggggtggggagacagaccaccctagggagaaggcagagttttttactattaagcataataccttttttttttttctttcggtgaagcttattgtcggcctgtacagatgacttggagtaggctggcaggtagtgggatgtcataaatgttgatgcctgttggtttctatcaactttaggaatcaggttggaatcgatgctgcattctgtattcctcgagataagtggattgttaattgggacttgggagtctttttctcatttaattaatattcagttaatgtgccctgagttctcataatgttctggttaccgtgctgggaagagtgagacacagcacccatctgctagggtgtgatttgcagggatataggccatcttggcccctgtgcacagtgaagggacatgccagaaaccagcagatacttgactgagacagaccaggacaggagcttgtggcaggaaggataaggaaaaatgcaaatctaccatcctgccctcagggtgctaacccttcgggggagaatactttctcccaccaggaagaaaccagaaagtaaaaatgtaggatgaaatgaattagtggattgtgtagaattctggaagcgtggtgggaatccaccataagggaaagagaaagtcttctgggaagcggcgttgagttgaggcccagtgtcaggaaagctctggtatagtggggccatctggtccctcttacagggccccctcccactttgttttggtaagatgggatctgacggcttgccatcctgtcactccttgccagtagatgcagtgctggccatgctgctggtcattgggtttccagttgggaagttgcatgtgctggcctttggctcttgccaggcagggccttttgtgactgggagctcatgtgggtcatgcatactgtactgtgaagggcatggtctgtggaggggaacagagcagcaggccctaacctgggtggcaccactttgctgtccctaccatttttcattgcaggttgaaagtctccaaagtggcaggggaaggggtgtaaatgttaaacagccccttcctagcctggcatgcgcacctgtggtcccagttactccagaggatgaagtgggaggatcattctagtctgggtaacacagtgagatccctggctctaaaataaatttatttatttattttattttatttgaaacaggggctcactctgttgcccacgctggagtgcagtggcccgatctcggcttgctgcaacctccgcctcctgggttcaaatgagtctcctacctcagcctcccgagtagctgggattacaggcgcctgccaccacgcttggctattttttttttttttttttgagacagagtctcactctgtcacccagactgaagtgcagtggcgcgatctcagctcactgcaacctccacctcctggattcaggtgattctcctgcctcagcctcctgagtagctggggaccacaggtgtgtgccaacatacctggctaatttttgtatttttagtagagatggggtttcaccatcttggccaggctggtctcaaactccagacgtcaagtgatccacctgcctcggcctcccaaagtgctgggattacaggtgtgagccactgtgcccagccttcccagctgatttttgtattttttagtagagacagggtttcgccatgttggccagactggtcttgaactcctgacctcaggtgatccacctcagcctcccaaagtgctgggactacaggtgtgtagtcccaccacactcggcctatttgttttttttgagatggagtcttgctctgttgcccaggctggagtgcagtggtgcaatcttggctcactgcagcctctgcctcctgggctcaagcaatgctcctgccttagcctcctaagtagctgggactacaggtgcttgcccccattcccagctaattttgtatttttagtagagagcgggtttcaccctgttggccaagctggtctcaaactcctgacctcaagtgatccacccatctcagcctcccaaagtgctgggattacaggcgtgagccaccgcaccctgtcttggctctaaaatttaaaaaaagtcctttccccaacctactcctctgtcatccatgtttaaatgacctaagtctccttaattctcaagaactgaaaaattgggggccctacatttcatttcacaatttacttttttactacgatttgttccatgctgatttcgagcattaaaaaaaaaaaaaaattaaatggaggctatttggtggtaacttctcatgaggccattctaccaagaaagatatggcgacctgctgcttggacattctgatttcctttccagctgaaacactgattctgtggcagaacccaaaagcgtatttattggaaacttgatttctttaagtggaaagaaaagctaaattgattaaccaagtggggtaatataatctgtaaggcaacagtagcatcaaagtggtgaaatgtgaatctccaggagtcatgagaattgtaatgaaggtttcctgagattaattttgtgttctggaaggttaatgcccgttaggaggcctgcgtacacaaggtaatgaggtgctcgttaggccttccctccttccaccaagggccaggcacatggtaagctctgggtcagtgtttgtgtccagattctgcaagccggggagacaggagggatgtgccagatgcccacagtggttccatgtgtttggaatgtgtgtcggcacttgggtgtgccttgtagctgcctcctttaacggtgtgttcctggaggtcaggcttccatcctcccgttctgataatgcttagctccaggatttgttgcattatgggggttctttgatggaaagttttatttgacaatgtaattttcttggatgcttttaatgacttaaaagctggaagaacaggaaaactagttctcttgagctctttcatgtccagtaattcccagaaattataactttatgctggaaattaaacctgctatttgaaaccttattacagggtgaattaagagtttaggtttcagaggcttttctgtgtgactttccccttagtgggagggggtttggtatgcccattaagttttatcttaaaatttaatgtgaattttacattgtactcagtaacgtggctgattgttttaatataaacttacttcgttccctaaatctttcaaaactgttgattctccaaaagatgtattgtgtttctggaatcccactgtgtatccctggagctgtccaccccacagctggagaagtgtggcatggtggagggtaccaactttgaggatctgaattccagtctgccctctgtatttagtggtagaatgaccttgggcaggctgcttggccccgctgaattgatgtccctatctataaaatggggctactagcaccagggacatcacttgcttattatgagtaagatggatgggaaagcattgtgcaaatgttaattttcatagtattaggggattgagatgtaacagagtaagaatgttaagatcttacaatgtaaatatcagatcttgttagttagggaccacagaagttttctagttgaggtctcttattttatgtgggaggcagctgaggctctcagtgtttaggtaagtaattctcccaaggcaaataatgacaaagcaagggctcttcacgcaggataggtttttccctgcatttttcctgttcccaacgtttgctcctgggaagatgcttggcctttttttttttttttttttttttttttgaggtggagttttgctcttgcccaggctggagtgcagtggcacgatctcgactcactgcaacctccgccccctgggttcaagctattctcctgccccagcctcctgagtagctgggattacaggcacccgccacctcgcctggctaatttttgtatttttagtagaaacagggtttcaccacgttggccaggctggtcttgaactcctgacttcaggtgatctgcccgcctcggcctcccaaagtgctgggattacaggcgtgaggtactgggcccctctgatgcttggcttctgattccagctagggtcaattgagaattattgaatcacccacactttctttgagaactttctaagtgctaggggctatgctcgttgctaaagctaaaaagtcagataggatgccgtctgatctctgttttcaaggagcttccatgtgatgaatgagccagaagaataatttcattatggcaccatgtagtaggtgccacaacagtggaacagaggctctggtgcattgtggaggcgctgtgcagtttcaacctgggttaggaggaggcgtttcccaaggaggtaactcttagggaagctagcagcaggagtggggaagcctgggctggcagggagtcgcctggcagagggcccgtgagtcggaaggggttctcctgtggctgtccttcaggggagagggtacaggaaaaggcacccggccacttctgggtgctgcctttgtgacagcctaacttctgaggcaggaattctccccattttgcagatgaggaaaaggaagagcaacaggcctgttggaccccagagttcatggtttcaccacagctgaattacagtgcagttttagattttcttcagattctaaacttcttagttttgctttcagagtagacttagttttgctgctgtagagtgctttttaaacaaattgtgtatttttcatgcagcctttcccttccatccaacatctgttttgcctatatggctgatactctaggccgcactccgttccatctctggcgtaagttcctttcttacagcagcctcctcggattcactctcctttgacacatttggatgggaggttctttacgcagtggctcagatgcttcttacagcttgctgagtaacagtccctaacctgatttgctaatgtgttttctttctcctttctctcttaatttacatttaaactggtagtctagtaataatgatagtatttagtcattgtgtcttacagggttttacaaacattagcttgttagtgatgaacaagtccccaaggcctggtcactctgcagagagcataatggttgcaggctagtacctattcatcttgaatttaattataactgcagattgcctgtggaaatatgagttaaaggcatggaagcccttaccactgttagcagggaaatgatgtttggctattttggagaatactttagctcttctgtgagaaccactgtcaaggttttgaacgtgcaaccaggaggggtcagtggtggctgagcagagatgtaggggcttgtttcatggccatttgtacctgctccaggaagggctgtgaataacggaatgcagccagacactgaggccactaggtcaggtccttgggatgacagagggtagatttctttgttcttagacctaagttggcccttgttgggtggaggtggtggcgtgagagccttccctgccttctccaggttgaaggatatttctgtgcatctgggataggtctctagggttgagacgacaagcttctcaagggttggctcacttcattctttctatttctgcagtctggtctatgatgtacacagtaaaaaggagatcagtttatgtatggaaggaattagacctgctttgaattctggtctgtccttcagctaactatgctgttaaattactcttcctttctaagcctcagttttctcatctatgcaaaggtaactgtagagttcacagtcacgtggaaaagcctctgaaacctaaattctccctctggagatggatggtggtgatggtcgcacaacattatgaatgtatttaataccactggactatacacttaaaatgattacaatgataaattttatgtgtaatttaccataataaaaaagtaattgtgagacttaaaagtgagcctgggctgggtgcggaggttcatgcttgtaatcccagcacattgggaagccgaggtgggtggatcacctgaggtcatgagttcgagaccagcctgaacagcatagtgaaaacccatctcacctaaaaatacaaaattagccgggcgtggtggcacatgcctgtaattccagctacttgggatgttgaagcaggataattgcttgaacccgggaggcagaggttgcagtgagccaagatcgtgccattgcactccaccctgggcaacaagagtaaaactgtctaaaaaaaaaacgagcctgtgccaggtgcagtggctcatacctatagtcccagcactttgagaggatgaggcggggggatcgcttgaatccaggagttctcaaccaacctgggcaacatagtgttataagaccttgtctctacaaaaaatttaaaaattagctgggtctggtggcgtgctcctgtagtcccatctaactactcaggaggctgatgcgggaggagtgcttgagcccaggaggtcgaggctacagtgaggtgttactgtgtcaccatacttccgcactttagcctgggtgactcagtgagatcctgtctcaaaacaagaacaagaaaaatcagagcatgtgagagaatataagaacctaatatttcagaagtgatcatttctcttcccctttcctttcctgagtggtttgataaagggaatgacttattagcaatgtggatgacaggctgtcttggaagtatggcctgtccctggaagaaataccggtgggagtagaaggacattattggactgcaaataaattatttataaaaagggtaaaatgtctagaaactgaaatcacagtatatttgcacaaaaggaacatctatagatatctccctttttaaaaagcaattttaacatatgaatttttatatatttaaattcgtattttagcacttttttttctgttatttagcaataataatattcttcaatttgggctgggcgtggtggctcacgcctgtaatcccaacactttgggtggctgaggtgggcgaatcacttgaggtcaggagttcgagaccagcctggccaacatggtaaaaccccatctctactaaaccaaaaaaaaaaaaaaaaaattagctgggtgtggtggcacatgcctgtagtcccagcaacctgggaggctgaggcaggagaatcgcttgaattcgggaggtggaggttgcagtgagccgagatggcgctactgcactgcagcctgggtgacagtgagactgtctcaaacaacaacaaaaacaacaacaacacttcgatttattcaggcctctgttcacattttacctcttcaaaggggtcttctgaacaccctaattaaacagcccatgctgttgctgtggtcacttgccttgctttttttttttttccatagcagaaaatggttttcctttcctttttcttttttttttttttgagatggagtctcccagtcacccaggctggagtgcagtggtgtgatcttggctcactgcaacctatgcgtcccaggttcaagccattctcatgcctcagcctcccgagtagctgggattacaggtatgcaccaccccacctggctaatttttgtatttttttagtagagacagggtttcaccattgttgaccaggctggtctcgaactcctgtgctcaagggatctgcccgcctcagcctcccaaagtgctgggattacaggtgtgagcccccacacccggcctgcagagaatgtatttctattaccttaacctgtgtactaggagtgtgcctggcatatggtaggttctcaagtatttgcataaatgaaccagtatattatagcccaatgttttattgaggcaaaattcacataacatacaattaagcattttaagtgtgcagctcagccgtatttagtgtattcacaatgttctgcaaccaccagctctctctagtttaaaaatcaggccaggcatggtagcccgcacctgtaatttcagcattttgggaggctggggtgggaggatcacttgagtccagtagtttgagaccagcctgggcaacagaggaagactccatctcaacaaaaataaagaattagcttggttgggtgtggtgtctcacgcctgtaatcccagcactttgggaggctgaggcgggcggatcatgaggtcaagagatcaagaccatcctggccaacatggtgaaaccccgtctctactaaaaatagaaaaattagctgggcgtggtggcgcatgcctctagtcccagctactcaggaggctgaggcaggagaatcacttgagcccaggaggcaaaagttgcagtgagctgagatcacgccactgcactccagtctgggagacagagcaagactccatctcaaaacaaaacaaaacaaaacaaaactgggcacagtggcttgagcctgtatgtagtcccacctactccagaggctgaggcaggaggatcgcttgagcccaggaattcgaggctgcagtgacctatgatcacaccactgcactccagcctgaaggacagatggagaacctatctcttaaaaaagaaaaacaacttttcatccccctttacccattaagtaatcactcccattccccaatcctcccatcccttgataacctctaatctgcttttggtctctgtggatttgcctattttagatatagcatctaggaatcatataacttgttttttgtatctggctgctttcacttagcatgatgtttttgaggtacatccaaattgtagcatgtgccagtatttgttcctttttattgctgaatcataatccattgtatgtacatacatgccacaatctgtctattcatttgttcatgggcatttggattattttcactgactattaagaataatgctgctataaacatttgtgtacaagtttctgtgtaggtatgtttttatttcacttgggtatatacctaggagtggaattgctggtcatacggtaatatcgtgtttaacttattcccaccagcagtgttccaatttcaggacatctttgctaaatttattttttttgttttgtttctttttcatgtcatatgggtaatgtgccgacgtcataacaaggtttcagagtggcacctctcacaccttcatttgaatacccaatcacacttatgaactacaaaaggatatatgtgtgtgtgtgtgtgtgtgtgtgtgtgtggtatgtgtatatgtatgtatatatttttgtttaaagctattctagttaaagtggtatctcgtggtttgggtttgtattttcttgatgagcaaagatattgaatgtcttttcatgtgactcttggccatttgtgtatttttggagggaagacaatgtttgttgagttctttatatattctgaatgttaaactttttttttttcttcttttttttgagaccgagtctccttctgttgcccaggctggagtgcagtggtgcagtggcatgatcttggctcactgcaatctccgcctcctgggttccagcaattctcatgcctcagtctcctgagtaactgggactacaggcacacgccaccatgcctggctaatttttgtatttttagtagagatggggttttgccatgttgcacaggctggtctagaacccctggcctcaagtgatccacccacctcagcctcccaaagtgttgggattataggtgtgagccactgcactcagcctcttctgagttttattgttttagtttttacctttaggtttttgatccatttcagttaattcttgtatatggaatgagataggagtcccaattcattctttgtatgttcttatttagttttcccagcaccatttattgaaaacactattctttccctattgaatcgtcttggcacccttgttaaaaataaattggccatagatgtttgcatttatttctggactctcagttctattctgttgctctgtaagtctgttacatcagtaccacactatattagtctgttctcatgctgctaataaagacatacctgagacagggtaatttataaagaaaaagaggtttaatggactcattgtttcacatggctggggaggcctcacaatcatggtgaaaggcaaagaaggaggaaaggtatgtctcacatggcagcaggcaagagagtctgtgcaggggaactgtgctttataaaaccatcagatcttgtgagacttactatcatgagaacagcacccccacgattcagttacctccccctgggttccttcccataacatgtggggattatatgagctacaattcaatatgagatttggatggggacacagccaaaccatatcacacactgttttgattactgaagctttgtagtaagttttgaagtagtaagtttgggaagtatgagtctcccaactttttcattttctatattgttttgactatttggggccagttgcaactttatatgaatttgaatatcacctttttcatttctgcaaaaaaggtcattggaattttaatagggaggggattgattctgtagattgctttggggggttgcaatcttaacagtattgtcctccaatccatgaacgtgagatgtcttttcttttcttttttttttttttttcgagagggagtctcgctctgttccccaggctggagtgtagtggcacagtctcggctcactgcaacctccgcctcccgggttcatgccattctcctgcctcagcctcccgagtagctgggactacaggcacctgccaccatgcctggctaattttttgtattttttgtagagacggggtttaactgtgttagccaggatggtttcaatctcctgatctcgtgatccacccacctcggcctcccaaagtgctgggattacaggtatgagccaccgcgcccagctgaacttgggatgtcttttcattcaattatgtctcctttaatttctttaagcaatattttgtagtgttagtgtacaaatcattcatctctttggataaatttatttctgggtgctttatttttgtgggttctattgtaaatgaaattattttcttacctttctttttgtattgctcattgctggtatatagaaacaactgatttttgtatgttggtcttatgccctacaaccttgttgaatttattacctctagtagttattttgtgggttctgtgggatttctttatacagaatcatgtcacctgcatatataatttacctcttctttctaatttgaatgccttttatttctttttcttgcctaattgctctggctaagacatttagtaaaattttgaataggagtgatgaaagtgagcatcctcatattgttcctgatcttaggggaagcttttcaccattgattatgaagttagctgtgttttctttctttcctttttttttttgtttttgacacagggtcttgctctgtcacccatgctggagtgcagtagtgcaatcatggctgacttcaacctctgcctcccaggctcaagcgatcctctcacctcagcctcctgagtaggtgggaccaaaggcacatgccacaatgccctgctgtttttttttattttttatttttggtagagatgggtttcgccatgttgcccaggctagtcccaaactcctgagcagtcagcccaccttggcctcccaaagtgctgggattacaggtgcgagccactgtgcctggactttttttttttttttttttttttttttatcagaccaggtctcactcttttgcccaggctggagtacagtgatgtgatcatagctcactgcagtcttgaactcccaggctcaagcagtgctccttctttagcctccccggtagctgggactactataggtgcaagctgccacaccctgctaattttttaatttttgtggagacagggtcttgctgtgttgcccaggttggtctcaaattcctcaccttgagcagttctcctgccttagcctcccaggtagctgggattacaggtgtgcaccaatatgcccagttaattgattttttttttttttttttttttagtgatggggtcttgctgtgttgcctaggctgatctcaaactcctggcctcaagcagacctcctgcctcagactcccaaaatgctgggattacaggtgtgaaccactgtgcctggccactgactttttttttttaatggaaggttgttgagttttgtcaaatgctttttgtgcatcttctgagatgatcatatttttttcattgttctagtaatgtagtgtattgtattgattttgttttgtatgttgaatcacccttgcattcctgggataaatctcactttgtcatggtatataatccttttaatgtgttgttagattgagtttgctactattttgttgaagatttttgtgtctatgttcattaggaatattagtctgtagttttcttttttttttcatttttgagacaaagtcttcctttgtcacccaggctggagtgcagtggtgcgatctcgggtcactgcaacctcagcctccccagtagctgggattacaggcatgcaccatcatgcctggctaatttttgtatttttagtagcgacagggttttgccatgttggccaggctggtctcgaacacgtggtctcatgtgatccacctgccttggcctcccaaaatgctgggatttacaggcatgagccactgcaccctgcctgtagttttctttccttgtgatatttttgacttcggtatctgggaaccaatctttttttgagacagggtcttactctgttgcccaggttggagtgtagtggtacgatcttggctcactgcagccttggcctcctgtgctcaagtggtcctcccacccagctgcctgagtagctggtactacaggcacttgccaccacacccagcaagttttgttcattttttttgtacagatgaggtctcactgtgttgcccaggctggtcttcgactccaggcctcaagtgatcctcttgcctcagcctcccaaagtgctgggattacaggtgtgagccactgctcccagcccccagttgtattttgactgtgcatcatgtttcttcagaattttgaaacctgccctctcctaattgagaaaattctaagagggtttccaagcagacaaccctaacatctctggctgggatgatgatgattgtaccatgtacttcccctcttctcaacacagacacattcatgttgtagtgccagctgtaagcataggagttgcacttaatggcttacagctggggaaaatcatggctgatagcacaccaccagtgcaggatcagggaagggaactctattcctgatgccaggacaggaaagagatgtgcttccttcatttcatgaaaaagccacagattgttccggataatggttgctgaataagaaaccaccctaaacatcagtgatttaaaacagtaatctactactacatctcatggttctgtgggctgatcaagcagggctcagctgggtgattcttctgctccatgtggccttgatggaggtaatttattggtattcatctgttggctggtccagtcatgagggtccaagagggccgtacacacatgcttggatggttggaaggccaggctcaggggatcctccctctccttgtgctctcaggtcctctgcagatggcctttctcctaaggtggttgtgcttcttacatgacaactcagaactcttagagtgagtgttctaggagaggaagtggaagctgccagtctctctctctctttcttcttttttttcttttgagatagagtctcactcttttgcccaggctgagtacagtggtaccatcatagctcactgcagcctcaaacgcctgggcagaagtgatcctcccagcccagcctcccaagcagctgggactacaggtgcatgccaccttgcatggctaatttcttagtttttaactttttgtagagacaaggtcttaactacgttgcccaggctggtcttgaactcctgggttcaaacgatcctcccaccttggcctcccaaagtgttgggattacaggcgtgagctactgtgcccagtctggagctgccagtatcttaagcctgggcttggatatcagtgtagcattattcctgccatgttctaaaaagacacagagtcctcctatatttgaggagaggggacatggaccctaactcttgatgaaaggagggtcgaagaatttgtgactgtccttgatctggtatacgcatggtggctagattccatagtgctctcagtaatatatgttagatacccatttgaaaactgttgtggattaaaatggaaatgccaactgttgtgtgttactcattttcagtgagtacattctgtgttctgaatcaataatttctaaaaaacttttggagtatacctattcataaaataattacctctataaaatgtatgtcttatcagcagccatccttgatcatgtgtttgtcaagtttttcaagtacagctttgggtccatacgttttttcttcctattactagttcattttaaaaatttgttgaaaccttcccttttattttaaataatattgtggggttttaatatttctctctgttcttaaaaaaagcttcattgagaaaatataagtaagcctatatatcctaaagttcctttcctttactctagatcattctagtaaatcccctagagacagttctggctgtttatatataaaagtgtggtataatttgacagtgtgtgcagaggtgtgtatggatgtgctctcacatagaaaccctgcctccccagcctgtctcagctgattgttgcaacactgagccgagcaaacatgatgaggtcacagagaagtgagggagtggttttaaataatgaaacaggaaatctctgtctttggctccagtggtgccccagtgttttgggattaatgagggaagagctatgtctgcctgtgttccatgagtgccccttgcttgtacctctatggagaaccccaacaaccctggctggaaagccacctaatcctgtgtttcccaagcataacctccctttgttcccaagtaagtctttcctagacacctgaacttctgtgcaacataggcatgaatgaggagagtgagctactgtggtgttatatatatacacacacatatatacatgatatgtatgcatgatatgtatatatgtgtgtgtgtgtgtgtgtgtgcatagttttcatccattgtttctgactcataagtcccatagcccttgttacagtcttttgttgtaatgttgggtgtcttgcctcctttcagctgcccaaggcaggactctaatctgactgtgagtcagaagacccttattccagagagggccctgcctcattccctagaggcaggaatgctgcacagagaggccaagataagtccgaacagacaggccttgctgggtttagatcatggttttttgtccagaaacatttctagatgattgtaagtcatgcctgtgtaatgaagccaccataaaaactcaaggacaggccgggcatggttgctcacgcctgtaatcccagcactttgggaggctgaggcgggcggatcacctgaggtcaggagtttgagaccagcctggtcaacatggtgaaaccccatctctactaaaaatacaaaaattagccgggtgtggtgtcgggtgcctgtaatcccagctacttgggaggctgaggcaggagaattgcttgaacccgggaggtggaggttgcagtgagccgagttgcaccattgcattcccacctgggtgacacagcaagactgtctcaaaaacaaacaaacaaacactcaaggacagcgttcaagagcttccaaatggcggaacacgtggaggtttctgaggatggcccgagggagggcatggaggctcccgcctggcctcatacctcgccctttgcgtcccttcatctgtgtcttctgcagtatcctctacgatataccggtaactgtaagtacatatttccctgagtcctgtgagccactctggcaaattaatcgaatccaaagagggcttgtgggaaccccaacttgaagctggtgggtcagaagttctagaggcctggacttgcgactagtgtctgaagtggggatggggggtggacagccttggcgactgaaccgccaacagctttgttcacgcaattcttctgcattggcgattgttgtcaggttgtgagagcaggggaaaaacacaggttgagagagtttttccccaaacagcccctggtcgatgccccggaatgactggctgctgcatggaattgcagaggcctgagtgcctctgcttctaccgtgattcctgaggccaagacctctggtctgcatggtctgaagtctcttacgaaggtaaaatgttatgtatatattttgaataagggtacctgttcctcattctgtccttttgaattccaaaagtgtgttggcctgtgagatagcataagggacagaatcattgctctcgtgagcctttgggcttgcttccttaggcactacgtactttctcattccccattgccttcaggattctttctgtcagaatgtagtggctgtggcctgggggtgaccagcataggggccaaagaagggtaatgagtcttgaggcctacagagggtagtaggcaaggcgggagggcaagggccagggggcagcatcattcacacagttgaaaacgtgcccttggcctgtctcctctctgtgttctgcatcttagaaaatagatattgtcttgtgttaagatgaatcaatatagttacccctttttatattgtcttaagcttcttaggaactgctttgtattttagtcactcaggcttggagtgaaacatgtaatgtgtagttcaacctgaaaaaattggtctgagaggcgtcttcatagagtccccaattctatatatgatgaggtctcatcaagctttgacattctgctcttttacgtgtaacactactaatgtaaatgtttctggattgtaaagaatggtgggaagcgtagagattatctgttggtaagccagaggcaggaggaagaggaggaggaggaggagatagtggcgtccctcctgcagaaaccccgcagtggaaggacaagattgcaggaggagttagagaccagtggtctagtccccatctgtctttgtgaccttaggcaaatcattgaatctctttgaaagccttgtctccttgcatggcatatggagattatagttgctgtgaaaataaaataatcagtttttaaaaatccataaaaatgaaaaatggtatttaaggttgaaggcacttgtatttctttttctttcttttttttttttttgagatgtagttttgctcttgtcacccaggctggaggtgcagtggcgtgatcttggctcaccgcaacctccgccacccaggttcaagcgattctcccgcctcagcttcccgagtagctgggattacaggtttgcaccaccacgcctggctaagtttgtatttttagtagagacagggtttcaccatgttggtcaggctggtctccaactcctgacctcaggtgatctacctgcctcggcctctcagagtgctgggattacaggtgtgagccaccacgcccagcctaggcactcgtatttcttagtcgggaaagagaggacaggatatgtccaccacacattcaccagttcagcatgtattaactactgtgtgcctgactaagcttaggtactcagtgtattttcatgtaaagaaaaacaacatttaaaacatttaagtgagcactgaccaaatctagcttagttcagaaaaccctttttttttttttgagactgggtcttgctctgttgcccaggttggagtgcagtggtgcgatcacagctcactgtagcctcgacctctcagtctcaagtgatcctcactttctaagtttccaacattttttgggccaggtacggtagctcacacctgcaatcccagcactttgggaggcaaaggtgagcagattgcttgagttcaggagtttgagaccagcctgggctttatggagacctcatctctataaaacaaatataaaaactagccaggtgtggtggcgtgtgccattagttccagctcctcaggaggctgaggtaggaggacagcttgaatctgggaggcagaggttgtggtgagctgagatcgcaccactgcactccagtctgggcgacagagcgagaccctgtctcaaaaacaaaattttttttgtagagatggggcctctatgttgcccaggctggtctcaaattcctaggttcaggtgatcctcctgattcggcctcccaaatggccgggattataggcatgaccactgtacccggcctcagcagacctttgtaaagcacttcatgggtgccagtcctgctgttacagtgctaggtaaatgcataaaaatgctccatgaggcattctgtgttctcaggaaattcagactgccagtttcagtctggaacgtgacactttatgaaggaggcaatagaacaaaaaaaggacaaattacaggattagtaattatcaaaagctaataccgaggtcagaataggactcttgttcagtttacatgaggaatttaaccaaatgagcttctgcagagaaccagcattagggtggtgaccaggctggggtacatacatgtcatatcagaagtgacctgagactgggtgtgagaagcagtggctgatttggactactgaaagcagaattaagagtctggtggcattggggggagattagtgctgtggaagtcctgctcagagtctttctcatgatgggtacatttgggaggagcttagcagacatcagaggacctgcagagagttgacacagcgggaggaaccagctgcactaccactcatgttcttttccatcttagcatctcgtgagcataattcagaatacacagtttgattaagtatgtgcagattccattcagttcatgaattcattcccacagtgtagcctagcccaagtgttagcacttctttacttgtttttgttgttgttgttgtttgtttttttgagacggagtttcactctgtcgcccaggctggagtgcaatggtgcgatctctgctcgctgcaacctccgtctcccagattcaggcagttcttctgccccagcctcctgtgtagctgggactacaggcacatgccaccatacctggctaatttttgtatttttagtagagatggggtttcaccatgttggtcaggctggtcttgaactcttgccctcaaaggacctgcgtgccttggcatctcaagtgctggaattacaggctgagccactgctcttggccaagcacttcttttctcatagtcttctgctaagtatttccttctgtcagctgccaggcagcaatagttttcacatttgtttgtggttgtcctctagaacttggcctttagtgtggtatgtgtaggattttgttgattccaagggagggtgaaaaatgctgtgatccccagaacctgggatggctggggtatgttgtctctgaggaatttaataacattttgtggtcattgctggaatcttcctagactcctttgatggaaagtagggactccaaggggaactcctgactgggcttgcgggctgccttctcagagccctactttattagtgatttatttctcttaatgggctattagaaatgaccacaaaaactgaggcccccacccatacaatttctatcagttaagaccctggaaattcagatttagagggaatttttaaagaactcctgggagtgctgatgccctgctggactgggagcctctggtccagtggaagcagcacattccctccaggagccccagtgctttaggaatgcagtttcccaggccctgcctcagacctgccgactcacagtcagctctcagagaggctgttaggtgatcattgcgttcatttaagtgtgagaagcaccgtgcaggctttgggtgagagagtcggggttcataccttgcctctcttctttcccagctgcatgaacttgaccaagttatttggcctttctgaaccaggaccgtagcacataaagtgagtgcgatggtgcaggccccagttcctcagccacagtgctgaaaccccagagcctctgaaaatggaatgttttttcatagatttggtgccacttggcctgaacttatgtgaggctatttataatctctattccacttaatatgaatatttcattattttaccacagatggttaattaacatgtttcctgttcttttccttttttttttttttttttttgagaagactcttgctctgttgcccaggctagaatcagtggtgtgatcaaagctctctgcagccttgaacttctgatctcaagagatcttcccacctcagcctctcaagtagcgaggactacaggcttgtgccgccacacccagctgattttttaatttaaattttgtaaagaaagggttctggccgggcgcggtggctcacacctgtaatcccagcactttgggaggccaaggcgggcggatcacgaggtcaggagatcgagaccacggtgaaaccccgtctctactaaaaatacaaaaaattagccgggcgcagtggcgggcgcctgtagtcccagctactcgggaggctgaggcaggagaatggcgtaaacccggaaggcggagcttgcagtgagcggagatcgcgccacggcactcccgcctgggcgacagaacgagactccgtgtcttctcactttgttacctaggctagtctcagactcctagactcaagtgatcctcccacctcggcctcccaaagtgctgggattacagtcaagagccaccacacccggtgaattaatgtgttttcttatggttactgcctcagacttccctggagtgttatataatatataatatataaaatatgcgtacaatatttcctttctaaaattcaaaaaattctgaactctgaaacacatctggcctcggttttggataaggattgtggtgctatagatacccagcttataggtgggtcagtatatgccatgttagtgtgttggtatgtgtagaaaactcttggcagttagcaggcacccaacaaatgcagctatttttgtttgtttgttttgagacagtgtctcactctgtcacccaggctgaggtgcagtagtacaatcacagctcactgcagcctcgatttcctgggttcaagtgatccgcccatgtcagcttcccaagtagctgggaccacgagtatgagccaccacacctgcttaatttaaaaaaaatttttaattaaaaaaattttttttggtctgctgcagtggctcacatctgtaatcccagcgctttgggaggccgaggcgggcagatcacaaggtcaggagatggagaccatcctggctaacacagtgaaaccccgtctactaaaaatacaaaaaattagccgggcgtggtggcgggcgcctgtagtcccagctactcaggaggctgaggcaggagaatggcgtgaacccgggaggcggagcttgcagtgagccgagatcatgccactgcactccagcctgggcgacagagcgagactccatctcaaaaaaaaaaaaaaattttttttttttgagacggagtctcactatgttgcccattctggtcttgaactcctagtggtcgtcccaccttggcctcccaaagtgctgggattgcaggcatgagccattgcacctggactcattttttttttttttttttgagatggagtctctctctgtcgcccaggctggagtgcagtggcgcaatcttggctcactgcaacctccgcctcccgggttcacgccattctcctgcctcagcctcccgagtagttgggactgcaggcgcccgccaccatgcctggctaattttttgtatttttagtagagatggggtttcactatgttagccaggatggtctcaatctcctgacctcgtgatctgcccgcctcggcctcccaaagtgctgggattacaggcgtgagccaccacgcccagccaactgtttaaagacatttcaagccaagagcagaagttgtgttagaaggtggctgtattagtccaatttcacgctgctatgaaaaaatacctgaggctgggcgcggtggctcacgcctgtaatcccagcactttgggaggtcgaggtgggaggatcatgaggtcaggagttcaagaccagcctggccaagatggtgaaactccatctctactaaaaatacaaaaaaattagccgggtgtgtggcgggcgcctgtaatcccagctactcaggaggctgaggcaggagaattgcttgaacttgggaggcggaagtttcagtgagccgagatcgtgccactgcactctagcctgggcaaccgagcaagactctgtctcaaaaaaaagaaatactcgagactgagtaatttattaatataaagaaaagaggtttaattgactcacagttcagcatggctggggaggcctcaggaaacttacaatcatggtggaaggggaagcaaacacatccttcacatggtggcagcaaggagaagtgcagagcaaagggggaaaagccccttgtaaaaccatcagatctcgtgagaactcactgtcacaagaacaggatggtggaaactgcccccatgattcaattacctccccccaggtccctcccatgacacatggagattatgggaactacaattcaaaatgagatttgggtagagacacagccctatcagtggcttacgctcctggcttggcctcctggcaggctttttatagagggagtgggatccttgctggttatgaaggacttgtgttccttagagttacagtcttggaatgtcagccctcagcttcttgtttttcttttcacccagatggtgcacataaggaggcagcgtgaggtggggtggtggctaagggcgtgagtgctggtggcaggctgcctggtctgagtgaccctgggtcttgggcagttaccttccgtgtgtctcagttcttttacctagaaataaggataatggtacttaccccctggagtgtgagatggaaagcatttagcataggtaagctcagtaaaatttagcagttttagttatctaggactataatggaggttaagttggccagaagtataattttttttttttttttaagagacagggtctcgctctgttgctttggctggactcaagctcctgggctcaactgatcctcctgcttcagcctcctgagtagctgggtgtgcaccctgcacccagccagaagtggaatatcttgttggggctgggcttagagctggagctggtggccggctctgctcgcttacagaattctgtacggtttctgatttctctcagcccatctgtccttcacttgcaagcatctgatgactgctgcatgtaccataaaaacatgcaaatatataattcttggctttgaggaggtgaccctatgaaattgacttaaaaaagttgggctggatatagtggctggcgcctgtaatcccagcactttgagaggctcaggccggagggtcgcttgagcccaggagtttgataccctgtctgagagagaattagctgggcatgttagtgtgcgcctgtggtcccagctactcaggaggcggggcgagagggatccttccaggctgagatgtgagggttctttgagcccaggaggtccatactgcagtgagccatgattgggccactgcattctagcctcagtgacagagtgagactgtttaaaaaaaaaaacaaaaaaaacttcagaggagtcatatgattgacttgtgtgtgtctacgcagactcccttttctctgtagagacttacaatcttcagttctctggagcgttcttcagattcccttgctccatgactgaccttggctaggaaaataattgggccgtttttggtgcacagcagatgaaaattatcagtatgtccctagctttccactgtgaggccgccgtagcaacagaggacagtggatgtgtgacttgtaccctttcagagggccaagaacgcaatatcctaaagcagccttttctttttttattttttgagtcagggtctcactctgttgcccaggctggaatgtaatggcatgatctcagctcacaggagcatcaacctcctgggctcaagtgatcctcccacctcagcctcccaagtagctggaactacaggtgcaagccaccacactggataatttttgtattttttgtagcgacagggttttgctatatcgcccaggctggtcttgaactcctggcctcaagtaatcatcctgccccagcatcccaaagtgctgggactacaggcatgagacatcacacctaaccctgttcttgatacctggtttttgtggtcctttttttctaaaattcatatgaattttgagttctgctgtatgatatgtaatatatatgttctaatattacaaacttctaaaaatctttctgtgcaccaaaattgatcctccaggacagaaaaaatgccagtggttcttgtctataccaccatattttgaggaacacaaggaaagattttgaccttccctggacgtagaagaatttgtattgtgattgacacatctttaatgccttaattacttgccttcagttttctttccttttggtgcttaagggagtatttgttctccatgcatatttggtaccctttggtttagataatttagataattagcaactagttttggtctcattatcagacattttactctggacaccccatcaccactcccatcatgggggagtttggaggccaggagattcactggatgcttcttttctagtgtgtgctcttcttagatgggaaggaaaaaggtaaaacctcaaaaactctgtggtaaactgatgtgggaatctgatactaaaaatgtcccaagtgatttaaagtgtgtaagaattactcacttttctgtggagagcgatgtgcataaagacagtgacaagtggaagaagatatccagatgagaccctcactgccctcggtgagtggattgcaggatgctgggagcccccttgcgtagagactcaccgctggactccaagccctctgtggcttctgctgtggctgagtcatcgctgcccaagactactgttgggttctcctccctgctggtgagcagtgaggcaccagggagcccctgcctgcagccagctcggtgattccatgcagttttacatagggaaagaatgctctacctggctacgttttcctgtgtcctgttgaaatgaagaggttagtcatgcattccctcagctagagcgtgaggcagtccttccgaagattgtccaatttagacccagactcttcaaaggaaatgtcagcatgttttgatgtcatggttcaaaacctcactgggatggtttgtgtgagtacatacctgttttacttttagtttcactagaggatgtcatttggactagttgtttttaagtgaacatttcaaacttaactaaatttgattcctgtttccttggttgtagttacatggaaagaccactgggtctgggacagtggttctcatccagagatggagttggtggggtgggggtggggtgcagtttcgtaccctagggggcattttgcagtgtctggaaaccttcagaagtggggtgggggatgccactggcattggtaagtagaacgagggatgctgtgaacaccctgcagtgctcagcatatccctacagcaaagagttttcgggttcaaaatgttagttgcgccaaggttgagaaaccgtggcttggaaattgttcattcaccatactcttcttgatttctagtgaatgtatgactgttaagattttatgttttcataaggtgaggtactttctacagaaattcagtctctttagtcattaaacagcagagggcacttggaggctagagtgcccagaagtccatcaagccagtctggataaacccttcccaacatgccataatttacatcaaaactttggttagcagaatgggaatttttgagtagataccattagaaaaataaaataattttccagctgtggttcccaagttccccaaacttatgtctttagtccaagctgccccttgagcttcagcttcggacctgcatatttatttaacagctattgagtccttggtatgtgccgggcaccctcctgtgtaccagggcatggcaggaaatgatatgggcagctccctgtagtcatgaggcctgtgttctaaggcagaccttgaagacagggaagtccatgtgctgattccagaagaatagagggggcctggcagggctggggggaggtcaagagtggagtgcttcatacagctggtctcagaggggctcattgtcccggacctgcaggacaaggaggcgttttgtccacaaaccttgagagtgagtgaatggggcatgactggggccactgggtgttattgcttgaatgacacctaacctgtctctagtgaagctcttgattcctccctacccccatccagatgctagaagactggggagcatttcttggtccctcttctctcacaatctgtcgttggtgctcacttctgcaccctgttttcccacgtccctggtccccagcccaggcaagccttctgctgatgccggtggccccaacttgtctatccacttcaccccagttttctccaggcctttctccatgctgctgtcagagagatctaaacataggtggcctcctgcccttccctgaaaaccctttacggcctctgactgcattcagtgcaccctgcattcctcctgataaggtcttgcgtctccctgctgccccagcttcagccccaggagcctgcctgcccaggaggccatcattgttccccctggacactgcctgtcctgcctgctgccttgtcctcctttctccaggggcctggggcctcagtctctccatgcctgcacctggagtcctgttgcctgtgtcctacagtttcctcctcagccatccccacagggctgtgtccctttctactagccatgtttattttcttgtggagatggggtcttgctatgctgcccaggccggtcttggtctcctggcctcaagcagtcctcttgctttggccatctttagatgataactcactcacctgtgctgcctttcacttggaggatgggtggatgattcacagggacctgccctccttcccgcagagttggggtttttgtgtaggggatttttctgtcagttattttttcctcacctttcagagtattaaaagaactaagccattagtggtgaggcatgagggcagcgaccacagctccaggggagctctcttatccctacagctggcaaatgttccaccctgtttttatggcacacagaaaggtaggcgcatagtgatgttgttagtaagcttttgaagtagagcatggtgagttagttggcctttttacgaaaaaggaaatggaaaactagcaccatggccttggcataattactccaacatgcaaatcagtactggaaggaagttgaggcagcatacctctatgctccactagtccttaagacacgtctgaaagaaatgaaattttattttgttagaggtgaaggaatgcatggatggaatgcatggtccaggtgtttataactgtgcatttatttggcggttgttttggatggacaggaagtgggaggggagggcacagagagtcactttggccacgtccctggtttgccacaggctgatactggagcattcctaagtttcgcaatggagatggatgtgaaagaagaacacactaggccaggtgcggtggctcacacctgtaatcccagcactttgggaggctgagacaggcgaatcacctgaggtcaggagtttgagactagcctggccaagatggtgaaaccccacctttactacaaatacaaaaattagccgggtgtggtggcacatgcctgtaatcttagctactcaggaggctgaggcaggagaattgcttgaacccaggaggcagaggttgaagtgagccgagattgtgccactgcactccagcctgggcaacagagcgagactccatctcaaaaaaaaaaaaaaagaaaagaagaaccatactagtcaggtgctagagggcttccaaggcagcctccaagggaaggaaatgtctgagaagttatttaagaggatttgttggaacagaaaaacttccaaattggtctagaaggtggaccctagctatagacgcattttacaggacataatgtaaatattaaaggcacattttcagtatttggggaaaatatgtcctctgagtcgaatgaccaatggctgtttctagaaaaattttagttgtagttttaatttgattgtcttgagcatggtgatagattgactttttttttttttaagacagtcttacgctgttgcccaggctgcagtgcagtggcacgatctcagctcactgcagcctccacctcttgggttcaagtgattctcctgcctcagcctcccgagcagctgggattacaggtgcgcgccatcacacccagctaatatttatttatttatttattttgagatggcgtctcgctctgtcacccaggctggagtgcagtggcgcgatccctgcttactgcagcttctgcctcccaggttcgagagattctcctgcctcagcctcccaagtagctgggactacaggtgcgtgccactacacgcggctaattttttgtatttttagtaaagactgggtttcactgtgttagccaggatggtcttaatctcctgacctcgtgatctgcctgccttggcctctcaaagtgctgggattacaggcatgagccactgtgcctggccgcacccggctaatttttgtatttttagtagagacggggtttcaccagttggccaggctggtctgaaactcctcacctcaggtgatctgcctgcttcagcctcccaaagtgctgagattacaggcgtgagccaccgcgcctggcctagagtgactttcttaaagctctgtgtctcctggaaatggaatgtatcccaaatgaggattatttttaagctttataataaaatctttcacagcatagactttttttttttttttttttttgagacggagtcttgctctgttgcccaggctggagttcaggggcgcaatctcggctcactgcaagcgccgcctcccaggttcatgctattctcctgtctgtctcctgagtagctgggaccacaggcgctcgccaccacacccggctaattttttgtatttttagtagagatggggtttcaccatgttagccaggatggtctcaatctcctgacctcgtgatctgcccgcctcggcctcctaaagtgctgggattacaggcatgagccaccgcgcttggcccacagcatagacttttaaagaccatgtaggcaagaacagatctttaaagggaaacctcagtttggcttttgaaagttcatctgattgaagttaaactgatgaaacatactccatccatgcattaccaaaaacgttggagcacggcatggcagtagtatctaaaacagattggcaaactatgggtctaagaatagtttttatgtgtttaaaggattgtaaaaataagcaaagaagaatatgtgacccatgaaacataaaatagttactgtctggctctttatgggaaaaaagtttgccaactcttggcttaaagggtcaagaatgctttaccaaaaaacaaacaaccccctcccccctacaactgtaatgtttgagcaggagttttacaagataaagaattttgatcttgaggggatttgggtgaggatggggcggtgcagtgggagagagagtatagatactgttcatcacacccagtgcagtcggctctggtgggaacatagggtgacctcagtgtgtggtgaggacagtgatcatggccccttttacaagttgaagcttagttctggagtggtggaccatcagaagcttttaagtaggagaatgtcaatgtcataaattagagttaattgtgagaaattgaaataagtattccatttttttctgagatgtgctctcctgaacttataaagtagttcttcagaagtgtttgcagtgttcacaagacactggctctgtggtatttgacatgcagatgggcccagaattcctgacttaaggctaaagatttatcttgagcttatcatgatgtgggcttatgattgttttgatcagcagctgacatctgtgaagcctcagtgatcctataaattgaggaacctgagagaatcaagagaaagacaacaattcttgctgatgtcagtaactgtatttcacctgttaaacttctgcatggaggaggtcagtgttgtctgctgtgtcagcatcagcctacctgggtgtggacgtattctttgggagatgaaacgtagaaaaggtaccccgagtccattacacattctggattcccagaaataagacatctctgagggcagaacctttacagtcacttacatcaagaaggaattcttcaggagaaagctcggtaaaggtatcttaactttgtatgtatacccagagaaaacacataaagataaaaataaaataattttcctcattatccccacaccattagcatcttggtgtatagtctttgcatcttttttcagtatgtatgcacttagatcatcttgtaggacgccagtcccatgcattatacactttgtatctcacagtggagtggaggacagcctgatccttaaggggatgccgaattgctgcatccccatgatttttgctgctttgattcttctcatgagccccgttgctgctgtctgtattagcgtccttctgagcaaacaatgggtacctttttttttttttttcttaagagagagtcttgctatgttgcctcaggcgggagtgcagtggctattcacaggtgctgtcgtactgccctggatgatagtacactgcagccatgaagtcctgggcttaagcagttttcgcctcagcctcctgagtagctgggacattaggcccgtgccgccatgcctggctcttgaccattcccacaagccacacctacaaggagctcaaggagctgtttgcgctgtaggcggttttttttttttttttttttttttggtttttgtttgtttttgtgcagaggtcagatctcttgtctcatagtgcaaaggcgatgaaggccttcattacagtctctcaatttgactctcagtttgatcggaagttgctaagatgggctgacattgtgaggaggatactgctacagcagtagtgtgtgtgtgtgtgtgtgtgtgtgtgtgtgtgtttgtacagactgtctcactctgccacccaggctggagtgcagtggtgcagtcataacttactgtaaccttgaactcgtgggctcaagtgatcctcctgcctcagcctcccgagtagctaggactgtaggcttgtgccaccatgcctggcccttttttttttttttttttttttttttttttgtacagacagggtcttgctgtgttgctaaggctggtctcaaactcctggcctcaagtggtcttcctgcttcagcctcccaaaacactggtattacaggagtgagccagagcacctggcctgaagctatatattattgttaactgcagtcatccgacagtgctatagaacactagactctgttcctgtctagctctctccccatttttcccatcctcctacccttcctaacctctagtatcctgtgtttacttttgacttctgtgagatcaactttttttagcttccacatgtattagtgagaacatgtggtgtttaactttctgtttttggcttatctcacttaatatagtgtcctccacttctatccatgttgctgtgaacgacaggatttcattcatttttatggctaaatagtagtccattttgtatagataccacattttcttcatctgttgttggacacctagattgattccctgtttggctattgtgaatagtgctacggtaaatatggggtatagatgtctctttgatgtcatgatttcctttcctttggataaattcccagtagtgggattgctggatcatatggtagttctatttgtagcttttgaggaaattccatactgctctccatagtggctgtactagtttacattcctaccaatagtgtgtaagagttgccttttctcaggccgggcgtggtggctcacgcctgtaatcccagcactttgggaggccgaggggggcggatcacgaggtcaggagatcgagaccatcttggctaacacggtgaaaccctgtctttactaaaaatacgaaaaattagccgggcacggtggcgggcgcctgtaatcccagctactcaggaggctgaggcaggagaatggcgtgaacccaggaggcggagcttgcagtgagccgagatagcgccactgcagtccggcctgggcgaaagagcgagactccgtctcaaaaaaaaaaaagttgccttttctctgcatcctggacagtatttgttattatttatttgtttatttatttagttttgaggtggagtctcgctctgtcgccaggttggagtgcaatggcacaatctcggctcaccacaatctccgcctcccaggttcaagcaattttcctgcctcagcctcccgagtagctgggattataggcatgtgccaccacgcctggctaattttgtatttttagtagagacggggtttctccatgttgatcaggctggtctcgaactcctgacctcagataatccgcccgcctcagcctcccaaagtgctgggattacaggtttgagccactgtgcctggcctgtatttttgataatagccattctaactggggtgagatgatacctcattgtggttttgttttgcatttccttgatgattagtgatactgagcattttttatgtatttggccatttgtatgtcttttgagaaatgtctgttcaggtaatccccctgccccggcttttttcttttcttttcttttcttttttttttgagacggagtctcactctgtcacccaggctggagtgcagtggtgtgatcttggctcactgcaacctccacctccaaggttcaagtgattctcctgcctcaacctcttgagtagctgggactacaggcgcacaccaccacgacctgctaatttttgtatttttaatagagatgggagtttgccatgttggccaggctggtcttgaactcctgacctcagttgatccacccgcctcggcctcccaaagtgccaggattacaggcgtgagccacccacctggccaatttgcccattttttaattggattttttttttttgctgttgagatgtgtgagttccttgtatatcaatcccctgttggatgaatagttcgcaaatactttctcccattctgtaggttggcttttcattctattgtttcctttgttttgctgaagctttttagcttgatataatcccattcatttatgtttgcttttgttgtccgtgcttttcagttactcatcaaatcttttcccagaccaatgtgatgaagcatttcccctatgttttgtagtagttttatcatttgggtcttatatttaggtctttgattcatttttagttcatttttgtataggatgagaggtggaggtctagtttctattttcactcttctgcatatggatatttaattttcacagcaccatttgttgaagagactgtcctttccccaatgaatgttcttggcgcctttgtcaaaaatcagttggctgtagatatgcaggttaattcctgggttttctattcttttccattggtctgtgtatctgtttttatagacacataccagttgttttatagaccagtaccgtgtcgttttgcttactacagctttgtagtatattttaaggtttggtagtgtgatacctccagctctgttcttcttgctcagcattgctttggctatttggggtcttttgcagtttcatacaaattttaggatattttttctatttctgtgaacaatgtcattggtattttgatggagattgctcttttaattatcttgatttctttttttcccccccaagacagggtctcacttcgttatctaggctggagtgcagtggcatgatacagctcagtgcagccttgacctcctggacttaggtgatcctcccacctcagcctcctgaatagctgggactgcaggcacatgccaccacatctggctaattttttgtacttttttttgtagagacggggttttgccatgttgcccaggctggtctcgagctcctgagctcaagcggtccacccacctcagcctcccaaagtgctgggattacaggcatacaccactgcacctggcctcttttcaatttcttgatggtgttctttgatgtacaaaagtttttaactttaaatgaagtccagtttatctactttttctttggcttattgtgcttttggtatccttttcttttcttttctttctttttctgagacagaatctcgcactgttggccaggctgtagtgcagtggcacaatcatggctcactgtagcctcgacctctagagctcaagggagcctactgccttagcctcctgagtagctagggctacaggcggtaccattatgcctggttaattttttaaattattttttgtagagacagagttttactatgttgcccgggctggtctcaaactgctgggctcaagcagttctcctgcttcagcctcctaaagtgttgggattacagatgtgagccactgttcctggcttggagtcatttctaagaaaccattgcctaatccaaggtcgtgaagatttacatctttcttctaagaattatatagttttagttcttttctgctgtgatcatgtgtgtatgtgttggttttttatttttatttttttgagactgggtcttgctgtattgccaggctggagtgcagtgcttatccatagccatgatcatagtgtactgcagccttgaacacttgggctcaagtgatctttctgccttagcttcccaggtagttaggactacagtgcataccactgtgcctggcttattgtgtgatctattttgagtcaatttttgtggtgtgagataggggtccagtttcattcttttacatgtgtatatttacattttgtagttcatttgttgaagggactacttgtattagtctgttctcatactgctataaagaaattccccagactgggtagtttttaaaggaaagaggtttaattgattcacagttctacatgtctggggaggcctcaggaaacttacaatcaaggcagacggggaagcaggcacgtcttacatggcagcaggcaagaaggagcgtgtgtgagtgcaggaaaaactaccatttataaaaccatcagatctggtgataattcactcactgtcatgagaacagcctggggacaccaccactataatccaatcacttccttcccttgacacatggggattacaattcgagatgagatttgggtggacacagagccaaaccgtattactattctttctccattgaatggtcttggtgcccttatcaaaaatgtattttccataaaaaaacaccaattgaccataaatataagggcttatttctggactctaaattctatttttttttttttaagaaacagggtctcactctgttgcccaggcaggagtgtagtgatgccatctcagttctcttcaacctccgcctcctgggctcaggtgatcctctcacctcagccccccaagtagctgggactacgagcacatgccaccaccctcgcctaatttttgtattttttgtagagatggggttttaccatgttggccaggctggtctcgaactcctgagctcaagcagtccaccctcctcagcctcccaaagtgctacgattacatgcattagctaccatacaccgattgtacaggccacaggctagccccacacaccagattttgaagattaagtgtggtttaaaaaaatgcaaaatatcctgttaataatttttgataatattacatgttgaaatgataaagtttaatgttgtgttaaataatacacagtaaattttactgacttctttttactctttaattgtagctgctaggagatttaaaattatttttgtgattctcgtatttctgttggaccagaggtattttttaatagcatgacattctgttacatggttgattatatgatgatcatatgattgtggcagtttcttgattcgattctctgttgttggacacttaggttgtttccagtcttctctgttttccacggtgctgtgatgactgacactgtggatgggtagtcatgcactcctgtgcccgctgccaggaaagagctcataaggaggacctgggaagcatttgctgcacttctgaatctagcgcatgcagactcgaccctgtgggtcgagctttggtgagaagtggttggatttggaacgtatcttgaagacgaagctgactgtctttgctgatggattggatgtatggcatgtgaggaagggggtcctttatgatctaaggaattggatggtgccatttcctgagccaggcattgccagaggcagatcagagaggaacgggtaccaagggctcagtgttggacctgttaggtttgagatgcctttttgatgctcaagtggagatgttgagttggttattggatatacaggtctgggggaattacagggaaaggggtgctggagatatatttgagaattatgaaaagctgtttgagcatcaagcaggatgggtgagacttgaccactggattttgcaacttgaaggtctttggggacttggacaagactggtgtcaggaggcatgacaagtggaagttttcaggggagaatgggatgtgtgtgttaacagcttcttgaaagagttttctctaaagtagaatgatgggggagtgggggtgctggggacacattagcacttaccgtgctctggaaggcagggtgttcaggagggaggttgacagaggagggcctgggatccagtgccagagtagagggtggaccttgcccatgggatctggagggagggcagagtagacaggcaggccttcctttcagcagtgggaggaggagaaaataccagcttgcccctttccaaaagctgagagtaagggtgacaagggggaaagaggtattataggtatgctatggagttaaaggtaaagtttgcatgaatttcgaatacaaaatgtaatacttcatatccattgagttgcttcaaagtgcttatcctcagggttctctctcctgtgcctttgggggtactttggtgaaaaagtttgagaagccacttcattattgtagtctattgttacgttgttaagtctcacccaagtgagtatttaaccttaaagagtttgagattcacttgcctattttgttatccataatagagcttttgcagctgctccaaatatccctccatttgtgcatcttaatagttgtttggcaatcaccttattctgcactgggaaggctggagaggggtggggagctgcggggtgtctggaggcagtatggcgagctcgagattcccaccctttcagagatgaggtggtggaggcaggcagggcctactaggcttctgaagcaacactcgccagggacattttagtgaccttttccccgtgttctcaaaacactttacaaatacaccatttgtctttaattctggcagggtggtttgggtgagctgggggtagtgctgttagccaaccttttacaatatttaacaatcagtagagattaaaagctgtttggcctctttcccattgatcacatagcctttttctttttgtacaattttagtatgattaaccctcccacccccattaaagttcttcagccttcttagtagaaagctctgtgaagtttgattcacccacggaagttacttcatggagtggaagcatttgagaaatcagatcttggctttcttcttgtggacagatcaggtggctgaggcctggagggagcttgatttgagatgagtagtttgtatgcctgactaagtcaagtagccacttacttcccttcacacttaatcaaatcctaactctctaactgaaactttgtaccatttgaccagtacctctcctttccccattcccccgctcccagcctccgtaaccactgttctactctacgcttcttcaccttctactttcttagattccacatataaataagaccatgtggtatccgtcacatatttcacttagcataatgccctccaggctcttctgtggccatggatgataatcatgtattgtatatttcaaaattgctaaagagtagatcttaaatgttttcatcacaagaaaaggaacttggtgaggtgatggatagattaactagtttgatttaatcatttcacaatgtatacatagatcaaaacatcccattgtatcttataaataaatacaattttttttgtcaattaaattttttaaaaattacaagaggctgaggtgaggttacagtgagctgtgatcatgccactgcactccagcctgggtgacggagcaagactctgtctctaaaaaaaaaaaaagtgaagttaaaaattaattaatttaaaaaaatcccaactcttccatcaccccagccctgcatccttctcccttcccccaagaccccctcccctgccactatgctctgattcctagagcggtgtgtccctgtcctgccactcttgctgtgcctgtggctgtccctgttccttgggtagcttccctgttactcctcaggggcttccctggccaccctctgctcgggcccttcctgagtgttacatcagcacctttcttgcccgcacccaccaccagccacagcttgtgtttgccgtgtgagccggagcacttgtttgtcacctcacggtcttcccctccatgagggcaggcacggcagtcttgctttcattcttgctttcatgcagtctacccagctgtgggcgagatgtgtgcacatcgctcagcatgtttgtagaatgaacacatgtataaactagacttgaatggagattattgttctctcctggccattaaaggtgcttcttcctgctgctcatttacatctcaggtgttaccatctctggccagtgcctgccctgttgttgtcatctaacagtcatgggaccacacctttgtgactctcagggccagaggtgtttgggaatgtggaatttttgagatttttagaacagaaatagtgaaagtaccgtatagtataggacatcctaggcagcaccatataatcaagcacattaagatttttgcagcaaaaagtatatgaatattcacactaagtgggacagtgagactatgaatagcttcacatcagatcagggcataccgccaagtgagttatgaacatgctttcagttttcagagagctttttggattttcaaattgcagagaagggattatggacctgtcttagtgagcatctgcttgtcacgcattatgcagcgtgctgaaatacaaaggaagaaaacatcacgcctgccctcccgtgtagggggtgggtggtcaccacatgcgggtggtgagcccatgctgggagggcactcccggcaggtcctgttgttctccctgtcatctccccctttcctttgcgagcgtcctctacaggtgcggtttcaggtgagccacatggggggctggcagaaggggcactgcattgtgacgcagggtcaaatgtgtccctctcagagtgtaggaggtaaccgttctggatcgcctggatcctgcccttgggtctggctgcccgggtccaaggaggaaagggccgactccaggtgatgctgcagaccaggagcgctgccctcacttcctaaccttctgcacttgggtgccggggccccctctctgcagtcacacactctgccctcttagctgggcctagagctttaaacattaactggattcaacatacgtttttctgactttttaaatataatgagtatagttttattttaatgtttttcagatgcattttgatgtaggtaggtacctttacattttaaaaatttatttgctttctgaaatgggaccagcatatatatatatatatatatatatatatatatatatatatatttttttttttttttttttttttttttttttgacaggttcttgctctgtcacccaggccagagcacagtggtgcaatcacagcgcactgcagtgcagcctcaatctcctgggctcaagcgatcccccacctcagcctcttgagtagctggggttataggcacccaccaccacacttggctaagttttaaaaaatttttttatagagacagggtctcactatgttgactaggctggtcttgaactcctgggttcaagcagatcctcctggctcagcctcccaaagtgctgagattacaggcatgaaccaccacaccctcctggtacctgcattttgaaaatgtttcattgccaagcctgcagggaagtctgccctttttttattagaaaatgaagagctaattctgaaatatgcctactaaatatgcatatctcaagcactttaaaaggatgtagggtgaaatagtctgttcctgaagcaaatatcactgtgtgttcattccattatttccgtagcttttctgtggcttttgataagttgtgtagaatgtattaagtctcatctgaaaatgtatattaaagattgttcttttaatttaaaatgatttgtccaaggtacttgacttaatgattcaagatttaatgagccgtgacacttttagtaacaccgtctcaatctttcagattttataaaagatattaaagttttcagaaagttgagaatggtcttttgtaatgtattttaagatagttaagaatagagtttatataattaagattaggatttgtattgcaaaaactcccttcaagacgcattttgggcctttatgagcgagtaatcatgacaggacagagtggcttcacccacagttttgtggttaatatttgcaagtcgtttatttaacaaggttgaaaagaggcttcctggtgtcttttataattatccttttctggggaccaacttataaagtaaaaaatacctggtggcattatctttgcttcagatgtattatgtttatggaattggaaatgtttgatttcttagtgtgtgtgtatcagtggattatgtagtttaaaatgtttgcatctgtattgcatgcataaacatgtccgtttccaagtgtggcctttaaatactcagggttttgtggccgggcacggtggctcacgcctgtaatcccagcactttgggagcccgaggcaggcagatcatgaggtcgggagttcgagaccagcctggccaatatggtgaaacccagtctctactaaaaatataaaaattagccgggtgtggtggcgtgtgcctgtaatcctagctattcgagaggctgagacaaaagaattgcttgaaccctggaggcggaggttgcagtgagccaagattgtgccactgcactccagcctggatgacagagtgagactccatctcaaataaaataaaatacaataaaataaaagactgagggttttttaaaaggtcataatagaaaaattttatgtgttttaattgtttaaatgttttcttcgggattaaaaaaacctgaatgtattctgggaaaatgttaaatggatgcaacactataagattttccacagaaatatgttattcaccgtgaagcacaatgggaaggctccattagcactttagatggtatcataactttggaaaaaccatttcaccatgcgagtatttacaaaaactgaagctgtccctgtcaggttttgacagagcttagctatataggtagtaagtgacgcagtgccaaaaccagtcttaaattacctatgttgtcaatatgcagattttctctatttagtatttaagctatgaatttaccaatctgagtaacttgaaatgcagtatcataaaaagaatcagatctaccaaactgaaaatgtgtgcgtatctaaagtagtttcttttcttgattttggttaagttaacaggagtatcttcacatctgtaatttctggtaacttaatgagaacacactgaacttttgggtcacaataaattttcccattatgtaaaatattttacacaccggttgactcattgtgaattgtgagtcgacatgattctcttcctgcggaaaacagaaacacatgctggccgggcgctgtggcttatgcctgtaatcccagcactttgggaggtgaaggcgggtggatcacctgaggtcaggagttcgagacccagcctgaccaacatggagaaaccctgtctctactaaaaatacaaaattagccgggcatggtggcacatgcctgtaattccagctactggggaggctgaggcaggagagttgcttgaacccgggaggcagaggttgcggtgagccgagatcacgccattgcactccagcctaggcaacaagagtgaaactccatctcaaaaaaaaaaaaaagaaacacatgttattgtaatgatgatttgagccaattacaggattgtgcttatgttaccacattgactaggtgctttctgtgagttgggttgttgaagagtttgaggtagacagatggcagtgggtgggaatgagcggggagcttttgttaggtttagggaatgtggtctttccaccatcatttagttgtttattttatgcataggcttattttcgttcttgtgagcattatgttgagttaatgtgttttctttgacctcaaaccttctgaaatgtttctgggtcttaaagattcaggtattatttatttcatagtagacagaatcaagtaaatgaatactttcttgggggagagtgttgataagttccatagcgacacctctccctcatgattaaaagtgctacatttgcacaaatatgtgacttatattttatattaaaattaagatcaacttttttcttgagaagttgttgaacttttagatttgggagagggggagttctcacaggaattatgaattgttttgactagtgagaagcttatttaacatttttggaaggagtaccccaaaagtaatgcatcttttggcatagtggaaacttgcagtaacgttttcttgttgttttttaattgattgggtgacctgcatctcattaagtggtgtctattggatgtttggcctttggcttgattgtgtccgcttttaaaaaataactttattgaaatcgtcacattccatacaattacctatttaaagtgtccatgtctgtggtttttagtatattcacagagttgtgcagccattgcctactttggacattctatggaaatgcggttgacaggatgtgttttctgtgtgcagtctctgtcactaagcaccatattttcattcatattgtgcatgtatgcatcggttgttccttgttaatgtcgaatattattccattgtgtggatgttccacattttatgtatttgttagtccattgatagacgtttgggttgtttctactttttggctgttgtgtgatagcgctgctgtgaacattcatgtacaggtttttgtgtggacatgtcatttctcttgggaatatacctaggttgtttgtatctgcttttgctgcttcttttacctacagttcagattcccatttatgtttgtacagacagtttgctacttgtgactggggcttgtttgacctttgttgctgacctagcgacttcttgtgtcatgtttaaagcccctgagaccctctgttgcctagagaaacaggcagaattgcagtctctttccttcctaagaccagatcacatctggtggtcatgaaatggtcttatcctgtatagatttttggtaaataagtatgtatctaagccaaataaattttgtgtgtattttatattatttttcttctctctgcttcctcttggggacatcctttgttctgtggccccagtggcacctagagtgaatatgaatgatttgtctatgttttcccttcaggcggaatgccgattacttggattttttcttgttaattttggtgactgagttgcctgtttttgaagtgaaaaatacctgcagatagtagggttgccctttagcattttaagtgtctaaatgagacctattgggatgtttccatagtttgcatcaaattcatgtaaatgcgcgttaatgatgttagctagtctgcctgagctaaattactaatttcattactactatttaataaaggggcaggatttgccatggtcattctagttaatggtaagagccctgtaggtctctcatcatatatctaagctgaattaaggttgaaaatattactgagtgccttgtggctctatttggtaacagtcatgccttacattttgagacagctaatccttttacacaccaggtgactcatgtgaattgtgagtagacacgattctcttcctgcagaaagagaatgcattcagtcagttgaaaatcaacatcatgtggtttgtaggataggtcttactcctttcttagacaaggaatctgggatccagaaggagtgagcggttggttaggaggagtcagtgccagagggaggcagcatgccctttctgctctgcccacgctgtgaggacaccgggccgtgccttcgccaggaggaggtcatgccaagtccaaagcgtcaggccgctcagagccaagcagctttgctggagcacccactggtgcacttggaaagtgatttctcctgttaaagcctcgctgccacctcaactgtaaactggagacagtaggaagccaccttcacaggcctgcggggacctggcacccgtgcaccaaaccttgctgcccttaatcagatggtcgaattgagaggcagttggaagggtcctgtggtgtgctccttctgggaccttctgccaccccttggaggcaggttgcgcccctgcccgtctcttcccaccagtggacactcccttcagccctgggccagctgtggggccctcctctgtaggcgctggctgttccaggaggcacaagagtgttggtgtgggaccttcccactgctcgagatcccccacggagagcccactcaggctacgcttgggcttctggccgtgtgggtcagcgtcacaggacggacagatcaatgggggaagagtcatcctgcagcgctgccaccactggaggctggtgagagtggcgctgccacagagaacaagccttgatccctgacttgaaagtcagagttcttctggaacttctgtggggagtgcccagagtggcacctaaatacgtctagaagcgcttgatgaaagttcctctgaggcttttaaactgcttgagtgagtctctctgaagcacggtgatggcaaaaggaaaccacctcacgctacctctttgtgccttctcttctctcctcatctcctgtaggccgtaggtgttccctgtcaggaatttacgcggaggcatgtctgctgtggccaaatgtgttcattcattcatatctcacagtaagagggaaggatgggggaggaagactgctgtatttccttaaaagtttttctgtaactcgaatccctcccacccccgtgaggtaacaacgtcttttccagttggtgtcagtgaactctgttttgggtatctacaaaagcagaaggggaggttaggatgtggctggaggaggctggttcctgggtgtaaatcctggctcttctgcttgaactgactgtgcctcagcatcctcgtctgtctggtggagccgcctcacagaggaacaagtgagttgtgcgtgtggagcaggtggctgacatgtggtgagtcctccaggaatgtggcagcagaaggaacacgttgagcaccgcagataccaccctgaccgccactgcagggcttctgtgcgggggcagctgcagagccgccgcttcaggacagcatgggagctgctggaggtcgggggagctcagggaaagggccttgctgccaggggtgggaagggagtcagtgaagacgtcctggaggagaagattccagagcctgagatgtgaagtaggttaggtagccagagacaaggcaaagaagggccattttcatcagagaacagcataacattggcagaggtctgacatgtcatttcctgttactagaattggggagtgaccagtagattctttaatttgtttattcattcgtgcagtccttcacctcacacctgttcagggtccggctgggctctggacatagggtggaagaaaaccatctgagcagaggccgcgtggactgtcacctctgtcaggggtgccagggctgccaaaggacagctgttacttatgggtggcggcgtggtgaggtcgcacaacacagagctgccctgctgtgtccatgccctggtgcctccccgtggtcaccatgtgccttgggcaaatggaggcctcaggtcccagacataggctctgtcagtggtggtggcggtggctgtacctgctccgggctgctgtgagggagggacgggctccggccacaggcgtgcaaggtccccttgcagaggacctcccgcacctgctgaggaatgtgtacagccatctggagggtgttctccccctggccctccctgtagtccagctgagtccacgtccttcagccccttttcaatgttcctttctcacagaaccttgtcctggaggtgcactcgggcccgggttcttcctcctgtgcggtgccaagccctcctccaccacgcatgatggtgtgttttccatgactcttcctcctagagcaccggtgcccgccctgacggcggttccccacagtcagattgagtatcccttatctgaaatgcttgggactagaagtgtttcagattctgatcttttcggattttggcatatttgaatatgcataattggatatcttggggatgagacttaagtgtaaacacaaaattcttttcatatacaccttatacacatagcctgaaggtaattttatgcaatattcttaaatattttgtgcatgaaacagagttttgactgtgacccgtcacgtgaggtcagttggggaattttcctcttgtggtggtatgttggtactcagaaagtttcggattttggagcagtttggatttttggattagggatgctccatttgaatattctttttatatacagcacatggtcagtgctcactaaacttagtattgcatgaatgaatgaaaaccaaaggtcatttactaagcgtgctactatttcagaagcctctttttcctgatttggttctatggtcagtggtttaatatttcaagtgctctgaccacgtaatggttgttaccacactgtgaaggtggctgggtgttcagtgattgctgcccacagaggacctggaagtgcttgctgtacttggttttctggaatggaaatcatggctcattcccaggagcccctcagcaggggctttgagtctggtgctaagcagcagatgtgcagattcccgcagggcgtacctgagcccggagagggggcgtcgtagcgcacagcgcactcgtttccgcattcccaccccgcacggccagttgtcacagccatcctccagtaaaaaacacaaaccagtcaacctctaggagacaggtaggaaatctagaagaagcctcaggtgttcacagcattttttaaagattctttaaaaatcttcgtgattggaaagactgcttcctgtgccagagagtctctctccagcgcttttgcttctgaggttggtagctttcagaaagactgcaatgcagcggttaccaaagtccttgttaatatggaaacaactcgtggtgaagccttttgctccccttcacaactgctgactgttgcctgcagtcggaaggaggagataatgaaggtaatactcctccggacctggcagtttagtgattagaacgtacgcgattctgtgaatgctgtggctggcacagcatgtcctgcagcagctctgtcaacttactgatgcagtgggcttcctgggaacgtgaagctgaagatgtctttgcagtttgtgcacgataattttgttttcatctctgtgttcagatggtggattataagaaggtaagggactttacagatcatgcatatatgtattttaaatgtttatgaatatccctaatcaaggtaaagaattatgattgaatagacctcttttgaacctaagaaataaaactttatttcttgttaatgacccttttgacgtttgaagacttatcttatttagtcttgacaaatgccctatataagtgaattattgaagatgttctttgaagagatctgctttttctttgatttgctaaacgtagttggtttcagaggtgtagatacgcatagaatatattcatttctttaacttaagcaatgacagttacattaatctggatggaacttttcgtcttaaaaaatctcagccactggctgtagatgatgaattctaatctccttagttcttattttgcctttagaagagcattttcagatgtgtggagctctgtgtttatccgtggggtgagctgggtgctacctccagctgctgctcttcgtttatcttagagggaggccaagagtcagagcggagatttattttgcaatgaattagtggccccaaacggtattaaatgcattatgggtggtaatttatatgtccaatgccaagaaatataatgttggggttaccatggcaactgcttgcattctgaaaagcttgtgaatgggttctgaaccttctggcattggaagtgagcttttccagctgagggcctgcattcgtgattagtgtaaataaattcagctttccatatgaagcacatcctttctctttgtttaccagagtagtccattgagctcagttctttctctggtgatgtctgccttggtctcttggttcctggcaacagaatatggttgagacatagttttcaacttcaggctgaggaactagcctgtgtgtgtgtgatgacctgccacctcagtccatgcactgtgtagaaggggctggctcatctgtacctcctgagggctggcaatgcatgatgtctccaaaagcacagttgcagccgcatgtgctggtgggctcctggcacagctttctatccatctgaagggcttgtttccggtaacacttgctagggctcttcctgggaggcagccctgcctgtttccagggtatcatggggattggttttggggagggaggcccaagttagaaagacccatgtttaaaatgtcaagcttgtgaaaatgataaacgagggcctattgtcttcattgccgaagatctgtttgctgtttgttagaaatatatgtagcataggccggggatggtggctcacacctgtaatcccagcactttgggagacgaaggcaggaggatcgcttgagcccaggaatctaagaccagcctgggcaaaatagcaagacctcatgtctacagaaagataaaataaaataaataaataaataaaactagtttcccttgtgcatttaaaacaatgttgacatcttgatggccagagactgaaatgtctgtgtgtgatttcaggggcctgaggtcggaaggttggagcctggtggttgctgccgaggcggcagctcctagagggcctggccagacactgggagaatgttttcatgctctgtagaattcattctctttgttaataagcattgagattatagaatttaaatgttgagcttgaggatagactggccttgaggcacacagcgggcatgctgctgtggctcacctgtaggcctcagttaagaatctttgtctaatccaatccctttattttacagatgaggaaaatgaggcccaaagaagtgatgccacttggttaaggtcccagagcaggtcagaatcagacctaggatcagaaacctggctcctggctcctggctccctactcttctaaggatcgctgtcctgacagaagaggtttgctctcagttaattgatgttgttgttgttttgctttccttttgtcagaaagaggcctgtaataacaacaggcatctaatttagactctgtaatttagaattttaaaaattcttgtcttcccttcttctggttatttatagaatttctactcagtgtgctggagtcacccataggaggggcaaagggcatgacctctgcccttaacgctgtgtgctgtgatgagagatgggtgcatagccgagcctgcaaactggaatgttgggataaattctggcttgacatctccatttctgccaggctgtggtattctgtgttcttacagagaagctgcagtgcccagcagttacccaggggtgaatctgaatcaccacctgttaaatcaaggtcatgatactgtatttactaaggcaggacaacatagtaatttaggctcaacttacaagttgcaacttattacaagtaataagaggttcggcttacaaggtttgaaatacaaattgatttttttagccagattccattgaaccctggtttttaattttccaatcttgaaagaagactgagattttactgtataactcacttagggtgacattgtgttttcctaagtattctcagtgatttctcccattctccctattcttctcacatgggactttgacagagagctgcacctgggctgggtgtgtggcctccctcacccagcagtatggcccaatggtgctatgtgactgctgagttaggtccttaaaagggtgcagtttttgcctggatgttctttttggggtacttgtttgccatccctatggtgaggaaacccatgtcgcccacacaggaggaccacacagtgagcagggcattgacataacaaggtgacttctgttttctgagtaacttccaccacagtggtgaaactgtgtccccaagctcagcaggcggaggtaaaacatttttcaaagaaaagggtaagataggctcttggtttaccacatggtgaagagaggcctctggctcttccaaactgttgcagatagagcgtggagtgctgggacttcggtcaggccaggtcctgccgcctcactgtccagctctcctgagtgctcctggtctgccttgctctctgcccagtgctgcctgctgcccgctgcccttatgtggagtgaccttctgtctcccagccccagccatgggtcccgttgcccagaatacaagagcctttcttggcttagaactttaattcaaaaccctcagttcttagagggtttgttttccctttttttttggcctgggattttgagaatatctaatagtgctgggcagttttatcattcatcatcatgggtagtttggtttattacaacttgcagcttcatatcttgtaaaacaaattcatttcttgctttcagatttgcttatctaaaagttttgttcataatagtaacttagcacaaggcttctaatatatgagttgatgaaaagcacctcctgtatcacctttaataaggataattttgaagtgtaatttaatgcctggaagccagttggtactgaggtttaattttgtacttgggaaagaagtgtgagaagaaaagtatccttttttccttaaatttatttttcttagttgacatataaaattgtatatatatttatcatgtacaacatgatattttgaagtatatatattatggaatggttaagtctagcaaattagcaagtgtaaagataaactcacagttatctttttttgtggtgagaacactttacattttttctttcttttaaacataaaatctttcagaaaagacgtctactttctcagcatttttcaagaagaaaagtatctttttaacaaatacattttctaagccctggtctgcaacccactccattcagttaatatttatcaagcactggccgggcgtggtggctcacacctgtaatcccagcactttgggaggccgaggcaggtggatcacctgaggtcaggagttcgagaccagcctggtcaacatggtaaaaccccgtctctactaaaaatacaaatatgagccgggcatggtggcaggcacctgtaatcccagctacttgggaggctgaggcagaattgcttgaacccgggaggtggaggttgcagtgagccaagattatgtcattgcattccagcctgggcaataagagtgaaactctgtcctcccaccaaaaaatatatatatttatcaagcactacctacacacacacccactctctcttatacacacacaaacacactaatagacatagcagtaatatatattaagcatgaatacagcaagaagtttggtaccctagaattagaacgggtttttttttcgtatataatctacaaaatgagatgttgaattgatgtttaatactaagctacttcttaagcatttgatttttcttactgcatttacctatgtttataattttaaaatctgagaattatagaaaatacgtaatttctacttatctttcagattatagcttaaatgtcctctcctggggtgggggaggtccccatatccacataaatgggtgtgacctccatgtgcactgtgcacttccctttggtacttttcgtctcacacacatgcacaccctgcacagacacacacactcttattgctggtgttctgtcttcttgcctgtggactgtcagctctgtgaaggggaggcttctgtctttcttgtccctctcccttctgtggcactcagtacatgttgggtgaatgaatgaatactggacacagacgctttccttgaaggtggttggatgatctaccctttccttataggactttttcagatgttttcaaattcaaccaagaaatcttttttttctattactaagttactgtttttccaaattattgaatatttctattttctcctgcctttaaggagtaggaaacaactaagaacagatgatgtctcatgttgcgaatggatccttccttcctttgcttttccctcaagttctttctcatgcaagcgaacacccatattgtgaggggtagcaaatttaaatgagtcctttgcattcgagtatagagatgactgaggagaatgaggtagtttggaaacactagaaaaatctgcctcagtgcttttgatattttaatttataggcaattcttttaagtttcatttttctcaagacaaatgccagactgtggaaagggtgctgtcatttaaaaatattcgggcatgtggccgggtgcggtggctcacgcttgtaatcccagctctttgggaggtcgaggcgggtggatcacgaggtcaggaattcgagaccagcctggccaacactgtgaaaccccatctctactaaaaatacaaaaattagctgggtgtggtggcacctgtaatcccagctactcaggaggctgaggcaggagaatggcttgaacccgggaggcggaggttgcagtgagccaagattgcgccactgcactccagcctgggcaacaaagctagactttgtctcggggggaaaaaaaagaatatttgggcgtgcatactgcccaaagcgatttacagactctctgctattcctagcagattaccgaggaccttcttcacagaactagaaaaacactgctttaaaattcatatggaaccaaaaaagagcccaaatagacaaggcagtcctaagcaaaagaacaaagctggaggcattctgttacgcaacttcagactatactacatggctacagcaacctaacagcatggtacgggtacaaaagcagacacgaatggaacaaaagagagagcccagaaataaggctgcacacctacaaccatctcatcttcgacaaagctgacaaaagcagtggggaaaggactccctattcaatcagcggtgctgggacgactggctagccacatgcagaagattgaaattggaccccttccggctgggcgcggtggctcacgcttgtaatcccagcactttgggaggccgaggtgggtggatcatgaggtcaggagatcgagaccacagtgaaaccccgtctctactaaaaatacaaaaaaattagccgggcgtggtggcgggcgcctgtagtcccagctactcggagaggctgaggcaggagaatggcgtgaacccgggaggcggagcttgcagtgagccgagactgcgccactgcactccagcctgggtgacagagcgagactccgtctcaaaaaaaaaaaaaaaaaaaagaaattggaccccttccctacaccatgcacaaaaatcaacaaaagatggattaaagactgaaatgtaaaacccaaaactataaaaaccctgcaagacaacctaggcaataccattctggacacaggaactgacaaaggtttcatgaagaaaacacaaaaagcaattgcaacaaaagcaaaaattgacaaatgggatctaattaaacttaagagcttctatacagcaaaagaaattatcgacagagtaaacatacatcttacagcatgggagaaaatatttgtaaattatgcatctgacaaaggtctaatatccagcatctataaggaacttaagaaacttaagaactacaagaaaaaaaacaaccccattaaaaagtgggcaaagggcatgcacagttagttttccaaagaagatgcacatgcagccaacaggcatatgaaaaacagcccaaatcactgaccattagagaaatgcaaatcaaaaccacagtgagatagcatctcacaccagtcagaataactattattaaaaagtcaaaaataagatgcttattttgagggtatggagaaaagggaatcctaatacactgttggtggagtgtaaactagttcaaccattgtggaaagcaatatggtgattcctcagctaaaaatagaactaccatttgacccagcaatcccattactggttatatatactcaaaggaatataaattgttctaccataaagatatgtacacatgtgtgttcactgcagcactattcacaatagcaaagacatggaatccactgaaatgcctgtcagtggcagattggataaagaaaatttggtacatttatatcatggggtacgatgtaactgtaagaaagaatgagatcctcctgtcttttgcaagaacgtggttgggagctggaggccattatcctcagcaaacgaatgcaggaacataaaaccaagtaccgaatgttctcacttataagtgggagctaagtgatgagaacacatggacacaaagaagggaacaaccgacagtagggcctacttgagggtggaaggtgggaagagggagaggatcagaaaaaataaccattgggttctaggcttcgtacctgggttacaaagtaatctgtacatcaaaccctggtgacaggagtttacctgtataacaaacctgcacatgtacttctgaacctaaaataaaagtaaaaaaaaataatttgggcacgatgactcatgcctggaatactagcatgttggcgggaggatcgcttgaggccaggagtttgaggttacactgagctgtgattgtgccactgcactccatcgtgggtgacagaacaagaccctgtctctaaaatatttatctacatgatatatacatttggtgggtgctttggtcccaactgtctgtgaccatctggggcagagccagtgccgtgtgcaaggtgtactgcctgcacacagcacaggaggctggggctggccagggcctgtgcacctgctcctctgtgcctggcttgtggatgcccctcactcgctgagtcttttctgaagtcatttagcagcactgccactgctctaacctacatttaaagatttattttcataattttctggcagaaaattttattaatgtagccattttatttgtataatgattgttgagaatagaatattttatgttcaagatattgattaatttttggagaaactaagaaatttgatgttgcataacaaatctctatttaaattcacggtgtaaactgcagtgaatcattagtgtattaggtaaaagccaacattgcagaatatagtttatttgaaaggccgcttagatgaaaattctagggtgatctggaaatgttttacacttttgtatatgtgatcattggatgctacttaggagagtttgtactagtgtgtctagcagttgtagcaaggtgaggtgggtggccacatttgattatgaagtaaatttattctagagagtttatatagcatgaagaatattacaatcaaagaagtgttacactacatatcttaaacttttaacatgactcttatctagctataaaaatatgtctgacattttgtgttttaggaatgaagtaagtatgcagtggtaatgaatgtttgatcatgatttcaggtgagtaagacgtcagggaaacctatcacagttccataagcaaaaatgaaaaaaactcactgaggtatattgctacaaaatggcttctttcccccaagaatagctgtaactgtgacagagtagcgcagcacagtccttccattctccccttgctctttcctcctcctcatccagatgcatttggatgatactgttcaaaagtaagataaataattgtactcaattttcatattagagtagctagaaattaagcaagtaatttgtgtgtgtgtgtgtgtgtgtgtgttttttttgggggggggtgaaggtcttgctctgttgcccaggctggactgcagtggtataatgacagctcgctatagcctcaacctcctggacttaagccatcctcccgcctcagcctcccgagtagctgggaccacaggtgcatgccaccacacctggctaatgttcacattttttatagacatggggtctcactatgttgcccaggctggtcttgaactcctggcctcaagtgatccttccaccttgaccttccaaagtcaaagtgctgggattacaggtgtgagccaccgtgcctggcctccaaacaataatttaaatgatgtgataaattttattttagcctagccgagatcttaaaatctattttgaagtcaggcactagccttatttggttcagctaaaggtgctccctggtgcatcaggttgtgaatgtcatatatgagtcctaagggagtaaacaaactctggctgtgtcagtgctgaaattcaaaacagtaaaaaaaaaaaagatacttggttttaaaatggggtggatgcatctattgggctttattgatattttggaaattttgagatatgtattttgcctcttgctaaggaattagataatcgtgcagggtttgaattgacagttgtcaaagtcagcaaaaatactatggtcaaattgctgggtctttgagacctaggttttagtcctgttagctctgactttgggcaagttgtttgatgtaattgttttagttcctcaacaatccagaccctggccagcagagttggagcattgaatgatctttctaagataatttgagcgtacaaatggcaaatctgatttaacagcataactgttgattcttacggcacaagtcagtgagcctgtctttgttgaggtagtcgcggtgtgataacagacatagtagttaagaacactgactcgaggtagaccgctgtgccgcttagtaacgtatcgtgttgtgaagctgctgaatcttcgtactctagtttcctcatctctataacaggcaaatttgtaattgtgacaaataataactacaagaagtaaattaataactaagaccaaatgcatactgtgtggccagcaccattgtaagtgctgaggatacaaacctgaacaagacacattgctgtcttcagaaagctcacagtcagatgggagagagagaaggaagcaaggcaagtacaggcttgtaagtgttgtgatgggtgtccttacaggaccaggatttcaggaggtaaggtcagtttccctgggaagggagagttagagaaaagatgctcgcagtttaattcaacaaacaagtggtacctgctgggtgtgcctgccgtcctgctaggcattgagactacaggataaatttagcatgatccctgctctaaaggagcttaaagtttagtggaaaaccatgagtctagtgataaatagtagttgtcaagatacttgaatggagtcttgcagatgaagtgtttgacaggcagtggaagaacaaaaacacagaaggagacagtcgttgcggctggagcagagtttgcaagtccactcctggtgagggaggggatgctgagccagcagggcagggtctactcacacccagaggctggctcggaagcagcagatgtaaagggaagtgtgtattggagggggtatgttgtgaatttgatgacgtctgattgttacattgaattccatgagttctagacaatttcttcatgataattacccccttaaatttcataatcttcattcccccactaaatttaataccataacatttttaatttaaaaaacaccttttttgtcggtacttttgaaaacattttcctgcacctgtgccttctatgaaatgaacgctgtagagaatctgtggaaatcggctcatggtagaagctttccctgtcatatggatgagtccttttgcttgcccagtgccctcctggcatattgatgaggtaggattgggagttcggaacgcctacaaaatgagcaggctaatttcgaacggatgctaatcctgcaaaaccaagagagatgcttattggttgatttgccttttttttttttttttttttttttttttgaaacagtctcactctgtcacccaggctgtagtgcagtggcgcgatcttcgctcactgcaacctctgcctcctgggctcaagcgattctcctgcctcagccttctgagtagctgggactacaggtgcacgctaccacttctggctgattttttgtatttttagtagagacggggtttcaccttgtgggcctgactggtctcaaactcctcacctcaagtgatccgcccatcttggcctcccaaagtgctgggattacaggcgtgagccactgtgcccagccattatttgcttttagttgaatttgtgtgtttggagactgagcacttactttcaacagtgaagaaattgacttggcagcagttgctgcaggtggctgttttcggtctacctcatactgtcagtgtgtcgcccagatactatataattactcagttattttgcagtcacaacatctttgtgtgtttgtatttatttagtaattagaagaaagtttttatgttctcatagtatcttcctgtctacacagtgcatttgtttactaatttatatccatttgatacacatctaatgattgcctctgatgggtatatgtgggaacatgtacattccctactgttagctgcaaatagtgagaagtagttagagcataatgtttcacatcgaagtaatctctttttcaaagacatctctgagaatgaaaacattaagtttggcagttccgacaaactcttatagtgataaggtattagtctaattctacttagtaagaaagttattcccggagacttccatttccactatgatggaattagaggtgatttacgccccccaacccaggactagggtaaggcaagtgaggcacttgcctcagtgcagaatttaaagggacacccaaaatctcagtaatcgagattattaatattttaatgcagtgctttaaaaaaatcaaatttgatgcaaaaaaaatccatgatgaaaaacaaaattattttttactttttaagacagggtcttgctctattgcccaggctggagtgcagtggagcaatcatagctcactacagctatggtaatacagatgggtgggctcaagtgatcctccagcctcagcctcctaagtagctgagactacaggcacatgccaccacgtctggataattttttatttttttttgtagagtggtgtctcactgtgttgcccatactgatctcaaactctgagctcaagcagtcctcccgtcttagcctcccaaagtgctgagattattggagtgagccaccacgcctggcccaaaacccaaatttgaaagacaggatcagtattaatgatttttctttttgtctcaagctccagcatggcttggcaagacaccattatcgatattatatataaaactttggtattttgtacctcgtggattttttcattaattttgattttatctctattactgagtttttttgacactcaattaagatttgtgcctaaggcaagtacctcacttggcttgccctagtcccaaattgacttctatcttaaacaacttgaaaaccagacaaaatatatgaagtaatagttttcatacatttgacagaaggctggttaggaccatgttccttgaaataaggggaacaaacaaaacaagccctgcagtattccagcttataccccacagcatgagactgcacttttttctataaagggctgtatagtaaccattgtaggttttgggggccggatgctgttaatgtcacaactactctgctatgctctgtgcctgctttcatcctaagtatgtaagtgaatggacgtggacgcattacaataaaacctttctgacacaaacagccttagtttgtctcgagaggcagtttccatgtttcagggcaggaagagagaagtcaaacagaacccactggcttcactaaagtgatgatacaggagaaattggggaggacaagacagctagaatttgtggaggaaaacataggagaggagggagcaggttagagagagagctctagagatctgcagaagggcccccttgaggcgttggctgcatcctggtctgcacgtggccaagaggaagcacctcaaggctgggaggagaaccaccaaaaaggagaaggccaagcacttcttggacatcagttgcacagggctgggaatagtttgtgttcccaccacccagggtggtctcaggtagatcctttgaagggttgccttttcatctttgttagcgtgggttcagagcagctttttcatctatggtgtcaggacgattcctcagaagggctgccttagcagtggggctgagttatccatagaccaatgggctgctcccgacttgccctaactgattacagatagcttgattacattatcagaaccaaagccccgactatatttaaaaaggatgtaataaaactagcacccaaaaatgtaaaaagaaattgtgtctagcatctaataaataattaccaggtatgcagagaagcaaggaaatgtgatattaaccaggaagaaaatcaagagaaacagaacccagaaagacaagggatgatgcaattagcacacaaacattaaaataacttataaatatgttgcacactcaacataaaacgtagagaaaaacataagcatactgagtgaaatgaaagactcaaaaaagattgaaataaaacttccagagatgaaaatagaatatatacaatatataaaatgccgggcgcagtggctcacacctataatcccaattctttgggaggctgaggtgggcagatcatttgaggtctggagttgaagagtagcctggccaacatggcgaaacctcgtctctactgaaaatacaaaaattagccgggcgtggtgcaggcgcctgtaatcccagctactcgggagactgaggcaggaggatcacttgaacccgggaggtggaggttgcagtgagccgagatcacaccactgcactccagcctggcgacagagcaagactctgtctcaaaaataaataaatagataaaaataatatatattttatttatataataaaatatataataaaataaatttatatatagtaaaataatatatacacatgtatatgtatatataatgcagtagagggatcacaacaggttattacgacagaagaaaagagttcatgagcctgaagacgtagcagtagaagctttccaaagcacagcacagagaatccagactgcgcgagatcacagagcatcagcagcctgtgggacaaagtcagctgacttaagatatgtataacctagttccagaaggagaagaggagggaatggaaaaaatatttggagaaataatggctggaaattttccaaatttgatgaaaaatgcaaactatgaagctcaaaaactccaaacagagcaaatataaagaaatccaaggtacctcataatcagattgccagaaaaccagtgatcaagatcaaaagctttcaaagcagccagaagaaaagacacattacagaggaatacagttgctaataacagcgattcctggtcacatcttgtgtgaaccagaagacaacagagcaacatattcaaagtactgaaagaaaaaaacctgttagagttctgtatctggcaaaaatgtctttcaaaaatgaaggataaatttttatttatttcagaagtaaagaaatttttaggccaggcatggtagctcacacctgtaatcccagcactttgggaggccgaggtgggcgaatcacctgaggtcgggagtttgagactagcctggccaacatggtgaaacctcgtctctactaaaaaaaattagctgggtgtggtggcaggtgcctgtaatcccagctactcaggaggccgagacaggagaattgcttgaacccgggaggcagaggttgcagtgagccgagatcgtgccactgcactctagcctgggcgacagagggagactccatctcaaaaaaaaaaacccaaaaacaaaaataaatttttaggccaatagacatcagaatttattgccagcagaatggcactaaaggagtattaaaggaaattcagatagaaagaaaataatatttgatgggaaaaatttttatttatatatattttggagacaggatctcactctagtgtccaggctggagtgcagtgggtgtgatctcggctcactgcaatctctgtctcccgggctcaagcagtcctcctgcctcagcctccctagtagctgggactataagcgtgtgccaccatacccagctaatttttgtattttttgtagaaacggagtctcactgtgttctccaggctggtctcgaactcctgatttcaagcaatccacccatctcagcctcccaaagtgctgggattacaggcgtgagacactgcactcaggcttaaatagtcagtttccatctggggccaggcatggtgtctcacacctgtaatcgcagcactttgggcaggaggagagggcagattgcttgagcttgggagtttgaggctacagtgagctatgatcacaccactgtactccagcctgggtgacagagtgagaccctgtgtttctaaaaggaaaaaaaaaagtggtaaaattgacaaagctccagtgaaactgataaggaagaaaaaacagatataaataatgaaatgaaatgaaaaaggtgaaaacactatggattcagtagactgttaagatatcataaaaggatattagaattagcatcacgctatatacatttgaaaatttagataaaatagacaaatttctttcaaaatgtaacttaactaaaagtaactgaagaaatagaaaaccttaaccagtcctatgactattaaaaatgtttagatttaaacaaatgtatgattgagggaatgctgggaatgtgtgtaaacacatacatatgttgtcatgtgttaccttaattgacctatacagttcttgagtacaagattaaaacctgtttctgagtatgtgattgtatcaatgagggctctttctgatgtaaattttgagaaattcaaccttagttgttttaagtaagtaaaaagaaggtttattgatcatctgattgaaaaacctaaggcagggctagctatagatggttcacttgggccagtttcttccccagcatcctccttcatgtgttcaggttctttgggaaagagggagaatctctataagtcccatagtgggaagaggagacccattaatcctgacctgggttgtgtgttcagagatgagccaactctgggcaggaaaataagatgctctgaatgaccaggtgcaaatcacaggctttacctgggcccaggtgttggagtcagcgcccctggaagctgtggactgagctgggaatttatacctgacaaggatcagggtgcaggaaccatggggaaggtgaacaaatatttggctacaaaattaaatctccattgcagtaattgccagatgtaaaatttcatgaattctttattcaaaattatgatgaaattctataataaagaattcttagttggccaggtgtggtggctcatgcctgtaatcccagcactttgggaggctgaggcgggagggttgcttgaggccaggagtttgagaccagcctgggcaacatagtgagactcccacctctaaaaaaaaaaaaaaatgttgtttttgttttgttttttttgagacggagtctcgcactgttgcccagactggagtgcagtggtgcaattttggctcactgcaagccctgcctcctgggttcacaccattctcctgcctcagcctcctgagtagctgggactacaggtggctgccagcacgccggctaattttttgtatttttagtagagacagggtttcactgtgttaactaggatggacttaatctcctgacctcgtgatccacccacctcggcctcccaaagtgctggaattacaggcgtgagccaccatgcccggccctaaaaattttttgtttttttttttgagatggagtctcactttgttgcccaggctggagtacagtggtgcaatcttggctcactgcaagctctgcctcccgggttcaagtggttctcctgcctcagcctcccggttagttgggattacaggcgcacgccactagctctggctaatttttttatttttagtagagatggggtttcaccatgttggtcaggctggtctcgaactcctgacctcaggtgatctgcccacctcagtcttccaaagtgctgagattacaggcatgagcaccgtgcccagcctaaaaataaaaaaaaaattttttttttttttcaagacggagtctccctctgtcacccaggctggagtgcagtggcgccatctcggctcactgcaagctctgcctcgcaggttcatgccattctcctgcctcagcctcccgagtagctgggactacaggcacctgccaccatgcgtggctaatttttttgtatttttagtagagacagggtttcaccgtgttagccaggatggtcttgatctcctgacctcgtgatctgcccgcctcggcctcccaaagtgctgggattacaggtgtgagccactgcgcccagccaaaaaaagttttgaatttgctgggtgtggtggcacatgcttgtaatcccagctactggggaggctgaggtgggaggatctcttgagcccaggagtttcaaggctgtagtaagtcatgatcatgccactgcactctagcctgggtgacagaggtcgaccgtgtctcaaaaaaaaaaaaaaaaaaaaaaaaaaaaatactattataccgctgttcagttagcaggaattaaaaagtttggcaattgttgttgaaaaagttaagcaacagaaactctctcatacccttctgatgggagtgcacattacagctgctttgggaaatagtttggctttagagtataagctagcaatcatacttctaggtatgtacaccagagaaacacatgcctaaagtgattgagatagctgtaccagaaaaatcttaagtcgtgtttatatttgctccaaagcagagaccaccctcggggatgagaatggataactaaattatggtatatttactgagtagaatattacacagcaatgaaaataaactacagacacagcaacaacaaaaaaggcaaagaaaaaagcaagacaagaatatatgtagtatgattttgttattttcatctgcttctggtttttatataagttatgtttggtagggctgcacacctaggtgataaatctctaaagaaaagtttggaaatgataaaccataaaagttaaagcacagtagctcatgcctgtaatcccagcactttgggaggctgagatgggaggatcacttgagcccaggagttccagaccagtctaggcaacacagggagatccagcttcttaaaaaaaaaaaaaaaaaaaaaaaaaaaattttccggacacggtggcatcctcctgtggtcccagctacttgggaggctaagatgggagaattgcctgagtttgggaggtcgaggctgccgtgagttgtggttgcaccactgcactccagcctgggtgacagagcaagatgctgcgtcaacaaatcaaacaaaatcattttgttaaagctagtacttacttacgtatgtggtggaagggttttggggtcagatagaggcacccagcctttctggagttctggcaatgctccatcccttggtggtagttggactggtatttatgtaataacttcatgaaacggtatacatatgttttctatgcttttctataagtaagtaatacctcatagtaaaagcagttttaaaataatcagattttatagtgcatgttccattaaaaaaatgtggaaaatccccaaagcacatgcatatacagtagttaatcatgttttatcttaaatttattcatattatagaaatttaccttttgaaatttcatttttatttatttgagatggagtctcgctctgtcgcccagactggagtgcagtggtgtgcatgatctcagctcactgcagcctccgcctcctgggttcaaactattctcctgccttagcctcccaagtagctgggattacaggtgtgtgccaccacgcccagctaattcttgtatttttggtagagatggcgttttaccatattggcccggctggtctcgaactcctgacctcaggcaatccaccctcctcgacctcccaaagtgctgggattacaacatgagccactgcgcctggccttgaaatttcatttttaaaagctctaaaaattttccaggtgagaattgaccaactattattattttctgggtaagggactccactacagtaattaaagaaggataaggttggcgttgctttgctcctttttttattgaagtccttccttcctgatcaagcttccatatatctccttaaaacatatgacacacaggtatgccactaaaaaacttaatttgtgtagatttctttcttcagctgttactttttcatcttgcataaaaatcaagtaattaaattttaaaacatcctgaacatattcatttttggctttagcaatttcattcttcagcagatgtatttgactttctatatacatggcactttggtttggtttgtgtctgaccttatttttatttttcattttttttcaaaccagtattaaactgaaaataatagacgtcatacctcatggcccaggaatgagtgaataagttggaaaaccaagagtagtggcctgcatctctttgtccaaggcctactttccaaaatctctcggccctacccttccctagaaggttccccactgcaaggaaggcacaggcagcctgggggtgtgacctgcctcatggagtattgcattttttgatacaagaactatttgctccttaacatctttctctaggagtttgaaagaaaagaaattactctgtgtttcagtctctaacttgtgattgagtggctgaggtgggaggatctcttgagcccaagagttcgataccagcctgggcaacacagtgaaactctgtctaaaaaaataaaataattaactgggggtggtggtgtgtgcctgtagtcccagctacatgggaggctgaggcaggcggatcacttgagcccaggagttccaggctgcagtgagctaggatcatgccactgctgcccaggctggccatagaccaagaccctgtccctttaaaacataataataatctttcatatgttagaatgttaaaaataagtataagaagtttgaaatgtttgcatccaaagtgagatttaatacatagctatttttgataaattgaaaagtgtcaagaaaactgctgtttaaatttcatttataatcatgatctcataatagtaccattcaattttctccaatagtctctggtatttttagtttgtttgaagcagcgtccaaataattgcagttaactgataggtctgttaagtctcttaatcaatagaatacttttccccatcccttttttccttgcattttatttgttggaaaatccaggctgattgttcagtagtcagaagttccctcattctggcctttgctgtttccactggacatgttcttctgcctgtgggtggatatagaggctcgatcgctttctggctcagcctttcagcacaggtacttcagaggtgcgtgatgccctcaccaggaggcacacatctgcactgatgtgagatccagtgttgttgttgttgttttttccttttgtcttttttatttaaaaatcatggggtcttgctatgttgcccaggctggttttgaactcctggcctcaagcagtcctcccacctccgcctcccaaagtatgctgcaagcttaagccatggcgcctggcagatctagtgttttttgaaatctcatgttttattctaacaattgatcgaaacattataatctgcttctcaatatggccatgttttatgcttttcacgtcttcaaatacagttgacactccaggaagatgaaccttatcacatttgcaacttctgccccttatacagccccggggctccagccccatgtggcaggcgtgacctaggggaagcctccatctggagaagtgctgcctgcacttggttgcatatcgagtggactgagcccttggctcctctcgctgcttcctgtccagatggcaggactctggtcgtgggccaaaagaggcacagtgtctttgcatataataaggattgaatgaatactttttaaaaatcctaactcttatgaaccaagggatactgacaatgctgggccccaaataactattgttttctcaaaggctttaagaccatgtgttatactgtgatttaatcaggttctttcctaggagtctgcctgagtcacttggtctgtgtgtctctccctccctgtcctaagggggcttttcatgtgtgactgtgttctgcctgcctgtctggtaagaatccagcctcctgttacttgcccaggatgctgactgtgggccctctcccgcagtggaacatttggcatcaggtaccaggaacagagtcagtatgctgaaatgtttgcatgaatgtggattttcagaaagctttcttatcagcagggcacacctgtctgttcgtgatctttgcccttctccctttattggcatcacttggacgatacctttaattgccctgctgggcttgatgttgagctgcttttctccatgtgtgtcgtgttttgtgctttcttgcggcaggagccttttgctttgtttatctgatgcttcccttttttggttttccccgggctttccagctcttggagcacccttttgtcagcagatgtacttttgtttccagtttttaaattctaattacagtgtaactcaactaaaatcatggaactggggaacataaaacaaatcattagggtaatggaggcatagaagaaagtgaaaggaatccagtccacctctttgctgtactaggtatggatatgcctcagctgtgagtgagggccttcctgagtagctgactacaaactaaacttttatgaaagaattttcttaaataattagagatgcctttcatttagctaaaaacaagacctcaaaatacagtaaattcatgtctaagactgtagcaaacagtaagtaaagtaatagagtaaaaattctgcttaaagaagactgcagaataagaattgcaggccgagcgtgctggctcacacctgtaatcccagcactttgggaggccgagatgggtgaatcacttgaggtcaggagttcaataccagcctggccaacatggtgaaaccctgtctctactaaaaatacaaatagttgggcatggtggcacacacctgtaatcccagctactcaggaggctgaggcaggagaatcgtttgaacctgggaggcgtaggattgaaccaagattgcgccactgcactccagcctgggcgatagagtgagactccgtctaaaaaaaaaaaaaaaaaaaaaaaagttacagcgctcagagtgccagatgctgcgctcctggtagtttctggtcttggcccttccttagctcaaagtgcactggcataggtgccattttttagtcacacaattcccttcattgtaattttcttagcactgtctttgcttagtggatctgttgttgccattcagcagtacatttctctctgtgtggaagcaaacatcttctcaaacctgatgctcagtgaggataggcagtgggctattaaataggcagtggcctcagattcccagcatgtgtatgattgccgtgctaaccagaggcgcatgtgtccagcatctgggcattggaacctgcaagctgctcccccaaatcaggatgccaaacattaattggcaagttactaaaagttgcctcaaataccatctttaatgcatttaactgaatttgcataatttttctttatcagcacaataattattataaatattgtagaattgccattaacttataattgtcatatctaaattttaggataaaaatagaacttaactatttttatacccatatataagcaagtgaagtaaaggtatttatgtttaaatcaagaaatctaatcaaaggtttttacaatccttccaaatatgcaatctcacttatttcttgccacttctggtgataggtctgtgtgtggaagacacgggattcctgcctgtccacagctcagtgtgaacggaccagatatggtcacagattagaatttaccatcacagggccgggcgcagtggctcaggcctgtaatcccagcactttgggaggccgaggtgggcggatcacgaggtcaggagattgagaccatcctggccaagatggtgaaagcccgtctctactaaaaatacagaaaattagccaggcctggtggcgggcacctgtagtcccagctactcaggaggctgaggcaggagaatggtgtgaaccctggaggcggagcttgcagtgagccgagatggcgccactgcactccagcctgggcgacagagcaagactctgcctcaaaaaaaaagaaattatcatcacaggcctcgtgggtggttcgtgtaagaggctgaggcaggaggattgcttgagcccaggagttcgagaccagtctgggccacattggcgagacctacctgggcaacatggcgagaccctgtctctacaaaaaatagaaaagttagcggggtgtggtggtgcatgcctgtagtcccagctggttgggaggctgaggcaggaggatcgcttcagcctgggagttcaaggctgccgtgagccatgtttgcaccactgcactccagcctgggtgacggcaagaaaagaaagaaaataaaagaaataacctcaaaagaaaaaaaagaaaagaaattacctcaaaagaaaataaattacccttacagacattttatttttattttattttttttacagacaaggtctctctcttgctcaggctagactcaacctcctgggctcaagtgatcctcctgcctcagccttctgagcaggcactacaggcacacgctgccatgcccgacaaccaccacagataatttagaaaaaattagccttttagttttaggagctttcttttacagtgatatttagtttggggcctttgaacttggtctttgcttttggagctgtacttgtaggtgttgttgttccagcctgggaacgagacatgaccgactccagtgcggcctgcttgctgtcctcaccatcagtcagtgtggtccgtgtgtgaggctgcagttgtcctcttggccacttatttctccttaattctctgcatgtaatttaaaacattatcccctgaaacttagtttttcattgacttctaatatctttacttctccttttaattttcctattgagatacttaggatgacatgaaattctttggatctacatatggacaaacagaattgtgtcacataaggttcagtgtgctagctgtttaaaaaaaattaaaaacagtttgttttttttagagacagaatcttgccctgtcacccaggctggagtgcagtggcgtgatcgtagttcactgtaaccttgagctcctgggcttaagcagttctcccgcctcagcctcttgagtagctaggactcacaggcatgtgtcaccatgccaggctaatttttattttatttttatattttatttttattattatttttttgagacagagtctcactctgtcgcccaggctggagtgcagcggcacaatctcggcttactgcaacctccacctcctgggttcaaacgattctcatattctcctgcctcagcctcctgagtagctgggactgcaggctcacaccaccacgtccggctaatttttgtatttttagtagagacagggttttgccatgttggccaggctggtcttgaactcctgacctcagacgatcctcctgccttgcctcctaaagtgctgggattacaggtgtgagccattgcacctggcctttatttttttttagaggctgactgagttttgctgtgttgccaaggctgatctcaaactcctggtacttcaagcagtcctcttgccttgacctcccaaagtgctgggattacaggtgtgagctaccacgtcctgcctgctagccatttttttatgttcgtggtggtggtaaggagtggctaccaggctgtgcgggattcaggaatctggatgttccccccaccaccgttttttaccccacgaaaaaaattgtaaacactttctaattgagataaaatttacaaaacaaaattcaccacttaaaccacttaaagtgtacaactcagtggctttgtgtatattcagaatgttacggccgggcgtggtggctcatgcctgtaatcccagcactttaggaggccgaggcgggcagatcacctgaggtcaagagttcgagaccagcctcgccaacatggtgaaacccccatctctactaaaaatacaaaaaaattagctgggcatggtggcacactcctgtaacctcaggcaattgggaggctgaggcagcagaattgcttgggcccgggaggcggaggttgcagtgagccgagattgcggcactgtactctagcctgggcgacagaggcaagactccgtctaaaaaaaaaaaaaaaagaatgttatgcaaccatcactactatctaatttcagaatatttcatcaccccaaaaagaaaccccataccactaagcaggcactctccattcttcgcttgccccagcctctggcaaccactaatctactttctgtatctatgaatttgcctattctggacatttcatgtaataggaatcatacaatatgtggccttttgtttctgacttctataacttacataatgttttcagggtccatccatgttgtagcatatatagtacctcatttttttttatgcctaagtaagagttcattgtatgaatagaccacattttgtttatccatttaccagttgaccatttgagctgtttctactttttttttcgctattgtgaatagtgctgctgtgaacgtttgtgaacaagtttttgcgtgaacagactggttctcttggtatatacatagagatggaattgttgggtcatacggtaattctgtgtttaacttttggaggaactgccagattgtttccacaagggctgcaccattttacattcctgtcaacaatatgtgaagattcccatttctccatatccttgctaacacttgtgattttctgtttttaaaattttagccatccaagtgactaagtggttatagtaggttttggttttggttttgagacagagtcttacttttgtgttgcccaggctgcagtgcagtagtgcaaacatggctcactgcagcctcacctcctgggctcaagtgattcccacctcagccccccagatagctgggactacaggtgtgcaccaccacacccagctattttttgtatttttttgtagagatggggttttttactgtgttgcccaggcatgtcttgaactactggcttcaagtgatctgcccacctcagcctttcaaagtgctgggattataggtgtcagctgccgcacctggctgtttttttttttttttttttaacaatgttttaaaataaattgtggtgagatacacataacattagccatttaaaagtgaatgattcagtggcattttgtacattcacagtgttctgcaccatgatctctatctggttccaacacatttttttcgttcccaaaaggaaaccccatacccataagcagtgagtccccattatgcctcctttcaaccactggtaactaccagtctgctttctgtcttgtggatttccctattctgtatgtttcatgtagatgaaatcgtagtgtgtgccctttgcttctgacttactcacttagcatgttttcagggttcatccatgttgtagcatgaatcagaacttgattcctttttaaggctgaatggtattcactgtctggatagattacattttgtttattcatgtattgatggacattttggtggtttctacctttttggttgttgtgaagagtactgctgtgaacatgtgtatacatgtgtttctttgagtaccttttttcagttattttgagcatgtacctaagagtggaattgctgggtcatatggtaaaatgttttaactttttgaggaactgccagcctcttttccttagtggctgaaccattttgcgtttccacagcagtatatgagggtttcagtttttccacatcctaacacttgttattttccttttttaaaaaaattataggccaggcgcagtggctcacacctgtaatcccagcactttgggaggccgaggcaggcagatcacctgagctcaggagtttgagaccaccctgggcaacatggtgaaaccccatctctactaaaatacaaaaaattagccaggcgtggtggcaccagcctgtagtcccagctactagggagcctgaggcacgagaatcacttgagcctgagggatggaggttgcagtgagccaagatcatgccaccgcactccagcttgggctacagaatgagactttatctaaaaaaaaaaaaaaaggccaggtacgttggctcatgcctgtaattccaacattttgggaggccagggtgggaggatcacttgagcccaggagtttgagaacaacctgggcaatataatgacaccccgtctctacagacaataaaataactagctgggcatggttgtgtatgcctgtattcccaggtattcgggaggctgagttgggaggattgcctgagcccaggagttcaaggctgcagcaagtcacgttcacaccactgcactccatccagcctgggcaacagagtaaaaccctgtctcacaaaaaaaaaaaaaaaaaaaaaaaattacagccatcccagtgggtgtgaagtgggaactcactgtggttttgatttgtattttcttttttaagtgaaagcaagtttattaagaaagcaaaggaataaagaatggctattccataggcagagcccattgccactcagctgcttatacttattgttacttcttgattgtatgctaaacaaggggtggattattcatgagttttatgggaaaggggtgggcagtatctggaactgagggtttctcccctttgtagaccatacagggcaacttcctgacgttgccatggtatctggaaactgtcatggtgctggtggaagtgtcttttagcatgctgatgcattataattagagtataatgaatagtaaggacaaccagaggtcactttcatcgccatcttggttttggtcagcttctttactgcagcctgtttcatcattaaggtctttattacctgtatcttgtgccgacctcctgtctcatcctgtgacttagaatgcctaacctcctgggaatgtagcccagtgggtctcagccttattttactcaccccctattcaagatggagtttctctggttcagacacccctgacatgtttcccccctcccttttacagcagaacccttaatcctaacagtcgtagagggacaaagatccatcttctgtaacttcttcaggctgaatggggcgatgatattcctgcctaactatgagggtctcttgtattcagggtagagaagagctcagtcagaaagcatcaatatggtgagggccattcatagctctgagttccaacaaaaggtggtatctggaagattaataagtgttcagtttaagaaaacattcagtaaacttatcctgcattcctacacaaagagtacaacagcaatatattccacaacagtaaagtagaataactaaaattatcctgagtaaactaaacaagaaggctttccatgaactgggcagttgttgaaaccaaactgatacatcgggttgctagccgactccagtatgtgcccagaattagaatattgatccagatttttacattacccatctctcttgtttcttgtgagcagcagccagagatcactgattggttcacaggagtaagcagggttagcctaagttgcagaaaaaaaacttaaaaacaactgatgagactagaatctagtaacaggtgtaccaagttcctgaaacataatttattttctctctccggtctcccatttttactgaagacaaatcatggtacaactgatttgctttattatacttggcctgattatttgtataaagtgcagcaagaacagttatttttcacataggtttttaaaattggctttgatgaaacttcattccataaaaggaagcttagataagactttttgttaaagccaagcccagccatgggtttgtaccctcaaataacctgtgagttgggaaattcctctcctcttgaggtcccaagatggcgtggggttcctgggcctgtcggaaagtgacattctttactaaccacaggtcaggaaccctgcacaggaactgtgtagacaaggtatgaggccagttttcccaaggaacttttattggctccataagtcaagtttgagtccttaaaggaaagcacaccattcccatcaaagtcctggtaaaacaactagtttctctaattgtgtcctgttgcaaaagaaaacagattcttattgcacttgtgcaaataactatattgccataagttaatactcacaaatagtttccaaattccagagaaagcaggtagagaaaaacaaatatgctccaaattttgttcacaggagtatactttactcaattgtcaaaagctgtaagtagctcaaaagttttcttggctctgaaaaacaaaaatgatcagcaacgttttaagcaaaaagtcagaaaagattacttgagtcttttgttcagtccatgcagttaactcctgttctacttgatattcataatcatttcagctctccatgagagtcctgaaagaacctctgttcttcttttttttttttttcttgagacagtctcactctgtcgcccaggctggcatgcaatggcgtgatcttggctcactgcaacctctgcctcctaggtttaagcgattctcctgcctcagcctcctgagtagctgggcttacaggtacgcaccaccacgcccagctaatttttgtatttcttagtagagacggggtttcaccacattggtcatgctggtctcgaactcccaacctcaggtgatccacccacctcggcctcccaaagtgctgggattacaggcgttagccactgcacccggcctaagaacctctattctaatgtcacaatctccaaagttattagaaacctgcatccaagagcacctgttgaagtcctataatagctgactataaaccaccttttgaagaggatcaacacagcagttgtctgtggttgacagaaagtcttaaggcagccactattaaaggcacaattgactaggaattttgattacttttgtggcatacgattttacataataattgtaattattagtaacatatgctaagtcatatcacaattctaggagtttcccattactttggaacacataccaataacatatttatataaatacaggtcaaagaaagccaaacaccatttcatatttgacagtgcttcctgtatgatttttataccaaataagccaaatttcaccattgcattagtgtactattaatgttaaacccaattcttaataaaacattatagacaaatctacccaattttaatgtcagaccagaaggtaagattcttataaaccttttataaccctttacaaatttttgttaaagagcagatcagtgctctaagaaaaccttgttacgcttttattccagtgttcaatttacggaactgtatcatacccctttaacttcagccagtatgttcacacacagaatttcttttaaaagattaatttttcacaaaatttccacaacttttgcaaaccttcagctttatcctaacttaaaacaatcccttaaccctttaatttaggccaaaaaaaaaaaaaatccacattcacatgtctccttctcttttaccaaaaacacatttcactttccctacacaccttgcatgtaaaactgtttttccagtagtctcaagtagatgttacactgttaactcttagcagtgtttatttttagtgaaaaacttggtaagcaattttaattatgtactaggtatggagcctaggacaccaggcagaagtgcagataaggtctgacacttactagcatagctaggaggcatggctaactccacatgtccctaggccttacctagaatctaatggctgtaggtaagtttaacaattttcaaaagtcaaagaggcagtttataaagttaaagcgtttagcaaacctaaaatttgacctgcctgatttagaccgaatgtctttattttaccaataatctttaaaattttctttacttcccacagcttaagtcacacgaattaaaaggcattacgctttttatttttctgacaaaatatttgatttaaacacttatttttaagccaattaatcaaagccttttatatcacacacacaacacatataaatacacagacagaagaaaatgtagtagttgtaaggtttttcctttgccagtttcttaattggattagtggctttatggtggagccctggaggaacagggcaaggaaagcatgcagtttctatggcctaataagcaggcacaattggaaggcaagacagagccccaaaacttgagggtcccatttttatattgatcctggatcccccaaagagaaacgctacagaacacaacagtgcaatgattttaccacatatttcattgccaggcaacccagagccaatcagccctttctgagatcagcccatcccccatgggagtcttatctctcagtggggaagggtgaggacatctccataccttccaggtggccaagagcatgctcttaatccagacacacaaagatccaagtatcccccacagtgccatttagccatccccaaaagtattaaatgtatttcctacctagttatattacacaccaaagttctctcataatgtgaagtaatttctgatacccccaaagtaaaaaacagataatgcagtgcaaaacagaacagagccatagattttgagagggatctatccacttttaataattctcggggttccatgaggaaaatagaggtttttcccaaaacagggtatgtggtgcctcctctgtttttcctaagaagtcccaggctgttagagcttgaatatcgacttttaattaagctgacttttaaccatagcactctttaaaaagtcgttttaaatatcttattacccaactttagccacgccaaactgccaatattcctggctttttaacttttccaaatgtaacctcccaggtgctgagagaaaggaaaatttaagacagtttatgaaagggaggagaatcaacaaatggcacaggtcacccaaatgccaaccagaaagtgctcattttctaggctaaaaattgaacctgaactcaggccaccattgtgaaaagacaaagccttaactgctaagctacagcattgggcagtttccactgcttttcccagaaggagcccagagcagtaaattttgagcttgcaaaggcttttaactgctcaagataatttgtagagctaactactaccccaaaatccctgttgcctggaaggcagagacaaagagaaagtactgccatatgattacaaggtcaagctctcagggacatttctcaacatgtggtctttgggcaagatggtggccctgaataacagaaaagataggaaagggaaaggaaagaaagggagaaaagcattgcctgcagcaggctggggaatgcaagaagctcagggaggccagagaaagacccgcccattgcagctgacactgaatcagaagttcaggtggctgctttttgggagcgtagggatctttcccagcattcccatcagctctagtttccccttttggggaggaaaaagctccccatgtcccataatcttggacatgtctagttctgtcacccacagccatcagcaaagagtgcaaggcagattaatccaaagagaatagcagttaacatcccatagtgccaaactggttcttagtcgagagggactctactgagaggggcctccaaccccctaaattttaggaaggactctaaccttcctaagttgggcatcaaacccaagttcagtcaagcgtgcttgccttttattaacaggcacctttatccctctcttaggagagactctaactctcctaagttgggcctctaacccaatcccatcctttacccaggtaactgcatcccacttacccaaggtcggccaatcagtgctgcagtctatttcctttgggttgggagtctcctcagtatcatccctttggggcttgccaggaagatgttaccggaaaggggtcccaatccagaccccaagagagggttattgaatctcatgcaagaaagaattcagggtgagtctataaagtgaaagcaagtttattatagaagtaaataaaaaagtggctactcaataggcagagcagccgatttgtattttcttaatgatattgatattggacatctttttatgcgcttgttgaatatttcagtatcttccttggagaaacgtttatacagatcctttgctcattttaaaattgggttgtctttttgtggttgagttataagagtgctttatatatatcctggatgctaaacccttattagatatgtgatttgcaagtatttcctcccattctgttaattgtcttttcactttattgataatctcatttggtgctcaaaagtttttcattttgatgaatgaagttcagtttatctagttttttattttgttgcttatacttttgttgttgtatctaagaatccattgccaaattcagggtcattaaagatttacctcctgtgttttcttctaagagctttctaatatattttttggggatctcattcatttttgaaagatagttttactggatatagaattcttggttgaaaaatagccagacatgatggcactggcctgtagtcccagctcccagagagactgaggcaggaggattgcttgatcccaggagttggagactgccgtgagctatgattgcaccacactgcactccagcctgggtgacagagtaagatcccttctccaaaaaaaaaaaaaaaaaaaattattggttgacagatttttttctttcagccctttaatttgtcacctttcggcctccatggctttagatgagaaatcagttgttaatcttactgagaaatccttgtacttgaagagtcacttctctcttgctgctttctacagtttggctacagtgtgtctgggtgtggctctttgaatttatcctacttggagtttgtcgagcttcctggttatgcagattaatgtttctcattaaatacaggacttttctaccattatttcttcaaacttttttttgtctttttttctctctgtctttctaagaccctataatatgtatgttggtacaattgatggtgtcccacaagtctctgaggctgtttattttcttcattattttttcttctgttccttacactttataatctcaattatcctatctttaagttctctgattcttactgctgtttatttctgctgttgagcccctgcagtgaatttttcatttcagtttttgtgcttttcaactccagaatttttgtttggttctttttttaaactatttttttctttatcaatattttctattcagtgagacattgttctgatggatcttgtagatttttgaacatggttttctttagttctttgaacatatttaaaatagcatatttaaagtcttcatccatacgtctaatgcctgggcttcctcttaaacaatttctgttagttgccttttttctgcatgtgaaccatactttcttgtttctttgcatgccttgtgatattttgttgaaaactggaacttttgaatttttaccgtggcaactctggaaatgagattcttccttctcccccagggtttattgactgcttgttacagtcattgtttgtatagttacttttctgagctaattttatatagtatatattctttatcatgtgtggcctctgagttctctgttccattaatatagtggtcagcttgtgattagacagagatttaagcgcctagaacaaaaaatgtctcccagtcttttgagatgaggtctgtgtgtatgttggagcacaccttcaacactcagccaggcatttgacggtgatccctgagcattcgctgcctgcttgcacagatcctgaaggtcagccagaggtgaaagcctagggccttttcaggtctttcctgaacatgtacacagccctgggcatttgtggagccttctggatttccaagaatgtgtcagagcttttcaaacctttattttccaaaacatcttactcctcagcttttcttcccaagcttttggttaaatctattgtttgcctcaactgttattcagtgcttcaggcagcagcaaatatgtttgtctgtaaatgtttccaataaccttttcccatctttccctagtagatgcctcagcactgggaggtaaagtcaagccctttgagccagtcttccagggactcagtagacaggtcgaaacaaacaactgcagttctttgccgatgaggcccattctgctccctctgggaccagtgcatgcaccggagtggcagcctcttgtcttctaggccactgcggcagccaggatgggaccagagaaagttaaaatgccatggaactcgcggttcttgctgagattcacctggtttttcttgattaagcattcttctgattgctgcaagtttttaattagttttccaaagttttaaaatagtagattctaacggtttttgcctttttcttttttttttttttttttggagacggattcttgcgctctcacccgggctggagtgcagtggcgccatcacggctcactgcaagctccgcctcccaggttcacgccattctcctgcctcagcctctctagtagctgggactacaggcacccgccaccacgcccggctaattttttgtatttttagtagagatggggtttcaccgtgttagccgggatggtctcgatctcctgacctcgtgatctgcccacctcggcctcccaaagtgctgggattacaggtgtgagccaccgcgcccggcctagtttttgccagtttttaaaatgtgtatattgaaggatggactttgagttccttactcagccatttttgtggacatgatttactagtcataatttaaattgaatattttaggacatattaaattatgatcagtttcgaggttgccaaatttacgtacaccttacttggttacacaagagatttaagatggcttacaaggataaatagcataagagatgcaataaattatcattgtcagtatttgttgggttgagggcatgttagtaaaaactgccctccctgctgttaagaacttgatcctacagacagaaatgtttccttggcagccttgagattcttgccctctctctgttacgtcagtggtggggaacctggggcagattcgcctccgtggcttctcctgcatgactgcgttgggctgagggagatatgccaggttagtgcccagcagtagggatggttgttactgtctgcctctgagttgattgtgagaaatgtgtctccagtgttggttttcctaaatctaaaactctcctttgctcaggacaggacaggtaagtgtttatatcctatttgaggacttaagacatcatgtctattgtcctatttgcttcaggaggtgatcaggggattcttacacttcagatcagaagtgactgctcttggtggctgttgatcactgggagagtcaagagtcatcagtaaacctgagacttgtccatcccctggttctggtgcctgttgaggtgtctgtctcctgctttcccaggagccagttcagtcctgtggccacctcattgatatagaaggtcacggggctgccggctgggctctgctcagggttcgtgtcatttctttcttcagcttttgtttagaaagcatattttccttgagcaatgtctgtcaatttgacatagtggctcatttactagtcttacttgagaacacctccttttgacattgcttctgtgatagaattagagctgctttctgtttttatatattggattgtccctttttcatcagcatcactcataagttaatctgaattttttttttttttttttttgagatggagtctcattctgtcaccgaggctggagtgcagtggcacgatctcgggtcactgaaacctctgcctcccaggttcaagcaattctcctgcctcagcctcccaagtagctgggactacaggcatgtgccaccatgcccaactaatttttgtattttagtagagacggggtttcaccatgttggccagggctggtcttgaactcctgacctcaagtgatttagccgcctcagcctcccaaagtgctgggattacaggcgtgagccactgtgactggcctaataaaattaagatttctcttcattaaaagacactataaataaagtcaagccatagtgctggctttggcagcacatatactaaaattggaatgatacagagaagattagcatggcccctgcacaaggatgacatgcaaattcatgaagcagttccgtatttttaaaacacatgcacacatatgtttattgcagcactatttacaatagcaaagacttggaaccaacccaaatgcccatcagtgatagactggataaagaaaatgtggcacatatacaccgtggaatactatgcagccataaaaaagaatgagttcatgacctttgcagggacatggatgaagctggaaaccatcattctcagcaaactaacagaggaatagaaaaccaaacaccacatgttctcactcgtaagtgggagttgaacagtgagaacacatggacacagggaggggaacatcacacactggggcctgtcggagggtggggatagcattaggagaaatacctaatgtagatgacgggttgatgggtgcagcaaaccacaacggcacgtgtatacccatataacaagtctgcatgtactgcacatgtatcctagaacttaaagtataataatttaaaaaaaagtcaagctataaatagggaaaagacatctgtaatacataaaactaacaaaggattagctgttaacatattaaatagatggggaatctccccaaatcaatattacgagacaggaacccaattaaaaaaatgacaccaccaggcgcagtggttcatgcctgtaatcccagcactttgggaggctgatgtggaaggatcatttgaggccaggagtttgagagcagactggggaacatagcgagacccccagctcctgaaaaaataaaaaaattagctgggcatggtggcatgtgcctataatcctagctactctggaggctgaggtgggaggattgcttgagcccagggggtcgaggctgcagtgagccatgatggcaccactatactccagcctgggcaacagaacgagactccatctcttgaaaacacacacacacacacacacacacacacacacacacacacacaaaacaatgacaagaaggcacaatttggcatttcacggaagagaaaacaagtggcctctcagcatatgaaaagatgccaaacctttctaatcaggataaggggcataaagaccatagtccttggttggtagaaattaagatgactgataactgtaagtgttggtgagagtgtggtttcatagaaattcttgtgctgctagtggaagtatttgttgttacctctgctttggagagcagtttggcactcatttacaaaactggcctttcgtacaacctacacaccagcgactcctctctgctctttagatgtagagtccagagcaaggactggtaaactctttctgttacgggcaagagagtaaatatcctaggctttgtggactacatacacacttagtctttgtttttataacacttaaaaaatctaaaaagcattcttagttcaaagaccttacaaaaataggctgctggctggatttgatttgcaggctgtagtttgccaattcctggttctctgatctaggggacgcatcctggagaaacttagttacatgcagtcttagtggcaggagggccaggggaaaagcacagagcggtatgggggagttgagagagactgggagggtggcctcctggagaaggtcgggggctggactgcatgtgtctgggtaggctcagccatggcctggctgggtgggcctaggggaacgtagagcttctgaggcacaataggccagtgtggagagcagagtggcaggcagggctgggggctgcaggtcgaggctggtcaacccttttacctggcgggcaaggctagtaccaggtgcccttgctacttagcttggaaagattagtgagcatcataatggaccggcaagtttgtaagcaaatgacatctataatacatatactttaacattaatgttttgaaaactttgttttcacaaataagtaatttcccacattttgccacagttatgttctatgaagctaacccaagtgtggctagaacgccagttcatccatctctcaaattgtctgctgccggcgttcattcctgtttgcttctagctgtaaagtcaggctaggagtctgtcagctcatgtgcctgtcagcttcatgcaggcagcaagaacggggctcggaagcaagggctccgcccgcccacccagcaactacctccccaggatgcccaggagctcaggggtggaaggaatttggctcttatttttctaagtagcaaaaatagatgaattgggtacaggaacgcagtgtatttttgagggagctggtgagttgtgaaagaaacttcctctgttcacctgaggcttaccgtatcgtgagaaaggatggaggaggcatggaggtgggaaactctacacaagaaaaatcctatagtgcagcagctactgatgtgaggcggctggtctaggcagcggtgttccctgaggctcctgagtctggttctcactgggtccctcacctcccttcacagccactcccttccttaccaaggtacatgggagtacagggctggccaggggctgttgacagtgggggagtggtgcaggctgagccttagagacaggaagggcatctgtgctggagctgccctgcagaagcctcgtaaaggtcgtaaggcactgggcaaaaacttttccaagaaagttcatggtgcacacgctgacctaaacactggccgacattcccaaggtttttttcattatggaagtgcatggccattgcatggtatccagaaaacaaagaccagagaagccagactttataccaccatctggaaacatttaatttgtgctttaggtaagtgttagcaaatatttaggatgattgatcaaatcattagtgtgtttatgagtgcatggtgtaatttttactaaagctcacatttcttcaggaactcgattcaactcctttacattcctggttattttcatttacttgatcttgaggtctcatctggcagagctgtgcaagctgggacctttgtggcttattttgaggagctgtttactttacctgttgatgggaacttgcaggtgggaggcagccagtcttaaagagtaccttgttagcaagtgtggaagagagtccgcgcagacagacttgccctatgtggtgtcccctctgccagcccagcccttgggcacattggcacctacctgaacccgagccccctcatgcacacagggagccgcacctccctcacacgctcctcaccagtgtgacatggtgtgacgtgctctgtgggtccacaacgggcccactccacagctctgtgcacagcatgctgggtcagggtggtgctagattaataagatgagggtgaatgtcaaaactgagcactttgagtactgtgggcacactgtcacagggtttacccaggaaggaacaacccctgggctccagaagcaggttgaccaggccagtctgagttgtagcattgagactcatctagcggaagtcaatgaggaaggaaaactggctgagaacagctgttgtttcagttaaaatctcagaatgatgcattgaattcaaagttacaacacagcaaaatagtatatgtatttttttaaacctcaaaaatactgtattattaactttaaaacatttttggctggtgtggtggctcacacctgtaatcccagcactttgggaggctgaggcaggcagatcacgaggtcaggagattgagatcatcccggctaatgtggtaaaaccccgtctctactaaaaatacaaaaaattagccaggtgtggtggtggccgcctgtagtctcagctactcgggaggctgaggcaggagaatggcatgaacctgggaggcggagcttgcagtgagccaagatggcgccactgcactccagcctgggcaacagagcgagactccgtctaaaaaaaaaaaaaaaaaatttttggagacagggcctcgctctgttgctcagcctagagtgcagtggtgccatcatagcttggtgcaaccttcaactcctgggctcagcaatctttccacctcatcccaatttattaagtatactttttaggaagttttttgaataataatatcaatagttactatgtgtttgggtaaaatagaaaggatggaagcatatttgatcatgttttgttcccaacacatattaaagttgggaaggattcttgtgttgcctaaaactgaaagacagcaggtctcaggcacttttgctttcccaaagctgtgtttgtttccttgcatgagaggatatgatggcactctactgttttttcccgacagaactcctctttcctaaaatggagtcgagtaaaaagatggactctcctggcgcgctgcagactaacccgccgctaaagctgcacactgaccgcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgaggtaggcgccctcgcccggcccgtcgcccggccccttctcagccctcggcctcaccctctccttcattcgtttctctaaaaataaacctctagaggtttaaagccctaaagaagtccataaaagcctccgggcccagcttgtgaatcctttagggaggtgcagtgggatcccacgtgtgggtttactgaggcctctgcgtgtctctgacctgccccgcccgtgtcttcccactccgtctgtagagccttggtgcccctcatatgtgttgctgtattttattgaggaacctcacagttccatggaggagatacaccaggaaatgacaagccagtcatttaagggcacgtgtgctggtgtgcaaggatgccgcagagaggagggaggatggggtcagcttaaaggactggacaggtccctacccgagcagaaacctaggccgcatgcttactcagcaggcgtgtgtggaacatgcaccgagcccatggcagccctttgctgctgagtgccagtgctggtaccgctggtggatcatgaaggcaggctggagctttactgcagaatagcatcggccagaagagcaccttgattcaccctgcaggcctcatgttttctggcattgtgctgggtgctggggtcgctgcgggatgccctggtcttggccactgccgtcagggcatgtcggcctgggaaggttgccagctcctcctcccacagcactcaagcctgggctgcacccgagccccagcctgggcacagcagccagccccctgccctgtcacctgccttcaccctcccccttctccatgcttccctctgtggtcttacccactcatcccaaatagtcagctaacctttgcccacttgggggcaaaatgacacttgagcttagtgacagcacaggagacacagaacaccgtgtctcctaacacaagagcctggactacacctctgggcccaggagaagcttcccggtggaggaggggctggagcccccatatatggtgggccacaggggagggaggctggtccccctgtgcaggtgccattggccttccaatagacagtgaagccaaatggcctgtggagaagggctggctgcttttacaacgcaggagcaaggctctccaagtaaacaggtactcacactgaagagctgctctgcagacagctagctttggtttctgaaataaaatttcacttttacattaagtggaaggggctttccaagtgggactgaactaaactgttctacttggtaacttccttttgaaaaatcagcattttaaaaaatgtagcccttttctcccatggcttcctatgtaaagtgaatcaccagggcgtcctgaagctctgctggttgctgtgagccactgtgcagacctgaccataaagtgaatgctcccagaatctcctgagtcctctcaagaaagggacttccactctaatgcagtcacttgtgtttccctgcagctcttcaagtccaaaatgtacagcgtgtcaagagagcatcgttaaagataaggtattctggggttttttttaatcattttgtcacatgttttcagctgggtaatacttttcacatagtttgcattcggcactctggcacaacacattctctcagttttggcagctgatgcggcaggctcccaggcaggacactgtgccatgtgatcacctgggcagacagtggattcagatccacttggccacttccctactgtgtgaactctgtgagctacttcaccccctcacctgtaataatcatatcacctgctaagaccgcagggagctggtgtgaggagtaaggggttgatgtgagcaaagtgctgagatgcctgtctgtggcagggctgtctgtggttgggtcacttccgtcattgcaggtctttatcccagacagcttctactcaactcttacactaggttttaccttcagactcgctaggctgaggggttcatttgagtttgtgctccctgccccccaggccccctgtgatatctttaagtcattagacatgagtgagattagccccttctcgccccctgtggctgtcctcagctagagcccgtgggcgtctctgcacattcagaggatggggctgcccagcctgccaccagcttctctcctggggcctggtccttctcatggagactgacagtcatccatgtgctgctgtaccctgccaggtatacttggagtttgaaacaattcttttcttttctttctctctcctttctttcttctttttcttttttttttgcgacagagttcactcttgttgcacaggctggagcacaatggcacgatcttggctcgctgcagcctccacctcccaggttcaagcaattctcatgccgcagcctcccgagtagctgggattacaggcacgagccaccacgcccagctaatttttgtatttttagtagagacggggtttcaccgtgttggttaggccagtctcgaactcctgacctcaggtgatccacctgcctcggcctcccaaagtgctgggattacaggcatgagccaccgcacccagcaattcattcttaaagtgcttaaaatatcaataaaaatgtgtgtttccctactttgagtaatatacctaaccattttttaaatgcaggtcactaagttgtacaataaaattcttactctggggttttcctgtctaaagcaccttgcagattgggtttgttggtcagagcagcccaggtgagtgcagtgatttgaggattgctggtagtcagtgtccctgggctgccaggcacacaggcatccagtatagccgctctggaagggggagagatggaattggccacctggccctgtaccttttctttctctgcatttacctgctgctgctgcaggcttggttagttccttgagtgaaaacagcccctcccctccactctgtgccttggcctagcatggtactcggccgccttgttaacatgtgcctaacgtgtgagtgagagagaagctcgcgacgatggctgagatgtttttttagtatctctgttttgttatgcagaatcattatccctattttttaatgacataagtagctgaagaaaaatggctagttttatcaaagaatcatgaacgagatgcactcaagttgtggaccctcatggagagaatggagctgtctgggccccgggtgacccggatcctcacccgtcagcaggtcatccaggggtgggcgggcctctggtcttcatctgtaaacagagacattttgagtaaatagtctcagatcctttccattccaaagttctgttgactttagtatctcaagtcatgaccttcttttttttttagtcatgtttatgaaagataagctttggctccaaattagtttatttttaactcttaacagctgttgattttatttctctcagcagtccaaaaaggcacattaagctcctgttattccactttcatagagcaacaggcaggagtttcttagaaataacctttggactaagatgttgtagatcgtgttgttagaaagagtgagagggagctgggcatggtgccttatgcctgggatcccaggactttgggaggctgaggcaggtggatcacttgggctcaggagttcgagaccagagtgggcagcatatggagaccccatctctacaaaaatgaaaattaaaaagttacctgggcttggaggcatgcgcctgtagttcaagccactcaggaggctgaggtgagaggatcgcttgagcccaggagtttaagggtgtagtgaagccatgattgcaccagtgcgctccagcctgggtgacagagtgaaacccaccctgtctctttttgagacagagtctcactctcttgcccaggctggagtacaatggcgtgatctcagctcactgcaacctcctcctcccgggttcaagcgattcccctgcctcagcctcccgagtagctgggactacaggcatgtgccaccacacccggttaatttttttgtatttctagtagagatggggtttcaccgtgttggccaggctggtctcaaactcctgacctcaggtgatccacccacctcggcctcccaaagtgctgggattacagaggtgagtcactgttcccagtcaaccctgtctcttaaaaaaagagtgagaatgagaatacttgtgttttctaagggaaaaataaaattaaaagttgaaaggttttttcttcttcttttttttttttttaaagaaatgggggtctcccactgtcgcccagtctggagtgcagcagtgcgatcatggctcactgcatcctctacctgccaggctaaagcagtcctcttgcctcagcctcctgagtagctgagactgcaggcgcatatgctgccttgcccagctaattttttaaaaaaatttttgtagagatagggtctcattgtgttgcctaggctggtctcaaactcctggactcaagcaatcctcctgcctcggtttcccaaagtgctgggattttaggcttcagctaccacgcccagcctcgttttcattttcaaagggaaatcttttcattattagactaacttcagactgcaatatatgtttaaagagagtgtttttcaaccacaggctaatgctgctttttttggtgaaaaatgagttttaacagcatgacctttagaaggaaccaacagttttacaaatcattccccaaatatggtctcttatgtggtctctccatttctccagcaagcgatctatacaatgtattcagttgtgtccagttctgctcttgtcctctggtgacagctgcaccataatggccacctgctccgtgctggctcccggaaggccccagagtctgaatgtgaacctggtcctcctctgccctcatcctgaaattatgtcaaagttaatagaagatgtttagatgctccagagtgatcgttaattatcaagtctaattcattttcttttggcttaactaataaaagataacagttaatgttatttaaattgtgtctcttagtgggggcagcttcttcattctacttctagaaatcaagatggtccttaatgctttctgaagttcacttaagagttcctctcttgttttttttttttaagtggttttgccttgtccaaagtagcagcatgtggagattaagaaatattaatcctccaaaataatgatctttcattttcaggtgtttaaggataattgctgcaagagagaaattctggctcttcagatctattgtcggaatgaaagcagaggttgtgcagagcagttaatgctgggacatctgctggtgagtagcaaagggacactggaaccttttacatgaaggaattcgagtcccttacatccagctgatgaagtggtcagtaggatgtggcactttaagaccatgttgacattagtttttcaaaacacagccaaataggaaagcagtcagaaccacttgagtataagttgttatttttatgacatcattggcagaattgtcaactggtttttaaacactcccccccctacttagaatagagaaaatctgaattggattttaattttggaaggcccattaaaaccttttttcaccatgaaattctacataacttcttatttttttagttagtaccatattttagcttagaaaattatttgaactggaataaaacaaagttcttagcagatattcatttatcctggaagcagagttgacttaattcttcaacaacaatatggtttgagtaatcatgaaatagaatatgaaattcagtgtctcttggcatacttgttactctttgctgtggaaaactggtctaacagcagatgagaaacatttctttagggtttcattgcatagagattagaatctggtatttcagatttagggtttttttcccaattaagaacattgaatggtctgtcttacaggtgcatttaaaaaatgattgccattttgaagaacttccatgtgtgcgtcctgactgcaaagaaaaggtcttgaggaaagacctgcgagaccacgtggagaaggcgtgtaaataccgggaagccacatgcagccactgcaagagtcaggttccgatgatcgcgctgcaggtgcgggtcctcccattccacaggccttccactcaattcctatatgatacattccacaggccttccgctcaattcgtagataatccgttccacaggccttccctcaactcatagataatccgttccacaggccttccactcagttcatagatattccgttccacaggccttccgctcaattcatagataatccgttccacaggccttccctcaactcatagataatccgttccacaggccttccgctcagctcacagataatccgttccacaagccttccgctcaattcgtagataatccattccacaggccttccgctcagttcatagataatccgttccacaggacttctgctcagttcgtagataatccgttccacaggccttccctcaactcatagataatctgttccacagtccttccgctcaattcatagataatccgttccacaggccttccctcaactcatagataatccattccacaggccttccactcaattcatagataatccgttccacaggccttaggctcaattcatagataatccgttccacagaccttgtgctcgattcatagataatctgttccacaggccttccctcaactcatagataatccgttccacaggccttccgctcatctcgtagataatccgttccacaggccttccgctcagctcatagataatccgttccacaggccctcccccaactcatagataatccattccacaggccttccgctcagctcatagataatccattccacaggccttccgctcagctcatagataatctgttccacaggccttctgctcagtttgtagataatccattccacaggccttccgctcaattcatagataatccgttccacaggccttccgctcagctcatagataatccattccacaggacttctgcttagctcatagataatccattccacaggccttccgctcaactcatagataatccgttccacaggccttccgctcagctcatagataatccattccacaggacttctgctcagctcatagataatccattccacaggccttccgctcagctcataatctgttccacaggccttccgctcagctcatagataatccgttccacaggccttccgctcagctcatagataatctgttccacaggccttctgctcagctcataggtaatcccttccacaggccctccctcaactcatagataatccattccacaggccttccgctcagctcatagataatccattccacaggccttccgctcagctcataggtaatcccttccgcaggccctccctcaactcatagataatccgttccacaggccttccgctgagttcataaataatccattccacaggccttctgctcaattaatatatacttcttccactgtacagcttcttaaagactattctaataggactaaagagaaaagataggaataaatagcactttttatctgactttatttcagaattaagctttgttttgcctattttgatttatgtagttaacattttccattgccttgattgactatcatttagtatgtcaaaaaatgaatagttattcaaaaaaggtaaaatttttatcttgtcctagggaattgcctcaaaatgttgatagattgcctggtcttattacagctctgtgacataaccatcacttacaacaggctaatttgtcctacagcattgaaatgcagctgtttatcttggagagagacagcttctcatacttcggttactttggcacagttttgcattgtgtgtttctgtgggggtgagtgtgtgaatgtgggtgagtgtgtgggggtaagtgtgtgtgggggtgagtgtgaatgtgggtgagtgtgtgggggtgtgtgaatgtgggtgtgtgtgtatgggtgagtgggtgaattaaagaggaaagcagagatgttgggggtggaggacacacttagaaaacaatgcatttgttgaacaaacacctattgggtacctactgtgcgccgggcagtattccaggagctggggactcagtggtgaggctcctctagtgggaaaaaatactaacaaatgtgtaacatcgggtagtgatcagttccatgaataaaaatcaggtggcatcaagggaagagaggtgatcagcactggcttgtctgaggcagccaagggacagtgggggagcatgtggaccctaagctggaactggcagggctgtggggttcaggagctgtgtggaacacaggtcagatgtgagggcagtggggcagccagagggtgaggggaaaggcactgggcagcccagaactgggagggtgagaggggccccggggcaaggcctggtgttgctggggtgggggaaggttgtactggggtgtgcctgagggtggagcggtaggattggccagcaggtggggtatgaggtaaaggtgactcccagtgcttgtggagaacctaggtgtcctgccgagggggtgcccagtgagtggagggtgatgggcttgggggagaatggggagtggagccatgcaggctgcagatgggggtgagtttggtggctcgcaggatcatggggctggagcgagtggagaggaggacagagctcgtgggggcctgggcacaccctcagaggctgcctagaggctggggtgggcttggccatgaagtgactgaagggaggcaccagggcagctcagccagggcgtgggccatcatccagttcctggtagatattgtggaatggtttgttttgtttgagagagagtctcactctgtcatccaggcctggaatgcggtgacacaatctcagctcactgcagcctctttctcccaggttcaagtgatcctcccacctcaggaaccataggtgcatgctaccatgcctggctaatttttgtattttttgtagagacagggtcttgccatgttgcccagtctggtctcaaaactcctgggcttaagccatctgcccacctcagcctcccaaagtggtgggattataggcgtgagccatcgcacccagccgtggagctctaatgaccaaaatttagggagagtttcttttgcttttttctctatgaaatgagttgtagtcctcttaggttggtgcaaaagtaattgcgttttttgccattaaaagtaatggcaaaaacggcaattacttttgcaccaactaaatactttataatctctgaatttgccttgctttctgtaattttcctgtgtccatgtctttcttccattgtgaaatctttttcttgtgtggtacttcagatgtttccagttattaagaactcttgaggctgggtgtggtagctcacacctgtgtgcccagcactttgggaggctgaaacaggaggatcacttgagctttggaattggagaccagcatgggcaacatagcaagactctgcctctacgaaaaataaaaatttagccgggtgtgctgaagcatacctgtagttctagctactagggaggccaaggtaggaagattacttgagccagggagtttgagactggtagtgagccataattgcaccactgcactcagcctgggtgacagagtgagaccctgtctcaaaaaaaagaacttttaagaactgtgccctcccctttggaaaatagcagtagtgtttttttggagtcaagtaattcctccaggctgtgcataatggctcatgcctataatcccagaactctggaaggccaaagcaggaggattgcttgaggccaggagttcaaaaccagcctgggcaacaaagtgagaccccatctctagaacgaaaataataatttctccagttgttaaatttcagtgaatgagacacatgcctaattaacaagacttcaggctttacatatgttaatatgttgccatctcatgccagtcagaatggcgattattaaaaagtcaaaaaacaacagatgctggcaaggttgcagagaaaaaggaatgcttttacactgttggtgggagtgtaaattagttcaaccattgtggaagacagtgtgacgattcctcaaagatctagaggcagaaataacatttgaccaagcagtcctattactgggtatatacccaaaggaatataaatcattctattataaggatacatgcacatgtatgttcattgaagcagtattgacaatagcaaagacatggaatcaacctaaatgcccatcagtgatagactggataaagaaaatgtggtacatctataccatggaatactgtgtatccataaaaaggaaggagattggctgggcgccgtggcttacgcctataatcgcagcactttgggaggccgaggtgggcagatcacctgaggttggaagttcgagaccagcctgacgaaaatggagaaaccccatctctattaaaaaaacaaaatgagccgggtgtggtggcaggtgcctgtaatcgcaggtgcctgtaatcccagctacctgggaggctgaggcaggagaatcgcttgaactcaggaggcgtaggttgcagtgacccaagatcatgcactccagcctggtcaacaagagcgaaactccgtctcaaaaaaaaagatctgccggtcacggtgactcacacctctaatcccagcacttttgggaggccaaagcgggtggatcacctgaggtcaggagttcaagaccagcctggccaacatggtaaaaccccatctctacttaaaatacaaaaattagctgggcatggtaacacatgcctgtaatcccagctactcgggagactgagacaggagaatcacttggacccgggaagtggaggttgcagtgagccaagattgtgccactgcacttcagcctgggcgacagagcaagactccgtctcaacaacaaaaacaaaaaaaaaaaaaaagaaaaaaaggaaggagatcatctactttgcagggacgtggatggagctggaagtcattgtccttagcaaactaacacaggaacagaaaaacaccacatgttctcacttataagagagagctgaacaatgagaacacatagacacatttaggggatcaacacacgcaggggcctgtggggttaggagagggagagcatcaggaagaatagctaatggatgcggggcttaataatacctaggtggtgggttgatctgtgcagcaaaccaccatggcacacatttacctgtgtaacaaacccacgcatcttgcacatgtaccctggaacttaaaataaataaatatatagctatcaaagttatattttgcttcttgccaaaatcagttacctttatttgcagaatagaatccaacaactgatttttgtttaagaaggaatcgtagcgtatgtctgttaaacaccatataagtaactgactctgaacaccagatgaggctgtaacaggtcaggtttaagcacaagcatatagattcacgaaatggcgtcagaccctgccctggttgcttaggatgcacaggagaataaattgcactctctccttcagtttgcagtctgatgagagagacagccagatgtacagtttaattcatgttagtatgggaagtactgggactgtaatattaataacatgccaacaaggaaggaccagttacaatagcttagccggagtgtcaaggaaggctttagtgaggaggttgcctttcatttgatctgggccttgaatttgtcaactaaagacaagggagaaagagaatagatggaaagcacagaatgataatgagtttggggcctgatttgtgcaaacattccttataaattgcacttcatgcttgagatgaaacaagttgaaaaccgtttgagcagtgttgacagtagagtgcattttaaggtgtgtgtcagcttctctcagggcctgcagacatttcagcaagcacgcgtgtttggggtcctgccagtgcatctgcccctgcctctcagcctgaccaggggagagcagttgctggttggctgcctttgctccaggcctggttctgtgacttgcccttgccctaggccacctctcttttcagtgatgtgatttaattcccatgtattttgttttttttttttttcaatttgaacacccttattctcatcccctgaggccttcgttgagtttatttctaggaagaacagtcctgatgtagggagacctaaagcccaggtcattctaattctcctacactccctgtgttctgtggtgtgtcacaacatcaagtgttgataaaatgtgctgaggatgcatggaaaccctggaccattgcagttcatataaggatttcttttctacgtttaaactgtggtgtagacagtatgccagctattttcaggttttattattactttttaaatttataggttagcataatttaaagtgtcaggaaacaaaccttttagatttaatctagaaattctggaccatcattctttaaacagctctgttaacttgtgaaggtcaggatgataaagatctcaccctatgggaaagcatacgtggtacaagtctgtaggtatgaccgctttggaaatcaactgtcagtatcctactaggttggacattcaggcactcagttaaccagcagttcttctcctggatgtgtaggagaaacacacacgccaggaaatgtggccaggtgtgaccagagccgcagaaatctggaaacagccggagcacccatcagcaggtggaaattatattacagtgttgttatacgacaaggagatgtgtcatacagtagtgaaagttagaggcctgcagttatttgcaataggcagatgagtctaagaagtgtaatactgagcgaagtccagaagactcctatggtagaattctgtattaacaaaattcaaaaacaatcagaatgaaacagtgtttcatttggcacacatatgtatagtgaaacctttttagaggcagaattacaaaactcagggttgtggttttaatgggtactccttgtgggagaatgagggtgagatgggagaggtaggtgcagaagatggatgttatcagtcatgctcttggacctgggtgttggcttcatgggtgttcactatgtagttatgctttttttttctttctttcttttttttcgaggcagtgtctcactctgccgcccaggctggagtgcaatggcacgatcttggctcactgtaaccttcgcctcccaggttcaagcaattttcctgcctcagcctcacgagtagctgggattacgggtgcccgccaccgcacctggctgatttttatattttcagtagcgacggggtttcaccatgttggccaggctggtttcaaactcctgcccccaggtaatccgcctgtctcggcctcccaaagtgctgggcttccgcacccggcctgtgcttttcaactcacacatgtgtgcacatatatgtttgtgtgatcagaattacatttaatttcatagataggactgatttcattaatagacaaatgaaaaaaaatcagcagcagattcagggttttttaaaaaatgaatgtgttattttcctttggcttctgtaacaaagtaacccaaagttggtggcttgcaaaaaacaaatttatcctgtcatagttctgggtctggaaatgcaaaaccaaggccctgctgtctcttgacaactgtagggaaggcttccctgcccctctcagtttctggagccaccagcagtccttggccttccttggctcatggctgcaccactccaacctctgccctccatgttcacgtggccgtcttcctagtgcatgtcctcacctcttctaagggtggcagtctttagatttagggtctgcccgacgccagggtgtcttcgtcttaactgacgccatcttcagaaatcttatttccaaataaggtcacattctgaggttccagatagacatgaattttggaggacattattgaactcactgtagtagtcaaaagctgtgaaaatgccttttcacaggaaaagaaatagaaatgattaatagagaaatagaaatgattaatatcaaaaatatgcttaagactgggtgcagtggctcacacctgtaatcccagcactttgggaggccgaggcaggtggatcatttgaggtcaggagttcgagaccagcctggccaacatggtgaaacccctcctctactaaaaatacaaaaaattagctgggcacggtgatgtgttgcctgtagtcccagctcctccggaggctgaggcaggagaattgcttgaacccaggaggcggaggttgctgtgagccaagattgcaccactgcacttcaacttgggcgacagagtgagactccgtctcaaaaaaaaaaaaagaaaaagcacatatatatgtgcttaaccacacattactaaagaattgcaggtcccactcaccccatttttttacctatcagattgccaaagattgtgcgatagaattggtgaggatgtggaaacgtgcatcccctgatactgggagtggagactggtgtgggcttgttgaaagtcgaacacagaaagttactgagtggccttctcttccctggccacagtgctgccctccactcccttctttctcagcctccctgccctgagccccatccctattctgccgcaaaaccactgtgggtgcctgcagagttgggccttagaaacatgccgaggaaagcaagctcctgggggagaggagcaaccacgttccgaggacgagcttccctcgggtgggccgctgccctcctcagccctcagacccgccagtcagactctggctctcagcaaatccctccccagttccttcagcagaacagcaacataactggaggccaaaagaggacctgaaaagatggatgggggaggattgaggcatcctgtggccactgggaaaccgctgccacagtcttctgctcagcagggactgttcagcgtggctccatctctggctcttcctcatcagtctctccccaggggccctgcagttgatgtccttgtggggagtccttgcccttgctctgctcatggacaggcacccagcaggtgcccatgggatagggcttaatagtcgccatcatccagccttagcaaaggtgaagtttgtgctattagggaaggcctaacccaaaacctatcccaattttctatggactaaagataatgtagattaaggttctaggttagtaatgtaaatactcagtaggttatgctgctctgacatacttgggaagcatcatttccagactccaaactaagaggccaagggaaaccctccgtctctcaaccagcagaggcagacaccagctgggtccccagctccactgtccacctgtgctgtgagtgctgtgtgagtggccatgcctgcctgagcattgcacgataggggctgtgtgaaccaggagcagctctggcacagaggaggcgtgctaaggggaaacccttgtggcgaggcccccaccagcagactgttctgaggcaagccgccctcactggtcagatctgaccagatctttggagatacctgtggcatcctgagacactcacactccgtgacaataatgactcagccatacgtaatgtgagtgccataacttagaggacagcgatggtgagcagagccattcctgggggccccatggggatctcagcgggactgaaggaagacaggttgtgtgtttaaagttgatagtactttctctctctgtagaaacacgaagacaccgactgtccctgcgtggtggtgtcctgccctcacaagtgcagcgtccagactctcctgaggagcgaggtaggggcggccgggcccggccgggagtctgtggagtcctcagggctgcgtgcctggctccccttccctgcatagccgaagcctcacgttttcccagttcgtgagagtcatgtgtatggcagacaaacaaaaaccacagcaaaaagccttatgccattttttggaagtcagaagcaagcattagggttaaaagctacagtgtatggccgggcacagtggctcacacctgtaatcccagcacttttggaggcctaggcagatggatcacctgaggtcaggagttcagaaccagactggccaatgtgctgaaaccccgtctctactaaaagtacaaaaactagccaggtgtggtggcgcgcacctgtaatcccagctattcaggaggccgaggcaggagaatcatttgaaccggggaggcggaggttgaacagagccgagatcacaccactgcactccagcctgggcaacaagagttaaactccgtctcaaaaacaaaacaaaacaaaactacactgtggtaaattcagagcaaagattgtgaagcattaagaaaatgggaatattttacatacagtacaagcaaaggtgacgaggggtttttaaagcaattttaactctatagaatagtaattgctgtaagattatctcaagaacatgaattaacttagagacacttcagaaccattttgctcacacatgccgggtggaggacagctcccacattttagggctgccagaagggcccctgtgtggcctctcccaaaggttgcacgtctcacattgcgcttggcactctttctttgagacaggtagattttgcattgacttcacttgatcaggatatgtccagttgggaaaatttcaaggattcttaatgtttctgcatctgtcctgacggggagctcctttagttagtattctgggagtcatctggggctaccctgggctccctggatgtgtggtacgctgatctaaggagccggctcaccttttcacctcagcatttttcaacagcctgaaattttaccactggatactgggtaacagggagaaccagcctcgcatgcccctgactgagcaagagggcccatgtggggctagggccagggactcagggtagaggagggcccagagagccactctcccccagggtgtgccctcccagcaccttgaagctgatgggtgagggcaaagtcttgcctgatgacagtggcctctgggccctgaatctgcccctgggaggagctagggaaaaataaatgtaaattattgccacaactggacaatcctctgttaatgtataaagagtctgtgctgttgaaataatttctttttttttttttgagacggagtctcgctctgtcactcaggctggagtgcagtggcgtgatctcggctcagtgcatgctctgcctcctgggttcacaccattctcctgcctcagcctcccgagtagctgggactacaggcgcctgccaccacgcccggctaatttcttgtattttttagtagagacggggtttcaccttgttagccagcatggtctccgtctcctgacctcgtgatttgcccgcctcggcctcctaaggtgctaggattacaggtgtgagccaccgcgcccggccaataatttcttatttaaaacattgttaaacctgcatttctgttgggtttctgatgaaaggtgcttttgagctatagattattcttgcccctattccagagatcctgtagattccccgagactcagaatactgataataaaaccaatttagaaaaagacccaacaccgaatttactctagtacactgaaaataacatacatcaaacccagtgtgtcagtgtgtccctggcttaacatgtaatagcgttgacactcaggtttgttattgcagtaatgacactggaagaatacattccaagtttttaaatgaacctggttctgcgcagtcttcacactgcgtttccttgccagtcacctgtcacgtgccttgtgggcgcttcctgcaggggcagccggtctgggttctgaggagcagcaagggcgtcaggctgccaggttcctaccaccttgactctgccctggctctgagaccttccttgaaggttgaccctagcagtggccgcatgggcccctcagtcccttcccgcagtgtccctcctccttagtttcgcagcagggatccattttcccctctgttgtaaatatccacctagagggaaggaccgcctttgtcctggtagactgagaagttgtagaacttagctgcgccctccaggaggatgtgctctatgagccttgggaacacatgcatgctggcacacagaagaacacattcccggctgctgcacccacacacccatcctcccaaaaagagtctgttttctgtgaagaagatctatccctagagtttcctgatgggaatttcttcaataaaagacaaaacttctgctcagtcttggggcatgataaagaaaaagaccaaactatacctcatttgtattagcctaacacatgactctaagtccttaaaatgtaatcctttccattcccttttctcttgttagggcatcataagtaatttttatttgataactcaccagcatttgagctgagcaagggacttttttcttgcaaaacgagttacctgctcccagccccacctaattttcctgccatcaattagagttgacagtagtaagagtgtatggttagactgatcttagaggtctttgaaaagctacctgagtttctggcccttacagagggaaaaagtcttttcagatgaaggaaaaactcatctgcacttatctcaagtattatgagtaatggtacattgtgtaagcttgctttgaaaatatatttatttttgtgtaccgtatattaggtgtgtgacccagttgcattctgaatgctttctatttttttgtgttttcatgcaatttttgtttatggtctttaaatgtgcatttcagtttatgttttttctttcttttttaaattctggcactacagatggcatgtcacattgaacaatttgttctaaagaaactggaagtttaagaaatgttatagtaaatgtattcttgtatattggcgtatatgtgtatacacgtgactagaccgtatatttactgcatagaagtctaggcagcagatgatatatacacacctgtagcgataaacaccattcttaatagtacagctcagatgctatctgtgccctaatatgtttgaacattttcatgcaaacgtttgtgccacaactcacgtctctttcccgttgcagttgagtgcacacttgtcagagtgtgtcaatgcccccagcacctgtagttttaagcgctatggctgcgtttttcaggtcagtatccgacatttgtccttcccagtcactgacattctgccatgagagaaagttattatattaacattttaacatgcaagctctggactccttattctttgtcatgaaactgaaacaccctgttgcatgggtgacgaaagccacatgcagcaggtgggatgctcgctttccagttggtggtgctttgagacttcagggagacactgtgctgaggtggaagttaatacattaagagaagtactacatccaaaaccagctagtaatgcaacaggtagacttgacatttggtggggttttcagatagattgttacggaaattttagcagttacctgaatataagcgaatatcaaactgagcatagtttcaacagcgtgtgtgtcagtacacagccataacgatcacacacgtgtgtatccataaatgcatttgatgtacatgtctgtgctgactctgaccccaacgggggacagacgcaaaatggagcacagctcatagagagcacacctccccgagaacagtgtggggagggcatctctgttgctgccgcacatgtagtgtgagaaatctgcatctggtgttttgttgttgtttattttttaacacatctgagattgctagtgaattggaactgagttttcatttaaatatatgtatcttaaaactatcaagaggcagtatatgttacaattaaagtattttatattttatgtagcaccaatacattattatgaagtcagtacagagagattggcatcttagtattttctgaggaagagaacagccaaagagtaagaatgactgtgccttcctttgctttagtctctaacaagactgagcctcccctgttctgtcgtacgtagtatcattcattctctctgtgtatgtgtatatatatgtttatatattgcaacacttatatcaacatatatatatgaatattctatgtacagagtatatgttttggagatcattaaaatgctttctgtggcttcttaattttctaatagcaaaacaaattatatttcagacaaattattttcttaaatatatgaagtacaatttcatgtgcttattcctgactctaaaatggtctacatcttatgtactctgtagattgtatttgttttgtatgtaacttttctaagaatactggaatggtgaagagcaatacatctttggatacagtgtatttgaactaatacattaatactttagtaaattcttttgaatcctgctttgcttacgtgtttactagactgttgtggcagtatctcgctacaactacaggtatctaaacattttccacttatgctatattttaatgggaaaaatagcttataataggtcaagaatgagtttaaaatttaatttcttgatattacaagtgtcaacccttgataagaagccacttgagatgagctgaagggatgcggagataaccctgagatgctcactgtggcactgcagggtgctggctctgctgctcctggcggcctcctcacctgcacgcagtagccaggtggccctgagcacagccctccttaggcgcagagattccctgttcacttgacgcaaataggtctcccctctttgtgtttagtgctgcttttagggtcgtatgttagccgttctgccctttgaaatgcagcgaggttcgctgaatgcctcacatgtttgctctcgcaggggacaaaccagcagatcaaggcccacgaggccagctccgccgtgcagcacgtcaacctgctgaaggagtggagcaactcgctcgaaaagaaggtgggctgcacactttcctgctgctatgggatttgtatcatctcttcagattatttaaagacaaaacctttttgtagttattaatgggttttggataaaagaaactatcaagagaatgtcaaaaaaaactctgtgtgatcttgagcttataaatgaaggtgttttatttttgttatttgttttttaattgccaagcaagtgtgaagtgcttttttaaagtcaatcacattgtgattattttagcatccatccagcacagagatgatcagatgcccagtccccaccctgctgttttttttttgtaaacaaagttttattggaagacagccatccttactcactctgtgttgtctgtggcttcttttgctcgaaagcagcagagttaagagacatgtggactgtaccgcttgagatactgactacttggctctttacagaataagtttgccagcccggacctgggtggttacccctctaaatgcgttaaacttctgtgttttttacaagagacaaacaggaaaaaatatttgatatgattacaattgattttgtcatttgacaccttgtgaaacttggtgcgctctccacatagacagggccacttcccaaagagactctcccatgctgttctttttttttttttttttttttccccaagacggagttttgctcttgtagcccaggctggaatgcagtggtgcgatcttggctcactgcaacacctctgcctccctggttcaagcaattctcctgcctcagcctcccgagtagctggtattacaggtgcgcaccaccacacccagctaatttttgtatttttagtagagatggggtttctccatgttggtcaggctggtctcaaactcccgacctcaggtgatctgcccacctcggcctcccaaagtgctgggatgacaggcgtgagccaccacgcccagcctccatgctgttcttaagaggccttcattgcaggcctataggcgcaggagcaagcaccttcctccagtaatgctggttctcagtggagtttgttctgtgatgttcagctcagtggggccttcttttcatgagaagatgaaaacctctaagaatggatagagaagaagttgttataggatctaccattgtggcttaattacaaaaatataaacttaattcaatattcaacaaacgtctattgagaacttgtagtaggaggatactatggtgaattagaacagccagtggagttgacatttgagtttcgtaaagatttgaatgtcttgtttccagtgttaaatcccagcaatttaaaatgtaaatatactgcaaggagtctaaaattttaaatagaaagatttccctttaatctgccataagagagtgtttcatgtaaatgcgtgagctgagcttgagaagcagcaggaggatcggcatcctgtgcacacacacggagcagaacagcgctgatgagcagcagtgccggactcatattcgcagaatcctagccatcttcccgtgagcatagagcatctgctctgagttcaacaatggtttacctaggaatcttttttttccctctttttgaagctggcattttatttctgtctttttaaaattataggcatagatcacaggctttttatctttcatagatgctgtgtttctcatttagaaggttcttcctttcattttaaggataggctttgtggccgggcatggtggctcatgcctgtaatcccagcactttgggaggccgaggctgaggctgaggtcgggagttcaagaccaagctggccaacatggtgaaaccccgtctctaccaaaaaaaaaaaatacaaaaattacgccagcatagtggcaggcgcctatagtcccagctacttgggaggctgaggcaggagagttgcttgaacccgagaggtggagtttgcagtgagccaagatcgcgccactgcactccagcctgggcgacagaatgagactgtctcaaaaaaaaaaaaaaaaaggaatgggctttgttactgctgtgttagatacacagtagttgaacaggtctgcagcacatggttatccagcaggatggttgtggaccgtggtgtcatctggcagcctttcggggcctaatccctgtggggatttggctccttccttcctgttctgtgctcttttccccactgaaagtgaatggtttgcatcattggaaaccccaggacataccagagcagcctgcccacacacagtgcagcagtttctcactctgtcaatgcctcatgtgtttaaactatctccagccaagtcacgatggaagccccgagagtgcaggatgcataactgtgcacttccctcttggacgttgccaaaggactgatctctcccggactctgtccatcagagcagagtcctcgccctgttgtcaggccagccagctcggctctgcacgttctcattgtgctcacgagaaggtgtatggtgccctttgctaggtccaaaagcaaaggctggacaaacagcagagatatttatgtttacttaaaatgggaatttatttcttattatagaattatttagttggaatttcttaggttattttgttcatctgtcttagaaaatagaatgtttgagcgggttcacaaagactgatcctcagctgggcgcggtggctcatgcctgtaatcctagcactttgggaggccgaggcgggcagattgcctgagctcgggagttcgagaccagcctgggcaacacggtgaaaccccgtctctactaaaatacaaaaaattagctaggagtggtggtgtgcgcctgtgatcccagctactcgggaggctgaggcaagagaatggcgtgaacccgggaggcagaggttgcagtgagccaagatcatgccactgcattccagcctgggtgacagagtgagactcgtctccaaaaaaaaagactgatcctcacattcatagtcaaactaaagaaaaactgcaaaatctggacttaaaaacacccattttatattttaagagagcttaaatggaggggaaatgtaaagcccaccaaagtgggctggagtaaaggatgttctcattgcagagaacctcggacctcctgggccggtgttttgccggctccttggaacacacctgccaggtggactttcctgtgcctatggcatctccctgctagaagagtggaagcagtgatctgcaggacctgggagttggattcttcgattaaataaataaataagtagtttaaataagggaagtcctaaagtgaaagaagttgagtttagtgtggcatgatgtgtgttcattgctgtaagctgcttctgctcatactcaactgcttgatttgttggagagcagtggcgcaattatggctcactgcagcctcgacctcctgggctcaagtgatcccatccagcctccccagtagctgggactgtaggcgtttgcaccacacctggctaatttttgtgtttttttgtagagatggagtttcgccatgttgttatccaggctggtcttcaattccttgggctcaagtggtccgtctgcctcagccttccaaagtgctgagactacacgtatgagccatcacagctggcctattgacaatgttttggagacattactgagattttttcaaaagagttggcatacatgtcatctttttgcagggatatgagaataaagagtctgagaattctgtcccgtctttgacagatggaaatgaatgaattgttactttcagagggacacaactaccacgcgatgctgcatatggcccgctccacattcgtgcaggttgatcacttgtaggagttcatggacgtatgaggcaaggaaggaaggaaagcctttgcggagtaaaatcctaggaaagtgaagttatattttgcccatgagacattgcaagttttgtattccttagtaaatacatacttgttttaaaataagacggtgattgcttcaaaagatgtctcttgacttggccaactgtgccgaatatgaaaaggacacccatctttaggctggctaccctttagatggacagcatcgggagtcagctctttatcacatctggttttgtgccgagatgccctcgggccatcacctttgtgaccattggtccccacgcattggtggttttagagcgtacatcgttggagaggcacacatcggatctggcacagagcttagggtcttctggggtggagaccaccaccccaatggatagacagagacactcgttaatagatgggggatcaagatgccctttgtaaaaatcttgtgagaaagaaaccctcgttggagttacccttgaacttttcatctttgagaccaggtgttaatttgtctttgggagctaattatctttcagaaagattttggaaaggtcaaatgtggggttggaaatgctcactcagcaagccctccctttggctgatgtgggttgcaggggctcttctgcgcttccgtggaagggtatcctcaggcatcagctctgcctctccgtgttgagggtgagcaggctggccccaagggtgtagcacccatgtaattttttgtattctcgtcacgctctcattatgttggcagagctgttcaaactgcagggtgtggcccctgggtggatgtgaaataatttagtaggttgtgaccagcattgtttatatttatggggtacagtgtaatgttttggtatatacacacacacattgcggaataattaaatcgagctaattaacatatccatcacatcactttgtttaaaatctgctcccccagcagtcttgaaacacacgttagtatgaatcacagtcaccatgctgttcagtgggctcaaaaacgtccgcccctctgtctaactgaggctctgtgccctttgcccagcagctccacaagcctacccccactacccacctccaccagcccgggtaaccaccattccctgcttctgtgagcttgacttttttagatcccacgtctaaatgagagtgcatcgtgtttgcctttctgtgcctggcttatttcagttagcataacatcctccagggactagtattttcttaaatgaaatggaataaaaaaaatcagggtgcattgtaaattattagggcaagtacagctttatgacatctgttttcagggatacacacacacgttggtataagtggggtgatacataagcatctgtttcttactatgttacctggtcaacaattgaaaaatactctgataaaagatttgctagtttttagcaaaaacttgaaaaagcatctgatttattctgaaattcaatcagccgctgcactttgcctcaccctaattactggaagagattctgagaaacactgtttatagcattccctattaaattaggactggctgggtatggtgactcacacctctaatcccaactctttgagaggctgaggtagtaggatcactttaggccaggagtttgagaccagcctgggcaacatagcaagaccctatctctaaaaaaattatttttttaaagcctaaccagacatggtggtggcatgtacctgtaggcctagcttactcaagaggctgaagtgggaggatcacttgagcccaggaggtcaaggctgcagtgagctatgattgcaccactgcactccagcctggggacagagcaagaccctgtctctagaggggaaaaaaaagaaagaaagaaaagtaccaggactgtcattttctgtgtgaagggatttttttcttctgaaactctgtcaataagctaacagaaggcctatattgtgaaaatttaattgatattgttgttaattaatatgaaaaccacttttggttacattaattaaagaatttcttttttaggtttccttgttgcagaatgaaagtgtagaaaaaaacaagagcatacaaagtttgcacaatcagatatgtagctttgaaattgaaattgagagacaaaaggaaatgcttcgaaataatgaatccaaaatccttcatttacaggtaagaatcttaggactacggccagatcaaagggtggaggagcttgcctgtgttccccttaagggtttcttagcaaactctttgagctgagtccttgacctttgcaagcagaaaggcaactgatttctctggcctaagtgaaggcttagaaaaggcagctggactagcacaggcccggcctgggaagccgcaggtcagcgttttcaaactgccttttctctggagagcaagcctccacccctcttccatgcctttgatctaccgttggagaaataagatgcgaagcttgtatttgttaaattagctgtttttattatttaagatttcatattgttcatgagtagttgctgtgtgcaaagtctcacttcctgcagtgaggtgctgtgcagcccagctactctgtgtgagctttccagtgacacgcgctcacccgctgggtttcactgtggaaatccacacgcacctccagaagaacaaaccagtgaacctttgctcccctgaatagaggcgatgatgtaaaggggactgatgaaatgtcgcttctcctgtcttctgtcgtcacaggtgtctgtggggtgcttgttaatagatgatcattgtagatgctctctgcacattcacttactcgtgtgcatttgtgatagcacttcccatgggtgtgtcacacaccgtggaagaatcactcatgtcactgaagggcctgaacttagacggtgtgtccctagattatctggaagagaaactacttctaatagcacagagtcatggcatctttgagaatgccttttctccaatttttgacattggagatgagtcatagtgacttgaattgcgtagggatttattaaattaatttcatttttattatattttgtagttatccagagagagaaggagaaaacacaatgaaacattagattgtattagaaaaggcacaagtcattagcattaaatcaagccaaataaagtacaatgtttcttaaaacaccaagcctcccgctggaagcccctagcattttgctgagggcccagtgatgtgtcagtcatcagactggccaaggcgactggtcaggccactgctgcggggccctggccatcctgtggcccgcctgcacctgcgctccctggcaagcagctctggctgttcatgagattattgctgtgttttgacctggggctcagagaggcactggaaaggccggggaaatcacctcttaaaatagccacaacagaaggaagaatgcacaagtactggattcatttacaacaaaaagttagaatatacacagtgatgtaccaacgccccatcccaaacctcacatttcctctgcattcatcttcagtttctccccttccagtcaggtgttgtcatttactttcctttttagtcgagtttaatcactctatggtatgtgatttctacttgaaaacttttgtgattggatgaaccaatgaagcataagtcagaaagaaagggggaagccaagttgccaagggcagagaagtgaggatggagtggtgacggcagcggtcagtgtcccttgacctgtgacgagtagaaggtgatggcgcacctgcctcttccccacaggaggctgggcgtggcggagagcaggttgtgtttagggaagggactcagagcaggctgcccgcgcctgattcccctgagtgcagggacacggctctgcctgaaacatgtgaaaactcttctccatgtgacctgttgagcaggcgtggtctacacagaaggtccttccaaccgtgtggttttttgaaaggggaaattcagtgttacctttgggaccactgtggggttggtggtctttggccaggaggattctgcactgtccatcctcaggaaatgctgattgaaagccttctgatgcccagaggtgctggctgtgtgggagctgcacggggccaggccatccctctgctgctgcaggccccgcctaccctcttgagcagcagcccagctcagccgtgttccccactgtttcatcctcagagcccttcctgttgccccaggaagggtttatcgtaaaatcttactgtggcccagaaaacctctgtgcctggccaccggtcaccttcccagcttcgccccactccctgcgctaaagtggacccgctcattgttccttgacaagctccatgctgctgcacagatgtctttttctcctgcttcccttcctggccagctccaggcactcctccagccatgtttgtggaccagctaggtgatgagggcacacgtcacttggggtcttcttctttcttccttgtctgattctccagtagaccctaaagccctggtgatggcgggagtcgaagcacagagggcccgatggcctggctgtggcagtgggggtgcaggcagggggtcaaggagtggaattcaagagtgtctttgcttttttgcctgtccggggaacgatgagttcttaatattttacttcttaaatatcctgtttttctttattaagaagacagccaggccggatgcagtggctcacatctgtaatcccagcactttgggaggccgaggcgggcggatcatgaggtcaggagatcgagaccatcctggctaacacggtgaaaccccgtctctactaaaaatacaaaaaattagccaggtgcggtggtgggcgcctgtagtcccagctactcgggaggctgaggcaggagaatggtgtgaacccgggaggcggaacttgcagtgagccgagatagcgccgctgcagtcaggcgtgggagaaagagcaagactccgtctcggaaaaaaaaaaaaaaaaaaaaaaagacagcctaggccggtaggccggacacggtggctcacacccatattcccagcactttggaaggccgaggcgggtggatcacgaggtcaggagttcaagaccagcctggccaagatggcgaaaccccgtctctactaaaaatagaaaaattagctgggcgcagtggcaggcatctgtaatcccagctactcgggaggctgaggcagaagaatcacttgaacccaggcggcagaggttgcagtgagcaaagattgcgccattgcactcgagactgggtgacagagcaagactgtctcaaagaaaaaaaagaagatagcataggtgcgagcatgacccaggcttctggtgtcagtggactagatgaactggtggttcttacagtcagggggtccacagggcacacgtagaggagcacgcactgggacagaaggcagggacgtccatccacgcggccttcactcaggctgccggcaccaccgggcttctcacagcgccgggcttgtgtgccagggtcgcagtggcctgagagtgaggcatcacagcaggtgacacggttgcagccctggcatgcaagtgtataaggctcacgggctgatgctccctgaaggcaaaccttctgatttggattgttgatgtggagtgcagtctgtctcttcagctctgtgtcggagtcttttttctgtacaattccatacctgcacttgagatttattttttatagaaactgcagtgactgagtgtagaccgttcttcaaggatgaaatcacgtttgctgcgttttagagaacacttgatgtgactctgcgttctgctttgaaatggtgccattgatacagatgaagtgcctgttttaaaaatagcccgagttcccttgctgctcatggagacgccttttatttagtcgtgctggtctgtgcatgcggtgcacgcatgttgtgtgttcctgactcgggggcccctgctgtgtgggggagtccttgctggagactccccgttctgtgcttgaggtcaggcgtgcccttgcgtagcacaatcgcggggaggggtggctcggtgccatccccctcttaacctcgggggcctgaggctcagcgtgaggcgcagcttgtcttgggccaccctgcctgggactcatgcttcatttcggggtttgctaagttacaaagggcgtctctcagacctctgttgatcaggttttcattaactttcccctgccactcgcgagcacccctgccagctcagtgtgcgtgttagaaggtggagatgcgagaggcttccggtgctcactagaggagccgtgtatttggatgttcagtgtcgtcagtggtattgtcccccagcaaatagacttggtgagctaattaaatatccttctgaacatgtatgattgtgtaaaataaagggacagtgacagtgtcagtttaaagggacagtgacagtggaaagaggtgttctttagagaaattatccttactttttagaggttaactaatatcatgtttcttggaaagaacaggaagaataacactgcttttacgcccaaaaagccacccagacctgtcatgtttgtgtctttgtggttaataacagccagcaaaggtgctgaaacctagatgtttaaaaatagacttccaaaaggagaagtgaattcagggggccctggggcccgcccctcgagcacccggtgtggccctcagcttgtgaggtggctcagtcattccacagctgcattgagcactgaactctccagccatcacaagctgcttgaaaatgcacatcattttttgaagtgaaaaccctttaagtccctggcttcatctcacaggtggacactccagccccttaacacagactgggccaccagggcggagtacagctcccacccctccaggtagtgacaaatatgagcagcctgtgtgttttgggaaagggctttctgaattagttaaatgaagtagcataaagtcaggcctggttactggcagcctcgtgtgttcgtggcagggtttctgcgttcctgcctccctcgctggggcctggcagcctgagtgtggagctggagggggaagacccctgcgtctgcagcatcggcccactgggtttcacctagggcctgaggacatgccttggggccctttcctgccaccatccaggtgggaggggtctgaggagtgggagtcttctcctgggaccctggggtcgttctggggaaccccctgcagccacagagacaggactgtgcttctgccccagacccagcagcagggtaggaggcctttagacgttccaagggaagatgaggccacatgggcatgattctggcatcctaaacctgagaccctgtggcagccatgcagggccacctgtcccgtgggacctgcacttacaggggtgaggcctctctgggaagcagggaccctctgtattatggcccccgaggtatacgagggctgcagaggagatgtccatgggagccttgtggccccgcacaggtgctgtggcctgggagaagagctgggagggacacatgggagtgtgagggtgaggtcggatcctggtatctgaacaggagagctggtggggttggctgatgccagggtgtgggtgtgtgagaaacaggcgggcaggcggcaccagtgccactgtgaaacagggaagcctgctgtgggcagcagaagcatgagctgctgcctgccccagagacagtggagacctctcccctggtcttctgaacacttgccacctgtcactttgctttcctgatggctctctgttgacaaagcaagctgacttagtggagcctcctgttgttttcttccatgtggcttcatgtcacctcgagtgctccctgccggcacaagcacttgatcccagggagctcccaggaggcctgatgcagagccccactcctggagtcagagccgcgggtggcaggcctcatacaggggcctctgactgttctgctcctagcctgtctgtatttgatggaaggtggtgcagcattttccgagtcctaactgtgttttgctttttaacacctttggtttggaagcgagtgatagacagccaagcagagaaactgaaggagcttgacaaggagatccggcccttccggcagaactgggaggaagcagacagcatgaagagcagcgtggagtccctccagaaccgcgtgaccgagctggagagcgtggacaagagcgcggggcaagtggctcggaacacaggtgaggcaggggccggggccgggccagcagtgtgcatctgggccccgggcgagtgctggggcggggtccgtgggatgagggctatgttaggtacatgtgccttaggacagttttttctaattatgggtaacacgcagaggtgtgatgactttcctactgaaagtcccccagcaaagacaaacgtttcccgcgcaggcttgtcccctccgtgtgaggccctacatggtgtagaaagtaggggcagctgcagccacgggaagctgcaaagccctcctgggagagactggccgcagggtgacccacaggacaggcccaagcgcagatggcagaggccaggacctgctggtcggggcgccccagaccccactcctaagggccagggggcagcagtcccaccgcgctctgccagcatgtttctgatccacaagcagatgtgggcctatggctttggggactgaaagagtattgggaatatttacatgaggaggattaatggcagaaaggaacacagattaccggtgtgtgtgtggggccggatgaagcaggcagagaatgaggttggaggagaggggagcagcttcgcctccaagagagcagaggccacctgtgggtgctgaggccggagggaggagtggggagagcacagctgtctcctgctcccaggagctcccaccagcgggcttcccaggaagccacagtggagcactctgtcttggaccctgcagtgaggtgtcctttgacacacaggcaggtcaaccgcccaggacatcccctgtcagcagtctgtgcctagtaatgtgtccagacagacagggctgtgggcatgagagctgtggtagaactggggcagggacctgggctcttccctgggaggcggtggcctcaggacatcttctacacagttttgctggtgttacccccagaaaccacagtgatttttatattgttgcttcagatgctggtatgactgggcatggtggtgtggcctatagtcccagtgctttgggaggctgaggcaggaggattacttaagctcaggagtttgatgccagcctgagcaacagagcaagaccttgcctctttaaaaattaaaaaatgaggccgggtgcagtggctcacgcctgtaatcccagcactttgggaggctgaggtgggcagatcacgaggtcaggagattgagatcatcctggctaacacggtgaaaccccatctctagtaaaaatacaaaaagttagccgggcatggtggcgggcgcctgtagtcccagctactcgggaggctgaggcaggagaatggtgtgaacccgggaggcggagcttgcagtgagccgagattgtgccactgcactccagcctgggcgacagagcgagactccatctcaaaaaaaaaaaaaaaaaaagagccaggcacggtggctcacgcctgtaatcccagcactttgggagatcgaggcaggtggatcacctgaggtcagaagttcgagaccagcctggccaacatggcgaaaccctgtccctactaaaaatacaaaaattagccaggcgtggtggcaggcacctctaatcccagctgctcaggaggctgagacaggagaatcgcttgaacctgggaggcagaggttgcagtcagctgagatggtgccactgcactccagtctgggcaacagagcgagactccgtctcaaaaaaatgaaataaaataacgagtgctggtgcagctttgctttcctaacctctctgacgttcacctgtctcattcaccaaaccctcctcacctgtggcaggcctgctggagtcccagctgagccggcatgaccagatgctgagtgtgcacgacatccgcctagccgacatggacctgcgcttccaggtcctggagaccgccagctacaatggagtgctcatctggaagattcgcgactacaagcggcggaagcaggaggccgtcatggggaagaccctgtccctttacagccagcctttctacactggttactttggctataagatgtgtgccagggtctacctgaacggggacgggatggggaaggggacgcacttgtcgctgttttttgtcatcatgcgtggagaatatgatgccctgcttccttggccgtttaagcagaaagtgacactcatgctgatggatcaggggtcctctcgacgtcatttgggagatgcattcaagcccgaccccaacagcagcagcttcaagaagcccactggagagatgaatatcgcctctggctgcccagtctttgtggcccaaactgttctagaaaatgggacatatattaaagatgatacaatttttattaaagtcatagtggatacttcggatctgcccgatccctgataagtagctggggaggtggatttagcagaaggcaactcctctgggggatttgaaccggtctgtcttcactgaggtcctcgcgctcagaaaaggaccttgtgagacggaggaagcggcagaaggcggacgcgtgccggcgggaggagccacgcgtgagcacacctgacacgttttataatagactagccacacttcactctgaagaattatttatccttcaacaagataaatattgctgtcagagaaggttttcattttcatttttaaagatctagttaattaaggtggaaaacatatatgctaaacaaaagaaacatgatttttcttccttaaacttgaacaccaaaaaaacacacacacacacacacgtggggatagctggacatgtcagcatgttaagtaaaaggagaatttatgaaatagtaatgcaattctgatatcttctttctaaaattcaagagtgcaattttgtttcaaatacagtatattgtctatttttaaggcctcatctggtctctgttttaataatttgtttgtcagaagaccctgaagtatatacctaggtcttttttttgaaagtctctaaattcagaatcattttttaatttaaagttctacaaataattgttactgcaaacattttattttaaaacgttgatagactgatatttcttggaagaaaatataaaatatcaaacactggttatcacttgtgataggaaagagaatattcaacctgttgttatttctcgttagaaatgtaaaccttcaaatatctgtcgtagttaatgacacgacttcacaattctgaacggagcctcgctcatggatgctgtgcatcattttcagatttataattgttttcaccctaaaatagggcatccgttgaactttggagttctaaacaaaatcctgtaggtgtttggattctgccccatgtgttcggacgagctctctgttgctgacagcaccggccttcggtctccatgtcaggggtgggcgggtgactgctgagggaggcccgcaggtgtgtttctccatcccgtcatcttgctgcatgccgtcaacggtctccgaaagcaacgttgtgcgtagagctggtggcatacggcccacgtgccttagatgggacatgctgcttctccaccctgggtttgcattgagcatcattctagaaagtgctagtttaaccagacttttctctccaccactagatctttgtctctacaagggccctcagacacctctgcacctgctgaggggaagccaggctccaccgtcggcttctggagcctccgctgcttaattaccacagattccaaatctctaggccccacgagtgagccgcctggtccaagtacggcctggtcccaccctgagggaggcaggtgtggaacagaagccgagcctctccgtgtccccaccggggccgtgggcacccccacagcccgaagcagaaccctctgagcattccagagaccgctgctcgggggcctgcccaggctgaccaacgggcgctcctgaccaccaccctggcgggaagggtggccacggggcccgtcgtcccagcctgtgcctgcccagatggcattttctcaactcactgtttactgtctctcagtgtccaactgtgattagaagcctggagcctgccccctgcaccccttttgctatgcaccacgcttcatggtgctcttaccactgatgggtgctacacgcgacgggtgcttcttaggcaaaaccaatgtgtgcgaactgtcacacctgtgccactcgcccacaagccgcgcccacaattggccagctgggccgtgcacgtcagactgcctgcctcggctctccccgtggccgcgcggggacagcttggtgggtgcccggtggcccacctgtctctggtgctgccatctgtcctgggtgtgccttcgccccagtgcctgctggaagtgccctccgtcgcacccctgtgccctgagctcccgtgaggggcccgccgcgccctttcgcggtcgaagcgttccgttgttcttatctgcctttcctttccccgctctcctgggattactttgggggaatgagtatccttggttctgccctgtgagggagtcgtgtgtccctgctcataaaggaaggacttcctgcagaagctgcggaaaactactgttccctcgaaggtgtcccccacctgaggcctgtcccctacctgccctcaggtagttttcctgaggccaggggttaacaacagggacatccctgcaacttccccttcacaaaatgtataatattagatgaaggatatgcaacatcttggtctagtaagaaccgtttcctcccctctgggttgaagtcctggtgtggcccccagaagcagcagtgcgtgtcactgggacgtctccagtagcccttcccaggcagacgctcctggcgggacgccatggggcccacctgagggtcccacagacgtaacctgagtgacaggagtccttgaggatgggatggcctatgtcacacactttgtccttgaacctgagtgatgggggtccttgaggatgggatggcctgtgtcacgcgctttgtctttgtgtttggttgtatcggggtctctgttctgagtgtgtcttcctctcatgtactcaacacagtgggcagcagcctgggacggcgtcccctctcccggcggcgggcaagccttgcgctgctccaccctcggcctgggcaccctcacttggcgctggccacctgggccagcctggggccatggtctctctgcagctgaggcccagtggccccttgggcagtgatcggccctccccgcatcacagggccctggcagcaagcgggaaatgggggcgcacactgtgtgcttgggggtgctgcttgtttaccacacatgaccagactcccagcaggacagagctgctcagtactttacagaaaccaactgagtcgtttgtgcatgaattaagccggtctgcttccccgtcaccttcgtaacaaaacaacgtcccctctcccctcgcctcgagcagtttcttcaggacaccgtggctcgggctgctccctgctgccaggcacgctggttggctggcctgggcccggctcacgtgaagggcactggctcttgtgaccacactgagccacgtgcaagccgcagccgggcctggaagcctgaccctctggttctagggcttgtcccgcggagcctgcagagctagacgttggggtgtgtccgtgatgatatgggggccaggctgggagtagggcctttctagcagggttgggtggctcagtgagggtgtggaagtgggggacccacggggcctggctttgggactagacatgccagccccagctgggctggagggagcctgagtgagccccgacatacgctgggcctttcagctcgccgtgctctggtgacacacaggcggccaggttgggatttgtgtcaattctaggagccatcaagcatgaatgtggttctgtctcctgagcgcaagcctcgccggacccctgggcgaaggcctggacttgcagatgtgtgttccctgtgcgggtggacagagggggcccttatgacccacattgcagccccattccaccaccccttcctccccagagcagtctctgccgagggacagcacctgtgtcccttcgatgccacaacagccagttgaacaggggagccctttgctcaggcagcttctcctgcctctccctcctttctccttccctgccccatccccgtgcccttcttggcctgtggcgctggggagccatggtgtggcatactggggctcctgctccttgggccacttcctcagcccgggccccacaggcccaccacctgccagggctcccactgcactggctgtggcaggaggcttccccatgaccccgtgtggcccagctcggtgaggatgcagttctaggcacagcccctgggacagccagctgcctcccagaccacgtcagcctgctccagggtcctcagtcaccctgggccaggggccacgtgtcccatggatgtcgaccatgccaacgtcacattccagcaccccttttgcttgatggcgtctggtggtagtcagcatggtggacccacatcctacagccagaggtgatgttggacaaaggaaggggagtctggatgggtccttaaacgaccattctgtccgcagcggggtcattccttgtcagcccaagggagggccggggagtacactgatcccaacagctgggctgacacctcctttctcccctgcacggggaggattggcctgaggaccgtcaccctgtgcacagccccagtagggtggcagtgccactgtctccttgggccgttgcaggattgggcgggtgcagactccccttgcgggccccttgctcaatccccggccctcccagactcctccctctactgggggtaatttgtgtgtcagaagggctctggcagagctgtaaaatactgttttttaaaaattttagtccagatctttacttattagactgcagaaggagagctagggagagtgggggaagcccccttgcttttgtatctgtgaggtgaatgagggtctgtcacccaaatctacttctcagcccatgaccatagttctgttttccgtttgcaaatctcagtagctctgttttctccaaagtagaatgtgcgcaccggggtcctagccaggcgaggtcagtgtcggcaggctacctggtcattattgctgcctcgtccaggctgatgctgatggtcacaggcacggtggcatcagggagccgggccagcaggcggcgtgaggcggggccagcagctcactgcaagggcattttccacctgatcctggtgtgccccacatgcggtggcagggcagacgtgtgaagcctcggccgtctcggggctggcaggtgtgcgggtgaggaggccccggtggccaagcagagcctgcgtttcatttctcctgctgcactgtgtctagtctgtcttgtgaactctcaccgtgaaaagaggctagaagtccaggatcgctgtaccgctcctgtaattaggtgatgactggatttgacaacttagtcccctcagacaagtaagataccctccaacagcaaattcaatgacttaattggaaaacacacaagctggcatgatgtccggtgatttctgtaagaaatgcctgtaggagaaggtctgtgaagtgtggagggcagtgtcgacgctgcacagcatctgcagattcgcagcctcttctctgccggtgcctctgttcggttctgttacccaaaaacaaagaccaaagaaggccaatctctcatttgaccctgtctttttaatctgcctgttttaaaagttgcgtctgtagtagccgcttgctgtgaagacacatcttgacagtccaagtgattttgtgaccagtgatttgggtcctgttttccgctcttctaagaaaaaacaaaaagaccgtgagttattgcccagcaataatcatgttgttactgtgagttagcaacatgcctgacttcctgatagcattactgttttctagttttgtttattgtatattatgtgtggttttatttggtatttatttgtgttttgaggtcttgcaatgtttttgtgtttctgatgctaataactaaagtttgtaagactgtagaatgcaaaactcggagatgctaaactgtcttattagaggaaaataaatctgattatggagtctca

SEQ ID NO: 2126 - DNA, 134022 bp, Homo sapiens; identical to SEQ ID NO: 2125
  source 1..134022: mol_type = genomic DNA

SEQ ID NO: 2127 - DNA, 134022 bp, Homo sapiens; identical to SEQ ID NO: 2125
  source 1..134022: mol_type = genomic DNA

SEQ ID NO: 2128 - DNA, 134022 bp, Homo sapiens; identical to SEQ ID NO: 2125
  source 1..134022: mol_type = genomic DNA

SEQ ID NO: 2129 - DNA, 26547 bp, Homo sapiens
  source 1..26547: mol_type = genomic DNA
tattttaatatatatatttcattttaatgaagagtgctttcttgtagacattgatgcagtacatagggctggtaaggaagtagtaacagtgcggagggggtaagtatgtcagtctggcatgttttcttctaaattaatattcaaaaaggtgccattcaaggaacacttttggtcataccttgcaaccagtactgagacatgacataaagttaaaactccaggtgcctttttgagataagtgtgaatccacattcacaacctgggttgagaaaggtcacacttctctacttactaaaatggagtccttcaatcttaagtcagcccagcaattcagttgtattgacctgatggaggccatccgaggtttcactgccattaggagcagggcttgttttatgcgctccgtgcatgctgatggtgcagggagtggtggaagatgtgccacctcaaatctggataattcctttaatcccttccttcaatacaacctgctcttaaaactgaacactgattttcattcttttcatgattagtgtttccccacccttatctttgcattcactccctctcataaaggatgcattttcagagtccagatggattaggataactgcttacaaattccatggcaatagttaagttctgaggaaaagcaggctttgtgataagaccactggatgtctttcaattttcaaaagtcagatttcattccacagcttgtcatacagtttacagaattatgagaatcctccctggattcacagtgtctttcttaatagagtcatacattaatgaatgttacccattatttaatatttaaatttcaaattctagtttctactttacaaggaaaaggacacgaagacaaaactgattgacccatggtcagtcaggagaaaatgtgtcttagctcctaatttagtgacctatatgctaaattacaccttttcatccctctgagaacataattctggaagcttgtataaacaaaataggccccaaattacattctcaccacagaaattagataatttatcaagtgcaaaaagaacacgagaatattctgcacaatttatcaaggaccttcaaataaatccattacaaaaaataccccttcaggcaaaataaataagactgaaattcagcataacaaatttgcaaagtttaaaattagcttaacgtgagggctgcaattccagttacaaagcaaatgtcccaagttcccccaaagaacttaagacaaattgattaaagttgttcagttattttagaatattttgtttagagaaaccaaacttgaagtctcattaaaagtaacatctatcaagtgataaagcaaatgtaacataatattactgcagattctaggtcgtagatgttcactatacaagtctttcaacatttctgcatgtttgggaaatttcatcaagtgctgaagaaaaaaagcaaaaaaagtaacatctgcgccttaccatctaaaatttacatgacaaggtaccagaaattggtcagcttcaactgctgctttcaataaatgttcattattacgtatttgagtgtgtgcaacgtgccaggcactgtggtaagaagaggggattcagcagcaaccagaacacatccccattccacacagtttaccttctcctggggacttgcatagaagagaactatggtcactgctgcttgggcgattgtccgagtgggacagcacctaccttcagagctgcagacagtaagagcagaggcacatgccccaacttccccatcttaaaggcagggctagtgtcctgctgagaaagcactctgagagaagaaaagcagcaccacatctctcatttcctaaaatgcttttcccacctagaattatttttcaggattttatgacccgaatttcctgtggggaaaaagctttaaaatattacacacacaagtgacatttagtgaaacaaccaggcacctccttgccaagtgtccgtttttgactgaaagtgaaggctgtaattgagtgtcacagtctgccaagatccatccaatttgatttcatcagatcatctttctggatactgggaatttgtaagtgccaagtacactctacaggcacaaagacagaaacagagaaactaacttacagtccatcatgtcaatctgggagtttagaaaaagcacacttcaaaataaaaatataaatgactacttatggctccttttcatttccttaaggcattgcactgtttaggttgtaagcaactaggcatcacaaacagaatctgatgtttttgttttgttttgtgagacagtgttgcactctgtcacccaggctgggggtgcagtggcatgatcttggctcactgcaacctgtgcttcccgggttcaagcgattcccgtgcctcagcctcccaagaagctgggattacaggcatgtatcatgacacctggctaatttttgtatttttatagagatggggtttcaccattttggccaggctggtctcgaactcctggcttcaagtaatccgccagcctccacctcccaaagtgctgggattataggcgtgagccaccgtgcccagcctaatagtattttatataaaataatgagtagaacttgaggcaagccaagagaacagtgttagtacatacaagcaattgttcctctgtaaaaataatgcattctaactgtatacataattcataagcatgcttagtttatctaagacttactggtgtaaaaacggtaatagagaattatactgtgacctgtataattttatatgggtcacaataattaactgctagagatcgtccagtatctctgtattattccatcattagaataaaaaacacctgccttcattctgtttcacttttttctactatttatccccaaaataaaagttaaatcatattgtagtataccaataaacagtctttgctgccaatagatagtaataaactaccaaacttcaaatcaacattcagacttgtttgccaacagcaaaatgtatgacgtgcagcaagtttcatccaacagtgggttggacgctgggcgtggtggctcatgcctgtaatcccagcactttgggaggctgaggcgggcggatcatctgaggtcaggagttccagacgagactggccaatatggtgaaacccggtctctactcaaaatacaaaaaaattagctgggcgtggtggcgggtgcctgtaatcccagctgcttgggaggctgaggcaggagaatggcttgagcccgggaggtggaggttgcagtgagccgaggttgcaccactgcactccagcctgagcgtcagggtgagactgtctcaaaacaaaaaacaaaacaaaacaacctttagttgaacatctccagaaaaaagtggaaacaatttcttttttaatttagcaatgtcccagaatgatgccaaaagataaatatggtaaaaggtggttagtaacatacaacataaagcccaaaggcttgtatacccaactgagtgaaactagcatgtttaagaatagagtaggagattgggaaaatgtaaggaagaaaccaactttccaggttaaggcttaattctgattgaagtaaaaagttttctatttggaatgacagcttgactattctactttgtagtcaagatgaatgaccagcataaaataactggctggtttatgacaaaatgccaaatgttgggggttaaaattgctcattttacttaagatgtgacccagctgatagacactaaattagaggaaagtatcagtgtcagcaaagagtaagttaaagacattttatactggcaaaatactttcctaagtattgtcattgttctgctggttggaacttaatttgagacagaatgttatggctggaggggactctagaaatatctggtccaaatcattttacagatgggaagcttgctaaaagctgaaattaggcaaaacaacttttttttttaataaagactcttgagttagtagaaaaaaatagtatcaccaaggcaggaaatgactcctctttgtatctaatgcacagccagtgcttttaatagaaatctgaccaggaagcttttaaatatcatttccttttttgagctgggggcgtggagattaaatgttttgtggcaacatttaatttttttctccgataaaagtacacatttattgtagaaaatgtaaaaaatataagcaagcgcaaaggaaaataagccaacaaaaagtttagtatatttccttcaggctttttctacgcaaatacaaaaatactactgttcagtttttaaatggaacttgacaattatttattcattgtaaaataatcacaggaacagcagcagtgtaggtttccctacctagagggtggtatgcagtgattctcaggcgctggttggaaggcacagctgagggacacaaactgccaggaagtaatgtggtaactagccatgagcttgtggtactaatggtggcacgggaaacaaggtctctgcttgacttttattttcactccataacaaactcaccagatcaggagcctaagggtgggtggggagggagaagagagaaaaaagcaaagggaaagttcaaagtgacactcgctggggctgaaaaccacactcccctgcagatgaggtccttggctttctcttgaaattaaggctgatctagaacgctggctggcgactctgatttggcctctctgggggatacaatgtcatctctcattaccagacaactttaaatggtggatggatctttagatcctttataagcttatactagttgcgggtctccctgagaactagattccacgatattttatatctatatataggcctttaacaaatacatgatggcacacaaaaaaatcatctccctattaggaaaatctggttacttccaggattctacaggatccttctcagaacctgcagttgttaggctacagcaacatactcaagctaagttgtgatacaaccactgtgacttctaatcctagtttggtgacctcctaggtatctccaatcatctcccaagttttaaaaaattctgattttaggaaatcaattttgttctttttaatcgaaataaaccagagggtattcaaaagagctgaaaacttctggctcacatagcttctgtcaccaccaatgagatgccacatgcgctgactacttgggtcacttttaatttttatgttgctgattgtatgtgtgcatctcctgtcttgtaagcattaaacaaatgaagacatatgcagagctgtgaaattcactctgcactgaatagacaaaaagggttacatagcataacaatgagcagttggtatccacgtggttctcagcattataaactctggggaagatgctacttcgtaacctcaaggaaataagtaagcaaggcagaaggaacacttaaacaagtattattcaacagacatgtttacactaaataattaaggttatatttagggtttaaactcatccctgaatatccttagtaacaacctggaggaaaaactggggtgaatgagaacttaagttttccaaggattatggttcaaatcctctgaaatctataacaggttaaaaaaatgagaactcaactttctagagcaataactcttctcgagggcactagcacaaggcggtagtgattttcacttttaatatattacatataatactacaaaaagactgaagttttaaggaaaatccattattattaaaagtttagtactcttgagtctggactttctgacaataaaatacaccagagcaaaagcccaagaaagtacaacaaagaggtatactaactggcaaaatagctgctgcaacatgccacaggcacttcaggcctaacatttctgaaaaagcatggaacgtgtggattcccaggaaaaaactgcctcagatcatttgtaacaggaagaaatagtaagtgacctctctaacaacactcactagtagatattacatatttcccgtggcttgtttgtttgcatgttattgagaacagggcaaggaaaggcactgttttctccaggtagttgtttttgagcaagtgagggcaagctatacccctgcatcagtacttcgtggctgaaaaccctccctccgaaggctacccatgtcaaagcgggtggagacctcacagcgcactaataatgtgtcatccttaatgaaagttctttgtcttagggcttccagatgcataaaagttacatagccaaaaccttttgggttccgtgggattgtgggtcgctggaaagcaagcagctctggtttggcatccattatctcttcgtggttttgccttacaggtgcttcagactgatcaagaattgtaaggcgtattgtaccctggaagggccaagggaggtggctgtcatattctccttgcattgtgtggacaaaaagggatatatagtttgcacagcgctgagcagtcggtaactgaaggtgcaagcgcatgcacagtttgtacccgggtttgccagtgtagaatccagggctatgaatcacaacaggtttctcctcttcttgacatttcaaatgcattccaaagttgccaatcttccaaatataaattccattgcactgctgtgcttcgatttcagcaactttgtcctcaagggttcgaatggttcgtttgagctcacttacatacatactctgagtttccattttagcagtcagctcccggatttgatggtcttgtcttacaaggcgaccctctaactggtgaatagtttcctggaaattccggacctctgagatatacccagagtcgggtataacgctcaaactatgaacagcctgggccaacattctcatgtgtgactgggtgttctcttgtaggtggcgtgccaagtgattcctctgcatctaaaaatcaagcacaagccttaggctgggaatagataccgtgaggagtaggaaaaggacctggccaggtcaaataagaagttttcaagtagtcacaccacttccctcaattctctacaattttcctttgccttcaacagattcttgatccaatgaggcgactctgcctcttagttcactgaaaaacagactatctgatgactactctcccagctttcactcacataaatctccctcccacctacaaaaaatgtatttacacacatccttcttttctaactgagatgcctgtcctctccaagattaacattctacctgtgctctaaatgttacctgacctgttgcgacaccccagagattttactcagtgatttttcttcatctttaaacatctcttcctctaacactttcctttagaatacaattattgaagtctttcccatcaaaaaaggacaaacctctctgaagagcttttgtctctctctagttaatattaataccattttttttaaagtcaagaatatagtctacctgtattgtctgcaattcccagtatacaaatctattgcaaattggaatttctcctggcaccatgccattctaaggtcattaagaacaccctattatacgaaaaacattcataatacaacaatttttattataaaaggtcatatagtctttaaaaaacctagaaaatatagatgaccaaaaagggtgttacctaatatctcacctaacttccattaacattttatttctttctttttctctaagcacaatacagaattttcccacaaaatacaaccataccattttgctcattttattttttaaattattaaatgtatgtttgttacacataagtcagggaaaaaaaagtataatggaaaaccaaaagtgtaactgcactctccaaaaagaaagacatatcataaacaatgatcaatctcagacatttgacactactgatcatgaatcttgaaactaattttggagaccataatactactttctctttgcctggttcatctgtttcttatactgtttgttcatggctcttttccttggcatacttctctttcctgtacatacgccatatgatctcaatcacaacttccattattaccacaaatcactttcccaaatcaatactctgagtcctaatttctctttggggcttaagacagcacataatgcatgtcagtcatcccacctgttccctagctgggtgaagtcattatctgtaattcaatacattaaaacagattttttttttaaactctacctccagtcagttcttcctgtgttcactcttttttgccgaatggcccttccatctacccagtgacaaaggccagaaaccaagagtcattctagacgcctccctctccttcactcatcacatttatttagtcacacaggcagtagatcttctctcctaaatatgtactggctcctaggtctatcttgacggtcatcgccataattcaagctgtcttcacttaggtattccaacagctcaggtactagtacccccacctccacctcaaatcatctacattgctattgggttgaactagcacaacacaaactacttgtagttcctcaaatcaccatgctcactctttctcactggtcttctctcctttgtcttcttggaaaactatttcacctgtcaagattcagcccaaagcatcatgttttgtcaagtctgtctgaatgctttaggcattgctaagtatgcctttgcttctgctcacagcatccatgaataactctattatatcacttattacactgctttacaactacatctacattcttgttgttattctccactacatgatgtaaatatttttttttacttatattcaagaattaaaagaaaaaaaaaccttaccttttcatggcaaccaaaagtactgaatgtgcatggaattggggctgtagggcagtctagatcataatgattaggcatctgaaatccaaaacaaaggctgaaaaatctcttccttgcatatcattttctagtttgatgcgatcacatttaaactgtattgtcaatggctgctttgtaccacattggcagttgaataggtgcagcataaaccatcacccacaaaaattaaaagaacatctactttcaaaagttatagagaaaggaaatatcaacatctcataatatcccctccaattatccaaaattcatttcaagaaaatgaatttgttcctcttgctgggaactggcaccctctagtggcactttacagaaaaaacacctaacaatagctacaagtgcaaactggattaagactcccactatggtctaggccatttaataggaaccagtcaactgcatgcactgaagccactgactacacccatacttgcctcatgaccacctctcaaaaatcatctttgaccacctttcaacaatcttcttaacttttgttaagctgggcatattttagctacaatggggagactcagatgttagaaggtactttaaacacattaatagaagctctaaaaaaagtctcagtcctggattttgggactctaagacacattctctaaggtaagatcctttatactcaatcatattttttcaaagaggtgccaaattccctttagaaatttaatgtagctatagttgtagatatttcaaacaggaagtacctgagagaccatttattataattcaatccttcatttctcaagagggaacagtgtagaacaggggccaataaaattttttgtaaaggatcagatagtaaatatgggctgtactgcctctgtcctaagtattaaactctaccattgtcatacaaaagtagccatacacaagacatacacacatgggtatgactgtctttcaataaaactttatttacaaaaacaggtagagagacagatctagctggcaggccagtttgctgatcccagatctatttagaatgtcaacttgttaaagatgagagggcacagttaaaatcacagtttaaacctaggactaaaacccaggttttctgactcttagcctagggttttttcttgtattttcttttgctgggttttaatttgttgcatggtttcctttaaatgttaaaagacagcaaaaaggaaaacgagttaggacttcataagcaaaagatgtttaacaccttcaaattaaggctttgttggaaaaattaagagactgttaacaaaccaatgaaaaagttttaaggttaacaaacttgtccagtgacaggttttgcttgctgcttctcagtaaggtatatcaataatgatctctgggtttacagatttcatgggtatataaatatttaatggttaatattcatattttgtgggtaaactccccaaatgtcagaagatagcaatcagatggaattttcctttctctactaatagtcaaaacaatctttgggctgggcttggtggctcacacctataattctagcactgtgggaggctaaagcaggtagattgcttgagctcaggagttcgagaccagtctaggcaatataacaagaccccgtttctacaaaaaatctaaaaaaataaaaaattagccgggcatggtggtgcacgcccgtagtcccagctctttgggaggctgaggtaggaggatcgcctgagccaggaatttgaggctgcagtgagccatgactgtgtcaatgcactccagcttaggcaacagagtgagactctatctcaagaaacaaaaaaaccccaccatataattttctattacaattactacttctaatgatgcccggtcagtggcctacaggacaactgaacagaagggctacaggtcctaaaaatctgaaaacttccctgtatgcctcagggattacagctacaaatattattctcctactgaacagaactgccttcctttatttcgctgttccctcttattctttcagccaatctctggacacttgagatcctcatttcacagtgtgtaaatatatatatatatatcttagttttttctttctttaaatggggacccttacttttgattatttttatcttaaaattggttttgttgggaatttttatgaatatacaaaagcacaggtattatgttaatgacttaggaattttaagtacttaaaaagggctggatgttttgttctccctgaaagtatttattacttatattaatttatataaaaaattttcacacagctctaatacttcttcaatctgtatttctttgccttattgatttaaattttcaattaaaaaacctaattcacttctttaagctgtttatgaaaataataatttatgaaaatgaataatacctgttctctgatgagtatagtattgcagtattcacagatgacatttgccaaaggacagttctggtcatggatctgaattttattagagaaatataattaaagcatgagaatatctgaaaaagtgaaaacaactaattttgataaaaagcaatttttcactataaacaaataaggacatcaatttgtacaaagcaaaagtgagtgaaagtgagagtaatatataaaggctattttctttctctttcccagtgtaataatgagattcattcaactttccagctctttaaaagagcagggtagtatataaaaaataatttttcaaatcccttccttttatcctgaggtggtacacctgtatctactttggacatcatctgccgaggctatacttctccaaaggtaatcttacaaaaattttcagcagcagcatgacaatttaattaaaatttcttgtcagtagagttaaagaacaaatcttttattaggacatgaggatttggtgctcagtttctcatatgccccagaagggtaagccttattttctagaatataatgactttagttgatgtgctgagaaataattagccttccaggttaagtcaatctaatttactaaagtttagaaaggagttgtcgggccgggcgtggtggctcatgtctgtaatcccagcattttgggaggcaaagagggcagatcacctgaggtcaggagttcgagaccagcctgaccaacatggagaaaccccatctctactaaaaacacaaaattagccgggcatggtgatgcatgcctgtaatcccagctacttgggaggctgaggcaggagaatcgcttgaacccaggaggcagaggttgtggtgagccgagattgcgccattgcattccagcctgggcaacaggagtgaaactccatctccaaaaaaataaagaaaaaaaggagttgtcattttactctaattatgactgagacttctctacatttataccaagttagctaactttttttgaatattttatcaatgtaatggataaaatatgcttgatctcaaagtggggaaaaactgccaacgtgaatttataaaaactatagtttaaggaagtatctaagtaacagaataaaaacataaattatatgtaggttattttataaaagtatacataggatagggatcaagggcttcgatttcagggttagctttttttattggcaatattaatacaagtctacttaatctatctcagtttctgaatataaaaactgtcctataatcatgatgctgttaggcactaccaagtttctttttaaaagataaacttttggcctggcatgatggctcgtgcctgtaatcccagcactttgggaggccaaggcgggcggattacctgaggtcgggagttcgagaccagcctgaccaacatggagaaacctcgtctctactaaaaatacaaaaatattagccgggcatggtggcacgtgcctgtaatcccagctactcaggaggctgaggcaggagaatcgcttgaacccaggaggctgaggttgtggtgagctgagatcatgccattgcactccagcctgggcaacaagagtgaaactctgtctcaaaaaaagaaaaaaaaaaaaggataaacttttaaatttaacatacaaaatgagaagtaaatacattatatacgctgcacgataaagtatcatcaagaaaacatactttgtgggtttgatttattctttgtaatagttagaacaacctattctgtttctcagaataattttgtgtagatcttatcttaatctacttgtttgtctccaatccaaaattggttattaaaatatcacacaggaaagctgatcggcatatgcctttcttagaagttctgttacttgcatatctacaatagtgataactagtataaatgtttttttaagaaagacatgcaaaacaaattctacacttatgtactaaaatggcttattgaaccttctttttcttaaaaatcatttttcccaaaattgataatgtagactcagagtcggagtcacatccttatctactgctaaccccctcaagtacacatttaagaacaatattttaagaagtagtgaatttaacaaatccaagttagtacatgcctctttatcttcaaatgccattgatgcagcacagttgtcacaagaaacctgtctccttggacaatccttcagaatgtgaatattaatatggaatttttggaagggacgctggcattggggacaatccataagagcaaactcacaatgtgcttgatgatcctataattaaaaaaataatggattagcattagccaactctgaagtcttctacatataagctctcctaatcatatactgttctctttcagcaggctactgaacctactttgtctaatgcacaccacagaaccattcacaatatgaacgtctttagcgaattttttaaaatggtcatgggttgcaaatttatacaaaggatgtgaattctcaagttcatgcatccaactagcaaagagtgttggaaagaagtcagatttcctatttatcaatttattactgtgtcaaaaaggccactctcttttaagagctaataagtaaaaggagcaagtagtatatctgccttaaacatttaatttcaaatataacactaaatttaatttctggtaaaaatcaccaagctaataattgatctatttagtataaaagcaaattattttataatctgattgtttctgttaatctgaaactataggcgtattccacttagttcataataaaatgcacaatttagaaaaacagaaaaaagtataatgaggatactgagatgattacttgggaattactgcttatttcaaaatgacaaaaatgaaattgcaagattaaaatgtgacacttgtattttttttttttttttttgaggcagagtctcgctctgtcgcccaggctggagtgcagtggcgtgatctcggctcactgcaacctctacctcctggtttcaagtgattctcctgctttggcctcctgagtagctgggattacaggtgcacgccaccatgcctggctaatttttgtatttttagtgagagacggggtttcactatattggtcaggctggtcttgaactcctgacctcgtgatccgcctgcctcagcctcccaaagtgctgggattacaggcgtgagccactgtgcctggccgacacctgtatttaaaatgctcctcaggtttactgcagataaagcttaccaaaagcttatgaaacaatactgattttttaaaaaaattactgctgggcaaagccagagtagataaaacagtatatttctggtttctacttacatttatattcaataattaaagggttggcattaattcagcaagaatttattaaccaatcatcatatgctaggtactggcaatacacagatggacacagcaaagtccctattctgtaggaacttccttttatacatgtgctaacagctagaaaagaactttaatacctcaagatgtctcagttccatcttgtgcaaacaaccttcatttggacatttcaccatcagagaaagaatctcacgttttgcaaaattgtctggaaatagttgattttccagcagtatttcattgtcaactggacatttgtgacctgcatccctaacagaaacaaaatacacacaattagatttaaagactcacattagaaaatccaaacaactttaattcaccatatataaattctccatttactgtttcataagtaaaaacaatttaacatattatattgcaggtcaccaaaacaaactgtccttttatggagagcttacaaactgttcttttatgaaatgagtacaactagcatactgataacctatcaaaagctaagggatttttatatggtgggatagattccagctttttgagaaaaattagctgaataaggtattttgattggtacaaaatgaagtgaaagaatgggaattttggcagtctggcctctgtgttgtcacacctatataatacactagaaagatggaatatgctgctcacagtaccaataacatgtctataatgcaattgctcagtcataagtaaaaatttaagcacttagcagtacctccgtgaggtcacattttaaagtttactctgaaatagtcactataacactccagctaacaggcaacaaaagtttcctttatttgtatgtctagggtccaatgttacagaaagttaaaggacctctatgtcctgcttctcagtggtttattctttcttatgatggaaaaaactatcctcagaaaaagaaaatgggattgtattgagatgcactttgattccttgagtgaacatactcaatgagaaatttcagagcagttcctttaagaacactggggctaagtgttcatttttaaaaagcttacagggagacagaaaaaaaaaagcctcagacttctttttgtgggttgtatttccttttcagaccactgtcccactactttcatgaacatcttgctattaaaaagctgctgaagattagctaccttcctgggcatggcagtgagccgagatcgcgccactgcacttcagcctgggagacagagcaagactccatctcaaaaataaaataatgtggaggttgagaaaaatctacccaaaatagatcttgttaagtcagcgctgtgtaatacatctttccccaaaattgaaacagcagacattatcttttgtgatttaaattaagccaagtcccgagtatggatgtagttactcttaaattcaagttttatagaaaagttaatgtaaaagttggcagataaaaactttggagactaacaaattgccaggacagacttataatgaattcactaatataactagatggctatttattgaagaacataaaatctgccccccttcatccaattttttgtcctgtataggactccttagttacctacaaaattcccatgtacttttgaattatagtaaaatgtatctatttccatggaaattgcaagtactttcattcagttaaagcaaccatgatttactgatcatctactatgggtcaggcactatttccagaacttgggaaaaatcaagaaataaaacagatctaatactttgctctcaaggagcttatcatccagtggggcagacaataaacacataaattatttggtgctttagaaggcagaaagtgctaagggaaaaaagaaaattagggccaggtggagagattgggattgttcggcaagaaaggtggaaccacgctgtggtataaatacggtggtgaggggacctatgagaaggtgagatttgagccaaagtggaagagttaaggggttagctgtggcaagagtgttacaaacagaagagctaaagccaccactcaccaaggcaggagcatgcctgacatgttcaagggatagcaaagagggaatgaatgggtagaaggacaaagagtgcagcagaaaagaggtcaggaaatgaatcatgggcctatcacacagggtcttataaggattttagcttttactcccagataccctgctacaatggtctgagcagagatgacatcatcttacttattttactaggtccactcccgctgctgtattgagaacagcctggaagacaagaatagaaagcaggaggcctgttagagagctggtggtgagtcacaacagggtggtagcagagggaggaagtgagaagggactggattttggatatattatgaaggtagagccttcagttaatactttctttaaaaatactggtaattttacagttgaccatacactttaggtaataaacaagatttaacatgcctaaaatcacaataactgatcacttacagagtcagtattctttgtgtggttgagattatccttatctagtagcatcataatttaaggtacatttaaaaaatactattttctttaaagcatagagtcactccccagtctgcattagaattgctttaagtaaaagtagcaaattatttacttatttatccaagggtcaagagaggaggagattcaagtcacttttcacacaacagtggaaactgggataagaatctaactttctcaattttctgtccattgttcttttttcctaagtagctttttatgtgtaagactacttttgggatgttccatgttctatgtaacaatgttctctgcatctggttctgttataggacaccattttttcttatgctcacgtaccttattgattttatgatgcaggctttgcagaacctatggccgcatggcgtttgcactgcttctcgtaatgccatcaagcagatggggcattcatacttgctttccaggggtgggtcaaactctacatcatatccctggatctcctccataaatgagctggagaggttccccgtgctggcagttccacccacactatcatcttttgttacagcgctacaggagctggccatggccacacagcagtcactttcagactggctggatccacagctgttttcacagtttagcagactcatagtaacttgattatcacttgctctgtagaaatagcaagaaaaaaatgcctttataagtaacacacacactcacaccccacacatatatatcatagcttatctatacaagtcactttttaattcatgtacatcagctgtattaatgttatttacagaaaacttttaaaagtgttttgagctttttcatgactattataagttacctgattctctccttcaataaatatatatattattatttgtgcaaatcacttggagcacacaaagaaagctgggtcccttcagaagttcatgatctagtagaacgacagcatataaagttaaaaaaggagaagcacctcagttgtaatactcttctatatcacaattatctgtttacatgtttgtttcctgtgattgagctaaatattttaatttccatttccgcagtacttagcacacgatttttcatacagtaagtgttcactaagcatcgctaaagaacttatccatgttgttgaagttccttgaagtatcctgagctgaagggaatagtatggctagcagctcagtgccaggaaaagcagtacgcaaggaatcaggtgatcatgtgccactgttagatgtgtgatttagtgcaagttacttaaccatttagatcttggttttttcttctaggtctaaaattctataaggacttccaaatgctcagtgtggagatttctattaggtattaaaaatagaattgaaaaagtgtatttttatgtccttctgccttcagtcaggtcaagtgactatgtttcattattaatgactggaaaaacaagtgatgttttgtttgcctatggaaaactattggtttcatgagcagatgagatatcctcaaattctaaaccattatggtatttacaggcgagaagctaatatttaaaagcaattcacagcccatgtaaccacaactgtattttaaataattacttttgaaaaaaatttctagtatgtgtcagatatcattcaagaaacagaatgtaggcctccagtcatattctcctgcttgtctcacttttatataaaattcctggctgccacttcaccaaatcgaggattaagacagtagtactcaatccttttaccactacaaatacctttttattcttttcaaagattctgagtagcacttgatgaccgcctacaatgaggtactattctggctggaaacgcagtgctaataagtggtgatgagctcaggtgctggaattgaatgatacgaatttaactcttttcttccatttatgagctgggcaaattatataacctttctgtgcttcaattttctcatctgtaaaatggttctaacaataaaatccacttgagttactgagaagattaaatgtgttaatatgtgcaaagcacttagaacagtgccaggcagtaagaatgaattattacaacaactttatgtagtatttaagttttgttgtcaccacttatcaaagtggtaactatggagcttaaaaggttaagtaacttacctaagattacccaactaataagtaacagagttgggatcagaacccacgtctacctgaccttggagctttgcactttgtaatacactacttttatccatgttttgaccaatttgtccatgaagctgcatttaaaatttatttgcctttattttattacactaaagtgctggccacagctactattaaacatggtctgtccagcactactacactacattgacagaattccaaagaatctgcaaagaaacttggcatgtggtttacttaagtttttttttttttttttgagacagagtctcactctgtcgctcaggctggagtgcaatggcacgatctcgactcactgcaacccccgcctctgggttctcccgcctcagcctccccaatagctgggattacaggcgcccgccaccacgcccaactaatttttgtgtttagtagagacggggttttgccatgttggccaggctggtctggaactcctcacctcaaacgatccacctgccctggcctcccaaagtgttgagattaaggcacgaacccccgagcccggctgtggtttatttagttttgatacagtattcccgaagttaaaaatagctcccatggccttgctatatctgatgtggactcctagggaaggttcatacagattgaaaggaagcaaacaatggcaagacagcagaaaatagcagaactagtcactacagctgggtcgtaaaatacggtatagggccccctttataccttccaaatctgaggacaaatgatgctgttatgctacactagggtatatatcctttgttatttttattcccatatacaggcatactcagacattttggattcagttccaaaccaccgcaataatccaaataccataataaagcaagtaatacaatttttttgtttcccatacaaagttatgtttacactatacagtagtctattaagtgtgcaatagcattatgtctaaaaagacaatgtatataccttaatttaaaaacaccttattgctaaaaaatgctagcgatcatctgagccttcagcgagctataatattttttgctggtagagggtcctgcgtcaatgttgatggctgttgactgatcaggttggtggctgctgatggttgaggtggctgtgaaaatttctcaaaataatacaacaatgaagtttgctaccatgaagtatttctctgtagcatgtgatgctgtttgatagcattttaccccacgagaacttctttcaaaaatagcgttaatcctctcaaattctcccactactttatcaactaagtttgtagaatattctaaatcctttgttgttatttcaacaatgttcacagcatcctcaccaggagttgattccatctcaaaaaaccactgtttgctcatccataagaagcaactcctcatctgttcaagttttttaccatgagactgcagaaattcagtcatatcttcagactccacttctaattctagttctcttgctatttctaccatcttcagtgacttctaatgaagtcctgaactcctcaaagtcatccatgagggcttctttcaagttcaacttctttcaaactcctgttaaggctgatattttgacctcctcccatgagccacaaatgttcttaatggcatctagaaaggtgaatcctttccagaaagttttcaatttactttgtccagatccatcgggggctcattctctatggcagctatagccttatgaaatgcatgttttaaataataagacttggaagtctaaatgactccttgatccatgggctacaaaatgaatgttatattagcaggcatgaaaacaacattaatcttcttgaacatctccatcagagctcttgggtgattaggtgcattgttaatgagcagtaatattttgaaaggcatctctctttcctgaacagttcttgacagtgggcttaaaatattcagtaaactacgctgtaaacagatacgctgtcatccaggctttgttgttacctttataaagcacaggcagagtagatttagtataattattaagggctctaggattttcaaaagtgtaaatgagcactggtgtcaactcaacattcaccagctgcattagcccctaacaaaaacgtcatcagcctgtcctttaaaattttgaagccaggaatagacttgtctgtagctatgaacatcctaggtggcatctttttccaataaaaggctgttaagtatacactgaaaatttgttgtctggtgtagccaccttcatcaacgatcgtagctagatcttctagataatgtgctgtagttttacatcaacacttgctctttcatcttgcacttttatgttacggagatgcgtttctttccttaaacctcataaaccaatctctgttagcttccaacttttcttttgcagcttcctcacctctctcaaactttacagaattgaagagaattaggaccttgctctggattaggttttggattaaggaaatgttgtggctagtttgatcttccatccagaccattacaactttctccatatcagcaataaggctgtttcactttcttattagtgagttcactggagtaccacttttaatttccttcaaaaacttttcctttctattcacaatttggctaaatggcccattttgacttctgatgtgccttcttcagtaagcataattatttctagcttttgatttaaagtgacagacatgtggctctttggtttacttgaacacttagaggccattgtaggattattaattggtctaatttcaatattgctgtgtctcaggggagtagggaggcctgaggagagggacagtaagggaaccagctggtcagtggagcagtcagagctctcacatttattaagttcatcatctcatatgggtgtggtgcatgtactccaaaacaacaattacaatagtaacatcaaagatcgctgatcacagatcactataacagacataataaagtttaaaatattccaagaattacaaaaatgtgacagacaaatacaaagtgagcacacgctgttggaaaaatggcgtgcaaagacttgcacaacacagggttgacataaatcttcaatatgttaaaaaaaaaaaacaaaaaagtatccgggaagtgcaaaaaaccagtgctataaaatgaggtatatctgtacatttctgtgtccaattacttccttaggtaaatttcctagaggtagaattgttggatcagagggtatgtaactttttaagctttctgatagataatgctggttatctaatatgtatcaaagacattctaatttccactcacacaagcacagtatatatgcaagagtccattttctctacgcttgacaacatcaggtatatttcagtcttgaaccattttttttttaagtaaaatcacttttgagaaattagtatttgttatttggtgtaggacatatatccaagtgctggccacaagacaaaggcagaaattatgaagctaggtgtatcttttcttttctgcccaaatgtccagtttaaaatatagtttattggatagtctatacactgcctgcttccagtccagttcaaaaggcttgaaggtctttaggtctgaagagaccttttatagctaatgtgttcctaagaaaatctgtctaatcagttataattccttaaaaggaactccactgtgggaatgcagtgtgacacataaaagtgagcatgttcaaaatctatttgccttcaagtttcacattactttccacgctttaagatgcaatccagaagctttctattttccaaataaactttttcatatagttatcctttaagtccacagtatttagtttcatgtaactagacataaagggaaaattaagttaaaaacaattcttgactgccacttagcatttttgtttcctctttctttggtaaaacattttgtccctttagttttaagaactgcaatgacttaaggaaaaatcacctaacttaattataacgataactaacactaagagaagaacaaaaagtgctttgtatatatacgtatatacacataaatgtatatacgtgtatatatgtatatatacatgtattatacatacataaatgtatatatgtatatatacatgtattatacatacataaatgtatatatgtatatatacatgtattatacatacataaatgtatatatgtatatatacatgtattatacatacataaatgtatatatgtatatatacatgtattatacatacataaatgtatatatgtatatatacatgtattatacatacataaatgtatatatgtatatatacatgtattatacatacataaatgtatatatgtatatatacatgtattatacatacataaatgtatatatgtatatatacatgtattatacatacataaatgtatatatatatacatgtattatacatacataaatgtatatatgtatatatacgtgtatacatgcatatatacatgtatatatgtatatatacgtgtatacacgtatatatacatgtatatgtatacatacacgcgcgtgtatatatgtatacatacacgcgcgtgtatatatgtatacatacacgcgcgtgtatatatgtatacatacacacgcgcgtgtatatatgtatacatacacgagcgtgtatatatgtatacatacacgcgcgtgtatatatgtatatatacacatacatacatgtattatacatataaacatatacaaatatatgtatatattatatatgtgtatatatacacatatatacatgtattttatatatgtgtatatatatacatatatatacacacacttttttttttgtcagggtcctgctctattgcccaggctggagtgcagtggcacgatcatggctcattgcagcctccacctcttgggctcaagtgatcctcccacctcagtctcccaagtagctgggactacaggtgtgtgccaccaagcctggttaatttttgtatttttttgtagagacaggattttgccatattgcccaggctggtctcaagctatcctcccacctcagcctcccgaagtgctgggattacaggcatgagccattatgccaggcctaaaataaaaatttcttacagcctctattctagtatacttacgtggctttctacaggaattaatgaagggatggaacaaagtataaattgttccttaacttgtatgttaagagtgtcctgactgtaatccccttttgcagttgcgaaatctagtatgataagcactaccttaaagattgtggaacgttaactactgctaacttatttcagccgtaaaatgagtagtattgaaagcagccttgtcataaatcaagacttaaattcacgaattagtatctgggtgtacattataatcaaaagagaatactgtaacatgtcttgggggagggggaagtaggataatccacaaaaagtttgtcctccaaggcagatgctaaggaggtatgtgccaagttaaaagaagtcaacaagttatgtcttaaatgagtcaattttaagtcaactgaaattcatacgagtaaacatgtaacttattgaagtaaaaccatgtaaagaaaatatgagaaattatctttaatgtgctactagctttagaaacagaaactgtttaccagcttcttaaatttctaaagtgtgaagacctacaaatgtactccaatggccaagagatgctgcaaaatactcaactgttgtgccttaactttgaatccaaattcaaggggcattccccttcctgggcactatttactctgctccaggaggcaaggatttgaacttctctccaaatctaagtgtccaaaagtttaccggcatcacatgcccaaatttatcacagagaagagctcatgttacaattctgaaatattgtggtgcatgcaggctgaaactctgatgtgatcctgtacccaccacatgccggactccttcctagagtcacaaaagaggccacattgttcctgcctatacactcaacctcaaaatttgaaaagcccctctcccttccctagtaatcaaaggagaatgaatgaaatgatagcggccaagttcacaaggccaacacagaatttctttaccagtttttctcgtttctacatggaacctgtgtaacaagacattcagtaatagtaatctgctctcagagaaagaaacaattaaataccatacagcgaagctgctaatactttatttaggtgctttctgttcacattcaagacagtcctaactcagctggagttccccttaagccaaatactaggaacagctttatcaacccggcgtctggaacaatcgctcgaactaccgagtttaggggcgggggagaaaacattcgtgtcatctgagcctttttttttttttaaactcgctgcctgagacttctatagagttcaacagggaatccaaaaatagctttcccatgacagtgacagccggagtcgccaggaacgtaaaggattttttaaaaatttaagcaggtgtttgctccaaggagcggacaactgcaggaggcaatttccttatctgggaaggggaaaaagcggagttgaggggagcgaggttgagtaaggcgacgcggggttttttagggggtggaatgagcgaggaagaggaggcctggggagcagaggtcaggggacagggaacggtgtccccgacctgtgggaagcgtggggacagaggctgcgtcccgacctgcaggaagcgaggggcagggaacggtgtcctcgaccagcgggaagcgagaggacaggggcggcgtccccgacccgtgggaagcaagcgggtaggggcggcgtccctgacctgtgaaaagcgaagggacaggggaggcgtccccgactggtgggaagcgaggggacagggactgcgtccccgacctgccgagagcgaaggggcggggggcggcgtccctgaccgctgggaagcgaggcggcggccgccaggaggaggcgcctgaaggagactcaccgttctagtgcgcggggaggccgaaccaggagggcagggctcccccaccaaccgcacgactccgctcagccaaggcgctggtagaggacggacacagacactgcgcgccgagacgaggctgcttggacggcaaactctggatccagtgggagccttcgccaccttcgctggccgcccgcaggccaagccccagctgcggacgccactgcttccgccttctctgctggctgcggggagcgaggggcagggagcgcgccggggaggag

SEQ ID NO: 2130 - DNA, 26547 bp, Homo sapiens; identical to SEQ ID NO: 2129
  source 1..26547: mol_type = genomic DNA

SEQ ID NO: 2131 - DNA, 2126 bp, Homo sapiens
  source 1..2126: mol_type = genomic DNA
ccgatgtggaagaccccgaggtggagtgtggctgaggccctgagtgtccagccacatggtggcaccagcaccactcctttccttaccacatcaactgattaaagcagtgaccagcaggaactgcccagagaactggctggccttgtttcctgagtctgatctgtttggcggagtgggaggggtggagcaggacccggaccctgagtggctgggatccttcttcctgtccctggctgttgctgagcccgtccccatggtaactgatctgccttgaggaaggagccctgccctgcctgtggaattgtcctgagtcattgctttgggctggggccatgggaagaaaccattgtgtggcagggaaggaggtggctcttggcccaggcctaaaccaggaaagcctgggaaactgggacccacaggtgggcatgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagagggacagaccaggcaggctgacgagcagggcgggcctggctcacgtgggcctgtaggcgggcccacgccaagtttcacttcccgccactgctgccagcgagagccgcgggagagtgtgcagccgagtcactactgcctgcctgcctgcctgctacggtgagtgtggcccccacaatgggatggcgcagggcaggagggccatgggttcccccaccccagactaagggggcactaggggaggggccgagtcatgtgaagagggagaccctctcagacagtcgaatgtgctggtcccactaaggaaaccacctcaccctctccaacttcctgcctgaaaatgggccctggagctcgcagacagggcaggattgtgcagggaaggcctgagatgtgcttctgcccaccccctaccccactccctccccttcggatcttaacactgggcactcacacacccaccccatgctcctctccaggctcagcagcaggtacgtacccaaccatgggctcgcaggccctgcccccggggcccatgcagaccctcatctttttcgacatggaggccactggcttgcccttctcccagcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcaagcagcccctcagaacacggcccaaggaagagctacagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtaggccaagaaggaaaatctgacgaataaagacccccgctgccccata

SEQ ID NO: 2132 - DNA, 2126 bp, Homo sapiens; identical to SEQ ID NO: 2131
  source 1..2126: mol_type = genomic DNA

SEQ ID NO: 2133 - DNA, 2126 bp, Homo sapiens; identical to SEQ ID NO: 2131
  source 1..2126: mol_type = genomic DNA

SEQ ID NO: 2134 - DNA, 22107 bp, Homo sapiens
  source 1..22107: mol_type = genomic DNA
gttggtgacgtcaccgcgttcaccagcccggaagtgcgcgtggcggcggtggcggctgcggcaacagcggggccggtaagcgggcgcgcgccgctcagaggggcagagttggtggcgtgagttgctgccccttccttcctgctgtgggccagaggcgccaccgcgcccggtcctcgaggaagacgggagcgggacgtggcgagaggcctcctcagcagtgggcaaaatagccccgacgcggaggtcgtgtccccgccacgtttccggcgaccgcaggcgcggattccttggcttccctcagcactttcccctccgcgcggacggccccgagacgctttttcactgggccttgtcgccagcacccggcgtggggggtgagacgcgccttttcagggctggggttccccagagcgttttcctaagtcgaggcggaggtgcgaggaaactgagtgggtctttccgccccacgtggcctgccgggaagcgcggctcctccacccgcttccgtggaatggaatggtttttctctgcaggtttacaccggggtcactcgagagctgctgcggcctccttatgggcaggacccccgtatggggagaacgaggatgtgatatgtagaagggaaggccgcggtgtgccagaaatcagaggagattgcaagatggcaggaaaagaatcaggaaaatgggggcagcaaaactaaattcatgggaaaatacaatgtctaggagctatcccagggtcgtgaatcctcgagtgcaggtggggaagtagggtgatacccacctgtgaccatgacaagttttggagaccagaaactcggttagagtttctagaaccccgcatccctctcatactgcctgaagccctgctctggggagagtgtcatcacagtaccatgtggcatgcgagtgtcgtggtaatgctccccgaccaaaccaccaaaccgagggttgggctgcttattctcgctgcccaataatgagatgcagataaactaggaaagaaaggagtttatttctgtaaccaggtacggggcgaaggcgtggaaaatatcccagaccgactcagaattacagagctttccagagcttatataccttgtaagttgtatgtttatgtgtaagtgtgcattgatctaaagatacaagtgattaacttcttacccataagatctgagtcctgaagaccttcctctggagcctgagtaaatttacttaatctaaatgggtccaggtgctggggtgattacccttatattctctcctgctaaatcatggaggtttggggagttccctcagacccctaataaacttgttcgtggaggcctggggagtttcctcagatccccagtaaaacttgtttaattctaaacgggtcctgttaagaattcctttgtggccgggctcagtggctcacgcctgtaatcccagcactttgggaggctgaggcgggcagatcacttgaggtcaggagttcgagagcagtctggccaacgtggtaaaaccccgtctctacccagaagtataaaaaattagccggatgtggtggtgtgcgcctgtaatccctgctacttgggatgctgaggcaggagaatctcttgaacccaggaggcaggggttgcagtgagctgagatcgcgccactgcactcccgcctgagcgacagagcgagactccatctcaaaaaaaaaaaaaaaaaaaaaaagaattcctttgttattttatcatgcttcaaggtccaggaaaggcctaggcaaaactcttggggggcttttgttacattctagccttgtttaagggcactggctggctctttcagcttttaatatgtaactcaaccagtcagtcagtactgaaacagttatggaggcctgcgctagtgagaccccgcctgccacagtaagtgcttctggagaacaaaaccaggtagatacatagacctagtcgtaatccctcaaactgacaccgttttcagttttttcatctgaacaagagatgaatttctgagttgataaacttgaaatgtgtccccctttgttttccttcacttaccttcacttttaatttcattggtatgcctgtgtatttgccttgtagatgtgtagttggtgactgcctctccagatgctgaggtgcctgtatcattggcacaggccagtgctgaaccgtaggtggagtaggctgtgccttccgaagcagtatctattcacaatgaagttgcagtctcccgaattccagtcacttttcacagaaggactgaagagtctgacaggtgagagattaggataccttttcttgattggaaacctatataaatggagaagtagagggttaactttttaagccagcattcggatattttcattgttgttttaattatttttattaaaaaacgtaagtagagggtctctttgtgttgcccaggctggtctcaaaactcctgggctcactccttggcctcccaaaatgctgggattacaggtgtgagccacggtgcccaatgtgcacgttttcattgttggaagaaaggcttggctgggtgtacccagcctgtaatctcttggggaggccaaggtaggaggattgtttgagcccaggagtttgaggctgcagtgagctatgatcatgccactctagcctgggcaacagagtgagaccctgtctcaaaaaaagagaaaggaatattaaaagagaaaggcttacatatggctgatccaaaaatatagctaaatcactggaaaaggcaagaagttgactgcagtaaaaagcatggcttttctgtatgctgtgctaagtacttgccattcattacaggactggtgctactaacttaatgagtacgcacattttgacctgttacgtgaaaaaggaaacagattgttaggcatgtgaagtgctttgcctgtgtttctgtaactactaactagagagctaggtttcgaacttacgcagattgatttcagagcccagcttgcaaccgctaagctctgtttccttcctaggtataaatgctttccatgagaactgaaggaagaaggaaataggagttgcctccattgtgcacgttgcaaaacctgtctggaaggagcataggaaatggctttagctaagtgccagtagcttcttgctgttgccacagtttcattagtgttgattctcaatgttgtctgctgatgttgctaaagcagccacacagtagcattacaaagcctgtgggaattttaatagcaccttcataaatatatttagtagtatatgtagaaatatgacctatacagcactggctatctattagattcacctggggagcttttaaagcacacatgctcgggttctacctgcagcctactgaattagaatctctgggtgggatgaccatctatatttttaataaaagctccacaagttaattctgatgcacagaagatagacgaaccattactttaacatgactcaccttgtattagcttattctcaaagctactttcccattcttgaaattggatgatggctttttaggtacgtgccagagataaatggcccagaatatgttgattcttttagattgttttaggcagactttaagtagagggcttaaatgcatgtttggttttgccgatgcttcactatcttttttaattggagagagtgaaaattgctaaaaattgctgtccaatagaaatttatgagcccatatgtaatataaacttttttactaaccacattaaaaagatagaaatggtgaaataaattttaataattatttttggttcatctaatttaatccaatatatctaagatactatcagtatgaattttgtataaaaattgttaatgaggccgggcacagtgtctcccacctgtaatcctagcactttgggaggctggacatggtggctcatacctgtaatcccagcacttttgagtggctgaggtgggtggatcacttgagcccaggagtttgagaccagcctgggcaacacggtgaaaccccatctctactaaaaatatgaaaaataggcaagcatactgatatgtgtctgtagtccctgctacttgggaggctgaggtgggaggatcactgaagcctgggaggggggcttgcggtaagccgagattgtgccactacactccagcctgggcgacacagaccgtgtctttaaaaaaaaaaaaaaattaatgagatattttatattcttacttggaagtctttgaagtctggcatgcatttaatacagcacatctgaattcagacttaccacattttaagtgctcagtaagtacaagtggctgctgtttgaatagtgcagattttgaagctgtgattttgggttgagttgaagcttttttctttctgtgtatgcccttcacagcccccaatttttcaacttcaattgcaagaggcctcttggaagaaggagtagtaattaactcttgatggcctaactcaggtcattctgcattttttggaaataaggttctaaatattgattactatagtttcttgaacatcattttaacaattgtgtttaacgttctaaacctgaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcgaggacttcatgtccaaaacaccaaaagcaatggcaacaaaagccagaattgacaaatgggatctaattaaactaaagagcttctgcacagcaaaagaaactaccatcagagtgaacaggcaacccacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagagacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaactggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaaaattaaaaaaataaaaaaaaacatatacctattgaaggaaaaaaaaaaaaacacaaaaaaaaaacactggattttctccaccctgagaaatgaggtcctaaggaagttagagcctaaatggtgtggtaaggtagaggtggtgattgcttccagagtcctgtccttgaaggactggcaaatgagaacatggatatattctaaagttgactttttctaggctactggagaagtggcaagaatggaatcttttagtgcaatgatcaacaagttagaatgtcaaagacttgggtgccctggtaaaatgtaatgttctgtataaaatcaaaatgtacaaaaacacacagcctttctgatggctgctatatagtgatacttggagtttaaatcctgtaccaattttcaaatcttaatagctgctttgccatgtgtaaaattagttttcagtatgcaagaatatgagagactagaatagtgtattattgtcatatcataagggttttataatttgtcaggttattttatgtatctttttgcttcagtacaatcatatgctagtggcatagaagattatttcccagctagctgtggtagctcatgcctataatctcccagcactttgggaggccgagatgggagaattgcttgagcccaggagttagagaccagcctgagcaacatagtgaaatcccatctgtacaaaaataataataataaatttagccagttacagtgatgcacacctgtagtcccagctactcaggaggctgaggcagggggttccttgaacttggggtcagggctgcagagtgagctgtggtggtgccactgcactccagcctggatgacagtgagaccctctctcaaaaaaaaaaaaatgagagactatttttctgtcctagagatgaggctgaagttcccaatgcagacgatttttgcctgagctaacagcattaatggatgagcaaggacttgtttagtcctttggctgttgtccacagggggtgatagcgctcagtgttatgtgacgtcagaaggccatcatgttaaaatatagcacgatagggacaactgatcactctcttgaagtccggagctcttagaacagatggtctgtttttctgtagtaatgctcacaccatgtcttcccactcatagctcccactcactgccccttaccccaccccagcctccagtcgtcaaaatttaaagctgtaaagggaagacgttcatgaaaatttaattaaaagttaacattaaaaagaggtgacagttataaaagttttctgacacattaatgtatggtcttttgaattgctaataataattaacaattgcttactatcagaggtggcatttggagcaaataaacgtagtttggggatgatgagattctgcattctttgacttttaggcttaagtttacagttaaatttagttacattaggtgttattttcactgaattatttcattgaatgtagctcgcaaagtcttttgaaatgttgactgcctccctgtttctgtaagattgaagatatcagtaacaggaataaataaatcttgaagcttgatagtccctgctgttttaggccaatgtgaaattatgcttttcttataatttttatgactgctctttcatatagacaaatatgccttgatacgtctttctcagttgtcttaaatgttattttaaaaatcctgaatggcaaggtttttggaatggtttaataacataggctaatcaaaatggtgaatatattactttgagttctggatctctttgtaatgcagttagcttactgagtaaatttgaacttatcgttttattttagtaaagccagcatgagaatcttaaaacagtagttatctgtataaattaagccttgaccttcttcatcccactgtttatagtaagttcaagtgaacgtaaaacttgtcctttatttgcttgaatttcagaacagctacttgataccgttttaagaaaacttaaaaaaacccaatacttaccagtgaagtcattcttttttttaatagttagaatatcataattcagtttaattatgagccagattggtataaagatgaataagataggttttctaccctgagaagtggggagacaaagacataaaacaggtaattttaatataattggtatgtataaagatatgctgtactagtcgcttagaagaaattcacctaaccttaccttcaggtgaggcttcctaaagtgagtcacaacagataagtaagagtgagctagatcattgttttccaactgggtagttacctcttagtgggccatgaagtcaatttagtggtcatgaccagtaattaaaaaaaagagagaatagaatagattgcatggtacgaagggtaggttttcttttatgatacttttgtttgccatgtagacatacaaattttggtgactgctatgtgaatgtcttagtgtgggttatgggctaagaagtgtgacagccagccactgagctggagtaagttggggaggtgtttcagtgaagtgactcacacaagcaaaattatggaggaaaactgtggggagagttttgtgcagacagctggtacagacagtgtgatgcagagtttagcaagagatgagacaaataggtcatggaagcctttggatatagcactgaggaatttgggtactgtgttgtgagtagttaggaggagcagttaatgcgtagcgtaattaacctagtgttttaaatccctatgtctagatggtggaggctggatttaagggaggtgatgtggtcccagaagtgggctttcatgggaaatgtggcattaggggaatatgaacacttccccttggggagagcttgtggaaaagatatccttaattaagtcaagagggtagggagcatttgttacttttaagtacatcattttaaggagtctacagagaatggggctgaaaagatgtgggaagagtaggtggaagaggagtgtgggcaggacagaaaacagatgttgaggtagggatagaggattctgttttgagttgtgattagaggtgctggaactttgatgtatgatgagtttagttgaatgctcgtgttgctgtctgctagccaaagaccaacagggacacaagttgggttgttactcctggcagtgaggagcaacatgctgagtgaggagtagcatgctgacactggagaacctggaggtatactcagtaagagggctttagaaatgacttcttataggagttgggcttgtattgggtcattttggagagcatttaaggtagtagagctttgcagcgggttagatgctctcaggaagcagaagtaattctgtgattgggtgtcttaataatggtttcctagaagttgagtacagttgtgagactaaacctaattggtaaggcacagtcactgttaccaactattgtagggtgtatcatggacagtgttcatgtttcgtgtatgtttaggtgattacagagttgtcttgatcgatccatcgtggtcacagaatgggcttgtctgatattgatgttttgtgaaaatgtttctgtaccacagaccccagggcctaatattgtggcaggctagctcctggatgccattctcactaggttccatgtggacatatggatatagttatagtggattttgccttatcctctacatatagaggagtcagctatgtagttgcttatagttgttcagtgttcaaatggttctacctagagcacagataggagttgattttagaattatatacagaccatttcttgaagatttttagctataaacattaatcataagtggtatagactaatgtctgatagtttcatgcgtgaacatcctgcctcaacatctatctgtaaacacagagaaatacaagaacatgttaccatttctaaagtatgcacataaatggggaaaagaaagcagaattgtttgatttactttctttttttttcttttttttttttttgagataaggtcttgctctgtcacccaggctggagtgcagtggcacgatcatagctcaccgcagccttgaactcctgggctcaagccatcctcccacctcagcctcccaagtagctgggactacaggtgtgcgccactgaacctggctatttttattttttgtatagatagagtcttgctctttgcccaggctggtcttgaactcctgggctcaagtgatcttttcacctcagcctcccaaagtatcaggattacagatgtgagccactgcgcctgacctgctttagtctttagtaatacttcaaatttatattgatcactttgaggcattgtggaattctgaattatcttctgaataagcaaagaattctgcaagttctctgtttcctgttggtcctcagaggcactctcctgtagacaagtctttttacttctttgggccttgttctcatttttcatatgaaaagcctcagttaaatgaatctctgctgttccaactagatggaaaagccttgtacttttgtggttaaaataaacacattgaaataaagaacttgggaataaaaatcttattttctctcatctcagaattatttgtcaaagagaatcacgaattaagaatagcaggaggagcagtgagggatttattaaatggagtaaagcctcaggatatagattttgccaccactgctacccctactcaaatgaaggagatgtttcagtcggctgggattcggatgataaacaacagaggagaaaagcacggaacaattactgccagggtgagtcaaaagtttgacaggtaattacattgcttttttggtaatttttaaaaacttaattttctctagttaaaagcaaataacgaaaagtctaataaaaaagtcagtctcttctatgcccgtcataaaccctgcagtcctctgttcttgcagccatgtttactttttatgttacctctccatttctaaaaagacctttgtatgctacgggtatttacttttcagtttttactatcccagttttaagatgtgttacgtattgactttccataagggaagatgatttagctttcttaccacacccttctcaacaacaagcacgtataattctccttcttctgtcttcctagtatatttatatcataatttttggttaagtcaatattcagggttcacgtttatgactctgtattgtttacagccagattgtggagtatattgtgatgacatttcttctattggcatgtttttaaattttcctgcagttaatggcatttttcttttacataagctttccatatactaccaatttattcctgcactctgtgccagagctatagagttcctctcaaaagatttaaacacattatatcaagtttcaattgggtttttgggaaacatcttacctggtgctgtcttcctgctccaatatggacttttaggaatttccttggcctctcttttttgttaagcctcctgtttcctgggtcccatgtgctgttctctcttggcttaagccctcattttaataatccaaaacctgaggaagccttacacgtctgaaaatgtttttatttcacctccatggtggtttgatagttacggttatagaattctaggcagggaataatttttactcagaaatttaaaggtattgttttctagcttccagtactgccagtaagtctagttccatttagatttctcttttgtttaaaaacctgattgccattatttccttttggaagtctttctgatcttttcatgtctaatgtttttaatttcaagatgatataacttgttttggatttttcacttactgtgcagggcacttagtgggccctcatgtttctttcataatttcatcccttttgttaaatgctttttcctttggaaactcttattatttggatcctggattgctgggactgaccttctagttttatcttttgtctttattttatattctcctgtcttactttctatgagagtgccttaacttcatctcccagtcattgtataatactgacaacttctgtggtcttgtagaatttcaagaggtctttcttagtatatttctttggaaagcttcccgttcatgtttcagatggaagatcttttatttctcttaggatatctactatagttattttgacagtgtctttgtttcctccgagtgttttctttcaggttggctttccttgaatttgggtgatgctctgtatctgagggctttattgtagttttgcatgggaagtgtcagccaactgggactcccagtctaagtctcagtaggagttttcattaggagaaatcagagaagaatactccagtattatgccagggaatgaacctgattgttagcatcttgaaaccaagtagggaaagggatgagggtcatgttaattttcacttgaatcttgttttcattatgatgcttcattcccatgagcatctgtgcctggtgcaacaagttctgattatttttggttgaacctttctagagaatcagtccctggttttctgcctcattaagggagtcattctaggtgggtctgattatttcttaaaatgagttgcaaacagttttcctatttcaaaccttaccttattctttgccttcagagatacttgtgcctcaaattcttgagttctggaattctatagtgagagatagatgtagcttgtatttagagaagagtatgtatcaaattgagagaaatcctacaacagacttctggtgatcgttaacggctttcacttcctaaataaagacattcctaactcttggcacataaaacactttattctctactcctaaatgctaatatgctacctgtcagatatactttctcttttacatatattcctcttcctccaccgtgcctttggtcatctcttctcttcatttgaagtttttctaccacacctgcatgtacaaaccctgctgctttttcaaggcttggcacagacgccaccctaacatgaagttactcagcttccccagctggaggtagtctgtcttcccaagatagaggtaactctttattttaatttctttctttctcttttgagacagggtctcactctgttgcctaggctggagtgcacagtgtgatctcgactcactgcagcctctgcctcccggggtctagcgatcctcccacctcagcctcccaggtagctaggaccacaggcatgcaccaccacacctggctggtttttttgtatgtttggtagagatggggttttaccatcttgcccaggctggtcttgaactcctgagctcaagtcatctgcctgccttgacctcccaaagtgctgggattacaggcatgagccaccacccccagcctttattttaatttcactggggattatcagtaagggagttgcaagatctgttaactgtacttattctttatcagtctttcgctcaatggcaaatgttccataaattgacattcacctctttgcaaactggagctattaaaaatatttctgataatagcttgatttgaaattgaagaacagttttgagtttgatgtggagtttctccacatcacttggcagaggtgacatgtttgtgtgttaaactcatcttttttaatcatgatggattttttttaaaaaaatcagtcttttgatctgtttttgaataatgtggatatctttctgtttcaatgtttaggtatggtagttgacgttaaaaagactataactgtcagggcttatagtaccatccctttataaagacaaaaacttatttttttcaattcagtagtatgaaaacctaatttaaatgacaacaaaaaccccatgtatttaattgcagcttcatgaagaaaattttgagattactacactacggattgatgtcaccactgatggaagacatgctgaggtagaatttacaactgactggcagaaagatgcggaacgcagagatctcactataaattctatgtttttaggtaatatttgcagataaaaccatattgtgagtctatcagaatgccttcttttcaagtaaaacctacattctggaaatgttcttcaacttgagaagttgcattaatttcttctaagagatggtttagcagattgcttcaaagaatagtccctcagccgggcacggtgggtcacgcctgtaatcccagcactttgggaggccaaggcaggcggatcatggggtcaggagatcgagaccatcctggctaacacggtgaaaccccatctctactaaaaatataaaaaattagccgggcgtggtggcggctgcctgtagtcccagctgttaggcaggagaatggtgtgaacccgggaggcggagcttgcagtgagctgagattgtgccactgcactccagtctgggcaacagagcgagactccatctcaaaaaaaaagaatagactctggagccaaaatccctgggttcaaattctgactccgtcactcactagccacaaaacaaaaacgttaattaatattggcttcctttgtaccgctgttgtgaggtttaagagagttaattgtaaatgcttagaacagtgcctgacacatgtacacactcagtcagtgctaacttcttaactgcatataaacatgatttcagggaagagaagtgcacacacacatggtacatgtacatactccacacacatctacacacacacacacccaggatcattctttttcctttgcactatctttcatgcatgtttattcaatctttcttctgcttccctggcaaacaatggtgaatgacttcagcactttttactgctgagcctacacacaacctcagattcttttttagcattgtattctaggaatcatcaataatcagagttggtatgtaagatgaaacctatttatttcagcttaacttttttgtttaatgaaagcactgggaattatatgggggctagatacgaattaggttagtgttttgatacattactgatgcatcatatgttgtactttaaagttaagacaagccctttatgtttaagattttggattaaaaaaggatgaaacatccactgttcataacctagtttgtagcaatagtagtggtaaaaggatgaagtaataggatttgcttcatgcatagatgggcaagaagtttataagctaaggtggcatctcttgctgattacagtaatgacagatacaatttctagggtacctactgggttctaggtacaacattgggtacctgatatactttatttcattaaactctcagaaaaacttcataaagtatgttaagcccacttgatagaagaggaaacttgagactgagagatattaagtaacttagtttaagtcacagagaaccatgattttggcttgtttccaaggcctaggcaatatatgaccatagagagcccaattggtgcatttttctctcagttaatgtagtcagagctccaggtatttatttattctcatatttactcatagaggaagctgctccaaatagtgcaatatagagtcttgtctaactggcttctcataagcatactgaaagagagaaactaatactctttttcagtgtcctagtttataaaataaaagttgttcctattggtactatcattttctgacatttactgaacccttataacatgtcaggcactgttctgagcacattatgtaaatttaatctcctgacaaccctgcgaagcagatactgctatttaaccgatggtaacttgcccaaagttgcacagcttgtaaagtgtaggatcagaattccaactcaggcagcctgactccagaggtcacattcttaaccactacattattccctgcaactcaaccatatttcatatttttatttactgtattttaaaaggatgatattcagagcaaaacaaaatacacaccagtatgatgcttactaagctttgtgtagttttctatcctggctttttccaagccttattggatcaagcattcatagttctggcatttatggttggttactttgcttcccaaacgcttatttttgctttgatcatattcctatgattttttcctccaaattttgatcttgcctttaggttccccagggacggttacaagtctcttcattaggagaaataacaccaagatggatataccatattatttgctactttgtgatcatatttttgcctatttacatattttctttttatcattttcttttatgtctttttgaatctggagccttcgaaatttgccatgtatgtcaagatggttcccttttaaaagttactatgcatataaaactattaacagcttggaaagagttaagcattaagtgtgaacttaccaatgtactgttgcttttgggataatcagagaacattcaagttcaaacacagccaagaggtatttttgataagtagttgtcagtgcctcttttctgtaatgctacagagtgaagtatctcatagatcactgacctccccatttggtgagctgaatggtgtctgtgtttcggctctaaattcctttttctatttttttaagtctccatggtaaccaactgtcttagtttgcctgagcttgaaatacttccttggatgtatgattttcaactttaaaactaggaatgtctcaggcaaaccagtatgaagtggtcactctactaattaatacttgaggttttatgtacatatatataaaattagttttatgtcacttttttcattcaacatatgagaacatttgtttattaccatttttgtgaatggctaatagattaacatggttcaaaattcacaaagttttaaaggctctacagtgaagtctcctgatctgtaatgaacaggactgcccatttaaccacacccttgctaacactgttatcaagtgtttgcatcgttgccgatctgaaagacgctatcttggaaatgggtatttactggccgggcatggtggcttatgcctgtaaccctagcactttgggaggctgaggcatgcagatcacttgatgtcaggagttcgagaccagcctggcccacttgccgaaaccctgtctctactaaaaatacaaaaattagctgtgtgtagtggcaggtctacttgggaggctgaagcaggagaatcacctgaacctgggaggctgcagtgagctgagattgcaccactgcactccaaccagggtgacaaagtgagaatccgcctcaaagaacaaaaaaaggatttatgactaaggttgaaaatcttcattattaaagagatttctatatttcctttataggtagcctatttttctatttacgtggcctttttattagaacttttatatattatggaaattagccatttttaaaatatggacttacatatatttttccaaaaatgtcacttatgactttgtgtgtgatagtagtttctgccatacaggcatatttcattttttatgtcattcaattatttcttcgaaaatcctgttgtttttgtgttgcgttttctgttttcttgctgagtttgaaagatcttcaagattataaagattccaagattaaaaatattttcctcgtttcttctgttaatcctgttacgtattttttccattttattttggctattattttcccatattgtgaaaattagcttgtatggtgtcttgttggctccactccacctcatacaagttttgcatatttcttgtttagtttattcttggattatctttttagttgcaattgtaaatgcagctaaacagactaaaagacagtcttttattgtcttccatttgatagttgatatgtatgaatacgtatgtgttttaataactgttcactctgctgaatttttactgtttgtgatagtgtttagctgattttcttgtgttttcaaattcttatttgccaatagtgatttttctccctccttttctaatgaataggttttgatggcactttatttgactactttaatggttatgaagatttaaaaaataagaaagttagatttgttggacatgctaaacagagaatacaagaggattatcttagaattttaagatacttcaggtaagaatttttaaaaataaaaaatgatagttttaatatcatgactagagcataacagtggtcatacgaaacccacagcaggtcagtgtacaaaatggtgacatcccaaatgtctgtctccagtggagacctagcaccctatgacttatgagtgaaaattacttagctacttcatattgtattttcattcccagaacgcacatatactttatgtcatctttcctacaattttaagtcatctttttaaatgtccatttttctttttgattgatatttcctccattgatttattaattacacagatgtttgaatgcttaccacaggtcaatccctgtgttaggtgcattaaacgtggtaatgaacgagtgaaagtgttcgccttcatacagcttacggttttaggtagtcatggaaatcggtgatggttcacaacaaaatgattttggtgaaaagaaatacctgttatatgatttaaagaatcaaagcataaagacataatcgaaacttggatgggccgggtgtggtggctcacacctgtaatccccgcactttgggaggccgaggcgggtggatcacgaggtcaggagatgagaccatgctggctaacatggtgaaaccccatttctactaaaaatacaaaaaattagccaggcatggcggtgtgcgcctgtagtccgagctactcgggaggctgaggcaggaggatggcgggaacccgggaggcggagcttgcagtgagccgagatcgtgccaccgcactccagcctgggcgacagagcgagactccatctcaaaaaaaaaaaaaaaaaaaaagaagatcttggataaacttggtaaatatgaaacgcatgactagttttgtgggtagcaatgatgtttaaatgtcacacactaacctttttaaaaaactatccgaattggctagtttatgtcaagtaatattcatttttcactggttgggattgctctcagaatattctataacagaacatggatattttgtcaatgtagtttctctaaacttgagtatttgtagtctgtcttataaataatagaacatagattaagacttagctgtatttgtatcactaatccagatttagcattaatttacttatttagcatcactttggaccgctgatgaattcattagaattttaagggcatgagagggaaacacatgcacgttagggcttccagttctaagattccgcgaaatatactccagggtgcgcaactagatgagtcgtatttgaaggttttccttgaaagtactaatgtgtacagacaggcaagctttgaggaattcagactactctgttaaggcactgcagtcttgttttggtttgctgcctttacaagaatgctgttttttttttcatctagtataagtgccaattcaggaattgcatttgatgaccattcggaatgtcttgagtcagtaatttggaagtgaggtggagaccttgaagttttagttcttgctaacctcaaaaaggctacttatattttattcgatcctgggttttcttatctgggaaaagaaagaggaggtggagaaatgaccagttgctttctaaggtcccttctagacctaactaattatatgttgttttcattaagcagatgtatgggatagtaccaataaaaatgaaaaacagattttgcttgtgatatgccaatatagaggtaataccctgtgaagattttgtcttgtaggttttatgggagaattgtagacaaacctggtgaccatgatcctgagactttggaagcaattgcagaaaatgcaaaaggcttggctggaatatcaggagaaaggatttgggtggaactgaaaaaaattcttgttggtaaccatgtaaatcatttgattcaccttatctatgatcttgatgtggctccttatataggtgagagcaagttataaagtgtttgaatttttggcagtgaaatatctggtttcaaatttcataaggaaaaaatgtttgactcatttggttgaagaattcttggagaaatggagtattttaaaataagacaaagtttgggttatggggtaagttttgtcgtgagtagggaagagctcaaagacagcttgtggtgcttgtagagtagtctctagtcagacctaggtttgaaggaagctcagccccttatctagtctttgcaacttgggttagtttctaacccaaaaaagcggtttaaaagtaatgtagcctctatctaataggaaagctaaaaggattcagtgagttaatacatgtaaagctcttttagaagagtgacttgtacacagaaattgttcagtaaacgttgtaattcattttcacagagaatagtgggattatatggtttatcacacttcggtaagcttgggcatatttcaaatttcagtaacattactgaatggggggtggatcttgtatcagtgtaaagtcaggaatttgtgattagaaagagtatgccttgtgagtctgacaccactgtcaccactacccctggaactcttgatgtagctttaatggaaacaagaacattttagaggttttgaaggtgacaggggagagaataacaatatattagtggttcgcctttaagttggaacatcagactgaacctatataatgtatcctagtgacaaagcatttctggatactaaaatggtggcaaggtttaggatatgagtggttttttatccccactaaaaacaggtgaaaaatgcttttgtccctacaggtttacctgctaatgcaagtttagaagaatttgacaaagtcagtaaaaatgttgatggtttttcaccaaagccagtgactcttttggcctcattattcaaagtacaagatgatgtcacaaaattggatttgaggttgaagatcgcaaaagaggagaaaaaccttggcttatttatagttaaaaataggaaagatttaattaaagcaacagatagttcagacccattgaaaccctatcaagacttcattatagatgtaagtatatactaggcttggtcagaaatatgaagtatcgtcacgaatttagaattaatttattaaaactaagatctacaaatctgtgaattttacttattttaaatgaaaaaatttatgttgagtatttaaattttaggataagattgtaagtgtatgttttcatgtgtgacgaaactaaatgtttgattttgacacgtagtctagggaacctgatgcaactactcgtgtatgtgaactactgaagtaccaaggagagcactgtctcctaaaggaaatgcagcagtggtccattcctccatttcctgtaagtggccatgacatcagaaaagtgggcatttcttcaggaaaagaaattggggctctattacaacagttgcgagaacagtggaaaaaaagtggttaccaaatggaaaaagatgaacttctgagttacataaagaagacctaaaactgatggctactaaaaagcagagcatttctggtaagactaaattttctcccctccctcttaatgaggttttagagactacaccagaataaaagacagtttaggggacctctgtagaacaacaagggtcttattttgtgaattatatatttcaagaactaaacagagatccacctttctggatctgatttatatcactgaaatgtacagttcttttggaatagtttcacctgagaaaacatagttggctattatctatcttaacctgttcaggcttttaaaaaaaactgtttttgcatagggtagtactaagatcttaaaaagtggtaactgtcttgaagaaaaaacgtttattgtttgtttgcaattgaaataacagggttaccttaacaatgactgtctatgatgtgtcagttcttatctgaattccaaaataaacctgtgcttaaaaaagaaataattgaccaagtaagtttgcataaaatgtgaatactaaatgtgtccccagttgctggcattcatatgtacaggatttgttctagcaagctatgcttcagtatgtggttgatatttttctgtcacaatgatttctttatgcatgcagagcctggggaagtcatgggattaacttgagggtcactattgagcctattaattaattattgttttaataaaacaaacattggtattggaagataaatatgtttatgtggtatctgacaatgtgtattaggtgtcatatacaatggtaatatgcctgtctttaaagtgttattttattaattaaaaggatatggctattattatatattctctaaagatttgagtcctaaatgctttcatcaggtaaataaaatgtataatacaa

SEQ ID NO: 2135 - DNA, 134963 bp, Homo sapiens
  source 1..134963: mol_type = genomic DNA
ggccaggggcgggtccgcagctggcggcgccggggcccggggcggaggctgtggcagcagctgcagcggcggcggcggcggcagcgccaggagctgctacagcagaggcggaggttgctcctgtacgcgtacgggccgctcggccggagccgcagcccggaggcgccgggcggtgcgctgggagctgctggtgctgctgctgctgctgctgcccaccctccgccgcccgggcccccgctgccgcccgggccccggctgccgtctgcgcccccgtcgaccccgcccgcgagtgcgccccagccaggacgccgcccccggccgggtctccacttcttggccgcaccttccatgacagcgcccgcgagaagatggctgcgaagggcgcgcacggctcctacctgaaggtggagagcgagctggagcgctgccgcgccgagggccactgggaccgcatgccggagctggtccggcagctgcagacgctgagcatgcccggcggcggaggtaacaggcgaggcagcccgagcgcagcgttcacctttccggacaccggtgagtaagggaagaggctggctcgccggcagcgagcgcgcgaaacgcaccgcctcctccaggaagcgcgcccagacagtcctcggccgacagcgggcgcctgccagcccaccgtgctagtcttaagagcagccagggcagttaggaaggtccttctgccgcgagagaaaaatcacatgtggtttgggggcttggagggaagagaaacggcttttgctctgtgtcctttaggataatgtggctaactctgtctaccgtgaaatggtggtatctgcatatcatgagatcagtgcattggctggactctgccccccaccgcggtccgagggtggggtgtccctaaactccatcaggtgaagtgtgtctgtgtcgtctttgtccatagttctcgcaagtgacgttgaaaacggagctccgtccgaagcagacaggggcgagggtttgacgagctccagggtggggtggtggagaaatggggaagaggcttggccagcctcagtttcctcatctgtggcgatctcgggacacatccagctctagcagtcggtggctttagcagtagggctggtttggctgggccgggctcttgtgctggggcgggaaagcaccctgatgtggcagcggggaacaccccgccccagtctctaacctcaaatcctgttcctggggccttcagcttaccctccctgagtcctctctgtgggcacaatcacttaggaggctttgtggaaggaggcagggaataaatgaatacagatataaataatttttaaagactgctcagcctgttgaaggctctgagagggacagatcgtgatagtaatagtaatagtcaacgcttacttcgtgcttcctgtgtgccagacactgtcctgagcactttaatcaaccccgtgaagcaggtactcttgtttgtcccactttacagataaggaaactgaggcacagagcaactaaataacttgatcagctagccaataagttgtggaaccaggatttgtgcccaggtttctgagtacatcctttaaatcacttgcactattacctctcaaagatgtacagcacaaaatccttgcccttgaagagctcccacagtgaatggggaggcaagaaagtgatcggagggcaattgtttgtggggtttttttggttgtctttttgtttttgtttttgtttgtttgtttgtttgtttgtttttgagacagggtctctctctgttacccaggctggagtgtaatagtgcgatctcagctcactgcagcctcaacttcctgggctcaagcgatcattccacctcagcctcccaagtagctgggactacaggtgctggctaccatgcccggctaatttttgcagttttagtagagacggggtttcgccatgttgcccaggctgatctccaactaggctgaagcattccgcccacctgggcctcccaaagtgctgggattacaggcatgaaccactgtgtctggccgctttctctattttttaaattcttgtaaacaaccctattaggagggcaggagttattgtccccattttagacatagggacaccaaggcccagagaggtcatataatgtgtatgtggttaaagcctgtactcaagcctgagtctctgccaccaagtctcctagtgtcagagttggggacacggagcctgggctggcttcactgtgggaactggccagtataaggaaggagatggagggtcagcagggtctctcctgccagttttggggtctgtgaatgatttttctcccagttaaatccagatacactatcacaaagcatgcactcacactgggacacatagtcatacatgcatatgcacacacacaaacacgaggaacaaaaaaaaatgcctcccaaagcccatgcgtagagcattgtttggattgactgctgttttggtcctttctctacagggttccttgatcactcaagggattgagagcttgttcttttttggggtttgatgcagactcccctgcagccctgaagggagattcttaacatcccacctggcctgtttgactcttacaagtcagtgatctgaagcttccacagttacagaattgggagaggttctgagatggggttgaaacccattttactgaggccttgaggtccagcggtgtctgatatttcctacagaaatgaaaagtacctcctacccagaggtagattcagggaggcagaaagggaagatgagctgtggggactctttctgatctggagggatgaaagatcaggagatacttagcagagtaggcccctgtacccttttcctgtctaaggttgctcctcaccacccaaccaggggtaaggtgcttgctactgtctcctcactcacatccggtctagattaggtcaggatggagcaggggaaccccagagtcctgcttgctgtgctggggtttgttcatatagaaacaaagagcccatccaagtgattaaaaaacaactttattatgaagaattttcaaaacattaaagaacatgaaagaatgagtcccttgtatccatcaaccaacagcagtgatacgaactcacgaagtctcgtctgagctatgctcaacccttttccttccacatttcagtttttcagtatgtacttattaaataagaactctggtattttgggtttttttttttttttttttttttgagacaagaacttgctctttcacccagactggagttcagtggtataattatagcttactacacactcaaactcgtgggctcaagggaaccttccacctcagcctcctgactagaaggaagggcagactgggcaacaaagtgagatcccatctctaccccctactcccctaaaaaatatagctaggcatggtggcacacacctgtagtcccagctgtttgggaggccaagacgggaggatcacttgaggccaggagttcgagatcagcccaggcaacatacctcaggcacacgtcagcaaacccagctaattttcaaatttttttgtagagatggggtcttgctatgttgcccaagttggtcttgaactcctgggcttaagctattctcctacctcggcctcccaaagtgttgagatttcaggcatgagccaccacacctagcaataagaactctttttgaaaatatagccactgtaccattattacaccttacaaaaatctaacaattacgttttacaattagttattagagtcaggatccaaattaggcgacataactgcatttgattgttaggttaggtctctgtaccccacccaacattttgttatgaaaatttcaaatatacagtaaaggtcaaaaaaatttgcagtgaacacctgtgtacctattaaccttttgctgtgcttgctttattacatatctgttctctactcatcttgagactttctttttaatttttttttttattcttagagacaaggtcttactctcatagttcacttcaccctgggctcaagtgatcctcctgcctcagcctcccaaatggctgggatcacaggtgtgtatgccactacacccagttaattttttttttagatggagtcttgctctgttgccaggctggagtgcagtggtgcgatctcggctcattgcaacctctgcctcccgggttcaagcgattcttctgcctcagcctcccaagtagctgggactacaggtgcgtggcaccacacccagctaatttttgtatttttagagacgaggtttcaccatgttggccaggatggtctctatctgttgacctcatgttccagccgcctcggcctcccgaagtgctgggattacgggcgtgagccaccgtgcccagctacctagttaatttttttattttttgtagagataggatttcactatgtggtccagtctgattttgaactcctagactcaagcaatcttcctgccttgatctcccaaagtgctggaattataggtgtgagccaccgtgcccggtctttgagtgtctcttaatctgtagtcaccctccccgccgccccactttttttttcttcttcttaagactggagattgttttgaacatttcttccgtttcagttagaaggggtttgtttgaggcagatggtctcttgctagtttcagccttttcctcttggctgtggttggcaggtcccagccttctatagtcctgggaggtgagcagctgcagaaaccactgtgcccgtttgccccagcggggaagggcctggtctgaatcctggcctggctggctagaccaatgtttcctgactgtgaatgggtgggttgtggagaggggatcactgtcatccaaacatggggtcttgaagggtattcctgtgacctggcactcttggagaggccgggaggggatgtgagctgcaggggctataaggaaggtgggcactgaggccttccagacacgatggggttgggagactgggtggccagtaaatggggctttggggctttggggctttgctgagggcaaggtgctgagcagggctgcagaatcagcacccagagtcagattcactatcggtctgatggcaaggtcttcttaaatgcccctgggtagagagaagctgcagcatttcaccagaactgggataggtagtaggtttcggacaacaggatgataaaaagcaacttgttttccctttggaaggacagggaagcctttatccacctgaattctttttttttaatttttttaatttttattttctagagatgaggtattgccctgttgcctaggctggagtgcagtggcacagtcatggctccctacagcgttgaactcttgggctcaagccatccttccacctcagccttccaagtagctgggactctaggcgtgtacctctaacatcagctaactttttttgtgtgtagcgacagagtctcactatgttgaccaggctggtctctaactcctggtctcaatcagtcctaccacctcggcctcccaaagtgctgggattataggcataagccaccacagcaggcctgaattcttgtttaacaactataagtctagaacttctaattccgaaacatccttcagttccatagactgaacagttgagaatagttggatggaaagaaaagaggaaggcaagagagaggtagggcagggagaggagagttgagcaaaggaggaaaagaaagtgaatttttgctgcctgctgagtgtctggccatgtttgtttaccatggtaaacaaacaacaagtagattgagttgggggctgaaaggggcaggcagaaagccttctgtgaaggacctgaagtgtcaatcaacaaagtagtctgaaagtcacaggtatatgaaggtaaggacagttcttatccctgtccttggatttacaactagcttttaacgtactcttttaagttgttaagactgttgtttattttgaaattaccagcagctccgctgtgcatgggttgcaggagagacagggtgtttttggctctgttatgttttattattgttactggctgtgaccctaacaatattgcatatctttattatcatctataaaatggtgataatacctacctttcagggctgtagagatgaaatgatgctatataaaaaagtgtctggcccatactaagccttcaacaaatattagtgcctctttcgcagccagtcactcttatggtttagagatatgtggtgaaggatcaattttgttttctttaaattccaaatctggccaggcatagtggttcacatctgtaatcctagcattttgggaggccgaggcaggcagatcacttgagcccaggagttcgagaccagcctggccaacatggtaaaaccccgtctctaccaaaaatacaaaaaattagctgggtgtggtggtgcgtgcctgtagtcccagctactcagtaggctgaggcaggagaatcctttaaacccaggaggtggaggttgcagtgagctgagattgtgccattgcgcttcagcctgggtgatagagaccctgtctgaaaataaattcccaatctgttatgctctgatactttcataaagtacaataaaaatgaattgctagaaaaataaaagaaaaatacacaaagtactacctcccaattttttagtattagatttcaacagatttaaaattactctgtcagatttctaaggtgtacttttaagtttctgcactcatctccttggtattggatcacaagcatggagagacccgcaggccatggccagccgcacttggagcagcctgggtccaaaggggcgtgctctggggaggaagctggtttctcttggcatgaaagtacccaaccaaacagctcaaccaagcgaggagctctggtccgggcaggtggatggcagagtgcacgggatggccactgatggtgccgtatctggtggcacggtggcccaagggcacggagtcctgccagtgcacagaggaaagggggcaacaaggcggggaccagctgggggacggggccagcatcctgaggggtgtgtttccctctttaggctctgacttcaaaccccacccctggctttacagaggcaaagcaggttagaagcagggagcaactttccccaaggcccacagctctggaatgtggctctgactgactggatctatggggatgttcaaaaataattttgatgtacgttgccaaattaccctagaggttctaccaacttatagtctgccagcaatgaatgatagtttgaaccaggtacttttttgaccatttccttaaaatgttaattttaaaagtcatgaggtacatagcaaaggatcccataacaggtgccttcagaacgaaacccccctgcgatggtgttcttgggattctgggctttagaaccgttctctgtggggaatctcccttacggtgagagattcttcttcagaggcatgaagttttttgtgtttttctaaagacgaggtctccctatgttgcccaggctggtcttgaactcctgggcttgagcaattcttccacctcagcctcccaagaagctgggactacaggcttgcactactgtgcccagctaaggcatgcagttttggactagtggctatgagatgttagcagactgtggtatcctgagagtgaggaggcaatggcagccctgtagatctgagaacactgtactggtagcaaaaagagcactttgaaaaagatggcaccaagcaggcattcctagggatgtttttggattggcacttaactctcgatcctgatggcttcgctgtggggtagttgagaggatccaattcactcaacaggtatttactcagtgcttatattgaatggtgggcctgctcctcaccccagttgctgggaggggcaatgagcacagccacccaagaaccatggtgaaaccatcttgacctcagaccctgcacactgaacacccggctcccatgctcgagccacctctgctgtaggtagcaggaatctggtggtcacaagacgagttttcagtgtggtaaagggaggcagcaaataaaccaagcagtatattatctttatttttattttttgagacagaatctcactttgttgcccaggctggagtgcagtggtgtgatctcggctcactgcaacctccgtctcccgaattcaggcagttctgcctcagcttcccgagtagctgggattacaggtgcccatcatcatgcctggctaatttttgcatttttagtggagacagagttttgccatgttggccaggctggtctcaaactcctgacctcaagtgatctgcctgccttgggctcccaaagtgctgggattacaggtgtgagccactgcgctcactaaaccaagcagtataaaaccacctaccaggtggtgagggatgcaaatgagctaccctcatttgcgggtataccctatatgtgagagaactccagaaaatgcaggtattcaacatgttcgaggatttgccttggcaacaagtagatctgcttcccacctaactctactgtggctgctaggttatcctgagtcatgtcaaattaccttaaaaactggatggtatggtggctgatgcctgtaatcccagcactttgggaggctgagtcaggagggtcacttgagcctgggagtgccatgatcatgccagtgcactccagctagggtggcagagtgagactctgtttaaaacaaacaaacaaacaaaaacacttaaaaatggggaaaaccaattatggttacatagaaattaggagcatgtaaaagtacattattaaaccacttcatgtattttttctcttcaatcatttggggagaattcttcttggtttaagaacttattatccacagcacagcatatgtatgactttgtcccttattttaaattctgaaattctgggaatttgtccccgagtcctgggaactctgtcttcccaaccattaaactacagcagaaaataaatccaaggggcaatttgtattgtgaccatagtagaatgcctgtgtcttttctttaaaggctgttgaaatttatgaaaaatgtgcctttattttctcagacctgagccattcatgtactgggtatgggtggttgggtgggtccaggagtgtgcaactccctccattatccgccttgttcggggtttgctgctctgacccctactttgcttttcagatgactttgggaaattgctgctggctgaggccctcctggagcagtgtttgaaggagaaccatgccaaaataaaagactccatgcctttgctggagaagaatgagccgaagatgagcgaagccaaaaattatctaagcagtatccttaaccatgggaggctctcggtaagtcgtcagccttcaagcctgagacctcctctcctcgtctgtcttgcctcgcatctgtccagtcctccctgagtcatttggtcacctgagcaacaagtctctcttacaagctgcccttgcacttacagtagccactggctgcacatggccccttgagcacttggagtatggctagtccacattgagatgtgctgtaagtataaagcatacacaaggtttcaaagacttagtacaaaacaaagaatagaaaagagcagtaactttttatgttgattacatgttcagatggtatattttggatatattgggttaaataaaacatgttattaaaattaatttcaccttttacctttttcagtgtgactaaaaaaaatcttagtagaaatttttaaattacacatgtggttcacatttgtggcttacatcatatttttttggacagtgcttggttgacttaatatgtgcctggccctttgggctccttgggtcagggggctctcaggaaaataaaacctcagtgaacctgtgacctagttagaaacaggcaaacatgcagagttggctagggacagaagagctccataacagggcaagcccatttaagtccacgtgtatttatcaagcacctactgagtacaagacactgagggaggtagaggacccacctctccctcccagaaggagtatggtcacaactttctctggactttgctgctcaaaatgtggtccacccaccagcagtgtaggcatcattggggagctggttagaaatgcaattaagagaaaaaaaaaaagaaatgcaattaagaattagaatctgtgttttaacaagctctcctgggtgattcatatgtgcatccaagtttgaggctgtggctgtgttagattacaatgtatcctgaactataatagtggcatgggtatgtcattagaaactcaaaagaggagggggagggggtaaaaaaaaactcaaagaggaagtgatccctccctccctcccttccttccttgcttccttcccctctgtctctctctttctttctgtctttctgtctgtctttattttcttcagggtctcgctgtgttactcaggctggtctccaactcctgggctcaagcgatcctcctacttcagcctcccgaagcgttgggattacaggagtgaggcactgcgcccagctgatttttaaagagctattccaaagtaatatattcacttccttaaaccttttattccaacgtactgtgtgcaaggcattgtgttgtgcactctgaaggcaatcaagacgaatccagcatggaccctgccctcaaggaggttgcaggtctcttgggaagataagtcctatcagcaagtaaatagccttcctccaaggtagaccgtgataggagtgctatccacgaggaagcaagtctgagggggatgctctttggggataagcagagagcagactctgagtaatggcagtactagaattggatccttctggggctggatctagacaaggttgtaaaggtactttggggctagtaagggcagactggaacaccaggccaggatgtgcagggcttattttgtaagggagggaaaggccaggggagaggggagtgtgtactagaagtttaaggttactgcttttaggctccttgacaggtattgtagcactgggaggtttgtattgggttaaaatagctgcctgaccctgagcatgcttgaccccacagaccttccagtttctcatctgctggtcaaaagggttggaccagattggtggggttcaagcttttcccaccaagaccgcttttcgttttaaaaatattaaattaataattaaatgttaaattaaatatttaaaaattgtttttaaaataaacatgattcagccttattgtaaaaattccagtcaacaaataagtaatttgagtgataaataaaagtcccagctggcctatggctcacgcctgtagtcttagcactttgggaggctaaggtgggaggattgcttgagccagaagtttgagatcagactgggcaacatggtgagaccccatctctacagaaaatttttttaattagctaggcgtggtggcttgcacctgtggtcccagctacccaagaagctgcggctggagggtcacttgagcctaggaggttggggctgcagtgagttgtgttcatgccactgcactccagcctgggtgacagagcaagatcctgtctcacacacacaaaaaaagttcttgttttccaacctcaccctcatgcccacacccatcctcagagttgagcactggtcagtatttgatgtgcatctcctatgcctttctttgtgcatttacaaacatatatacacacagatatttcttttcatagagttgtaagatatatatttttcaccaagaagttttatttagagctttctccatgccagtattgtctcattctttgtattggctgaatagtaaccacatgtattgtgacaacggttttattaaatacaaattgtaccatattttgttaaacaaagacatatataggcaccaataatgtgcagaaatttactgttatccaggccagagccaaaaacttaatgatgatctgtaaaataatatattaaatgtcgtttgtgggattcttttttgagacagggtctcactctgtcacccaggctggagtgcagtggcgtgaacatggctcactgcagactggacctcctgggctcaagtgatcatcctgcttcagcctcctgagtagctgggactataggcatgcaccaccacacccagctaatttttaaatttttttgtagagacaaagtcttgtcatattgctcaggctggtcttaaactcctgggatcaagcagtcctgtcacctgtgcctcccaaagtgctaggattacaggcgtgagccaccatgcccggccatcatttgtagtattttctatctcacccgcaaagatcaggtcacagttggcgtgacctttcttggcagctgatgcagtctcaggtggattcctgtgcatccaagtagctctgctggatgagaaggagagctgggagaggtgggtcctgaggcccctccttgggaaagcttgaaaccctttcctcttggttatctctctaagaccccgtccagctcagttgtgtggagatcagtgaaaacaagccacttgtcctaaactctgttctgctactaggttgaggctttgcaccatcgcatgcaggcctccaaggaaccttctgcaacggtatttactattagccccatttctttttctttctttctttcttttttttttttttcaattttttgtagagacacagttcttactgtgtttctcaggctggtctcagattctgggtttcaagcgatcctcttgccttggtctcccaaagtgctgggattacaggtgtgagccactgtgccctgccaagctccatctcttgagacccaagaaaggtgatcacaacccaggcctttagtgtctacagcccatgctctaatgctgtctctcatttcttggtactgcctcccagagtactggggtggaaataaaataatgactgggaaagttggattcatgtgaaagatggtgatcacacccccacttttatagttcccacgttagtctgtgaagtatttcctcatccgttctttcctcatacctggatatctccatgaagtcctttttccccttttattgacagggacagtgaggcacaaaaggagtaggtgatgcgctgatccacacagtagaggggattgttcctctggtaaagcgacctcccccgtggcaccctcccactgggcaaggggttccgttccctgactgttgtactgatagaccaagaatatttcacattcaaatgcatgggccccacagagtgcagtggactcttaatgttgccaagtaaggacattaagaagcaaaaaatagcagcaaaatgataccatcttctgctcttactgtgctataacagaaaaacagtttagcattgaaagggcaaggtagatatcctttcagaactaagagccttttttttttttttttttttgagacaacggagtctcgctctgtcacccaggctggagtacagtggcacgatcttggctcactgcaacctccgcctcccgggttcaagcgattcttctgcctcagcctcccaagtagctaggattacaggcgcccaccaccacgcccggataatttttgtatttttagtagagacgggttttaccatgttgtccaggctggtctcaaattcctgatcttaggtgatctgcctgcctcgacctcccaaagtgctgggattacaggcgtgagccaccgtacccggccgagcatttttttaaatagtgtaaatgtggctttataaaacatgccctgcattgtctaatttttccccagcttggtggaagctctgttgtaaactgccactggtcctccaggaaccgccactagccacaccccatcagcatgcctgaaatgtccttctctgcctcactgcccttgtctccatgtgcaggataatgataaatacgcataccctgtatttatcttgctcttttccaaagaaaagttcaaagctcttttctggactttgccctattaatgccttcagcatcgctgtgataggcagtgaggagtaggtgttattatctctccctcacccacgaggaagacgcagcccgagcagggaggaaatgagcccgtggcttgagaccagtgcagggaacgcagagtcactgcccagcttggaaggactgtgggccacatacctctgggatgtgtcatctgtggccctggcccagggagtggatggcctatctgggaagactagcaaatcccctcaaaagattcagctttggagagttaattaatagagagagcaggtcaggcgtgcagaggctgaatgggcccattggtagaggcattggaggagttcagctgaagggagctccctggtagtcaaggaggctttcaggagaaggtgggcctgagcaaggccccaaaggatagaagaggacctggttaggccagggggaaggggacctgaggaagcacaggcaaaagaggaatgtggatttacaaaggccagaaggaccagttgggaaggtgaatttggcttccccagagcctgtctgtgccacgcttcatttctcttggcttctgagagggcagtagatggtaaggagtgctggaggcttgccctggggtcacagggaccccagactcttacctccctacagggagacaggggtagcaccttcctgccagtgacaaatgccaggtgtgggatgagagctgcatcttcggggagttttatggacagattggtgcctgtgtggcgggagcagtgcccagggcctggcccataggcattgtgagccagctgaggacaggatcagaggcagggggccagagcaaatggcctgcagaggcgggaggttacaaggagaactggggccatgtccaaggtcagaactcacgtgccagggtggcacagcccagggccagcacagcctccctcaggcaacagcacaggatcccaagccacagtaggggtgatcatggctgacaagaccactgcaggccctaagggaggccctgagagttcctctgtgggatggagattgagatgtaagcaacttttgaaaaaggaggggaaagaaaacacgtttaaattcagccactcttggcctccgtgattctgcactttgacccatttctgataggaagaggatggtgacgcagcaggccctctcctcctcaatctgtccctctgccactgtagggggaggcataagctttagggtcctcacaggctgtttctaaggcctttcacctaattatgatttgcatatacatgtacacaagaggactcccaaaatgagaagcctggggctccacaaaacttaactccatctctgactccccacttgtgtttagaataaatgcctgagcttctgagtgccccctggggctgcagtctttggggggattcaggagagggaagacagggcctagtctgcaaggtctctggagtcttgctgggggcataaaacgcacacacatgaaacaattagggactcataggagaattttattgagaaccacaatgtaggctgcagaccatgggtgagagcggggagctgtcggcatgtgcttgagcatcaaagaaggctttctggaggaggaggggagttctgagcaaggtctgaggcaaacaaggtccaggttcagtgggggtgttcaccccaaggtaactttggggcaggcgctggtaacatgtccttgtcatttcagccacagtacatgtgtgaggccatgctgatcctgggcaaactgcattacgtggagggctcataccgagatgccatcagcatgtacgcacgggccgggattgatgacatgtccatggagaacaagcccctgtatcagatgcggctgctgtcggaggcttttgtcatcaaaggtagctgtgggcaccagcctgggctcccctccactgtgtgcagctcgttgcactctgactcccagggccctgctgggctcgtgtccagattcttcacccctggtagtgcccatgccctggcactggtgtctaaggtggatgccggtggcaaccggccatgttgacattgcctggtgcctgggacgttaggagactcagattctcgccctggctctgtcaacaacaattaccctactttgtgtacccttgggcaatcacctcttcacctcctttggcctcagtttacttgtttggaagatacggttgtaatacctgacctcccagggttaccatgaccaagagtcatcagcagaattgtgtagcaaggttgagaaaggtttacaaagtatgacctctcactggcaggctggctctgctgactggcgctggccccagagcaggtgctggatgctgtaggagtctgccactcctcagttatttgtcgggcacctgctgtgagtggcccagggagcaggggctgagacccagtgatgaacaggtcagaaccagttcctggaggagctcttagccttccagggtcaaggggtgctctggaggggatttagggacatgggtcagtgatgtaggaattttatgagggggctgtggacagcccagctgggggaatcgtgccatttaactggaccccaaatgtgttcaatgttaaagtcatcctaccccaaactttgtgcttcaggctccttcttccctggatccctggctgcgggagcccctctgcccagcctgctgtccggaatcttggatgtttgatcgtctccctagtgcagcacaaaccaacctccagagaaaagtctagaaaagatgcctgtggctcagtgggcatttggtgcctggcatttgtagactatgtgacacactctattatagatagggacattctcactatcttgtggggaaactgaggcccagagaggataacttgcccaaagttacccagatacatggtggagccaggatgagaacctccatgctctgactctggccttggagtgtgagtcctccaaggccctgcaacacacactcagtttcccctgtctcccctgggtcccaggaggagtgactgtgacatctgtggagggcacaccctccttgactctggctggtgggacttctgagggggttcgcccacccaagatccttggatcccttttctgttgggtccacaccatgccaggaaacctggcaagatggtcactgtgggtggtcttcgtcctttgctctctcatcccccgctctgcgcctctggcacaggccagtcttgggggtgatctgcatttggcatttgggtctttcgggtctcttagaaaccccttcagccatggacgccctgagcggaacccccttcctcgggcttcctttccgggactttctcctgagcctggctcaggatggattgccccctgtctcctgctctctcctctttccagcatgcctccggcttcttgggggaacacagtcccggtggtcagaggtcctgcaggggaggtaaggagacgggcgctgccggcgcgggctgcttggtctcaggctgtgctagctcccgttccccagtgactgcacatggcctcccctttgcctgcctcctctctgcctgtcctcctccctgtcctgctgcagtgaccacgcctgctgcccggcatgctgaggtttgcctgaccctgtgtgtgcttgagaccatgcacgtggccaccagggtgtgcatgatgttgatctgcctgggtttgggggatccggtgggtcttcccatgcagagtagaggccacacccttcgggggctgaggacgctggtcattggtcctgactccgtctgtgagcatgagggtggtggcagcaggggccacagagttcacagaatgctgatatttattcagcccccctccatgccaggtaggccctcgttgagccccctctgtaaccctctgagctggtgttcccctcattctatgtcgcggatgaggagttaaggttggaagaagtgaggtgactcatgcgcggatctcacaggaagtggcagaggcaggatttgaacccaggcagctggagcttgtgatactgttgctgagaatcctaggatgaaaggaatcaagtgatccaggccaagccctcatgttacagttgaggagactgaggctgacaaaaaggaagcagcttactcaggacatcagttagcatgtatttgaactggagtcctccttcccaggcagcccctcggtcttgggctccgtttgatgctgggctgcctgcaggagcctgactgacccacactcagcactccttggcagactattaggccatggcttgactccatttttcacaggagtctgctctgtggttctgtttggtactctcagggggtgggcagtctgggtctcaggcacatctggctggaggaggaggacagggcctgtgtgtcacaggggagcctgagctggtcaggctaggaggctctgtgggggccccagtgtggagcggttccaacatggagctgctgttctttttaggggagtcaggagcaggccctctgtctcttcgcccccaccctcaaaagacataaaaacatattcccctcaccctctttccccatcagagcagagggacttgcactgtgaccctgtgaggcgtcactcacaaaggccctgccttcctctgaaatgtgcctctgtgtgttacacccaaagatgctttctgattcccggggaggctttagacatcaacccgggagcctgagtgaaggggcagttgcagcagtcttgggttttccttagccagagtgcagacacatcacatgcgtatttgtgtatataaggtgtgggggagtacataacctccacctcctctgaggggaaaagagttattgtccatgtcacatttgcttagaaacaatagaaaaaccacatgttcccccactaagatagaaaaataagacaacttcatggaaagacctattgtttccatgtccaggtggtctgtgcccagccaccagcattcctggtcccctaacatttgagtcacacatgtgctcagactgaccaggtccagccaggagtaggagactggattttagggcctcttggtagcacctgggaggtgggctgggccctgctggaggctctggaagaagaatcacctcttccctggtcctgccttcagctgctcctggctgcagagaagtcatcatattgacctgttgctcagtaatgccctgttctgtggtcagctgctcccaagtcacctatggccctggacagagcctcccctgcctgtcagaatcccctgtttgattcttcatttccccagtaccaatttcctgagctcctctggtatacctgatatttggtggcattcccagaaacatggggtacagacccatccctctggaagctgagcctctgatgtatgtctctgatgtatgtgcatgtagggggatggggggaagcaggatgatcacatgtgcaccacccaggagcttgcaggggccctccccaaactcactgaatcagaatctacaccttacaactttcccaggtgatgtacacgcacattaccgttggtgagacactgccctggaacacttgtttaataaatatttgttgactgatggttaaccttcatctctactctgtaaatgggaggtggccattttaaggatgaagaagctgaggaagttcacgcagcctataagtagcattggtggccagatggatgtctctaaagcttgtgtcccacctgtaacagaggagcccaccagagggtgctgggaggcagattacagttgcctccaagatgggtcagacagatgaggactttctcctctctgggcctccttcagccctggcttgagtaggggctacagccctggtgaagccctgcagccattttcttggcatttgctttcccagggctgtttttgggtatttgtggacgagttgttcagaaaatttgcttttatatttcaacctaacatccatcaacttggtctagagtggaagcccactcctctcctaccctattccccaggccctgccatggcccctttgtaacttccgccagcctacggacccctgaccaaacatgtcagatcaggggaagaccctggaaaggaaatgttcccagccgattccaggtgcaggtgacagatatatattcagatgaaacagctccattaccattcttgtttgtttggtaaaaagggaacatcatccatttactctgtattaaaaataatcaggccgggcgtggtggctcacgcctgtaatcctagcacattgggaggccgaggtgggcagatcacgaggtcaggagatcaagaccatcctggctaatgcaggtgaaaccctatctctactaaaaatacaaaaaattagctgggtctggtggcaggtgcctgtagtcccagctactcaggaggctgaggcaggagaatggcatgaacccgggaggcggagcttgcagtgagccgagatcgcaccactgcactccaacctgggtgacagagcaagactccatctcaaataaataaataaataaataaataaataaaataaaaaataatctaggctgggtgcggtggctcatgcctgtaatcccagcactttgggaagccgaggcgggtggatgacttgaggttaggagtttgagaccagcctggccaacatggtgaaaccctgtctctactaaaaaaaaagaaagaacaaaaaattagctggtcatggtggcatgcacctgtaatcccagctacttgggaggctggagaatcgcttgaacctgggaggcggaggttgcagtgacccgagatcacaccatggcactacagcttgggtgacagaacaagactccgtctcagaaaaacaaaaataatctagaatgctttggtttcaaggctcttctaggatggcctgtctgcagtgctgcccactcccttggcagaaccctctgcatttgactccatgtgctcatggctgtgagccctgtcttccactgaattccaagcctcttgagtacaggtggtcatttcttttgtaccctcaaccaatctccctctctcctttcctgaagccccacctgtctgcctaatgaggtctgctcctggtgtccaacataatctgtgaagttcttcccttcacttcttcttgggacattgtccttgccttttttcttcactctgcacaaagctgtttccttacattctcctccgacacagttcagtgtgtcctgtgctgagagcttcccttggttgttcagcctgcaacatcgtctccctcctcccagctcacttggacctcagctcagtatgcacgtccattctacccagttaggggtcagtatgttcctccaccgagcgtctgacctcttgcagttgtatcccccaaggctcctggcccacctcccacaggaggaagtaaaatttgtcagcagttgattcagcaaacacctgctgggaatgccaagttagggtcacttcctttgagggagtggcaggtgggtgagcaaagcatgctcctggagggatgcagctagaggggaagcagctgtttggaagaccccagagtggctggtctgctgctcctgccatggctcattggggcagtatggcagacttcctgcctggccatggtgtctcggccatatggctgtctctagttctgtcccatgggaagctctgccttgactcttggccttttggccaccagaaaaggccatttgtgaagagtcccctctgggctgctgcttctgggcagcccaccccctgatgggagtggaacacttgagcctacctgataggttgaacagtgcaagggcttgtttgccaggtttggggtctgtctgcctctacagctccttaaaactctgtagtaataagcctttgggcaattgccattgcatcatcttcatgggtgagaacctagagataaagatggtgttgacttcaagtccatggatctagatccaggcctcaagggtctgtcgctcagcagcaggcctcagggctcttctcaggcacccacccctggctctctcgcagtgcagtgagagctgcagcagggggtccttgtgaggtttgcatggggagggattcaggcctttccagccttgtctcctaatagaatctggtccccctgtctcctctggcactgccttcagcaaggacagagaattttcaactccatttatctgacttcactctcagctgtcttgcattgttttatacagacaaagctttcttattcggagaggctgccaggagtgctgcttgtaaggcttatttttatagggcttagcatgggccccaagaagcatccggcataggccagtatcctgaagtgttccaccacatgcccaaggtctcacctcaagacaaaataggctgcattccagccggtagtgctgctgctgtctatctggaattccagtttcttagcttggagatggcaaagtcctcactgccccacctgacctcagcccagccaatcctgtatttcaggaattttcccctcggacatcatgcctctggggatcagtttctgcataaccagacttatggttataataaccaatgtacaactccaactagttggaaagtcacaacaaaaaggagggactggatatttatggccccttgtactagaaagttgttggagcagcatggcatcaggcatagctgaatccgggggctcagctattgaggtctgttgaggtcttcctcagcagctccaggagtacatggttcttgcagtatggcacccacaaactcagaaggagagactgcctggggaagcttctcatggacctggcttggtctcatgcccaccctggagccaattgtgcccagcacctaggatactgggctggtgtcaggggtgggatttcccccacctgaatcttgtggactgagatgtgggaatggttcctcaaaggaaaaccagggtacggttatgaaagtaggtaaaaggcatggaggcagagccccagagcgcaggcagaaatgattcacctcaggttacaccagtagttgcagggtcaggctgtggacatcgctctctctgactccagcattcaggcttgttcgattgaagcactcttgcagagggaggtgagatccagctagttgtggggccttcacaggcgagctgggtggtgagcctgaacttgaggatgaatcacctacagttgaggggaagaggtgccttccagcaagggaaggccaaagggaagccccgggggaaacaaggggaggtggcttgtttggaggtgcagtgtaatcatacttcttggagccaagaggaggtgtgtgtgggatggattgggaatgagtgtgagggccaggtgggccccatgagagggcccagagcggagagcccacagtaaggctcagggtgtctctcttcactggggtttctagatctttggctgtgggtcaccacaccctgaggtgcaccacagcctgttccccctcaaatcaggctcacctatggttcagcactctgtctggggcaatcttctctagggtctggagctgaggggtctgggccctagactaggatgaagcctttgtggatccagggtaacaaatcacccacttttttgttggtctgagctctgagggttattccctggctttgattggcatccaggatgtttcggggcctgctctttggacatctctagctttagcccgttcagcctccccaagctccggtgggtctcttccatttctctagcactagctcagtgtgctaagggcatggagagtgactgccatttctccagccattcattctaccttgagcctggcagaccttagtcattggtgcctaatttagggttcactgtggctccatggatggagcacaggccccttgagaatgggtcctgcccccagcgtcagcctggccggctcgcgttctccttcacctcacacccagcgccagggaggtcctgatgccctgaccgtggtgcacatgaactgtgcagtgcagtgacatgctaggttgtgaagctgctgtgcaaagtcaaaaggtgaaatgccctcagcagccagaaggattatgatctgcagattctcctctccccgcccgttgaagatgggcttctttttttactgttctcttttggtcagtgcaaccccaaggtattctgctgtcacctggaattgtgtggctgattaaaactttttaaaaagaaagaacactacgctgcttccaggacaggatatgatagcatacttggtttttgtgtttttagccctggtatggcgggaattcactgttgattttggcttccctctccaaggggtgtgggctgtgtgcctcacatggacaggagctcagtccctgtggcactgctgtcttggccccaggtgagaggctggcttccagatggagaaggaggagcaggctgctaggggatcaggcctcatccagccagagacctggagctagtcgacactgatgcttttagctgaggggtcttggaattaatccgttttccctggattcattttttttttttttttttgagacagtctcactctgttgcccaggctggagtgcagtgatgcgatctcggctcactgcaacctctgcctcctggcttcaaatgattctcctgtctcagcctccagaatagctggaattacaggcacgtactaccataccctgctaattttttgtattttcagtagagatggggtttcgcaatgttagccaggctgttcttgaactcctgacctcaagtgatccgcctgcctcagcctccaggagtactggagttacaggcgtgagccaccatgccccgcttagattttttatttgtaactctggagaagggttaaacccttacctaagaggttattgtgagcatcacttgaaaatattttctaagtgcatacttttttttttcttgaggtggagtcttgctctgttgcccaggctagagtgcaatggcacgatctcagctcaccgcaacctccacctcccgggttcaagcaattctcctgcctccgcctcccgagtagctgggtttacaggcatgcgccaccacgcctggctaattttgtatttttagtagagatggggtttctccatgttagtcaggctggtcttgaactctcgacctcagatgatcctcccgcctcaggctcccaaagtgttgggattacaggtgtgagccactgtgcttggcctgcatactttctactctttataatatttcatctaatttaatgatcatggctacactacgagctaggcattattagtaactctattttgtatttgcggaaacagacttagcactctgtgaacattttgaggtatatctttccagtcttttttccctataggattatatatgcttttaaaatgtaagttcatacagtcatgttttataatctgctttttaaaaaagtatttcatgagtcatttttcaatacacctctatgtcactgtaagtaacttcatagcatttcattgtaacgttctatcctaattttgtgaagtcccgtcattggacctgtatgctaaatcttttttttttttgccattataaataatactgaaatggatatccttgaagctaaattttgtatacatcactttttttttttttttggtggagatggggtctatgttgcaagggctggtcctgaactcctgggctcaagcaatcctcccaccttaccctcccaaagtgctgggattacaggtgtgagtcaccacccccagcttttttttttttttttcgaagataaattcctagaaagtagaattactgaatcatagagtatacattttttggagactttgatacagaagccaaattgcctgtgttttttgttttttttttttccgttaaaaaattgtgttggccgggcgcggtggctcatgcctataatcccagtactttgggaggctgaggcgggtggatcacctgaggtcaggagttcaagaccagcctggccaacatggcgaaaccccatctctactaaaaatataaaaattagccaggcgtggtggcgcgtgcctgtaattccagctactcaggaggctgagacaggagaattgcttgaacccaggaggtggaggttgccgtgagctgagattgtgccactgcactccagcctgggtgacagagcaagattccgtctcaaaaaaaaaatgtgttaaatatacataccatagaattgaccatcttaaccacttttaagcgtacagttcggtactaagacactgttgtgcaaccaatctcctgaactcttttaacatttgcattattgtgcaaccagtctccagaattcttttaccttgcgaaaccaaaattctatgcccgtgaaacagcaacgccccattccctcctcccctaacccctggcaaccactcttctattttctgtttttatgaatttgattacgcaagtacctcatgtaagaggaatcatacagtatttgcctttttgtgtctggctcatttcacttagtaaaatgtcctcaaggcttatccatattgtagcatgtgtcagaatttccttccttctgaaggctgaataatattgtattgtatgtatgtatatgtggcattttgtttatgtgttcatctgtcaatggacacttgggttgcttctacattttaactattgtgaataatgctgctataaatgctagtgtactaatacctctttgagaccctgctttctattcttttgggtatatacctggaagtggaattgctggatcatatggtaatatctatttttaaatgttctaattttaacagagtgatctgtgagggttctttcctacctggcctttcggtttccccccgagagctgaatgaattgcattttttcgcttcttcccgtggctgcagggtacccaagtctgggattcatcttccgtgggtgctgcagctgtcctcgtgccctttgacaggctgggtaggtgggagggaaggggttctgttgctgaggatgttttctgttttctacctctgcatccagggcccaaggctccagggttccaagggtggggcttcttggaagggcggctgccttggatgtgatgagtcattcagactgaaggagttgggaccagcctggtgttgggcctgaggctgtgccaggatcagcttggctccaaatcgaaagttctgagttaatgaaaaagcaagtcctcctcttgcaagggacctttcctagagctgggtattggcacagaaaggcccttgccggtgggaatcacaaggcagtgcctgccctgcagggctgtgttacaaccctccgatgcctcaaggactgggcgcagggcagcccaccttcatcctggattgagcactgtagtctggccgtttgtgcagaagcgctcacggggcagaaggtaaagaaaagaaacccaagcctgcagcacctgggtgggcttccagtcagatgtttgtggacaggaaaatagaccttatcaaccaggggacaaatacaaggttcccggcccctttttatgggcagaactgggtgactggactgtgaccttgcttaggaaaagccactgccagctccagaaactttttggccctgtgtatattggaaattgctttatagaggaccgcctccgtgaatgtacccctctactttgaacttttatttctctgaatcatgacagctcccttcaaaaaggcattatctccattatttttagataaattttcatatggtgacatgtacaaatcttaactgtataatttcatgaattaggccagtgtaaatatccatgtgaccagtaccctaataaagatacagaacatttctatcaccacagaaagtccccttgggctcttttctaattggtctccaccccaggcaacctctgttttgtttttgtgttttttttttttttttaagagataaagtctcgctatgttgcccaggctggtctcgaacttctgggctcaattgatcccctgcctcagctcccacagtgctgggattacagacgtgggccaccactcctggccttattttctattgatatagattaatttgcttttttgaataaatgaaatcatacagtatgcattttttttatgtctggtttcttttgcacatgtaatttttaagtaattcatttgtgttatgtgtatataagagtttgttttaaaaaaaaaatctgggccgggcacggtggctcacacctgtaatcccagcactttgggaggccgaggcgggtggatcacgaggtcaggagatcgagactatcctggctaacatggcgaaaccccatctctactaaaaatacaaaaacaaaattagccgagcttagtggcgggtgtctgtagtcccagctactcgggaggctgaggcaggagaatggcgtgaacccgggaggcagagcttgcagtgagccgagatcgcgccactgcactccagcctgggcgacagtgcaacctccgactccctggttcaagtgattctcctgcctcagcctcctgagtagctgggatttacaggcatgtgccaccatgcccagctaatttttgtatttttagtagagacggggtttcaccatgctggccaggatggtctcaatctgacctcgtgatccgtccgcctcggcctcccaaagtgctgggattacaggcatgagccagcgtgcctggcccaggaaatattttttaagtagagagggaggaactcctttgggctgtacacttggctacgtgaatatgctcattcatctatgcatccgtctgcatgcttcctaaaccctaggccctggccatcactggggtgcaaagatcagtcggaaatgggtagagaggatgatgacaatgcaggaaaaaggcacatacttaggagatgcagccagactgttcaactggtttagacacagggaggcttaactctacctggcagggtttcagagaagaggtggctttgctttgagcttttttttaaattgaaatgggtcttgttctgtcacccagctggagtgcggtggcataatcttggcttactgcagcctccacctcccgggctcaagcaattctcccacctctgtcttctgagtagcttgagtcacaagtgtgcgccaccaagcccagctaattttttctattttgggggggacggggtttcaccatgttcccaggctggtctcaaactcctaaggtcaagcagtcgcttgcctgggcttcccagtgtgctgggattacaggtgtgagccacttcgcctggcctgctttgagctttcaagaaggatgggatttggggttcttggagaagcatgatggggaggcccctgcggggagtggaaggaacaaatgccacacagggaaggtggaggcccacagaccattgttcctgaattcacagctttgcggtggccagccctctggaggcttggggctggcagcttgaactagccagtagctggcatcacccatcccagtgctggacccggaggtgtggcaggagggagcccagcctcagcacatctctccggggactacaaggcagctgtgttgaaacagatccactccatgtcccctggaattggctgtgccctgccacctgcagttggtctcctgggccaggcctctgaacagttcgtaggttcgccccaccttcctgcaaggtggataggctgcatgtctggggagcaggggctggcctagctctggcagtgagcaacgaggcctgcctccttgattctttctcggttcctcttccccctttagtcctctggaataaggatcctccccctcctggttgtgagtcatttggcagtcgttgacacccagtgtcctgggcacctgggtctttgtgttgagcaaggaccttcatgttctctgcccgctttcctccaggccaaggcaaccgaactttggatctggtcacaccccagcctggcaaagggacaaggtcactgaatctgtgtgcatgggaatgtggctaagaaaaacaataataattccttaccttatatttgcagagcactttgcactttgtcagacatgaccaggcttgtgttttttcatccagccagcaaatgcttgtccagtacctactgtgtgccaggtggtagaaaagtaaacacgattaggttgatgtcttgaaggagcctacagtctggggaaacatatgaacaaataagtataagaaatggtgagtcaggaatatgtatagactggggcttaaaggaggaatgtttggttataccagggaatatcgggaagggctttgtagaggaggtggcatttagtgggtcagaatatgaacagtaattttgggtagacctggtggggtggatacattccaggcaggaggaacaacttgagcaagtcaagaaggcatcctacaacctagcagttgggagcaggaggttagttgtggatatggcaggtaaggtgagggatgaggctggagaattgataccaggagggcctggtgtggagcttccagaagttggaccttactctgtagcagtgtggacccctggagagttttagaaggatccccctggggattagagtgagactggaggcagggaggccagttaggccgatgtagtcatccactcaggagataaaacctgaaataaggtaataggaagagaggaagggaaggtttgaagtgctgaggacttggtcattaggtggatgttggggcttatagggcaggaaacagttgaggattcttccattatacatctcttcagtaagttcatcttgagcctctacttactacatgtaaagtacctaaagtgtactgtgtgggcacaaagatgggacagacattgattcttcccgttgggaaccaatagttcagaaggacagcactctctagtcaggtctatattagctgcaagtgacaaaaaaaaaaagaaagaaagacaggaagggacggaggtagggagggagggaggcagggagggagggaggaaggaaggaagggaggaagaagacatgggagctatttaatggcactcatacactggaaatttccagcaggtagagcttcaggcaaagctggatctaggtactccgtctctttaagaatccacccttctctgtcatgtcatgtcttttctctgcatggatttcatttttttcgtgactaagagtttattcaatatttttcctgtcttaaaaaaaaaaagtaacctgacgcaaatacagttgtttttccatacagcattaatttctagtaaggctaacaatgctatatcccttctgtgtttcttacagattgtttttatttttttgagctttttgtttttggccttgaagcttttcttaaataaaaattttaaatcgcagtaaaaaagccccatacaacataaaatttgccatctaaaccatttttaaatgtacacttcagtagtgttatttatgttcacattgtgtagacttcattttaaggcaggttttctctaacatttctaagctgatgtctggtaccagcttaacaaccccagtggaaagagcgacaattctaagactggtttttattggcccagattaggccatgtgcccacacttagctgattgccatggctgtcatgatcagctgagattgcaagagaggtggtcaaaaggagagcaaggtgctattactgataaatgggaaagtgggtgtcccctgcaggcagagacctgagcatgggtaacttctgcagggaggaactgttgggttccatgggaagtgtgcatgtaaaatgctgcataactcgagcacctactatgtgaggtgctgttctagggttgtggttgtccaaaaaggttcacatttgccctcgtggagctttcagctagttggagagagaagagctggccggagatgaccaaaatatagtgtagaaagtggtgagcaccaggagggtggatgtttttcttctaacaactggaaatgtaaccaagtaaccccatcttcaggccagaattcactgtggcccagatggtattgggtccagatagtattatggtaaaacatcctctttttcctagtcatgggctcacaactgtatgcttttcaattaaccaaaatgcaccccgaggggctctttgaggggacaaagaccttgttgcccatgtccaatcctgttccctctttaaatccaaggcccaggagcagaatggagcccctgaaattaagggttgtggaacagcaaagtgaagggaaggggagaaacttgtcctcgcgttttatggaggagataagagtatggactatctggctggcttttgcagcacagccaggttttccaagagtggcatgagagagagaatggaaagagagaggaaaaagtagagtggcagaagaggagctcgagagccttccagccaccgcatggtgcagggaaacccttgctaccctcatttatcccccgtcagggagggcctcagtgccgagtgcggcggaggatggatccctcccactgccgcaggttgccggttgaggtgaactgtttccacctggagggagctaaggaaagaaagaagcctgtacacaaagtcatacattcacacaaacaaatggcgtgcttccaaacaaaattcccagtcgagggactgagtggagttctgaaccccctgcctcagctccagataccttcacaggcagctgagtccctatagtgacacaaatgtaaatgctcaaaatgcccaaatcgtgccagtagcggccaagtctgcacagaatgaagtcccaggatacccagaagagacagaaaaaagtcgggtacagtccaacttgctcacccagtttcaaggttgccggcttcttcagaggtcactttctttataccagtgaagcattggaggcagcagatgtcgtgccagggggtgaaagggaggtttccccaaaacaagaacgttttggcagctgctgagaaatccccttaacattcctatcctggagtccagtagccaggagcagctggtgctcccaggcagcccccgccttgcctggtggtgaaaccaggctgataggctcaatcgtccaaagtgtactgcagtcctcataggggccaccaaaattgtaactgaaatgcagttcagtcactcgccacttgcagagtccaattaacaagagcgaggtctggaataaagaaagtgactttattccaaagcttagcttaggggaaaaggtacaggctcctgcctttaaagataaccacttcagttcctgggcaaaaagcaggggcttttaaaggggtacttggcatgaatgccatgcagaggagggagcaagcaagtgcagggtctgcatgacttgccttggtgccttacctaccaggtggtcgagctggcaccgtcacgggcagagctaggttgtaaagtgagcattgcttcaagatactctccagttgggagagagttccctctcagtcacactttaggatgtaaattgactgttgtctctagaggcagtctcctggtgggaaagttctggatctggagcttctaagtcagcacatggataagcttgctgtgtagggagtgtctggtgaagggaaggtaaaggttattgcatttctaaagagctaagtaggaaatggggaactagggaaaaggaggaaagaggaaagaaaaaaataaatttttttaaaaaacctcattctctttcgcttagaaaaatggggatactgcgttacagaggaggggtcaggagtggcttccccgggtagttgggctggggtgatgcactgtgattccccacgtgctgtcccatcgcttactcccagccactgctaacaccaccgtcgcttcagcttcctccctcccctccgcagacctccgcctcctcctggctgcaccagagtgtctgccccctcggatgagcccaccttcggcccatggggagggcctggagtcagggggcccgagcaggacaggtctgaggcaccctcttcctcccgcaggcctctctctggaacgcctacccaactccatcgcctcccgcttccgcctgacagagagggaggaggaagtgatcacctgttttgagagggcctcctggatcgctcaggtgttcctgcaggaattggagaaggtgagctggaaataacaccgtggtaggagctgctctctattgagcacctatgtctatggatcccactaaacccataggtcacctgtgtgctaattagaagaagtcaccttctctgtcccccaaagacactctacttcatagttggaaaactcattatagtatactgattccactagaatgagactctttactggaaaatagtttgataaatgagtccatgccatccgctaggatgtttaatagatgagctttaggagattgaatcatttgctcaccatttctttccctggcaggggtggagtctgcctgggtcttgcagttggacatccttccctgctctcggtgtcccagaagctcctccctggatcctgtgaggaagcaggatcttgggactccttctccgagcctttcagaggctggtaaaagagttggtcggcagggctctggcagttttcagatccccctccctccccactccctgtggtgggtctgggttaactgtctgcagggtatcaagtacaggtggtagcagcgtttgcgataagtatcccagccctcccccttctgggaggctctggtttatttttatgtatttttttacttttatttttaatttttatgcattttatttatttattattattttttagatggagtcttgcttgctttgttacccaggctggagttcagtggcacgatctcagctcactgtaacctccacctcctgggttcaagcgattcttctgcctcagcctttcgagtagctgggactacaggcgcctgccaccgtgcccttctaatttttgtatttttagtagagacagggtttcaccatgttggccaggctggttttgaactcctgacctcaggtgatccacctgcctcagcctcccaaagtgctgggattacaggcccgtgcccagcctccattttattctttttccctccgcatcttaatactatgccatgaggggcccttggttcaatgctaaggggacaggcaactatattcaacagagatcctgctagcccttcttgagtgcctgcttttgtgtcagacacagctccaagcactttacattcattctataatttaaccctcacactgactggatgaaatcggtcctgttgtcattcccattttacaagtaagaaaacaaatttgaagaagagttagcttcccagagtttacctcattaataagtgctattggcaggatttgaacccagggagtgtggctgtgaatgctcgtggggaagatattggggatgatgctcaggtattctgtggaaaagataatttaacatgttagatggaaggttctagagcagcatagattaggattggtgccctgaaggaggaggtggtcatgggccgagagactaagagcccaggagacacttgcacctcgccttccttggcagatgccaaaatgtcagtccagtacccgtttttgtgatgggccattttggaagagtccaccccaggccaggtcatttcccctagagcaggattctcaacctcaatgctgttgacatttggggctggagaattctttgttgttggtgagggcggggggctgccgtgtatattataggatgttcagcagcatgcctagactctccccactatgccagtagcactatcccccttgttgtgacaaccaaaaatgtcttcagttactggcaactgtcccctgagggcaaagtcacccccctgctgacagccactgctctagaagatgtctgcttgattggactttaggaggaaaggagaaatgaccgatgggctcagcaaatataggacttgagtgcccattctttggcagaggccacttaaaggctcagcatggttgagttgacctccaccaagggggaatgggtcactgctagacagtagtagtgttttaggagcttttcatatttgcattgcatgtggttgggaggaaactttcatggaaaagataaagtctgctgctcagctggaagcctaggctttggactttcaaaaggggattaaggcgatgagctataatgccaggcactgtactgtccctgtcaaaggtctgatgatgatgtccagggctggaatcagtgcctggtagcagtgggcagacaaatgggaccctatagttgttatctaagttgagggagggcaggccacagaatcttgtgcatcctcagaaatactgtgtgtccctcctgagacccagtcctgacctctgaggaactaagaccttctcttaaatctcctctggattctgaaagaggaggtggatgcctcattgattttttttcccctcagattagacaaaggaaatggtatacagaaggcaagcctgtctggttgggcaggaggaccctgttagagctgaggcttttaagcaacagctcagttaatgaggtaattgttcctcagcttttcctggaaccagagggctctcaattctctggatgttctgacgttccatgcttgtttgagagggacagtacggtgcctggcatatagcaggcacttagatgtttgtggaatgaattaactgatacatagtagaaatagcttggaatccatacctggctaggcttgagtttgaggtccggactgacaccagctttgtgatcttaggcattaaattattattgatggattgattgggacagagcctcactcttttgcccaggctggtctggaactcctggcctcaagcgattctcttgcctcggcctcccaaagtgctaggattataaacgtgagccaccacatctgtaattgacacttttgaccttagacattttctgagcctcagtttcctcatctataaaatgcaaacaaaaccagccctgtaggaccgttgtgaggcataagtaagatttgggcttgggtggcaattttctaagagtttcatttccccttctctttccttaactggaggtggggcatggacagtagtgagactcaggagacacagctcctgtcctgtgggagtgaagtctggtgggagctgaggtttgcatacacagaacagggaagcagtgctgcgtgaagcggtctctctaccatgtgctcaggcagtgagtgctgtctggttgaagagtgagtgctcagcatggttctggacagacagagaagtcctcctgcagtagagggtaagagtggagaggggaacctgactgcctggctccgccaccacctgccacgttagtggccttggggcaggaagagaccctctctgttctcaccggtgaaatagaaatgatgacagttcctacctaatagagctgctctaaggactaaatgagctaatgaatttaaagctctgtgattgttgaatgaatgttaggggcttagtgcagtggttcatgcctgtaatcccaccactttgggaggctgaggtgggaggattgcttaagcccaggagtttgagatcagcctgggcaacatagtaagaccctgtttcttaaaaaaaaaaaaagacagagggcttgtgggcatctaacggttggatggggagagaatgctttagacatattttgagttaaagcgagttagatcaagcctggtctgagaatgcaacaatgtgcccctgaacaactgggactgggatggtgatgaggccacctcctcttgctgagtgaccctctgcctcagaactttgagacaatggctctctctctgtttcccttcccagaccacaaataacagcacgtcgaggcatctgaaaggctgtcacccgcttgactatgagctcacctacttcctggaagctgccctccagagcgcctatgtgaaaaacctgaagaaggggtaggtcactggtagttgagtgagtgggagaacgattcccctgggctgaggcttttgacgtggccttaaggctgctctccctcttctctggcctgtgcatacgtgctcttccaagaggattggtgggaactggcttgtgtcacatcttgtcagacaggagtgtgcagagacgttcttagtgggaagggccacgcttcaggaagccacagaagcaataaagcctgtgtgtgcttgggggagactgccaagaagagaaacaggagtgggcatttcaagaggggagggtggagggcatctgggaggtgatgttgaaaaagcaaaggacagtgagctggccagtgggtctggttttgtctactgttgtctgcagtgtgaatgaagttatttggttcctctgagcctcacgttccccaaaaacccaatgggaaggcagattcctgttcattccggcttttaaggagtggtgaaggacgagggaaagtatggtagaagtgaagttctggcgtcacgctggggctgtggctgtccctgctgacgaagcagcagaagtgcttgttttcctgtgggttgtcttgaggtccctggaatactggcctatctgagacctaagaaccatagtgcctggaatgccttccgtaggcttttgctcctgggtgaagcaagacctgccttgttgaatagtcgagggggtggctggtgttaggccgggagtggttgtttcatggggtgtgttgggtggtggcaggggaaggagaagattcaagatgaggagtgcgtattggcagcaagtgtcgcttcatggctattccgcaactggtccggtctgctggcaacatctccaccagtctggggactcccaggcgggagctgaggtttcctgcctgtctctgcagcagaggctttgggccccttcctctgcgtcattacaaccttagacagacacagtgggctggggctggaggacatcactgacgagaggagcagacccataggtgccaagcgcagccgtcccccgtgcgtagtcacgccctgcctcactcagccttccatggccatgggtcaggcccagtaggtgtgaccacctcctcacacacaaggaaaccaaggtcagggtcacacagctttcttgtcactgactgcctggagttctctgaggcctgtgtgccatttttagtgtgatttattttgttacatttcactttatgcattcttttcattacatgcttttgaatacatgattgttgcatatggtacttgtttagtaggataaagcaaacttactgttttcttctaccctatactctctctctttttttttttttttttttttaaagacagatcttactctgacatccaggctggagtgcaatggtgtgatcatggctcactgtacctcctgcgttctgggctcaggtgatcctcccacctcagcctcctgagtagctgggacaacaggcatgcaccatcacacctggctaattttttgtagagagggagttgcattttgttgcccaggctggtctcaaactcttggactcaagtgatcctcccgcttcagccttctaaagtgctgggattacaggcgtgagccactgtgcctggccctactttatactcaatacaacacaggtcatttctgtgaccaaatgtggggttttttccgcgactcacaaccagttctctgacaccagctgggtttccaacaattaaattcacctctgatgctaaccgtcaggcttgatctgggccctggctggggcaggggaaatggaaggagtctgggaggggcacagaggctcagtcccatgaaagactgccttccatagcagataccagtcacaaatagcaggttcccaggttaccaacaacttctgtctcaactggctacaaatcaggttcccacaacctcttctcagatccataagttgccagagcagctcatggaacccaggagagcagtttacttgctagatgactggtgtgcagtaccacgtaaaatggtacagcctagccaggtggaagaggcgcatagggctaggtatgcggaaggcatgcggagcgtccagggcccctctgggtgcaccactgccacgtgtccagcaacctggaagctctccaagcccatgcttttgggtttttatggctgctccattacgtaggcatgatgtattatatcattggccactggtgatcagctcaaccttcagcccctctctggcccttgacagaaaaaatttgctgatcccccccgccactttaaataattactttaaacattttgatacatctttcgtgtttttctatgtgtagatacacagatgtattttttttttttaacaaccacaacaaaatagtatcctagaggacacactgcttgtagcttgctctttccacccaggcttggctgtgagcctctttccttcctgcttatctcccttccccacaaagttgctcgatgtgggggtcgaggaggaggtgagctcagagctatgtggggctgggcacatagtggactgtggcaggtcaggcttgatctgggctttggtgggggcaggcgaaatgggaggagtctgggaggggcagagagggtgggatgaggctgaggattgtaggacagtaggaatctgcaggagagggtccatggccaaataagtttgggaaacaatggattgaagacctctgagactctctagaaccggagcctgaagtgggtcatgaatctccaggaggcggcaaaggcccatgaagctgctgactgttcgatgtggtgcccttgtatggagtgggtctccaggtgctctgggactgccaggggagcattctgaccaaagcacaccgttctggcccaggcagcttttccatctagcaggtatccctgcccaatggagctgcttatcagtaaccttgagcttgagttctcaattgcctggaagagaaggaggtggagttgtttgtccagaatgtggaacaggctgtggtgaggtcacttccaggaggcagtggctgtgatgactgcaacaggcaggtggacctgggccttggggaggcagtcctgccccagcaggacccttgacccaggggaggcctgtgcccttttctctttctctccaccctgcccttgcggttgtggggacaggcacgcacgagtccctatcttccaaatggaaagaatagggtggaaggagctgggagcagtggctcacatctgtaatccgagcactttgggaggctgaggtgggaggatcgcttgagtccaggagtttgaggccagcctgggcaacatagggagactttgtctctacaaaaaataaacaaaactggccaggcttagtggcatgcacctgtagtctcagctacttgggaggctgaggtgggaggatcatctgagcctggcaggcggaggtttctgtgagctgtgattgtgccactgcactacagcctgagcagcagagtgagaccctctgtcaagaaaaaaaaaaaagaataggttggaagggcccctactgggaaacaggctgcctccctttctctcctcatgcctggcagacaggagagtgagaaccacagctgtgaagtcagcacacctgggagccaatcccagctcttatgacaagcctgtgtgtgcatgggcaagtcccttgagctctctgaacctctgctttccttatctgtaagctggtggtaaggaccgtgcctgccttctcatagcattgttgtggggatcaaattatatgtgaacacccacccacccatccaccagggtgcctgatagatcacagctgcctggaattcatgcctgtaattccacagctttgggaagctgaggcaggaggattgctggagcccacaagtttgagaccagcctggacaacatagtgagaccgtctctacaaaaaaaaattatttttaattagctggacatcgtggtgtgcacctgtggtcctagctgctcgggaggctgaggtaggaagattgcttgagcccaggagatcgaggctgcagtgagccatgatcccaccactgcactccagcctgggccaacagagcaagaccctctctcaaaaaaataaataaataaataaaataaaaatagaaataaaggaaaagaaaaggaaaatcaaagccagtattatcatttgttttattatttttgtgtagtccacagctggacaggctgctggcccaaatatgagtcaccttttgttttctttgtgtaatttctcaagtggtaggccagggaggtggtggtgtctctgtttggaatatgtggatgtggaggctgggagacccgaggcagttcacctgcaagggtagggcctgccatggagtcctgggctgcttggaccacttgtgccagagatggggctgaggacggcccggggcactgagaagcacagctgcctcgctccacctccaccatctgcttttttgatcctttttcggttgctgagctttggtttcagagaaacggtggcctggagggctggttcctgttttcatggcccggcagttgaagctggagatcaccactcccccacggctgctgcttggagcgcccttgtctccctctgccagttgtgagctcccagggatgagtctgggggacccaaagagaggccgtcctcagctgtgcctgcagagctctgtctgcagagatttgggaggagcaggggtcaccactttaactcctcagtgacttatgaagcccggcacggacctggggcagttgtgcctgtaaggcaggggtggcctgccgccacttttcttgtaaataaacttctgttagaacacagccatgccccttcatttgcatataatctcaccacagactggagtagctgcatttgggaccttatgggaaagtctgtaaaatttgctgtctttatttgccctttagagaaaacagtttgctgacccctgcactacagaggttaaggagtcctccctccctcccaaggacctgtataggcacgaaggccagaggagctgttcttatctatgaaagcttcctggagtggatttcgtggggaggggacagttctaatttcaatactctgtctcctttattcatccatttcagggatatttcttaggataatgcatgccacttaggaagggctaaattcacaccaggcacttgcatgtctgttagtcctcccagtattccctgagggaagcaccatatttagcatccctgcttcacagatgggaaatcgaggcacggggaacaaaaatgacttgtccttggtagagccaggattctgtgcacagggcccggctgactttcttagctggcggtcttatctgataggctacactgcccacagcaggaatcctgttactgagctgagcccctggggatgctcacgccctgcaggtgctgtgtcccagcttctggtttgaaaactttggtgggtgccctcaccatctggaggaagtaagggtgaggccctggggttggaggccactctgtggccctgaacaggttccccctctgcccctctagttggctttctcccctctaagatggggcttctgtttgtccatgtcccagagggtgtgagggtccaatgagagggaaggaatgcaaaacacctggagtattttcacagctgttaacttcctctccattgagagccccccgacagccacctctaggggctgcctgctccccttccccacaactgaattttctgcaggtatgactttaatgtgaacatcaaggacagccaggagggaaagagggagagagaccagtggcagtcatgctttgcttctgctgggggcctggctgaaccatgtgcttggtgtacagtgctctgggaaggccaggtgaccccattcactagtgagggaggcttggagaggttgagtcacttgcccgagcttacccactgtgattccagcttcgggcctgagcggcctggaaactcatgccatttccaaattttggggcgtggaaggacagcctgggcagcccgtgggtgtgtgggagaagccagggcctagtgacagcggggagcatagagctgatgcacggtgcgctgactcccacccctctgggaccctgaatcaccattctcaaaggatgtctccttgcaggtggtcccaccctccctagagcctgcttccccctgtctgcactctgtgctgaggccacgcatgagggttgtgggtcagtgggtatgcagtgctgcagtgggtggaggtgttgactgaccgtcaccccccagaaagcccaagtgctttcagtcactttctgttcctgtagctccaccccctcccttcctcttctttcttcctgaggcacatgttttggtccttacagccaggatcctggctccaccctgccccaacctcaccaccctgaagaggggtagaaattgagtcatcatttcttttcaaggaaacagcccaaacatttgaaagtcttgaaagtcttggcgtgtaagtagcagtcccaggacacgtggcagttactcagcccctgtgtctgtttcctgtggcccatccagcccagaggagctggagttgcagcctgtgtggctggactgtaaataatttctgtgcacctttcctcataattgtggctaatatatgttgaatacttaatacttaacttcatgccaggtagaatgcaaatgcctttctgtataatcctgtgatgcaggaactaatacaatccccattttactgaagaaaggagaggttaagtaacttgcccaaagtcagagctcacaggtgtagaccccatgagcctggtgctgaagctgggtctgtccagcccatggcaccacgcccagcacaaagcctgcccatggcatgtctacatcagtgagcctgtgtaataccacattgtcccttggtcacagtgatatcctcgtaggtgaatcatcagtttcagtattttttttaaatgcatttgttgttaggaagttaaaaaataatataaagataccttagcccagggtttctcagcctcagtactgctgatattttgagccagataacttcatcatgggactctgctatacattgtaggttttagcaacgtctctggcttccacccactagatgccaggagcaccatccccccactcgccctggccaagtgtgacacctggaaatggctccagacattggcacgtgtcctgggtgggggcacagttgcccccagtggagaaccgctgtcttagcttaaggtgctagaagcagaatacctgtcagatactgacgtcagctcatctgcattcgggcatctctgaatggtctgttaaagggctgtggagtcaggcagcattttctgctggttacattccatcctgccctcctagcctcttgggttgtttgggaagcagggagaaacccttctcggtgttcagggagcttactaccccgtgaggggagtcaggtttaggtgacgaagcccagagaaaggccctcagttcctgtcctgggttgcctcccagtgcctgctatgggccagatgccccgccctcactgcggggttcgagctatggccaggaggaggtcccctcccctcgtggagtgaccgtcccagaggggagcctgtggtggagacggtcaggcagtgctctgtgctgggggggaaagaggcagagaggtgggggtgctgcctggggtggggtggaccctgaaggtgtctgaggagcagttcgccccaaggggccaagagtagagcagaggtgctgcagttcctcagagtcccagggagagggagggatggtggagcctgcttcctgcctgagctcattcccacatgggcctgggtggacccagctgccagcgagactaaggagaccctgctgagaacagggtggggccagatggccacaggcagtgcccgcccccagagtccggctcgtccctcccattgaggacttgacctaatttaaagagtgtgctgttgtccactgtgtacggtgggtggcgattgctggaccccagacgctttccttggagcttcaggaaagcctgggcctccctgtctctggctaagcctgagactgctgcccagttcctcatcagaatgtctgagggatgttaatttcctccaggagtcttgccctattgattcagtagctgattcccccagatggctcttgccccttgctctgtggctgatgacagggttcctaattgagctagaactgaaggcacaggcctgaaaggaccatcaggaattgggaggccccagtgcaaaagagccctcggtgggtgggggtggagggcgtctcttcccctcaccgccactagagggcagccgtggactctggttggagcctcgccccaggcagttcggccacctggttgccagaagggggcacctttctgacatgttttttggggaggcgggcaatggctgctggggccagggtccagactatgggggaggctccagaaatgagcttggttctcttttgcatgaaacagctctaggggtgaagcagtgggggcctgaaaggggagggggaccgtgcagtgccagagaagctggttgtccctgtcagtggctctaactgcactaggacaagtgcctgggcatctcccaaggacaagaatgtgagcggactctgctcctttacccagagtgggcaagagcccatttctctctgagttggtttttcccttccttccgcctagacctggcagcacctattctttgctctgggtccagagtgagcttgggccgtgcacattgaaccaggtgggcagcaggttttgtgcttgttcttttaattttgttttaattagtaaagcaacatgtgctcactgcaccaaaatcaaacaacagagaagggagtggctgtgttttctaagggagttccccagggctttggcaggttgttcaggccggtgaaagcactgtccctttccgcgcgtgtgtgtgtgtgtgtgtgtgtgtgtgtgtgtgtttgtgtgtgtcacctttccagctggatgccgagttggagaggcagcaaaggcaccttagaaagcccagcctgctgtttggtgtgacccccatgaggggttccatcagtaattttgccttgttctagtagccacctggtatctgcagggctaggggaggacaggagtcagactgttctcacaaatctggggttccagggccacagtcaccgaacagcgaagctcattctgagagcctcctggtgctctgtgtcatgctttggggcagagggtaacctctgaggcccattccagcctctctgaatgcacagcctttgtctactcttagcactacctcctcaaccttccccacccccatccccggcctcactagaaaggaaggagcccggcacctggatgacatccttggtgccacaggagggaaatgtcacagccctattctgaggctgggggtgaagaggaatcctctgtttgaaacagaggatttgggtctgcgacaggggtgaacagtttgatgaccatttgaacttcacctgaccttgtcccctgattcacccgttcagctgttgggatctgccaactagctatgctcttctgggtctttgactggtaacctttcatacacagttagcagtactggccctggaatgcggacatctggccagggccatatgcactagtatctgtttaggttccattcagccatcagttccatgtagtttctcattctctgtttcagctcaaacccagtcttccccaaatatttttttaacacttactgtgtgcagaatacttggctaatctctattgtgaacagagctgatgaccaggcacttggtaggcagctggcactttgtaaagacttagcaaattgagtcccaggagttctggagttcacatggccaggaaaagaaaatgtaaccatgctgggtcaagagacaggtgttgtctttctcaggggtctcagggtgaaaagagaggaaaatctgaacccttttgtgcttgccgtaagcctgcctctcccttttggtaagtgacagcctggaaaggcaggcatcttccaggctctttttcctgttggaacatagggatttatttattcagtgatcatttcttgagcaccttctatgcaccacacattgtgctggtacagggataatgaagcctgtctccctcaccagcctcattagaagctgcacggactgagtaaggtaaaggaagggctccgcgaaacgtgtagcactgcctgctgccacctaggggactggggagcttgccagccgcttgcacatcccacccagaggctcccctaagatgaaccgtgtccttgacccatcatcacacccacatctgtctttctgttcctggccaaccaggctttacttgacttggaataaatggcttcctggcttctccccacgcaggctgtttctgggccagggtttgtttgaggccctgtttggatattgttaaaagtgggcagctttgctcagaaaggtcagcatgagagacaagaacaaagagatctttcaagctggcctctggcagggcagccagcaatggctcggaaaagccccagctccacctggcactggcagcttcagagctgggacgggattgctcaggctcatggccatctgcagagccctggagaagccccgtgtgctttctcatttctcagaggagtaagctgaggcagaggggcattctcaggtcagtgttagctgggaccccagatctctccctgtacagccctggccactgggacctctctatttttttttttttttttcttgaaggacattcaataaaaattgggatttacccaaaacatgcctgagggtgattatttggtttgcaaaagaattcctgggagcttacatgctagagtaaaaagacacagcttttagatacagaatcttaagatgcataatgtgcagtcctgattctttaattgcgtgtgtgtgtgtgtgtgcatctgtgtgtgtgtgtgtgtgtgcatctgtgtgtgtgtgttttggaggggagtctgcatttctcccaagcttccaggtaatgccactctgctggtccaagagcgttgatgatgtaaaggctaaaggctgagctcatttggcaatgcagagagaggacagtccttgcggtggagtgggaagaaggggccacagtcattcttggctttggcctcttggtagcaggtgccaggacctgccggccccctgtaggccacagggccctaggcagccccggggtccagccctcttcagcctgctgctgttgggcccagctgccagggttgtcctagactgatgtcccagaatcagccagttcttttctcttcctggagctcgttgaggtctgtccttttacttagtttgctgcagtctgtctttttcctgtcttctggtggtggctggtgctgggctgtccccttagctggcctggcctgtggcctgctctccagctctgggttatttcctgagacagaggcctcagtggaaccgaaggagcttcttgtggggggcccgggcctgtccttgggcctggcttatctaccaggaatcctgttcttctgtcctctgtggggcagagggctggtaggcggaaggtggtcacaaagccgaagggtccctgcaggcacttgtgtcctctcccctactcatgagctcccaaacttccaaactttaacataagtcagaacataagtcatatgatcttcaagacccaaattagaaggagaaaggaagagaatatttaatgaacctctgctacatgcctgagtgtgcttggggccacatgtatgtcatcttcctaacaggactatgaggaaatgaaaagagactaggacttagggaggctgcctcactttcccaagattacagacttagggactggctgcaaagctggggttactgtgtcagattgtcccttctgaagcccgacttcttgaactaggagaactagaagaccccagggcatcccctaaaccagtggttctcgacttgagtgtccatcagaacccccctggtgatctgataaagcccagattgctgggccccaccccaggggttggttggttggtttgttttgagatagggtcttgctctgttgcccaggttagagtgcagtgatgcgatttcagctcactgcaacctcagcctcctaggttcaagcaattctcctgcctcagcttcccgaatagctgggactacaggcacgggcgccaccacagcctagttaatttttgtagttttagtagagatgggattttaccatgttggccaggctggtcttgaactactgacctcaagtgatccgccagcctcggcctcccaaagtgctgggattataggcatgagccaccacacgtggcccaccccagagttcttaattcagcaggtctgggtgggggtctcagaatttgcatttctaacaagtccctgggatacggacgctgctagtccaagtactacattttgaggcattcttgtctgaattatcatttctggccaggcgtggtggtggctcatgcctgtaatcccagcactttgagaggctgaagtgggaggatcactttagtccaggagttcgagaccaggctgggcaacatagcaagacctcatctctgcaaataaaataaattatcatttcttagagtgtgggacaagtacttctagtgacacacaatgtggttttaagtgatgtgcacactaacttttaaaaaatacttctgttatttctaagggaaggtgagttatttactcaccttaaaagaagaaggaagatataaggaaaagtacgacataaataataataccggtgatagtattattaggactaatagtggtaaacatggtgaatgaggtatgcagtctacagaagtctgggagacactgagctaagtgaagtcttcattttacagacctcacccagacttgatggtctctaagggggctgaggttccctgtcctgcttgccactcccaagttttcagagcacttggcaggctagcgaaggtcatcgtaactctgatcctaccccaggagtctccattctcaactctgaagacaagggtccatcttgcttgcgtgtcctgaggccagagctttccagaaggcaagggacttgatctgcaaaggtgtcctttcatggctcccaggccccaaagcccccaggagcctgttttgtgcatgaaattgaagaaggggcttatgtaactttcttggctgccagctttggctcttcaccctctgtgatcttaatttttctgaattcgccagcccagcagcctctgctttcccttgtgtggtgtgatccggggaaccccctgagtggatgagcagggcagcccttacactttcctgagcatgtgctacgtggcaggagctgctgggtggagctttagaaacacgggagcgatgcgcctggccctcaggtggccacagtgtgcgagggtcagacctgcaggtagaaaatgaccttgagtggttttacttgcttcagaagaggaattaacaggcagggcagcatggggaggggtctggggaggcttcatggaggaggtgacattggaacttgcttttgaaggatgaagtggggaaaggccacgtaaggcagtggaagaagccagtgccgagacttgatataggggactgcggtcattcagaaaggacttgcttgagtgctgggggctgaggtgggagaaaggtgaggggcaggccccacagcctcaggaagctacgctgagggcttattctgtgagccctggggccactgtagggctggacttgagaggatccaggtgaccttcctgcatccactagacccccaaggcgcagtgggagcagtttttcacattgtgggccacagcctgttagtgggaatgcaagatctatttagtgggctgcagccagcatgttacaaaatgggggtagaggtagaaggaaaatggaaaacctcagtgttgattgcacataggagagatgggtattttgtcgagaaacttcggttttatgtcagggaagtgtatgtgggtaatgggttgccatgtaagatgtatttgtcactatggctcacacttttaaaagcttgaaaactatttcaaggcacagaggctgactgaaagtggcgagactggctggtgtggtcatcaaggcccaaggtgaggcaggccagcctggggccatggtactggggacagagaggggaggatggaatccagcatcaatcggatacagcaagtgaagctggagaatttgagactgactgaggtcagaaagtctgacaccagcccaaggctcttagtccaaggtcacaccttgtttgagatactcaatcttggtacccctttggtggtaaaccggaagcccaagttgctggggggaaagagggaaagggactaggggaaaagggatcctccctcctttttgttgatgtcctgggcctctaaagtcctggtgttacaactctaacttttcactccagttatcgaatgtgttcaaataaaactccagcagtcagctcctcctggggtctgctggtgtgctgagagcatccttctttgcgagctaggctggtaacaaatctacttctgccgtcctcccaccaggaacatcgtgaagggcatgagagagctccgggaggtgctgcggactgtggagaccaaagcaactcagaacttcaaagtggtaatgtggggtgctggcagtgctggcttatttaggagtcagctttggtgggagacaacagaagtccttgcagggagcctgtgaagcaggggtggcagtaggtctcctgcctgcttgtggcagaggttggtaatcaatctcagcatcctttcccacgcagccagggaggtgcggcctctttccccccgcggcattgcagatagtccctcatgttaaatcagatttcagatctactgccagcgcttccctgggcaaactgtgttgacaaacttgctaccaccactagcaaggtgctatgcgaacttttagggatttgtttatgatcctaataaacagcattgaccctgcttgcctgccccaacacaggcctgccctcctagtccttagtttgtccaaaccagagagccacagctgcttcttatgctataattctccatcgaatatcagaaaggcacctgagagagagagagctgcccatgcctgtggcattatgctcttcccaatactgcaaggtcctgctgaatactcagagtggggctgggctccaaggggtcaggagagggaggaaatgctcctcttgtctaggagaggagagaagagaaaagatgaggtaggagccgtctgaggccagcagaggggtgggagcgccagtgttggagggactgaaggagcaagggggctccttgggagtggggttggggagtttacccaaagggccgcacattgcaagcggggcagatttagctgggatgggcagagggcgttctaggtcatgctggggtagagctgacaactgtgcctgggtccgagtgcttccctctctgccagatggcggccaagcacctggcgggggtcctgctgcactccctgagtgaggagtgctactggagccccctgtcccaccctctgcctgagttcatgggcaaggaggagagttctttcgccactcaggccctgcggaaacctcacctctatgaaggagacaagtaagttctgcctgccctgctgcaccttgccagtctcacatctcacgcagggttctgtccccactggtggcttcctctttgccccatgctctcctccagtctccactcagcacactgccagccagcctcctcagtctcagcaggagccagatgaactagagaaggcaggtgttggggtccaggttgtggagataatcctataaggcactcggagaccaaagaaatcatttagaagttacctgtcttcccagtagtcttgtctgatacacctctctctcgcttgtgccattcatcgaaggtgcggtctgtagccaaccagcagagcgtagttctggcttctccctgcttcttgccccagccattccctgcagtgctggtgctgggaggaatgtttcctccctgggagaatccgtactattccagcccagcagccaccacccaccgcagcctttcagatccataactctggggcatatggtatccggtgcccatgaattatgcaggaagaggtcaccttaccgagctggtgctgactctggggcagaaggctggcatggtgggtcagtggtgctgtctggtgaggtgtgtgctctagccaggcctgtcattggtgtctttcagcctctactgccccaaggacaacatcgaggaagccctcctgctcctcctcatcagcgaatccatggtaagctccaggatgtccttcaggggcctctggccctctgaccctgtggggaagggctgtggggcccaggtacaggccacccgtgacctagccaaactctgtctcccagggatactcctaaagtagatgcttcttggccctgggcccccatacagcaagtcttgctcattaggtttggaattggctgtcgaaggcttcatttggaggcctgcgttctgcccccaaataagtagagactgagtgcctaagtccccacccacctcttttgggattaaaaagatgatcatcaacaaggtcacagtaaaatgttacatagctgtgtgttgggtgctgtgacagatttgagaacatggcaggtagggaatggaaggaatgtgtactttggagtcagaaagcatggaatcaggttccagttctgcgtgttagttgagggctggggcacatcacttattttctctgagcctccgttttctcccctgtaatataacaatactcacaaaggtaagtgtgcctatggaaggagttcatttattcacgcaacagctatttattgagcatctactttgtgccagaccctgctctagacaccagagatgccgcagcaaacaaaatggagaaaagtcctttccctcgtggagcttacattctagtaaagggaagcaggcagtaaattaatcaaaaactacaatatgcaggatgtccacgcgtgaatgctatgggaaaagaacacagaggagaagacaaatcgtgctagacaaagcacacatgaagttggctgtttagacttttctacaggacccattgctcatgtcctgggcaggaagatgaggcaaacacaagcacgtggatgcacgcacacactcgtgcttgcacacatatggtggccatggtaccaaggaatgtttgcccagggccaagcactttgggtgctcagcaaaggagagtgcactgtggctgtgtggttgaggaggtggtaagatgaaggatggactggactggtccaaagggggcacaggaagagtggggcaggagcatcagaagccaagcacacaggagtcatctacatggtcaggtccaagtcctccgaccaaggggcccatcagagctggtgagctgggaaccaccaggttgagaaataggtttttaaaaaaacgacgcatctgagagcagtgtatggatatggaggttaagaaaccaagatcccgtgagctggatccctgaacagccagaagtgaatgttcccttggatgcctgggaccatgcgatgccagggcttgcttagatagcgttggtaatcagattgcctctggtgcctcaggcctcccagcaaataggagcaggcgctggcctgtggggcagagggattgcatcctgcctcagctggggctggtccatgttggatctgagagtttctgtgtagggtgtggatatttggatgggagtgccagctggccagggtgttgccctaaaatgtttgcctgtgaggtgggtaagtggttgcccaggggaggggccatctcgctggttagcagctgtggagatacagggaccatgtgccacatctgattttcatgggagaacagtgtgctttttactttttaaaatgggcccttactctgaccacagactgaatcctagttttgaaatatggaaccccagatgcagaccagtattcccatcccctctccgccatttcaccacgttcaccctccagtgagactgccctggaatcatctgtctggaaacacagagttttttttgtggtggttgttgttgttgttgttgttgttgttttttgagacagagtctccctttatcgttcagactggagtgcagtggtgcgatcctggctcactgcaacctctgtctcccaggttaaagcgattcttctgtctcagcttcccgagtggcttggattacaggtgcgcgccaccacacctggctgatttttgtatttttagtagagacggggtttcaccatgttgaccaggccagtcatgaactcttgacctcaggtgatccacctgcctcagcctcccaaagtgctgggattacaggcatgagccactgtgcccggcctaaacaccggttattttgtggcctttgtgtactgaggcttccagtgcaatttacaggtaggtggtgaaaggctggaaacggggtcgtctgttaggtcctttctcagctagggaggttccaagctgattaggtgcgcattatgttgagtcatatgaaattgccaattttcaattgtttatgacctgcaaaaacaacagtttcatatagttcagtctaatactgtatgttcccatcttacagatgacaaaagtgaggtccaggacaggtatggctgttggtcaaggtcatatactaataagccttgaagccatgactcgaacatgtccttctccctcagcagtttccaagccccaggacgcagggctcctggacttccatcctggtacttcccttgcccactgctctaatccttgttcttaagtgtaaaaggccaaggaggtgactttggggatcagagggctttgtaaaagggacaagcctgtcagggtgaggatggtcataatttttctcctggtaggagtgaagctgagctctgtcttcccaagtcattttctgtagcctctgcttgatctgagtcctcaggacagagttcagatgcctttcagttaaggctgtccacccacccccaaaccctccaagtggagaatggccttttacagaaacatggcccgtgcttggagccaggtgggttttcctgagtatgcgatctcctccaagcagctctttcccttttgtaagacagtgtggctggcagcctgcctcagagactaggggttatggggtgggtgagtctgggttggctggccaggtggtgtcctgggagattccctgtggcataggaaacagaggcactgcccagacgctgtttgcactgaggctgggaggaggcacctcttgtggggttggctggtttgtttccccttacgcacacccagcctgttagacattcagaaacttgagggatttgggggagagtattggcaatgaacttagttttagtgtttcatctgcagtgacctttcccccggctgctggatctggcctctgtggctgggaatggtttctctaagtggccagacctgccttttctcctgcctttgttttaaattctccttccctccaatctcattcttgatcagtgagaggactagggtatgggttccactctaccagcctcccaagctcctgccctgatacctctcagctgaaccccaaggctccatgtacctgcagggttttcctcatcccgctttgatgttggctgggtttggctacaaatgatgggcttggggagaaacctctagaacagcagctggtgaccttggctgctacttaggttctcctaatacctgcagaatgcattatgctgcagtgaaagctttttccacagagccaacccaggaggcatcatcatcattgcttccacctccaggacatccagagcagctgctgcaggaaacggtgtttgcaggcctccttgttttgtggtttggaactcaggagtggctgtgtggtgtggggctgctaccttggatatggtttttattacaagctgactatgtgcgatcagaatgaatgagggagaccttgtctttcaagaggtaaatagaaaccttactaatgctttcacaggaatgcaaggaggatataagatataactggttgaagatgatttctgttttggacctagttttgggtcttcggagccaaaatgacatttaaaaatccacatacttatcattgattcattcatatatcgatcaccgacccactttaccatttatccttctggccatctaccctcccatcatttctgcatccgcccatcctcctacccaccattcattcgtccacttattaatccattcatctaccatccatccatccacccattaatccattcatccaccatccatccatccacccattcattcatccgtctacccacccacccaccaaccatgcatccccctacctattcatccatttatccatccacctcccattcatccgtccaccctttcctccatccatctacccaccattcatctgtccacctattcatccacctatcattcatccatccacccatcattccatccatcccccattcatccatccagccacctaccaaccctgcatctacctacccattcatccattcatctgtctatccacccaccatgtatccatctaatcttattcaaggagctacagcatgcgggaccatgctcagcaatgtaaagacaacgattaacagttcaatcatagttcctgtcccaaatggactcccatctactgcagtttgtacccagggatgtggaggaaaccctggtccccaaatcagaaggaatgaccccagcctgctgaacctcaaacgtaaattcttgtttttgaaagaaccgtgtatcaaaccagcctgattttctgagacagctggggaactaggagatacaggaatctttcttatttctgaaatactgatctggggcataaaaatatgtgctaaagtaaactgaacccttggatccctgtttcattcagctggcgaacaagttgctgctgttagaaatggaaagggtacagagccctggtgttgagagtggggtggataggtaagtctctgggtcctgggactctgcagattaacagactttgtgccatgcccaatgctgggcatctggctgtttgaatcttgaatttaccattcacaatctgtgtggcctggttgagcttcttaccaccctgagcctcggttttctcatctgtaaaatggagctaataagatctttcttgtatgactttggtgaattaaataagaaaatgaatgtgaagtgcctggtacattttggttgttcaatatgtcctgataaatttcctcattctgtcctgataaatacttgattctgacttagtcatttttgaaaatgttcaggtctgattgggagataaactggattaagggtgccattcagttaaaaaaaaaaaaaaaagtgcttcctgggcttgattccattagggattcagcagatgagcacagattgtttcagcttttgggatctggtttgttctaacacaaggccctgctctgctgaaggctgaagcggtgaagggtctgataacactgccagcttagagcccttggttcagtggaggtgggagagcctctctctctaaccggcagaaagagctgttttttctgctgcaggaacctgacgcagcaggagctcggaggctggcgtgggcctggcctgggtcgctgggtggatggaacatgtcacagagcatgttatttcttggctctgtggactggcagctcgagagccagtggtaattatgtctgctggtggggacgacagcacagggggagcatgacagtgtcctccagggagggggcaggtgctgggtacagatactgccaggagacttgtttctggggtagttttgcgggggctgagggtggcagcaacaggccctgagccttgttccttggccaatggagagcctgtttttgagaatgcggttgatcagggccttggacttgttgcccagggagcatgttctttgcagagaagcagcacccagggcctgatgggagaagcctggccttgtgttttgcttcagttcttttataagcagagccagcccagggtctcttatggcacggatgaggctattgggcacttcctcggaggtacctggaggcacagaaggagccaggagtgaagtcagaatgtctgggctctaatttaggtcccaaccccctgtcttgtatgcattggaaagcttacctggcctcccttagtcttctcatctgtaaaataggctgagagtacacagaagattattgtgagcattgtgagatgccgtacagaacatgctccacatggtagtttcctttccttctcttagactggagccctgtttatgtccagggttagagaggagaaacagggctgggcagagggagaggttagtgctgcctgtggccctgcagccaccaaaggatcaggactagtcttgtatcttactaggttggaaaaagctggcagaggagcccccaggcagctagagctcaggcaagcagcagcagtcccagactggccgactgagggaatggggggtggttcagcctcagctccctgggaccttatgcaaggtagttcatcttctggggctcagtgtcctcatctgcagagggtggggggtggtcagtggtttcatccctgcccagggttactgtgaggccagatgagacggtggatgtgacaattcagcttctaaaggagtaatgcaggccgggagcggtggctcacgcctgtaatcccagcactttgggaggccgaggcgggcggatcacttgaggtcaggggttcaagaccaacctagccaacatggtgaagccccgtctctactagaaatacaaaaaaattagccaggcgtggtggtgggtgcctgtaatcccaactacttgggaggctgaggcaggaaaattgcttgaacccaggaggcggaggttgcagtgagccgagaccacaccactgctctccaacctgggcaacaagagcgagactctgtctcaaaaaaaaaaaaaaaaaaaagagtaatgcatgtcacacgcatagggctggctgtttgaccaagagtagtccctgccttgggtttctcatgggccagcctgcctgaggcctttccctaaggtcccatgtttgcttcatggatacttggtcaaagaccagaaatgtgttatgctagcagtgctgagctgttgggtgatgggtgtatggggactagcgttgtttctttggcttctcctcttctgacctgccagaaggcttgcagtgaatgttctttaattgaggaggggctaccctaggagaacagccggaaggacaaaggctaggagcaggacaactacacaagccctaggtttaaatcctgggattaaatgcatggattaaacggagcagtgcatccccagcgctgggcagccttggggtgggtgtgggggttatggcagtgcacactaggcagggagaaaccagaggagaacattctgccattattctaagaacagtgaggaagagacggtgagaagatttaatgttcatgtattactttaagggtcacaagtgcattcacatctgttactgcatttgatctagaggattttctaatgaaagaaagcaggattctgaggccacttcaatggtggaagggaaagagtgtggctgggactaggtcagagctactcccagagcatgggggtacaccatgtggcctgagggcagtgagccagggaggagggagcaggacagctgggggtgctgggaaggaactgatgctcccatagtgtctgaggccctggcctcagaggctagccctggcccctgagctgcacattaattctgttctgctgtggcttacccaccagcccccatgcctgccttttctctgtcccatttccccctacccctccctgttgccatggttacacacacaggcactgcccagcaaccaccaggaatatttcacttcggccctgccccaaagccatagtaaccactcagcccacttctgcttctggctggggaatcacagccctctcttgcacaggccccagttcgcaccagtccctaggacccccagggagccttcctggctgcctgcctattgagggcctatcaccagcctgaggatttgtgctgctgctgctgccgctgctgctagtatgctcctctcttctgttcctattcttctgacctaattaacgcccggttctgaaaatccacccctccctctgccagacacaaattcagacactgttctcttaaaggtcaaggtctagggtggacagggggaggtttccactccaggcccagagtctttctctcctgagtgtcacaccctgcaggttgagtcaagttctgtgcgtgaggctgtgcctggggccaggagtctagccatgagcaagaactggtgaaccagacgggggcatgtgagctgaggcatgggctgggttgggggaggacaggagaggcctgacctctcctggtgagatgagttagggatggtgctgtaagagggtggtcctgaatggggttgtgaggaggtagaaggtgtccaggttgatagagggaactgcagcatgaccgaagatgggccatggtgactgtagggaccagcaaggggttccatgtcactggagagaagcccgccagttaggctgccccagaaaggagtttagattttatcctgatggccatagtgatggctcgcagcccactatcccctgaacaagattggtctgcacagacaggcaggagggtccccagaccctggatgtgcccagccaagcttcttcccacccctgcagactgcctggctccacccgctcccatcataacctcttgcttccaccagaattccaggtcagcctccactcggggatgtgcatcctataatgctgctccttcctgttctccccatgggcagggcctctgtgcccccgtcctctcacacccgagccactcttgcctgttggaggccgcccctgtgggtccccaccctgggtggccagagctggggagctgctggaggtggtggagtgggtcagtacatcgccggggacagaacgagggctgtattcctagttggctcaggggactagctcctgccaaccctctccctagaatttcttctctcttcctgttggtggctgtgtgggtggacttcactgggaaggagggggatttcttggcaccttctttctccactcctctccttcaaccctttggagctcctgagtggctcctgttccacaggctgactccagagctcagccttgccgggatttccgggcatcccggcaccctctcctgggccatctaagtccatgggggcatgggcagcactcaccaactgtggcaacagggcagccatcagaacccctggccaccagtctctcagtgactgagctgtcccccagggtgagtcacttccttgggtcttggaggtgttttggcttccagaggcttctgggaggactccctccagccctgcgctgcaggacacacccagagcctgtggtctggaggcctcaggggcttgggcttctgcctccagcgcctcacctggaggaggggagagcagtcctgcccaagggaagctgtgaggcccacttgctgcataggagggatggggtagctctgatgagggagatctgggtttttagggctggcagctcctttttattcggttaggaaggctgagtccttggtcttgaggtcctgtgtatggaagcagaggagggcaagtactattgtacagaaggaggctcagacagagggagggagatgcaggagagagccccatttggcagaggggaatgagcaggagaagggaggatgctgggggcggcccccagcagcatctgcccagaacacagctctgcccagctcccgcacagcccttggagtgggggtggatatgttaccatttctggccccagagtgtcctctgcctaagtccctgccctgtggctgcttggaggcccccatgactcctgcagctgaggagcttctccctttccaccttttgcccccagcctgcgtgttgcccccagggtatagaggtgggcagaggggtgggactatctgcacataccaaagaacacaagagtcccacatccttgatggggagcttctggcttggtgatgaggagctcccctcttggaattagacagaatttcccgctcatacagcacctttccctctcctaccgccacccccagcagccatctggcaactctgtgagctactgaaatcctcggcgctggacgccaagagcagagttcttgagtgtggggaagctctccctggggagggacggaggagagtttccatggttggaaggagccaggagagggtccgggctggacacagagaggaagggaggggggggctctgggaatgtcgttgtcaaagctacttgagaggctgaagaggaagagaagagggcactgggggccacagcccaacctccccaccaagagtcaagcagcagagccacctacccaatccaggcactttcacatcttagccaaaactcttgctgtaattgtgagaattgcaaacacaccagggactgttccataaaacgactggcctgtgctcctcaaaaatgccagtgtcatgagagagaaaggtggagggccgcttccagatacagggagattaaagagacatggcacctgaatacaaggtatgatcctggactggatcctggacaataatagttatatagagagaggaacattgaggaagggttttcggttatgagactattcttgcaacttttctgtaggcttgaaattttgtagaataacaaattgaataccagaagcttgacccctcagaactgctccctcacctaaactgggctaagggtgaaggattttctctcttggagagggcctttgtggagataggaaaaggccatttctgggagtgtggccatctttctggcttggggcagtggcaaaaaggtgatagcggctgggccagcaaggtgggggccctgcgaagacagacacctgcttatctactctcctcactctttcccaaacaatgtcccacccacaggcaactcgagatgtggtgctgagccgggtgccggagcaggaggaggaccggacagtgagcttgcagaatgccgcagccatctatgacctcctgagcatcacgttgggcagaaggggacagtacgtcatgctctcggaggtacggccggccatgcagcccaccccactctccggagtcaggtggtctgtaaaggaaatcagacagagccatttgtcccttctccacctgtcattcccctgccaggctgctctgccgctttgacctcggcaagttgtacaagtctcagcttcctcattggtgaaatatgggtagttagagaacccacctgacaaggttgttggggagagtgcatgtgaaaggctgagaacagtgccatgcacagtaataataaatgttcgctgctatttttattacatgtctacgttttgaaagcactttcacaaatcttattccatttgctctttgccatcaccctgtgagatcattcacatgttaaggaggtgaactgagggcctgagagggtgagagacttgagtagggtcacacagcaagccaggggcaggaactgggtttcggcagggtgtctcccaggagccaagtgcgggcctcctgcagcctcccaaaagcggtgacttgggcagtaactaccctggaagggtgcggatggctggggtgggaggacccctggtgggtaaatgctgactatctcccctccccagtgcctggagcgagccatgaagtttgcgtttggagaatttcacctttggtaccaggtggccctctccatggtggcttgtgggaaggtaaggcccagggggcgctaggggttgcacactcacccgcagggggctctgctgagatggacagaggggcttttctggccaggggagtgggtgggtattatcctgccgctggtttgaacctccgggagagtgaggggcgtggggtgggccacacagacaccttgtgtgaattcctgtccacgtgcgagctgtgagtgtgccggtgtgctggtgtgagtctgtggatgcttttctctgagcgtgcgtacatgcatgggagcactgtatcctctgtgctgaagagctaataatgtgactgcatgtggtggatatgaggtgcatccaggtgagtgaacattgttccacgtgggctgtagttctcatcctgtccactgagcatagcatcaggaaatggcctgcttgtggactggagacttgcctcggaggggaagcttaaagggcagagcagaacagcagcacccacaagggagttcggagggagtactgcatgatgcatggggctgggagcacctgcatggggacagggcctggcgggacgctgcccggagcaaggagcaccgggcatgagttcactctctatccacccagctccggtgccatcacccctgctttttgctccgatcagaattatacttacataagcctctattttaagcagtgacatgaaaggaaaacctttctggagctgagttctgagggtgttggggctgaggatgctatgaatgcaggaaataaggtggcatgagcttgcagattgttccaggagctgtaaatatccagagccctttcatggggctgagggaattcctcgcccccctggcccatctgtgccacgttccatttctggccccgcagccgtctctgaggagggccctcctggcttgccagtgcctcctccacgcatcaagggcgtgccagccagctcggggcctcggcagccgaggcaggccaggccctggcagggagggggaagaggagcaggtgctgcagcctgagtgcggggagaggcttgctggggagccttccctacccccatctgctgggcatgtgtctttccaaacctctctcctctcccccatcacatcggacacctcacagagcatcttgaagtcacagcatgatctccttggctctgtgctcagcagggtcttgtcaaggctcagggagaattcagaacacagggcaaggccctggccctccaagggttagagagtgagagaaaccctcctacagaactgcaggcaaaggagacaatgtgggcaacggtgaaggggctggaaaagacgagctggccgtggggatggggacaggaaggtgttgaaggcaccggtcagcctggggtagtagggacagggccgggaggaggtggggctggatcttccatggagcctggggagacagctcacagtggcatgggcaggttcttcctacctctgggaaacacagaaagcccgtctaatcttgggacagtgagtacaggtgggagaggcctagggccagagcagtggttcgcacccttctgtgggtcctggactcctttcaggaggtaagggaagctgaggactcctgctcagaaaaattcactgcacgtgcaagttagctttaaatccgagagaggctcctagacgctctccaggctcagtcaaaggtgtcgtgatagcctgggaggtaaggagtcttctgcctctgactagctggactcagagagatccagacacagcctggcaccatcccagcatccagggagctggtttcgcgacttggctccttcacagaccagcaaggtggccccgggagtgggcttgcatcagggagttaagattggccagttgcccatgcatgaggcttcatgggctggagacactgtgtgttcggtgcagcaggagattgttctggaaagcattctccaccccccttgggaaccctgcccaccaaatcagtctgcctgattgtcccaggcagccctcaagagtggccagaccttgcctttgctgaaagcctaaggtggaatcaagggcctgtatctgtgattatgcccgaaaggccttccagaaggtgagtctgggtagttgaacctgcaggaataatggatgagttccgtgacatgatttaggtcgttccttctcttgctctctgtgcggcaattgcattggctgtgttgctaggtaaccagcatgacaaaaaaaaaaaaagctgctgctccggctgctgagtcctcagatggctccttaaatagcagcgttttttggtgtacgtgggggtggggtggaacggggtggaatgcagagggtcagggttagagaaccctgtgtggcaaggatccagagttcagcagccatgagaaggaggccgaggagaagcctgaggcttgctggggtgtggatggaggggccttggggagggacttggagtggtgttcccagggcagggcctcaggaggaggtagatagcctgacagtgccttcaagcccctcaggcaccctggcacccgcccactctgggcaccctgtggagtctcccagcctgcaggagctggtcacctgctaacaccctcttgtgcttggcctcctaccctcttgtttccagagagagccatgggggtggtggccttttttgtctctcccaccctttctgtggggtcctttgaggaaagagccatgacctcatcccctttcctgagtgaccgcacaacgcctagcccagtactgggtgagagcacaccctcggcaaagacacccgcaattaacctaataagtctgagccaaagcccagggaaatctatcacgtctgggttgagaaaagctcttccttagatggcggggaaaaggggaggccagctggagggaggcggggtgtccagggtggacatagaccattcggatcatagctgtgcacctgccagttgctcataccctgctgtagacaggcgagccttccagagcctccgtttccttctgtacctccagagttgctggggggatatgagagctaattaatggggggttgcttggcccacagtagggcccagtacatgggaattgtcatagttacacacaggtacctgtaaacctggaggtcacacaggtacaggggtgtacacactgggaggattactgctgagtttcttagaaaaggttccagcccagaaagagtgtgtgtgtgtttttttttttttttttggtggtgggggggacaggggagggggcgcgcagggaaacaggccgcctttctggccaaggtgcttatcatagaggcagtgtagggtagtggttagagccaggctacgttcaaacctcagctcagccattcataggctgtgtggctttgaacaagttacctgacttctccgcatttcagttttcccatctgtaaagtagagtcagagtatctgcatcataagattgctgtaaaaattaaatcacttggtatttaaaatgcacttagaacaggggtctccagactcttttctgtaaagggtcagatagtagacgttgttgactctgcaggcccaacagttttttgcaactattccactctgctactgtatcaggaaaacagccatatacagtatgtaaatgtaatgcacatggctgtgttccagtaaaactttatttacaaaaataggcagagggccagatttggcctgtgaactgttttgccaaccccagacttaggacaacgcctgcacatcccaagatctggataagtgtttgctgctgctgttcttctcattactgttattggtaacattcgtgtctggctgtggctgccccgccccgcccagccctccttcacacttggccgtcctcagcaggtccagtctgagtccctgaagcctggggggatcctcagattactgtctggaggttctctccggctctgccagtttagaatatctccccttcctctctgccagcctttatacgacccccaaccccgccattggccatgcctccagagtccttatttatttgtttgtttgtttgtttgtttgagacacagtctcactgtgtcacccaggctggagtgcggtggcacaatctcggctcactgcaacttccacctcttgggttcaagcgattctcgtgtctcagcctcctgagtcgttgggactatggacacacgcctccacacctggctaatttttgtatttttagtagagacggggtttcaccaagttggccaggctggtctcgaactcctgagttcaagtgatctgcctgcctcggtctcccaaagtgctgggattgcaggcgtgagccaccgtgcccagccctcatttagagagcccctttctacctctaaaatttctgtgcttgaaatttgaattccttggggagaccttccattcgttttcatgttagctgtcatcatgttacctaaagagcaagggtcacagcctctaatcttcagatgaggaaactgaggcccagggagggatttgcctgccgacactgcctaggcttctctgccctggacctcttcctggctcctgagagcaaagggatacagagcaaggcttggttgtttgggaagctcgccccactgtgggcccttgagatccaggactgtgagtgacagtgtttcctgctctttttttctgcagtcagcctacgctgtgtccctgctgcgggagtgtgtgaagttgcggccctcggaccccaccgtgcccctgatggccgcgaaggtctgcatcgggtcccttcgctgggtgagtgagctgtgagggcaggtcccagaggcctcctgtggggagggtggcagcagctggctgtgcacgtcttgacgtgtatgtgtgggtgcatgccgaaggtggaaaggatgggagctaccaggcagatgggcctgggcagggagaaagtctctgaggagctgccagcctccaatggcagggtcccctgactcaggatggtgtctggtttggcagttcagccttgaactgtggcctccagagagtgaaacataaggaagtagaggtgttccccacctgcccagcagcagagtagtaggtaagaccttgagtcacctggaccagcctcatcatttctgaggcttcagatgaccttagcatccaatctgcaagggcctgcaaggcgcgattctgggggcagagctgctcttggcggaatgggaagttggtcttttctgtcagcccctctccttcctcttggctccagccctccagggccctgccctgtgctccgctgcctgcttactgctctctgcagaagcagctgaactgttaggaggctatggctccaggtctgctctttccccagttcgaggcctttaaccccccagttgggggttgcaggctcctgaagactcccatgagatcagcagcttggagtagtgaaggagaacagtgccaggagcccaggtcccccgccttgctgtagtcctcctgccctgggcctactcggatgctgctccaggcctatgggggctcttgggccacggcactgggccccagcaatggggcctctgtgcaggtatctcttccgactgggggcccacttctggataatctttgctttcttcagtcccaatcagcttgctgatgtcagcctcctatttctaccctctcaagcaacacagagcaagcgcattctccctcccacatgatggatatcaggcccttctccacccacatctccccagttccttcatctgctctccaggcccagggtctcctaaagtgggcacttcccctggagatggcctccctgtcttccagttggcctgacaccttcggccaccccctcaccattgtgtgcccagcttgttttaaggcagtgggggccaggctctgggtgcatgcagcaggagcttcataattagcagcctttacaactcttcttgccactttccctcctgtacacaaacaaatcatggattctggggagggaggcaatgagctttccacaaattccatgttccaacctttcttccctgggattggaaactggccccatccctctgctgggtccccgcctcatcatcgcagcagggcttgccttctctctgctccagggagtcagtcctcccaagcacaaagaggctgggtgaaaagagcacctttccccttttccacctggttctcagatccctgtgtctgaagtgccccatcccctctgtggctgatcaggaggaagggaaagtgtggcatctggctcgtgttctttatgctgtcatttaggctggggagaattacgtgagatcagtcctgtaatgggctctgggctttggaaggagcagtgtaatgaggtagttaagagtttcactgcccacccactgggtaccctagagtaaggcacctaacctcactgtgcctcagttttctcatctgtaaaatggaaacagtaagtctcctcgggtgggacataaatgaccaagtagggagagggctggacgggtcagggaggcatcatggaggaggcagcctcagactgaactgagagggcaagggaggatacaggagggccaaaaccaggcccttgcatcacagcttgctttcccccacctcatgagtatcagggaacccttggttcccaggtcttttggggaagacagttggcacccagaggtagggcgaccttgtgagcaagcacttcagatacaggtggcccatgggtgctgagcacgtgcagcagagggtggagatatgagccagagtgtgcagagcaggtgggctccccgaccccaactcaggccgctgcttgctcctagggcttctgagaggggcctcaagctcatctctgagatgaaacccaaaatacccatctctgagggggtgtagcgggggagggcatctgtgcccctcaaggctgccagctctgaggtagctgtgggtccacccagccaacggccgcccttgccaggaagccctaaatttaggtcttcccaccatgcaggagctgtttccctcagcagcataattacagtaattatgtgcattcagattacatggtaataaaattaggatcaaatcagtccaaattgaaatcagatgagttaggagcaaagtaatcaatgacaacataaatagaaaagcccaaaaggaaacttaaacatgcagacttgtcatcagaatcgaggagaagggtgagctgtttaacttcagctgagcagcatatttgggttcaggggctagtttgagccagggtttaaatcaggcacaggccagagtgatgtcccatgggtggcccgagagtgggctcctggcaaccttccctgatctggaagcttcaccccctgcacctcctacctgtcttggatacagatcacatcacattgtgatcatctgtgtttcttgagtgcaggaattatctgtctcttctttgaaaccccagcccagggttcaatgcctggtgctcgctggatggatccttcttgccgatggacacattcacttggcaatgaattctgtcttatgtggtgcatgacttcccaactaggtggggaacttgctcacttgccatgtcttgcactctgaccccctctcccccacaggaagcctacatatagtaggtgctatactagtaactgacgaagcgacacacatcccaacctgccaggaagggaccagatgagggatctgtatttggtttgggggttctcccagcactctgcacctaattcttgctccctaggtggcactgtaaagagagcaggctgtgggatatccaagggttctgagaagggaggcaacaagctccccacaaatttcgtgtttgagcccctttttctcaaggactggaaactggccccatccttctgctgggttcctgcctcaccatccctagttctacagggaggcccagagtgggtcagccctgtactctctgttcctgaggctcacagtgaaaagaatgggtctgcctggcaggcagggggtgttcgtgcatgagacagggcacagatcccaaaaggcggctcacacccccttcgtctcctgccttcgcagttattctggctcacgtcagcccccagcaggcccagccaagccccatgagcaggggacagaaatctgggggtggtcaatttggcctgggttgcagaaagggaggctgaaactaggacatttggaaaacgagttgtgctgggtgaagctggactgggtggccatgtgcccagaggcggagcacctgctcttcccacatcctgtcctcatgcccagagccactgttggacaccccataccgggtctgggtctgagagcaaggttgtgtcttggggattgtggcaggcagagggacgtgcatggtcacgtgctggctggctgattcgggggtttgcaccagggtgggagtagctgagcaggtttgggtttggaatgggagagcactgaccctggggcttatcttgaagttccccttggtgagggagggcttcccaggctctgactcagtgacgccagcactgaaatcagagaggcctgcatggcagccttctgccttggcatgcccagcctcctgccagggtccctatttttgcagcagaaggaaagagagatgtaaatatttttttgtatccctccaattatttaaaattcatttaacttaaaaagttgaaacctttacaggaggcaaagaggaaaggctatgcatgtgtggtgtcacacagacagcagaggagttgcaaaatggaaacagggcatgcttatctttggaaaggtctctgatgccatctctcacctccttcctgaggagggcagcagggggtagtggaaaagtgcataggctttggaggcagagatggtagagttcaaatttctgcctacccatgtactcccacttactagctgtgtgactttgagggagtaatttaccctgtctgtgcctcggtttcctcatctgtagcctggaaacaatcatgtccgccattatggggtagctgtgaatatcagagatgacatgaagagtgcccctgcttagcacactgcgggtacctgcatggttgctatcaccgttacagccccttgaaaatagcaggcacacaaaaaggatgcgccttgatgtttttgacttcatttttcaaattcaggggtgggcagagccaggaagatggattaagtgttgatgaggcaggggagaaagaatgccagccctcctgccaccagcttgtagaaattggaaagagtgcctactactcctcccagggagaaaaaaaggggatttttcagtagagcagctaacagcaggttccgggctcgtgggaaggaactaaggagaaactggaggtgctgttaaaaactctgcgggctcagaaacgaactttctgtagttcccagaaagagaggaacgagggtgaagattccgagggcaaacctttttggctcactgcaaggtgaggtaacccttgaaatggaaggcagtcctgggcattagcagagtgtgtgagcaagaagccagtctgtgtagggaccaaattcgaaacactggagagacagaggaacttgtaaagtcacaggaaattttcccttacttatgtaacacaaaaacaaaggatcaaaacattatgtccttcaatgcatccttttccaaagggtcagagaggagaaaaatgaaaccctccagagggtagctgtgaatcagcatcaggagactggggttggaaacagttctgctacttcctagacaggtgaccttggataggtcgcttcagctcagctccctgtgccctcagcgccttctgctgtgaaacaccaatgccatcaggtagctgtggtgctgtgaaaatgccaggggagcccctaatcactctagaattgcagaggactaggcagggaaagatcttcacctgggttttagtggcaaggttccatggctgccctagataaacaaggcattcaagagcagtgtatcactgggagaaggaaggttgaagagaactctggaaactcaccctagaagtattttgatgagcaaggaaagcccggtgctgtaacctgagcttgctgcagaagcagcagcctggactacagagccaccagctgttaacttggaggccacaaggaggaagtgtctggaaagggcacatgaggtgctaggcagggaggaagacgtctggagtagagcagaagggcaggcgctgggccagtctgcagccatctgattagagcaatttttccagatcgcaggtggggcccattagtgggctgtgaaatagaactcttaaaaaaaaaatttgaggccgggcaaggtggctcacacctgtaatcccagcaccttgggaggccgaggtgggtggatcacccgaggtcaggagttcgagaccagcctggctaacatggtgaaaccccatctctactaaaaataacaaaaattagccaggcatggtggcgggcacctgtaatcccagtgactcggaaggctgaggcaggaaaatcgcttcaacccaggagtcggaggttgcagtgagtcaagatcatgccactgcactccagcctgggcaacaagagcgacactctgtctcaaaaaaaaaaaaaaaaaaaaaaaaaaaatttgagactggggtggtaggtcatgcctatcatctcaacattttgggaggctaagtgggaagggtcgcttgagcccaggagttccagacaagcctggaccacatagtgagacccaccctgcctcatctctacaaaaaataaaaataaaaaggtaaaaagtcagcctggtgcaatggtgcgtgcctgtggtcccaactacttgggaggctgaggtgggaggatcgcttgagcccaggaggtcaaggctgcagtgagctatggtcatgccactgcactccagcctgggttacagagcgagaccccatctcaaaaataaaataatcaaaaccttgaaatagactgtagattatcagagaataagataggaaatactccagtgtattacccacagtggggtgagtggaccctggataggggatggaaagctcgaccagctcagcatagtggactgtgcgggcctgcggaggtgccaacttatgctcatgtagagtcactcctctgtggctaaggatctggctgagagacaaaaggcaggcagtaatgtctactctctggattccagagggtctttgatgccacttcccaatttgtcatgtagctatgaggaaccaggactatactcagatgacacttgccatcagagacttaggctgagatatttttaaaaccatggaagattaattgtataatacatatacaaaatatggatatatatatattagtatatatgagtagttgtaattgatatacatatatatatgaacctggctagctgcagtggctcactcctgtaatcccagcactttgggaggccaaagcaggtggatcacttgaggtcaggagtttgagaccagcctggccaacatggtgaaaccccatctctacaaacaatacaaaaattagccgggcatggtggcacacactggtaatcccagctactcaggaggctgagacacaagaatcacttgaacctgggaggcagaggttgcagtgagccaagatcgcaccactgtactccaacctagtgggtgacagagtgagagtccgtctcagaaaaaaaaaaaaaaaagctggccaggcacagtggctcacacctgtaatcccaacgcttttggaggccaatgcaggtggatcacctgagctcaggagttcgagaccacccagggcaacatggtgaaaccctgtctctgctaaaaatataaaaaaattaaccagtgtggtggtgtgtgcctctagttccagctacttgggaggctgaggcaggagaaccatttgaatcccagaggtgaaggttgcagtgagctgagattgtgccactgcacgccagcttgggatacagagtgagactccatctcaaaaaaaaaaaaaaaaagcttatattattatatcaaagcttatatacatataagaaagtagatatcatatatgaaatatacagttatatatctacatatgtaaatatatagatatataaattacaactattaataatagttatttttttttaagcactgctgtgagcattgccccatcttatctcatcctgtcctcccagcacctcatccagggagagacactattgttatccctgttttacagaagagagaaggaagcacaacaaaacaaagtgacttgcccaaggttagcaagtgaccagcctaggatttggaccagggtgtttggccccagagcttgtgttcttagctgctagactgccctgcctctttgcatgaagtgcctactcatggatgtggggctgattccggagttgggtgggattatagtaactcagaacagagatgacaaagtcaaattctcaagggctttaggatttacactcttgtgacattattctccccttttgccagctacagtacccatgtatattaatactgtgtgctattgtattgtatattgtcatacttaatagaattgatcatactttttttccttcctaatcactgctatgactctgcatgcaaaaagcctgccttgtagtatggtaatagaaatcaaaattatggccggatgtgttgggtcacacctgtaatcccagcactttgggaggccgaggcaggaggattgcttgagcccaggagttcgagaccagcctgggcaacatagtgagacaccattttctatttttaaaaaaaaaaacacacacaaaaagaaattaaattatgttggccatatagggagatggtacattaagccttgggattttgatttgaggcaaatgctgacaccaggcttagagacggttttaaactacgtggacaatgctggcaagtactggacaaggagtgctactaatctcggggtcagagtggatcacaagttggacacattaaggatgtgtgtcttcactttataaagctaaaggatgattagctcttttaatctagaatatgatgtatatgaactggagaacagatactttgccagtatctgctgagccgtattcctggcaccctctctgcatgggttgcaggagctgaagctggcatttgctgagcagaaggacatggccgtgtattcatggagtgcagcgggtgtctggattctttttataacttgtgcttggtgtttgtaagaaagctttttctgtttgaatggagcctcataatgcctgagatagtgtgtgagatgagcctcattagccaggggtatattaggaagaaaagagcgtgctatttgcttactttcccctcccttgttgcctccttttccacctctgctgcctcctggggtaaccacagccacctgataagctcttggagttccagtagccctatgtcagcaccacacagtggggccttaactaggggccacctggtcctgccaggtgtgtgcctcctgtgtcagctcctccgccaggcctagcacagggcctggagctacaaaaacctcagtgaagggctgtggggagcggggaggagcgggggtcccacctgccattttgcagatgaggaccttgggacacagaaactgagccccacagctgtcaggtgctgagccaggagtggagcctgtctggggcttgtcttccagtgctcttctcaccatgtggctttggcttcaggccccagcagccctcctgagtcctgctgccacgtggcctaggagacagatcttagcatctatagccttgggtccacctggccggctgaggctgagctgtagacagctgtggggtttccccgactatggcctcccataagccctgggttctcgggcctattggtgccaaagacagaaacccagctccccagacaccctcatccttccagtggccagcccagcaatcaggaagcagcccactgccccggctggcagcttgagctcgcccacaaggtggctgtagggctgctctggtcagctgagtcgggcatggtgggcagacagcctctcccgccgtctccctccaggccatcatgcagctttctcggcttctctgtgccttgcctctctgctctttcagtttgcacatagctcaccctggctaatagcctctgtctcatgatctcacttcctaactccagggagagagaatccactgcccctcttcctgtgtccagtggtcaggcccaagatacccagagctgcccatctcctgctagcgggatgggcctgagcagggatgggggccgggcaggggcagcactggctttggggctagaagccaacttgggtttgaatctcattccctggtctcctgactctgtgagcctctgaccaggagaaatgcccatggcttggggctttgatgtctgggtggcactgaagggtttgcacatggcattcagtctcttgctgtgggtgggtcagtgccagtcttagtgacagaggaagcatccctgccctctctggaaactggcgttttcaatgacatgaacttgggcacactaccacaccaggcatgccatttcctgggttggatgggaggaagggggcctttcttggaggcatgtgtgccatgagtgggcatgacaaaggcccctggctatcccttgccccctaaaccggcctgactcctatgggggcccagagtgtccccaggcccaccttgtgcgtgcccctctctttgtgtcccatgtcatgtggtgatgtgtgcacatgtgacccatacgggttggtccatttccaactggaacagtccctcctgcttccaggacaaaaacagccccaggcctttttcccctgaaagtttgagctccttgtctcagagagggagcgagctcatggacggggccagagtggctgcctgcctgctccatggggctgaggacatccagcaaggcacatgttcctgaggcccagccagagacccctgcctgccccggccctggctttcctctatgtgccgagcaggacaggcacagacacaggcccctacagaggccatgggaggaaaggagctggcccaaactggcccggtcttgggttcatgctctcagcagaacaaaatttggggagctgggatctctggggcaagggaagcttctccctgtgagagtaaggccctgtgaccttgagcacaaggcttctgtttcgggaacaggtccagggagtcattcactggtagaggaaactccaaccccacctccatgacctctgtctctcctctttgcagctagaggaagcagagcactttgccatgatggtgatcagcctcggagaggaagccggggagttcctccccaagggctacctggctctgggtctcacctatagcctgcaggccaccgacggtgagtgccaggccccaggaggcctctacttggggatggctcaggcttcctaactgcctcagaggcatcttgtcctaccggcacccctcccctcaggccatgcctccatagacaccatgcactcctctgggagagatgcccatgtgtgcacacatacacacgtgcatacacacacgcgcccctcagacccatttccactgtttcccccagactgtcgccaccctcaagcatgccttcctctcccctcttcatgggcctcaaggcccagccacagctccagcaaagcccatgctgatcttctctgtggaactcctgcttcctgtctgtaatgcgccatcagccctccacctcacaatgcttccattctggttctcataggcctgcctttaacctcagcactgctatgatcttctggagccttttaaatccccctcaatacgtggcatagggctgggtacgcagcaggtgcttagtaactacttgtgctcggctaatggattctgctccttcctgccccacacctggccttctcttgccaaccctgccagctcagccatgtgtcttactccgtctatcaggcagccacctactttgatcttgtagcttgagggatggggagtgacgggccgccacccagaccaaacctggaatagtaatcagcccatgcccacctcccccaaacgccagttgctgggagcggcagtcacggtgacatcgggtataaatgagccctgtataaggaacacctgggtctgcacatgctggtcaagtgagggagtcatcagcccctttgtcaaagtctactttgagcaagacaccctccttgtccttttaactctacaaatagcggttgctttctaagctttcgaatccggggagctctgacaactgtcaatgcttggtcctcgccagtgggattctgatcaggtttgggaggggcctggatgcaatcatgttaaaccttcctgggtagttagttaagtgtgcagccaaggctaagaacacctgccctgctgcattttaaatgggatgcagtttaccagaaaggtgcctggtttgggttcaaacttcctagtgggtcaggaagcctaggaaggtatgtggccaggcagaggtggtggcccctctctcaaggcttgggcctcctgggtggggtgcccatgtcgtggaatgcttgtaggcattggcctttgaaagggttaaggtagttcaggcggtggagaaggcaatgcagtagaagcaactggcatgccaaggaatgtgctagaagccagggcattggcccaggctgctggagtttgaagtttgccagatgggaccctggtggggcctttatctgcagagctgtgtgctttgaggatggtgcagggctgggccggcacccttcagtgacccctgatggctcagtttctgtcctgtcccctgcagccaccctgaagtccaagcaagatgaattgcaccggaaggcactgcagacgctggagaggtgaggaggctcccacctgcagcagaggcccctcttgcctttggtggcagattcacaagctttacgtcatcagaccctctgatgtgggcagaacaaacatttctatctccattttacagatgagggaactgcacacagcaagcagggataggcgttggggattgggcaggcagccgagccctgccttcagctctggggggctccagcagccacaagtctcggttcctgctctcccagggctcaggggtctaaaatgggtatagtaacccattgctgttgtagtaattacagaagataaagcagaaaaagcaccttgcacagtatcctatgtgtaacaggggctcaaaaatggcattcacctccttctagctcctccccagccacccctcccactaaacccacccaccccttccaccatccccagcccctacagggatttcctggcatatgctcagagcagtgaggctagcttctctgccctggtgcctgacttgtcactccctctctgcccatgggttgtatattcatcccatcgtctttcttctttggggtctgtcaccccagggctgccctcccagatggcccctacctcagtgagtgccagccccctcaggcccaccgtccctgccttgggctgcctgtgggccgccttccttggtcttcatctgccagctggatgcccctctgaggcagagcctggcagaatcccccagggtattgcctcatagcgcccagcacagggctggcatgctggaggcccgagtcacacgttggtcactcaacccctggtgcctgacttgtcactccctctccccacacagggctcagcagctggcgcccagtgacccccaggtcatcctctatgtctcgctgcagctggccctcgtccgacaggtgggttgtccgtgttcctaacccccgggtcctcgggggctgctgatcttctcctggaaacccagcttaccagctgtgtgaccctctgcaagtgactttgcctccctgagtttgtttccttatctgtcatgtaagtcctttgagccctcatcagaggggccagtaaggatgaggtcaggtaatgtgggtaaagccgtggtgggtacacaggaagggcgtgttctccgccctcactccccctacaacatttcagtggactgagatgttgatgagtgaccacctgtcactcatttatttgtgtcctcgccttccactggcttttccccaagggtcttggggatggagtgatgggcaggctcatggagctgttgcatgttgggctttctctgtgacccccaagctactccttcactgtgtggacaccaccatcaggccttggcttctggggccccatagggacctcctgtctgctgactaccttagccccaggaccacctccaccatgactctgcaggcagacccgccttttccccaggggtgctgagagaatgctggtgtgtccaggactccccacctcaggtccttcagagcctcctttactttcctgtggcgcctcagcctgcaggctggcgctctgggcatgcacacatcctccaaaacaggacctctcaggtggcttgaccctgatgcctgccgatgcccccacctgactgcctggggattgcagacaagcctttggctctcacagtggagctctccttgccggaaccacccaggaaatgggctgagctccaggccggcggagggaagcccgaagaagcccatgtatttgctgtcaggtggagggcagccctgcctgctggggatggtgctgtgtcccccataccagcctggggaagccctaccttctgaggagcgggccacagcagtcccattttttaccggaggacaccactgaggccgagccagcatagaacccaggcctctctgatccacagcccacggggtctaggtaccccgctcccctgacccttttggagttggggccctgagagcatgctcaccagccggggcttggtcttatggtcacttcggcgggctgcatttctcctgcctctggggcaagccaggctctgccctgcgtcagcctggctcctcctctcgtcacagttactctcagtgctgggaccccttccctctcaccccatgcctagacccttgtcccggtgcctgtgtctgtcctgacctgacctgaattgtcactctgtttctgaggcattctgtctccctctccaggttcttctgtctcaaccattttctccccaacggccctgatgtcatcctggctgttgtttccactgtcgtcggtggcttcgctcccttcctcttgcactgcccctccccctgtgactccctccatcctcctccacctctaggctgcgcccccaccctgtccccactcctcactcctgaccccaggtcctggacaggcacggggcacctctgtgcccctccaggagcatccctcccctcccaggaataccaactttatttttagttccctgtaaaagaaccagtgcttttcttgctaatctagtgaacgataaacctttggtgatgcattttttaacctgttcagttattcatccctctctgatgaatagcatccatcctcctagagagatggcgggccaggccagcggagccagtggagcctagggcccagtttccttggagacctcattttggcagcctcagggagttgagaactcgagaactccctgaatggactgtaagctagagtcctagcctgcctgggtctctgaggcccccagccagcccatcctgccaagagtacatctggctggccggcacagtgatggctgtggatttggatacgtagcccaggataatcaggtctgctctagcagagtcaccagcacaggagcagccttagggccaccgacaagccgagccagtggccccactgatcttagtgtcctcctcgtatgctccttgacctatccacaaagtaaggtgcccggggagaactccgggcctggcactggtgcccacagcctgcacagaggccaggctggagaccaacacagaagccaggcagactggggacccaaggccccgcgagaagggtggaaggctgggtctgaggtttggcaaggagcaggactcttaaaaagagactcatggggttcctgcagggatggaacgctgacatggagtcagtcacaggagctaacgcagctcccaggcctgagagcacgtgccttcaggctggaaggaaggttctgtcctattccttagttttctggctttggggcttgaagagggaaacgcacactttaaaagtgtttgttccaccagtactttgcaaggcatttttcatagtgtctcatcttcatggacactgaaataggtttaaccattatcctcgttttgtagcagagaaactgcagctcagagaggtgagtcctcttgccctaaggtgccagctgggaagtggcagagccaggagccacaccccaacctcaccccagagcctctgagcaggagagggtgtttatctgtcagccacacatcagattctttccacatcaccgcgtgaacatgttcagaggggagggcctcgtcagccctgggtatgtagctggcagattctttatcccagggccaggccttcctggccctccaccctccagcctgccgtaagtttctctcccaaccctctctttccagacctggtcacagcctttctacagggtgcagaacctcaagctaagggcactgctcagtgaagcagcagtgtgtgggggagaggattccctgcatcctggggaatcaggccaggttggaggtgctaggaatcagggatgaggaggagaaggccagctgggccctgccgtgcgcctggacccacagcacaaggagggctggccttgacctgcgacagctttgaggccaggcctgtcactcaccaaacacaggcttagcagcctgcatagctcacacaagagcacttggcctggagtcaggacccccacctgggagcgcctgctctgctgctaacttgctctgctgtgtgaaaagaatggaagggatagaagatagcatttttgcatgtacattagctctttgaacccttctgtggaaaagcatatgcctaatttgcagataagggaactgaattcagagagaatgagggacaaaggtgagtgagcggcagcaccaactctagaacccagctcttgtgtattcacaaatataggacccctccacttgccaaaacgagcaggatcaatcagctcagatgacaggcagcaggtgggggctgcctcaggcagggcatggtgcaggggtgcccagcagggtgcaagggccagggactctggggtgttttgtagagaacgaggagatgacgtaaggggggcagcgggccacctcacaggtcacatgggactgcgtaaggggctgctatagtcaccaggactggcagcctcttttgaagaagagagtttatgttggtaactgccggaattcttttttctccttaatgcttgtggaaacattccccagaccctgtcaggagtgcgcaggccagggcccatggggtggggagctttttctctgagggtagtaacctccacagctgaatgtagatgggtctggggaggtagaatcggaggcaaggagaggggcctcgggtgtcttttgcatccaggggactcttgggacccatcctgggggtgttgtgttgtgctgagaatggtctcttcaggaaagggctccttgaaccttccatatcctcccataagtccagctatgggcagagacccatcctggcaaggtggcaggcagccaagcaagtgtgtggtctcagccctgaaatagtccccataggatgtgctggggcactgactgaccccataaccctgttaccacttgcaggtggggccctggccacagctgcaaatcacccgtgccctctgcagccagatccagtagaacattggagtcctgcctgcagggttggcgggagcagtagaaggtgcccttccatgctgcaccagcccctcctgggctcactgactgggctactggagcagctggggcctgccctctttcatgcagtgctccgagaagggaggcagcaaactcaagccagtgaaaattgggacccatggtgacctctggtctccccaccacatggaaggaaaggctttcctgaggccacatccaaatccagacccttagaatgtggctttcctgaccctgcataatctggcctcatcccatctgtccagaaccaggcttaataaatatttgttgaattgaaaacaaaacacaagactagaatctggattctagtcccagattcccactgtgcccacattagaggccagtctccccatcttctaggcacttgcctctgcacacttcccttcctgtggtcaagctgcaccccctacctggagcaccccattttcatcatctcctcctggaaggcagggtctcctgatacatcagcagaactccagggtgacgtttccacacatggctgcctcaccctgtggcttccactcctcccatttaggaagtgcttcctggtggctgccatggtcctttgtgccacaccacaaacctgcttctcttcattcctgagtgtggcagcagacccctcctcgccaggccatctggggcaggtgttttctcacagcagcctccctgcccccagtgcctggggctcccttgagttgagtgtgagtgcccttgttgactggcacgtggctcctgagtcccagggcagcatgtgcctggggaaggctaacctggcgggttccttcaacagatctccagtgccatggagcagctgcaggaggccctgaaggtacgcaaggatgatgcccacgccctccacctgctggcactgctcttctctgcccagaagcaccaccagcatgccctggatgttgtcaacatggccatcaccgagcaccctgagaacttcaagtgagtgccctgggaacactctggcagtgggggagctggctggcctctgcagcaggcgcccatgcacacctgccctgccatggtgtcagccaacacacatgaagtaagcacccgctgcatgcacaatccctggtggagagacaggggtgaggacaggtggggtcagcagacagctgtggtgctctgcaccaggaggtgcctggtgggtaatggggtgcacatgctgctcctcagcccccatgaggtggggtctgcatgggccacaaaggagactgcttgaatgcatgtgtttgggctgcttctgcctgccctgggctctgcatcagcctcaggatgacagtaacttgtgtaagttaatcatagccctgacacagtcagccaaggatgggattctaacatgagctgggctggcagctggagacgggttatggccctccaaggtggtcctgctccttcatacctccccacctccctcatttactgcatcagccagatgtcccacttcttggagcagggtttaagttgcacttggcctaagtggtggtaggacacagaggacctgctgccacccagccaggacactgggaacaaggccgtgctgggccacctgaggtgagaggatgtgttgctctgtcaggggagttagggggagtcttgatttctgccttctgcccctaagggcaggtgacactgagtgtaacaggctttgtttctcagaaccctgtgatcccagatgagggacccctaagtaacccacttccccctgttccaccttagggtctgaaggaaggcaatttagaaccagcccaaggctgtccccctgcagacagcaaggaagaagctagagtcctggctgccctgataggtgactcacgctgtgtaaacaggttcacaaaggattaggaaaaaattgctgggtgatgaagggaagcttcagtggtgccagcctagggaggttcccatcactgggctttcacctctgtccatccccagcccatcagaggcagggctgaccacaggggtgggttcaggttttcctgcatccttggcctccttcagacgacagcacatagttctgcttgtggcctttgccagcgtgccgagcactgctgttgatggcttccttctccccaaagctaaagaaaggtgctttgggagtggcagtgtttcctaaatataaaccccataatgtgcctccctgaagaggggagtcccagtggccaaggccaacaatgggtgttcatcctgctggtcagcctggtctgcagccccaagacccttgagccttgacctgcttgccctagtccacactaacccctgccccgcctgttccccctccatcctggcctaggcaggtccccactgctcacagccaggtgtaagcagagtgtgtggccaacttgacacagcctgtcttttatgttcgtggccggccctgattctgagccttgcctcagcagcattcaagagactactaaaggccaggcgcagtggctcatgcctataatcccagcactttgggaggccgaggcgggtggatcacctgaggtcaggaggttcaagaccagccttgccaacatggtgaaaccctatctctaataaagatacaaaaattagctcggtgtgatggcaggtgcctgtaatcccagctactcatgaggctgaggcaggagaatcacttgaatctgggaggcaggggttgcagtgagccgagattgcgccactgcactctagcctgggcgacagagcgagactcagtctcaaaaaagaaagagagagagactgctaaaattccagtcacttcacccgcaaaggcgagtagcttaggaaatcctaacacagagaaaacagtgtgtggacaagggattagttgccttgtcttgttaatcccaagtacagtacagtaatacaaggtaagaacattttatttttaatgaaaatgcacaaaagatgtaggttccccactcctagtgccagtaaccttgctttgatcccagctccatctgcgcacctctctggcagggtctgacccactaccgctggcctgcgtgcctgtgtgtgtttacacttcagttaggcttcatcggaaaccgaaatggccaagcagaaagatttagaatcttaggctggagaaaggaaagggctctttgtccaccctgggtctgtggagcattggagaagcaagaggcctgcctcagctcggcatcagaatttcctaatgaaatcttccttggaaactgagactgtgatgcaggcgggagcaccgctgctctgatggagccaaggaaggtgatttgtacctgcccagttccagctgagggggcccctccatcccagcacctgacatctcacccctcagcatctcttgctgacttctgagctgattgctttctgccaggctaaagcagctcccctggcctgctgtggggaggctaactcccttttttggaaatctggctgcagcccaggctgtgtgaggtgtggcagaaaatggggtctgcccagcgtgggggacccactcgtggctccccatcagcttccttgactctcaccccaggggtgcctcctgcgttcatcttcccaggctcttggactgggctaggaagctgtccctctccctgcgggcagtgtgtgcccctgctgctgccctgcctcaacacgtgcactttccacccttcccttcctcccaagcttactcaggtgctgactccttccccaggaagtgctccactcactgacagtgccgttggtcaggggctgccttgaggttggtgactgcccccaggaggcccaagggtggacatctgggtctccaagaacccctggacctgaactatgacattttgtgcatgtgagcctgagtccatggaaatggctttcagcagattctcaaagggagcccgacctcaaaaaggttgaggagccctggtgcagactgtgctggttgtcaatgtgcagagtaactgtgcccctgtctcgggtgcttccccaaggcttgcaaggagcttcctggagagcagtgtctgcaggcaggaacctctgccgtgggaacaactcacccatgcagacatcgcagagcgactgcaagggcttcaggagctgtggagggtggggcctaggggaatcagctctgaggtcagagcagactttcgttccatgccctgagggattctggaggttattctgcaacctgtcactcaccgtagagtgtgctgcgaagcatttggggatctgcaggccccacccccagtagtgcctcactttccttagtctgcttgtccagggctgtgggtctagggggaagcagcagtaggttcttcatcttgagccaccatgagctcctcacctccaggatcccgaggagctctgttttgatccagctggccctaaaaggctgcaaaactaattgggaaaaaaaatacagggacttttggcctccagaattgtaagagaataaatctctgttgttttaagcaaaaaaaaaaaaaaaaaaaaaaaaattgtatctctatataccatttatagagatataatactatatatatggctggggtggggctgagaagtccatgtaccgccagactatggtgagtgaccatagggtatgaccattatctctttgtaagtaagtcaatactgttccccacagatgaaacctcagagcatagaaacccatggattagcaggaaatgtcactgagtccattacaggtcagggatcactgaaaaatgtcattgctcttcgattgacactgctccctgcttcctcagctgctctgcatttgaggagaagccctgtgtgcctccagctgttgccaaggcagttaattaaacaaccggtccggtaaatatcactgcagcaaaataacaaaaaccaaactccctttgtcctgacctcatcgtccccagtaagatctgtatccacaggacacttaaagtcaccttacagagggctatcccagtgcctgaggcctattagaggcgtctcttttcagccatcagtgttagaggccatctgcatgggatcccagagcctgcctcgggaatggcagaagctggctggtgctgggcgtgggctttgcctgtttcactgctttcagggaggcctgccacaggggaggaaactggtgggggaatggacccctgtccatgtgagctggtccttgtgtgagagccacagtgaggtcccagcccttgagtcatgtctgtcactgacctgtgccacctgcagcaacttactcctcttccccttgcctgtttgctcatctgccaaaagacagacacctgctctctctcccctggcttgggaggtttattgtgagactcaggagagggcacacagtcgatggacagccgtgtttgaaaggtggcagtagggaggggagaggaggctgcccaccaacagcgtgaggctgtatcctgggtccccagggcggcagtgcctggggaaggccaggtagtccaggaggtgctggcagccgaggctgggccctgacagaggcagggaaggaagctctggggaaaggttagtgagctccttggctgcacaagaagtcgccactcccatacaggcagcctctaggctcccggagaaaacccggctttcgtggagtggaacttttgaaaagccttctgaattcaggggttagaaagcacagcaaagaggatcttgatttctgtgctgtgggatgacctttagttagtggagcttgggtttaaaaaggcaaaaaacgtgatgaggcagagacagacagccccacagggacagcataaacctcgcacggtgggaaccagacaccccgagcagcttcctgaaatcctgtgggcttctgactaagccctggacacatgtgccagccgggctgtccctggccaagaggccaggcctgcagggggcctcagggggcagcagctccctatccaggcctgggtttcgggccaagccgcggaatgtgaaaggtcccgtgcacgcttggagatgcctgtgtgagtcctttcttcttgttttgggtatgagaggcagctgggaggcccgaccagggaggggcaggaatatgaggtgaaggggaatgggccactgataagcgtccttcctgaagccatgggctctgtggggcgatggttttaggtaacaaattccttgggctttagtcaggccgcttgtagtgaaggtcaccatagtaaccaaacaaagttcctcagctcatgatgggagctttccaataaccagcctgtcacggctcccgtcccaggcctggcagtctgccaggctggttttgaaagcccaggccatacataggtcaagggaagaacaaacaatttccccttcccctctccacagtgggcaaggccacctcttcccaccccctggaacctccgtcggtcagggtaggccctcttgggagtttctgctggcccagtactggtcccgggggacttggaaagtcctgggggaagctttcagagccccggagaccctccccagtacaggaataatatgggcttcccgacaagccagagcacgtgcctgtaaacaaatggaaccacacagccttctgccccaggaaacctagactgttttggaaaatgtttgagctgataaccaggcattagctggagccataccttgactgacttcagctaaggctaacgttggagctcaagggcactcctgggatctacctggtgtgcctcacctttttttcaggtggcgcttgttgtatatttctcgtggtatattccaatgagcaggggggatgagtcccggggcttctgttaacattcctgacttaaacccagtgtgtttatttgattgttcttattaaggacttgtagtacatcaaaaggatgcttagcataccaacactccagtgagggggtggaatcaaaggtattaacacaaacatagtttatcactttgctgggttcattaaacacgtttggctgccacagcccctgaggaagacaccagccatgggggaaccttgcaagccacgtggcagagggaagtgttaagccagtcataatcactggcagcgccggatccttccccaaaggtcagttcctcattagctaagctgagttgacattcagcatttcccttcgtgggttgtcccgtgagaacctctgtggccttgctctgtgtgacatgtacaggtgaaagttgatggtcatcattctccagttagtggtctgcctacattcagacttctagggtagatgacacaggttgttttgtttgtctggggaagagaggaaagaaaggaaagaggaaggaacatagatactttcaggttttgttttcaaaggtgatggtaaccctttccttctggtacttgttgctttctctgcttgcggcaggggctggaggcaggaattgtggcccagggcacatggttctctgtagcaggggaggcccagccccaagacaaagcctttttgcgcctgggagaaggcctgtgtccacaaagcagagctgacctctcctctgcagtgggagatcttcaggtccctgggggtctgacacagggcagagagaccaaggcaattgcttctttgtgtctcagccctggctgggaacctgcctttgttcctaaggtaagaagaacctaagcgtcttcttttgggaagttcttccacccctgaatggccatgaaaaggcactgtgtggtttacatttaagtctttcaagatcaggaatttgtgtttgggaagtcctctcaaggtagctggaggtagctgcagggagggaagccgagacccggaggccagttgtgtcagcccagaaacagataagaatgccatgtaaccctgcagccagctgcagggtaggggcaggctgctctcagagcagccctggggcccttcaccaggtcagggacagtctttgaagtaagaaggcactaacttcaggaaaccaaagctttcaggctgttgatttttaaagcttcaaagtgagatcacgttaaatgaattcattaagaggtggaggatcatcatgagccttataagattagaggacatgggtcagtctaatcctccagaccgaaggaaaaataattagttttagggttaagaagagctgctaaaaaatgtcccttctgtgttagggattagtctctgggaaggtaataaaactggggctgactgtggccctccccctttcagggagggtaaggcctgttagagtccttttaaaaatcataccctctaggctgggcacagtggctttgggaggccaaggcaggaagatcactcgaggctaggagtttgagaacagccctggtaacatagcaagacctcgtctgtacaaaaaattttaaaagttaaccaggcgtggtggcacacacctgtagtcccaacgacttgggaggctggggtgagaggattggttgagcctaggaagttcaggctgcagtgagctgtgatcacactattacactccagcttgggtgacagaactgtctctttaaaaaagtcctgagcatgtgttggatttaacatgggtgagagaccatgtgtctgggagacctagatcactcagcatatcccccgcatcctggccagggtctgggtgatcacacttgaatgggggtgaggggcaggctggctcctgctcagagggccctccctgccccatcctactgtgcaggtagggtatccataccttgtcaggctggcccctctctcccactataggcctttgtctgcccttcctgcccatcttcagaggaccccctcaggtccactttgtccccggagcccctgtacttcaaagctgaaccactcatttgagtaccagattctgttcttgttgtgtttcccaatgcgttggatgtcttgtttgagtttggaagtacctttggagcagagactggcctctcctctgcctgcttacccccatggtagggaaacccccactaagcacaaaacacactccagtggactctccagctgctagacaatgggagggagctgttttgttttttggaaggaagagaaccatgcggggatttggggatctcacagccagagtactgtcacacccctcacccagtttggttgttttggtttggttgctctgttttttggtctttacagcacccctgttttgaagatgaagaaactaatgtgaaagttagatgatagctcaagatcacatagctgatgagtggtggagcagaggcgagaacccatgccagctgattggcaggaccgccctggtatacttgaactccaagagcttcaataacaataacaatgatgcacccagtgctggctccagccgggcactgctgtgggcaccttgctgcattagctctgtaatcctctcagcgccctaagagggatagaaactcatgattccccttttacagatgaggaaacagaggcacagaggacctaagtaagcacctgcacgtaatggggattggggactgagaatgaaagtttgggcaaacatgtattgaaccctttctgaagtgccagcccctgctgggccttttatgtgcacgatgtcctgcagcaatcctcagggtaaatagacgctgtcattctcattttacagataagaaactgaaactctaggctgggcgcggtcactcatgcctgtaatcccagcactttgggatgccgaggcgggcggatcatttgagatcaggagtttgagaccagcctgaccaacatagtgaaaccccatctgtactaaaaataaatttaaaaaaaaataagccaggcgtggtggcgcatgcctgttgtcccagctactcaggaggctgaggcaggagaatcgcttgaacccaggaggtggaggttgcagtgagccgagatcacgccactgcactccagcttgggcgtcagagcgagactccatctcaaaaaaaaaaaaaaaagaaagaaaaaagctgaggctctgtgacttgcccaaggtcacatggctacaaggagggacacttgggtcatcagacttggaccctgcttttcaccactgagtccgacttggtgcagcccaggctggggaccatttactatgcagcctctggcctcctggccaaggaattagactttccagaggcgtggccacctgactcagagaatagcctgctttttcactcaattatgtgttttctataaaaatagaactcttcattaaaacagctcagcacagccatcagctgcaattactaattactgtccttttaagagataatgcccctttctatgcattcactacacctgctgccacttcccacccaccctccccccacccacccccccgacacacagagggttcccagaatggccaggagccagagggatccggaattgctgcccagggcccagtgagcacacatgggaccagtagcacctggaagaatggagagtttcaggaacgccctgcagcttcacttccttggagctgcttggatcctgggaatacccacagtgttccaggccttggtgagcccttgtgactcaactttcctcttccgttcttcagcaatttgttgagtgatatgagagcaggcaccaaggatacaaagataagaaagacctagttctcccccagatgaaggaaggatctcgcaggaagacaggtctgacaacagcaaagatgactgagaatgacagctaacctctcttgaggggtgacatgcgccaggcacaggctctcttccccttagttctcccagcaaccctcctgggcagtaccatgactgtcctgccttgcaaatgaataggcaccatcagaggtgaaggcacttccaggaagcagcagagcctggaagtatacccacatcatctgatgctgaaggccctgtctcaacagggaagtggctcccttatgtacatggtggttactgtgttcaagtgttcattgcaggtgctgagtaactacagggagctgctttcaggaatatgaaagtaaaaatgtgcacccgacgtgcttgctgcccacacagcctgtgtgtttccgtgcagccagctctgctctgccaacttcccccaccagcaagagtggtgtgctggggtgagcagccagggaggggacacagggagggtgaggattggtgcccccaggtaaggggatggagatgacctctgaccccaggactgtgcttggcttagccagagacaccacaaaaatatcccctatctacaagataactatttttttttaagtttttggaaaagccatacttactcatttctgaggagtctcaccctaagagctctttatagcagtgggaagaaattgtttctctttgcctcacatgggaacaagtccaagtcttaatccttttgacaaataattagcagtgtgatcctgccctaggagtgcaggtgaggcatggctaggaagaaaaggaggaagaggaggcagatgccaacattctcctgggagcctccatcatcagcctgagctggagcgcttggggagattggcaaagctggtggcctgtggcatagccattttctaacggggaacagagacaccaacctcactggtctctaacttcctccacagaatcagtgctgccctagacatacagaccctgtgggctgagatgtcccctggttcagcaggggctgactctgttaggtcacctgagtgcctttctgtgcccctgggtgctgcatcatgcttgcagatggcatgggagtcggcaggtcccagtggttaggatggtgggtgagggaacaccgagcctgggtgaggggtggccggtgtggtctactgaaggctctggcagcatcctgacgagggcataagcacataaagagggggcttctgtctgcactgggctccccgcccagaccagggcctgtgtgccacgtggcctggatggggctgcagagagtaccaaggatggagcacatctcaggacccggccgtccttccctagccccaggagtgtgaccaagcgcatggggtgtttacactgacccacgctccttcccctttcccagacagaacactcactttcatatcatccttcgatgccgatggcgtggcaagggcgttcggccttaaaagacctcagtgtttacttcacatgggcttccacagcttaaacaggaaaatgcttgcaagaggggtcacagcgagcatgctttgcccagagcccagttcctatagctttatgcatctccttccatcgtcttcctgtcataagcctgtcttaggtcctaggagtgaagggcctagttcaacagaccaagaagctcagggctttctgggagccttcagaggcacctggcctagaaacttgcttcttgggatcgggccggcctgcggcttcaaagcaggagtcccttccctgtgtgctggagagctgaatgcagctgctacttagaggtcatcacagttcagcctggtggaagttcgtgggacaggtgactttactcctgttgtacaggtgtgggacctgtgacatgcccagctgggtgaccacagagcttggactttggcttgggtttctaattcctgggccagtgtgtattcactttgagtaacgacacagtgtgaggctcgaggacagtactgtgaccattgctcttctggaatggctcttgtcggagggcataaatgttgaaagctgctggatttcggtattcaggcgtttcgatcacagagactctcctcagtgatactttttggccttgcccagtgactgtcccctgggatggaggccctccacccccaccccagtcaggaggagccagaagattccacatctggagcccactgttcctccccaggtcctgctttcacagggaggaaaactttgcttctggacagtttggaatggaattggccagcgctctgcttgtcagctgtgggagtccggcccacactgcagctatggggaatcaagtaacaggctccaggactaggcagatactgtgtgctcagcactgtgccagacgctgggggagggcagcggggccctgcctgcaggcacttgcagaccaggtggggacgcacgatgaggcacaggacaagataaacggtggtttcaccatccataggccgggctggctgcacactgattctagaatgtctgacattaaaaatgcttgatacgccagtcgcggtggctcaagcctgtaatcccagcactttgggaggccaaggtgggtggatcacctgaggtcaggagttcaagaacagcctgacctacatgcagaaactccatctctactaaaatacaaaaaattagccgggcctggtggcgtatgcctgtaatctcagctgctcaggaggctgaggcaggagaattgcttgaacccaggaggcagaggttgcggtgagccaagattgcgccattccactccagcctaggcaacaagagcaaaactccgtctcaaaaaaaaaaaaaaagcttgatatgagtttactattaaactcttaagcctaggtggcaaaaaaagattatatacatagtaggggaagggaaaatggcttccctccacccttctagggaggagggctttggctgggctacagattaaattgaaatgacagattaacgggaaaaaaaacgtatttaattatatacgtatgcacagaagtcccaccaagtatgagattcgaagaaagacgggatgattgaagcttaatagcatctggagctacagaaaggaaaaggggattggggttcctgcgggtggtagagacaagttataggagggtgacagagaggagatgatgaataaaggtccttttgttatgcagataaaaatctctcgggtgatagaagttgtcaggaacagccctcttctttatagatacttttactaatgtagatttccctgagaggtggaagtttctaggccaggcagtgtggctaatgcctgtaatcccaatgctttgggaggttgaggcaggaggatcatttgagcccaggagtttgagaccagcctaggcaacatagtgagaccccgtctaacaaaaaattaaaaaactagctgggtgtggtggcccatgcctgttagtcctaactactcaggaggctgaggcaggaagattgcttgagcccaggagatcgaggctgcaatgagctatgatcacgtcactgcactctgcctgggcagcagagccagaccttgtctctttaaaaaaaaaaaggaaatttcttttataaaagggcagcttttcagagctactctgtgtctgcagtttctcggaataaccaactcaaaatataaaatatgccaaagtatattttggggtggcatattctggtctcaaacagtcatattttagggtggtgtgtcctgagccccaagtgtgtgtgtgtgtgtgtgtgtgtgtgtatatatatgtataaagtaattaagtgctaatggaacacagtgccagacattcagagaaggacagcgtggtcacatagggacatcttggaggagggctggagccgtgggattgaaatagtttttttagtctcagaatcctttattcaagtggtgttttaggctcagttggtttataagacaggtaagcaaggggaaggggagcctaggcttgcctactctatccccagccccgactgccagcagcctccccccagcttcccccaggagtcacagcgttctggtgaggctgtggccacagcttcgattccccctggctgtgagggccccagaatgtcacccaccagtcctgacggcatgccagggctccgccaggcttcctgaagaaatgggctaagcattgataggtgggtgaggagaagcagctacccgttgcagtggacaggatggagagggggcctgtgctccttagtcagaagagcagctgagttgctccttctgagggagtggagttgtttgctgatccctgttggaagtgggagaaagttctgcagtgaactagaggcaagccagcagaggcacagataaccacatcctgacatcaggaaggctgtcttagagggggttgtgcacagcccccatggggatacagaaagccagagggcgacatctggttaggagctggctgaatgtcagaggggaaagggtgatctcagcagaggctacagcagaagcacagcacggatgagtcccggagcctgttccgaggctcagggagctgctaatacccatgtgatcagtgtaccagcgcccaaggtcatggggaggatggcaggaagggagggtagagccagagtgggaaagctgtgaaggccatacagaggcacagaaggtgaggaccacaggtcagggttctttgtggaagaaaatccctctggcagcgctcacctgccagcccaaggaaatctcaggagcaaatctggatcctcccaggatcctggagtgaaagatcagaccagagtgactggtggagcacttgccccagcccagaaaggatgtggtcgggttgagaaaatccgctctgggccactcatgctaatggaatgtcagcagctgcaaaggtacagcctgcctttggtagaacttactgtgatgccagctcagttttcatccacttctttgccaggcacatggtgtggtcgggtctgccctagacccattccggccctcaaagatgaagaaaatgagaagggggctctggcagagagaagtgtgatgcctgcagagggcccggggaatgcagcagggctggcctgcccagggagctgtccccagggagctgtccccaggaaccagcccagcccaggggacttggctgactgagggaggggctttcccacctcactgacacctgctgcttcaaccagctgccccaccctccacaccggagcctcttctctctccctgactcccagccaagtcccactccaccctgcttttcaccaaacaccagctccagcaagacccctttcctgtttcttcccctgtactgagtctgatccaaaaattcagcccttgattctctgggcagtgtgtcatttatagcgctctaattgttgtctcgaaggcagccattgtgttttcttcttcatattcccgaaagcacaggcccctgatacttatggagtgttggatcctttgcaaacctgcggaaggagagtacagtggcaagaccagttgtccccagcagttgcccactggggtcattcctactcagggctgtgtcctgccagctgtgcactcaggtccgtgcagtccatgctagggggatcccggtttctgcccttgggacctgataggcaagccaggtggtcgttagttctatgttccaagatgggtgcagggcatcctaagaattgagagaggtgggatttaaagccaggcttgggatggatgaaaatgaagaggagagttggtatctggggggcaacccgtgtgcagggtcaggaaaggcattttggggatgcagtgaggaagaaaaatacttgtccagaaatcccctcttctgaaaatcctggggcaaattccaccctcttcattctctaccaagttgcaatctaagagacaaagtatggaaagatgggcagagagtaaggacatcagagggcttcatgaagctgggagcccaggtcttagggcagaggcccagctgagagagaagatcagaggggcaactgccaggggcaggcctggcctcaccgggtggcacctgcagccttcgcagtctgggtagggaccctccgatggagcaggcctgtgtgctaccctcaggtgggctggtagaacctccgggcagtgatcaagtgcaggccctgacagtaccgtggtcttgctcatcagtgatactgagaagaaagggcctcactactcaccactggtgagaaccgggaggtgctgccgtctggccctcggtggttcaaactcttcgcaggctgcccaggcagctggttgggtgaaaatatgactggacttccatactggttgctgtatagccactgcctggacccctccagaacccccagacctccccagcatctgaagggccaacaccagtcacagcagggcctccagggctccaccccagctcttgatgagcaagtgtcatgactggcctgtgagaagcattctggctgtgcctgctgtgtccagggtagagggagggagccagccatccccgctgaggtcctgcctccaggtgggaccagctcttcttctcaaccattctaagggccactccccacactggtcttacctcagaggactttaggttttcaggtcgaaagaaattctgaagttgcttgctctcattgcacggtaactgtccctaaatggtgattgaaaaggatttcacgtcactttaatcctatggattatataaggggagctggctattttgggaaatccaaggaagaatcctttgataaagcataacaccgccttctttgtgtatctccagggtcaggaagcaaactttgcagttccacttaggaggcgttgcttgggcacctatactgttgtggctggcaaggtgggaagtggagctctgtccttaggggacctccttgccagttccttgctctaccttcactcacggattctaagtcactgtctggatgggtctcttatccaaggtcccatgctgggccctgtggggaatgtgagtgtaagcctggtcccacgatcattaggcacagggcgttgcttagtggaggatgtgggtaggaagagcaaaccgagcaagaccaggactcacagaacagtgcttcagagatgggcaggatggcacatggtcaggggacacggggcatcagcagtgtgggcactgacaatgcttcatggagtgcttcatgctttggcagcaaagatggggagaaactgaggcacacagagaaagcaagcggtccaggggcatggcagaggctgctgccctcatggcactctgctttctgcgagttagggaggtgagcatgtggagccgccctggtggggcaggatccccaggtgaaagtgggcccttgctggggtgtgctgatggccactctccgtccccacagcctgatgttcaccaaggtgaagctggagcaggtgctgaaaggcccagaggaagccctcgtgacctgcagacaagtgctgaggctgtggcagaccctgtacagcttctcccagctggggtgagtggccgtcattgtctcttgggttgccagagggtggttgccagggcaacaatccacagctgggtggccaccatgcctgccaagatggggaggagagtgaggcttttgaatgagagcgtggaacttcctgcccacagagctttcacatccatagtccagtttgaacctcctgacagtcctctatgaagtacatagagaccctacgtaggacattgaggttcagagtggtaagaaggaagagaaatcattcttgagcactggagctgggtgctgggcttgttcctttatcttacacctcagctgcttatagcttatgcattatcagattttattcccagcccagtgaggaaactcagacacagagactttatatatagcttaccagaatcactcgcctggtaagtggtagtgctgggacttgaacttgggtctcctgagttccagcccatggagcctgtcacttctttcctcattccatttggaggctagaagaggaggaggaggtgtactcctgaagggccaccccttcttccctagtcacccacggtcttcatgcctcctgtctcctgctggagaccctggcctgggacctgggtctttcatgggccagagcagggcactcttgtccaggctgaatctgcaggaagtctttgctcaaacccaatgggatgcctaggcttagcctatgtggcccaaagggaaagtgggcctccttcaggtcaggagccctgcctcttcctgatcctcttgtccttctttgggatagctggctgtgtcatctccctgaggcctcaggggaccccagtctggtgtatatttgtgttttcacagagactttaggagcccagaaggcttccagactccccagaggaacatctgtaacagtgaaatttacagaggagggtaatcagacagagtaaaacaccttgggcaaagtcagccctcacttttcaggcctgggagaccagggcagaggaggaccagtgggcggaagctgccagaaggaggctctggggttgagggacttttcagaatgagaatttgaagccacctggcagctggatgcatgaagccaagggccacactctgggtgaagggacctgcattccgatggccttgttttcctgctcactggctgtggccgcacaagcaggtgcacaacctggctcccttcctgcaagggggttgctccagagctggccgctctgttcctgcatccttatctggatggctgcttgtctcttcctccaagtggtcagtcgtggtgggacccctctgagctgcagccttgtctcccagcattgaagacctggcctatgcctcccttggagcagcagaactgcagggctggggcttgtcacaatgggaagcccctaagcacctctccttggctgccccaaactagattttataagccctggtttctgatctgtggccccaagtttagaaaagaatcctccctgtctcctgggaaagccaggaggatattggatccaggctcctggtccagatagccctgccctacactgagggtagaatctagtttggagccaaggattaagaccacagcctgcaggtctggcctagcagaccttcactatcagccgcaccttccactgaactccctgacccccttcctctgctctgcctgggccagccccacactgctggtctcatgttctaattgcccctcaggccctgtccagatgcccctccttcatggagccaccaaccacccagcctctaaaatgcttcattcaaccctctcatgtgggtttttgctaactgctcaacttgaacggtcccttctccccatctgggctgtaaggttcttcaaggtagggaccatgctgtacattggcctagaaccaagtgtagtcctggagatggactctttgtggagccctaggaaaggccccttcacgggatgggagaaagagtaggatgggaagctgcacccagccctgctccatgccagccctgcaccaggatctgcccatgttgtctcatttgctccccacgaccaccttgtgtgatggacattctcatgaccattttcaagatgagaaacctaagacttagaaaggtcaagtagcattgccaagggtcacaaagctgagaaaggtggcccatgattccagcctagtgtttctggcttttttgttttgtattgtttttgtttttttgagacagggtcttgccctgttgcccaggctggagttcagtggcaggatcacagctcactgcagcctctgtcccctgggcttaagcaatcctcctgcctcagcctcccaaatagctgggactgcaggcacccacgaccatgtctggttaatttaaacattttttgtagagatggggtcatactctgttatccaagctgttgttgaactcttgccctcaggtgatcctcctgcctcagcctcccaaagtgctgggattatgggcatgagcctccatgcctggcctgtctctggcttttttgcaccacactttgtgcctcctgggaatgggaaggggtgggagaggaagggagccagccctgagccattgtggttttatagatggtttcctctgatgcccactaaaattcccagacccgagttgaagccagggtgagcctgagttacgatggcaaggacacccctggtattcattgtgggatcatcatcttggtgcttctctgaaggaaagaaaccttcttgcccaggcttggcctgcctcctcctctcctgtgccttctgcttctattctctaagtttccccagtcaacagggtcaaaggttgtgggcttcctcggcagtgggaatgtgctggctggggctgcttgtgccccaggatggccacggcgggcttaagctggaggctatttcctggctccccgctgcccccactctgtgaaaagaggaacccctcccccccgccagcagtatagcagcagggatctgggaaattggggacaagggttgggggacaagatgggatctccaggggctacccctggagatctgccaccccaggggcctccgctggctcttctggggaccccctggcagcccaaggaatggaagcctgaggcagggggtgacatccgggccctttttccataggggtttgggggttgcagcacttctagtgccctatgaagaccaggctttccttggcagtcagtccacagtccccactctctgcctggcactctgctggatgttgctccccctggcctggggagcttctggccttacccacttcagagaagatagtagggagtgtgggagagtttccaggtctcagcctgtgtggtatgcgacccacgttgatccctcctgcctctctagtgatgttggtgacttcagctctgtctttgggcctgaacccacagccccagagcctgcctggagtgaggctgtcccattctccctgccagtccttgtgatgctggccctctacctcactgggccctgtgatgctagccctctaccttaccggaccctggccctcttttgccttccagaggcctagaaaaggatggcagcttcggtgagggcctcaccatgaagaagcagagtggcatgcacctgactttgcctgatgcccatgatgcagactctggtaagaacgagctccttgggccactgtgtgcatggacccacagctcacactcccagcttgagagcaccaacacagagaggggccgggccctctcccagccgggccaagcccaccactggctccttgccagctcgggcaacttctggggctgatcttggctctgggtaggggctggctgctggtcccacagtgggcagtgggcaggggaggaaccctgcctcctgcatgggggtgaagaaagaggagcctggctgaaaaggtggctgtggagcacagaaaccgtttccccttaggctcaagccagaggccacagtccacgtaatgtccttggcagatcaagtcaaatagaaaggaatggactgagctctttacaattctaagctgaaagcagactcttttctggaaaaactcatcctgaaacccatggcttgtgaaattcaaatgagttcaggaactgcagacttaacattttttaactgaggacctgcttaaagcagaacaccttcatcaaaaacacaagaattagtcatgggaaagaaggtgtgagtggagttgtatttagtggaattgctcagttttttcacttctgtagacatgagcctttctgtggacaaagccttgcacctttgttgtcaaatgacagagttgatttcagaagccaaacctagcacccaactttagaggcacatctcaggggtgtatggctgtatgcagagcttctgtctcccaggagggaatggttaagggaggggagaatggtagctcccttgcaattaaagaaggaagaatcatgaacaaagttattaggactccaggtacacttgtctcataaactgaagtcatccgtggtttgccgtgaggtctcctgagtttattggagcctttattgcgtctatgacagagagagagaaagtgctcacatttcacctgcatgggaattataaatgtcaacagcttatatgtcctgaaccggagcccatgtcacccagaactgccactgagagaggttttccagagggcagtgttctgacttgagctgctatccagtccttcacagcacagccttgaatgggtacctttctacaaacaaatgagaatatgcacttgtgaaaacagaaggtgaaaatagccaagggaagaaaagaaaaatcattcctaatttcaccacttagaccttaataaatggcctttcagacttttttccatgcccatatttcttttttataaaaatgtggtcctattcttttgtaacttgcttgttttcacctaactatatagtgcgaacatctttctacattgatatctgtatttgtattttgttattttaatgatcgcagagtctgggatgattatacccccacttatttttaatcaatccctattgttggacactgaggttatttctgttgtgttcacgtaaagagcatctttgctgacattattgttttcccaggaatagatcctagtgggatctctgcctgattttcctccaaagagctcccctccccagctgtgggtgagaggacatagtgggccctccctagtgggtctgtgagctgctttctggctgcccagccgcaccaccctaccctgattcagggtgccctgtctccccatggtgctgggcaatgactgctcctggggcctgcaacgtgtggacctctgaccactgctcggctcgtgccctcttgctctgcaggctcccggcgggcttcgtccatcgccgcctcccggctggaggaggccatgtcagagctgactatgccctcttcggtcctgaagcagggccccatgcagctgtggaccacgctggaacagatctggctgcaggctggtgagtgccctggtcccagtgacacacacagcctgtctgcaggccacccatgctctcagagccctgtcctggagaagggagtgtggggaggtggggacaccttgctaggcccacgcgggttacagagtcctcgcctctggctgtgggtctccttctctgcccagtggagatggtgtctgccttcctgcctgggagagcttctctggcagcaagcccaaacgtgagaggattggaggtcctgagaggccacacagatggacagttgtctcagtctcaaaaacaggcttcaaaccctggagagctcagagaggggaggtgtggaggccccaagaaagagagggctgggggtagaattcattgaagatggaggaaagactggtaactttgaggttgccattcaggtgacagtccctcttggtaactaagtgataccattgccaccaggcgtctgaaggccagccagtgttggggaggcaggctgtaggaagcctggctccagagttccacagacctgggttctgaaagcagcccacagctggctagccctgatctgaaacgagccaatgtgtgacacagtcagggtggccattacaagtgctcagcaaaaggtgtttggcttccgtctcgtccatggcagtcatggtggaggaagaggcagcatggccccacggacagcgagtgtcttaacaccggcttatgaatgcccgggagggactcgctgccaagagttttgaaaatttaccctgacagtagtgtgagaggtagatcagagtggaaagagagagagccaaagccaaagatgacaagtgcctgaatgaaataaaatggcagcagaagacagaggaggaggataggctaaatggacccctaaagtaccccaggccaacacaaccccttggcctagagctgcccacgtgaagttctgggcccaggagtacctcttgcattttctctgattaccctcctctctgctccttctccatcatgggggtgtgctattgtccccagggggggagttggagaagaaaccgaaagttgatgatctcttactgggacatggggatttggtaagtcagagtccgaatatgcttgttagctgagaatctaaggtttcccactgcatgttcctcacatacggcacattagtatgcagtacgcccccactctccccactgtaggttctgaatctgcaaaaaacattggataggattcacaggaaggctagacatgggagcactttaacaatgcagaaactgtcccagttagcatctcggggtcccttcggatgctgggggtgggcggaggctgcacttgctccacagtcagcttgttgggttttaagtaggaagagggatgttgaaaaatccagaggaataataaacaaggcctcgccttaggcaaaggttcccgtcgtcttctaagattctaatgacttctaagactaaaataatgacttccaacttccaaggggccgcatggagccccagcccccacagcttcgcacccatgatgggggcttcaccagctttaaggaatgcagcgtaacacagtgatcagattctgcagttgtgggttgcctgtaccagagctcccaggcctttgtttgaatgatttgccttggttttggtgggcgggtttttggtgggtttttttgtttgtttgtttggttggttggttggttggttggttggttggttggttggttttttgaggcagagtctcactctgtggcccaggctggagtgcagtggtgcaatctcagctcactgcaacctccacctcccaggttcaagtgattctcccacctcagcctcctgagtagctgggactacaggtgtgtgccaccgtgcccggctaattttttttgtatttttagtacagacagggtttcaccatgttggccacactggtttcgaactcctcacctcagtgatctgcccgccgtggcccaccaaagtgctgggattacaggcgtgagccactgcgcccggcctgatttgtcttgtttgtttactaccatcatcacaagcttgcttgcagttctcaggttgtatattgctttatactagggatgttagcatgtgctgataactccaagtaaggttaaaggccctcctgaagccagtaattagacttgggaatgtcaagagaaacacatgcctttcagtcatttgcacatgagcctttcttctttggtcattgtcttagatattcactccacagaagagaactccgagaacagcatctgaatgctttgaatgtggcgctgcatcagggtcaggcagtgtagtattaggagaccagtttgggtgcatgtagcagatccaaaatagcagtgtcttgcacaaggtgggtgcttatttctttctcatgtaacagtttacagtttacagatgacagccttgactgggacagcgactcttctgtccctagggtatcactgtcgtccatgtggtccaggatggctctctgccacattcacattccaaggcaaacgatttacaaggaagaaaggcacccccttccctataaggacatgtcctggaattggcacacatcacctcccctcatgatccattggccagaacttagttatttgactgcccctaactgccgagggctctggcagatgtcattattctgggtgtcccattaaaagtcaggggatcaggccgggtgcggtggctcatgcccgtaatccgagcactttgggaggccgaggcaggcagacgacttgagcccaggagttcaagaccaacccaggcaacatggtaaaaccccatctctactaaaaatacaaaaaaattatctgggcatggtggtgcatgcctgtagtcccagctgctctggaggctgaggtgggaggatcacttgagcctaggaagtcgaggctgcagtgaactgagactgtgccactgcatgccagcctgggcaatgggagtgagaccctgtctcaaaaaaaaaaaaaaagtcaggggatctatcctgctagaagaaggggagaatacactggtgactggtgcacaaccgccacggccaggaaaggaacatgagaaggtgtcctagttctttcattctgagcatgagagaattccagggtaatttgcaccccctgagccctctcccctcccctggctgccatcatcactagcaagcatctaccaagcacctgttgaatggagggctgccaggaccagatcaccagggcaatgatctccctaaaccgcctcccccacctgacccaggctaagaatacaatcagcatccccccgccaaaccctgcctaatgactccaccagctgcagcaaatttgcaggaagggaaaaagatgccttgatcattttggaaggagctaatccccctggtttggttcaagataaattgcatcccaatctgtatggcagtaagttccatcgtgaattcactctttggttgaattcaaagagactgtcgtagccttcctctctcaactcttgccctcctctcctcccttcttcaagcctccttccaattccagtccagtgcgagaagctgatgaatggtacccacttgagagacgggctgcagggcaatgcctcttgggcagcgggtctgtgtgagagtgggagaggcacagagtcccatagatgctccaggatctgagtgttgagagaggtgctttccctaaaagcaagaactaccccttcatcccccatgacccccatgatcccaggtcacggctctgggagctgacagtgggccagagcaggagacgcatgtagggagagtgcccctaccctggaggtccaagggctcatgggtagctctgggctttctccaggtttaggggaagctggcctgagtctcagctccccagtgccagactcctgtggtctggtgccggtgctctggcccgcagttggaggccaccccaggtgtctcctgggcagacttggggggctggggtggggtggccagcgctgtggctgaagcgggtgtttatgatgaagccatagtccagggagaagctggcgctcacccttggtcctacatgctcctctactctttgtcatccttcctgcccccctcctgtcttcattcagtgccttcttcccacgtcctcctcttccctggctccagctttttcttccctcctcccagcttcccgagtcagcgaggccactctcaggacaggcccatgcagcccctgactgccttgtgccctctaggtcccagggatggagggtctcagaccaacctgagaactccctggagacctttggattccctgtgttggcctgggcgttctccattctagtccccttgatcttcactctccttcctcccttgccctctccccaccttccttctttttctgggcatttatatgctctgagtgtctgatgcttatttcctttgggtcacccaaatggcccccactgagggtcaaggctagccatggtgaattcttttggggggactaacctatttctctcctgccctgtggctcacctctctgaagtctgggggagggtctctgtaggaagcacactcacctggagaagccctaagaggccttgggggtgggcccaggctctctgtaccctgctcattagcacagggccagcctgcgggcaaggccctccctgcaaagggggtgtggaaatagcccatggaaagtgggcccatccccctgcccggggtgggagagcctcggctttggcaggaagactggaaccagctctgggtgcagggttagaccaggatgcctcaaaaaaataataaaagggcctcttgcaaagctccagggaacagatgttttccatttgtagcctgccgagagaaagcacagaggagagggggtggagagagatggagggaagaggaggaaaaccggagacagacaagcaagagaagaggtcagggggtaggcaggaggatgatgagagcagagggaaaatcagaaaggggaagacagcatgaaggaatggaggggccccttgacgctgagggtgcagcaggggcaccgtgtgcccaaatctctgacccctcccccccatccagccccgtgtgctggatgatgacctcgacaatgaaaattcaaggaaaatgtggtgccctggccaggggatgctgggatggatgtgggcaccactgggtcctggcagccacggccaggctgggaaggatcagggccgtgggtggatgcggcgccccagggctactgcagctatctgaccatggctagcaaagcgtcgagcaggagccgaaggcatctgctcagggacactgagactagcaaggggcagtgcattgtcaccccagacctttgggcctgtgtgcaggtcagaggcctaccctggaggctggccctgctgggcactgtctgccaggctgccagaagccttcaggaggcttccctgcttgggctctggtctgtgtcttctggtttcctgtctaactgggaatggagcccatcagtggagcagccctaacggttcttcagggcgtgctctctggtgtgtggccagcccagcaaggccctggcctctggaagaaccagggccccgaggcaagagggattgggattgggtggggtaccctctaattaaaatctgttgatgtgaatacactatgaggggtccccaagggagggacaaggggcagcctctggagacagcgcagcaagttgtaaacagcttaatcagctgtgccagggccaagtagaccaggggagtggggagcttgactcctgggccctcagctaaactgagcttctggcgatggaggaagcagccaccctgcaaaagtcacacccacacacttccttctgcttctcctctctcgtgaccctgggggattctgccacagtggagcccagcccatcttccttgtcctcttagtccaaaggcctctgcagccttcaggctccagctccaatgcctcctccctcaggaagacttccctgaccacaccagcagcatcgacctagcccctcttgagtgcccataacactcagatgtggcacttgtcattccactgtcctggtctctgaagtggtttagtggctcagctgctcccactcctgtccccactctttctcctccttgtggggagaccaggcacatagtcagtactcaaaagttgtatgttaagcactcagttatgagggcagcctgttcagatgccccagcagcagctcaacagcaaagcggagagggagagctgaggctgagagagccaaatctctgacccctccccctaccagccatctgcccctgggttcaaagaccccatttcctctgctctctgccttgggaatctccatttcaggctgtccccagggactagagcccgcatttctctcccatatccaggaagcctggcttctctgtgtttaattctctgatcctcccaagttctcatctccactagagaaaaaccagagtcctctcactcagaaagcgttgtattttaggatgtggcaggctactcgggttgcacaatgaaccttaggcaatgctcgtgctaagtaccccagtgcctgtgttgcagtcaaggttttagttaggcctctcctgctgcctactgggacaggaagagggaatgtctgggcctggtttctccacctctttctgggagcttcccttgggcatctctgttctctatcccaccccagacataatctgaactagggtaacctcagctgtcagcttttgctaggcagggttcttggcaaaaccacaagtcagactctgctggcccttctgcgttcctcatctgtgtcttgatccttctgtgccttcagcataggctcagccccaggagtgggcagccaagcctgggggctgctttggacaaaggctgagtgcccagtgaggccgaagagccgcgtctcctaaagtgcctaccgtggggtgtgcctgtgccacgtgggtctgaaatgtgtgtgtgtgggggctggcctgggttggagaaactgccccatttcctactcctctggttgcaggacagatcctcccctgcctgctggcccaaaggggtgtgtgtctgctttggagggaggccacagaactgcttgggagtccagccctggctttgccctttctcagtgagggaatggagtggggtcctcacctcctaagcctgcttttttttttttttttttttttttttttttgagatggagtctcactctgtcgcccaggctggagcacagtggcgcgatcgcagctcaccacaacctccgcctcccagattcaatgaactctctgcctcagcctcccaagtacctgggaccacaggcacccaccaccatgcccagctaatttttttgtatttttactagagacggggtttcaccatcctggccaggctggtcttgaactcctgacctcgtgatctacccgccttggcctcccaaagtgctgggactacaggcgtgagcctgtagcccagccacctgcattttttaagtatggattatagcacctgcctgcttccaagacttgctgtcaggattaatgagaaaatgtttcccaaacctggtggggcttggcccatcagctctccatcagggcaggggtggtttctgtagctgttaccaacactgcctggtttgtgccctcctttgcccctgagctgcttctccctcatcctcccaccccatccttggcagggtcatttggttctccctggctctgagcacacgcctaccttcagtcagcccctgcctgggagaccaaggggcccaaagagagatccctggtctgcttccatccccttctccctggacatgcaatgaacaaagtgaaggaacactgaaaaagaggctggagtcacctgagcaagctcttagctcaggggacgccacatccccacgcgaggttctgaagtcagacagcccagtgcaaaccctgtcttcaccacttactcccactgtggccttagtcccatgccttgacccctctgtgcccagtttttgcccctctaaagtggggtaataaaagtacttgtgcaaggtgcggtggctcatgcctataatctcggcattttgggagactgaggtgagaggatctcttgagcccaggagttcaagaccagcctgggcaacatggcgaaaccccatctctacaaaaaaatacaaaaattagctgggcatgttggcacatgtctgtagtcccagctactctggagactgaggtaggaggattgcttgagcccaagaggtcaaggctgcagtgaggccaggcacggtggctcacgcttgtaatcctagcattttgggaggctaaggtgggcagatcacttgaggccaggagttcgagaccagcctgagcccctctaccaaaaatacaaaaattagccaggcgtggtggtgcgtgcctgtaaccccagctactcaggaggctgagacaggaaaatcacttgaacccagggggcagaggttacagtgagctgagatcgcgccactgcactgcagcctggacaacagagggaaactctttttctaaataaataaattaattttttttaaaaaaaaggctgcagtgagccatggtcataccagtgcactccagcctgggtaacaaaggataccctgtctcaaaaaaaacaaaaacaaacaaacaaaaaatgcttgttctacagggtttttgtgagcattaactgggacgatcttggtgccattgactggcacttagcaaggtgcctgacacagaggaagcactcagaaaccgttacctagtgttcccactacatcctatagtcagtgtgtcccatgctgtgatttggtgggatagagtttgtcacctaagactagttccctggctctgaggatgcagggagggggtcaggatgcctctgactccccaccactcacacctcccactgcccttctgcttttgcagctgagctgttcatggagcagcagcacctcaaggaagcaggtttctgcatccaggaggcggcgggcctcttccccacttctcactcagtactctatatgcggggccggctggctgaggtgaagggcaacctggaggaggccaagcagctgtacaaggaggcgctcacggtgaacccagatggcgtgcgcatcatgcatagcctggtgagtcagagccccccgcgctcccaccacctcctcccacagcctcagggcccttatcccgctttgtccctccttgtccccatactccactgcctgcctgtgccttgctactgctgttccctggtgtctaggggagggggcttccctcctgctctgttggaagagacagttcttgggatacttagccttctcttgtagacacaggccatttcccttcaatcagggtctgtgttgatgacaaaatctagaaggtttggttgatactctttgtgacttccttttgctgtagggttccgcaaagggatctagccccaaaaggctctcattgttaaccatcagacccttgccctgaaggctaatccagactctaggtggttaccaaaatgcttttctttctgggagtccccagaccctccctgtctcctccatttccaaggagttccacatctctttggtgggattcagggggttttctggggtgggctgtcatgtcagacctgtctcaagcacacactgagaatggtccctggggtgctaagaggatccagtagcccctggtcctcattcatgggctcaggacttgggtgtccagggcacagtggcctccctgtgggaagctcagaggctggggagcaggatgctgatactcttgtcctggccttacctctacctggtgatcatgggtaaatcagccaccttctctgaaccttagttttaattatctgtccggtggatatcctctggtccaggcaacatttattgagcaccagctctgacaggtgatatactagaccctatagattatcattttttcctgctttcctttgctgcttccagagaacatgtatccggataaatatagtgatctggaagcttgcaagcctgcatctgcacaagtgatttttgaaggataatctaggagcccacagttagcaacaatctttccctcttagggtctgggttccaccttggatgtcccccctgtgagagagtgttaaggagaacagccattagggtatccctgacgtcttctggcacgtagagagcacagaggcatcaggagaatggctccagatggctgaagagttggcattgccaaaagggggctgatttgtccgtgaggagaagctacagggagttagatttcagccatgtcagggaaaacgttataactcctagcatagtctaggcacatactcagtaatcatctggtgagagtgttgccgagagaatgcaacgtcatggggaggagccagaccaggtcatcttcatcaggtcctttccaacctgacagtccttgaaaaggaaatacaaaagaaattcccagctcagctattactcccgctgcctgatttctatagatttctaacttaggtctgtgtgaatgttcagcctcaaatgaagaaagcccgtgcagccaccatacacccttgtccatgttccttcccacatggctgcattgccttccagtcagctcagcaaatgtttgctttctgcaagaggcttcctccttcctccctcaatttagacattagcttctttgataaatgcctcgccagaggtcacatccagaaacttgattagggcagtgggagggagggtgtgggctatatcattgggcctgcagccaggcagagatgtctgccttccactgtgttcacggatataagcctgcaggctcagccctgaaaacccaacagaatccaataacaagtacaatttggaagtaacagtgtaccatttttcatttatgcttattattgtttgtagctattttcctgaaattgaagcagtttccaagggtaggtttccatggttactgaatagccatccagagtggctccctgcagatgtttctgaaatggtccctttttccttcctggggtgccttgctgatttgatgaaattagagcaagtcagagccaggcctgccctcttttaaagttacaagcaaccagaggggcagtcggcttctgcgtgggcagcccatcccgtctacaggctctgttcctgccagcatcccacacatatgcataaagaatagcaaatgttcagcctggggaagatttgctaagcgctcattttctaaagacatttgaacactttagtgagtcgatctcaagtgttcacagatctaagtgtcttccctgtgctggcctgaggctcaggacatctgggatctaatcctggctctggccctgatccacttgggggacttaggaaaagacacatttaacttgcatgctcctggtgtccccttttgtacataataatcctcgttcctgggccatagtgttgttctaatcaaatgaggtgatgcatgtgaaagtgtaaatatgtgcagtgcaatcccagagacggcaaagcacagcatggagtatctcaccccccttcagtccctcaccagtgtcagacattgctaagcagtcacagcacctttttcccactgagcaaagatgtgatcttggaatctttttcaacgtgaaacaacatgataggaactactagctgtcattctaggtcagtttcacatttatgtaagggattcattgtaaaaatagtagaggaaagatgtccatcagtcatctgagcctttgtgaactctggaggttggtacagccttagataattaccaagagaggaatgtggaaggtatccctgctgtggagtcagggcaggcccccagggaggacactctggccttaccatgccactgtgactttatgaggacgttggcctctgatcagtacaaggggaaggagagccttccctcccctgagggcacagccacccacaagcctgggctggagcgagccctctgaggtcgtgggtgagtcccactccctgaggtctggaaagtggtcggtggaggtattcttagtgtgctgtgtgggtgctgggtttggccctgtagtccttggagtgggattggcaagtgccaagaggctgaagaaagcccactgggagttgaagactttgctcttaggggctggggaccccatgtttctaagaatataagttttggccaagagcagattctctactctccctgtccccctgtcggtgccctagatgcaataagggatgtttctgtggttctagccctgctctgggttcagcttagggttttctacccagaccaggcaggaaggagatgccaccttggcagttctctgctaggcaagagaaccagcggaatttgtcccaagtttgtccatcaggctctggtcctgctggctgccgtctgtgccaggctcaaggatggccaggggcctccgggaaactggcaagtgtagaaagaaaaagaagtgtgctctctgcagtggaaatgaaatcacaggagcaggtcctgacagtctgccagtgtggtcccagacttctctccagtagctggaaatcccactcagctggggtattcagaactgaattcactggcagaaaattctagccaagaaggggaagactgaactttgcctgcctgccaatggggaaacgtgagaaggaaggcagaggccctcccagaatgcgcaggagtcgctggttgacactgctcttcagagagggcttcaaggcttgcccaggaagggacccccggcagcctgcactcctcttggagcttatctctgctctgccacctccctggatcccctctgcaccaggcacttccaagggcagaagaggtacctgaggaaaccagggagtcccaacagtgactggtggaatggttgggtcattgagagccctcccaggaagggggttcctttgaagtcacctgaccttcatggtgggagggtcattggttggtcatgaagctgagattagagcacctcagggaatgactggcttgacttggtttcccagtgtaaggaaggaaaaaacaattttccctctacctttctgagttcttagctgggaccttggtaacaggagacagattaacaaggaaaaacaaacagaactttattaacatgtataaaatgtattcatgggagatactcagggaaaacgagaaaagcttaaagaagtagcttagaggcccagctcagtggctcacgcctgtaatcccagcagtttgggaggccgaggcgggcggatcacgaggtcaggagatcgagaccatcctggctaacacggtgaaaccccatctctactaaaaatacaaaaaattagccgggcgtggtggtgggcgcctgtagtcccagctactcgggaatctgaggcaggagaatggcgtgaacctgggaggcggagcttgcaatgagccaagatcacgccactgcactccagcctgggtgacagagcgagactccgtctcaaaaaggaaaaaaatgaggtagcttagaactgtggcttacatagcattttcaaccaagagcatacaatttaaaagaagcaatgagacaaagaaaaaggacttggagtctctggggatggcaaattgtgggaagacaaatcaatgggaaactaatggtagacaaaggccagttagcagcgcttgttatgtagattcctttgtgccatctccaggctgataaggttctaacgttgtcttctgtgatcaacctttgtccttcctggttgagaggggaggaggaacacccttataaatttatatcctgcttttaggcaaatagggggagggcagagagcttttcttttctctgcttcttctcagttgccttcagctcaaaacagtccttacgcccaagtgacatatttgggggtggcatgttctgctatccttcagcagcccctgaagaaggtcctagccctggccacagagccacccactctccctgccctcagcttggctaaggagagtgtggacactttggtgcagcttgtctgcactgcaagagacaacttgacaccctcaagcatgagtggacaagcgaggtgtctgggtggcactctgccctcttctcccaggggcagactctggagaggaggagtttcctggtccctccccttccccagcccctcccctcctcatgctttcttcttggtgagggagctccaggctctccagaacctctccctgtcaggcaccccagcagtagtggggagatggctctgcatgagctttggctaatttggtaattcctgggatgcagttactgaagcattcctggcatgtgacccagcttcttctctccccaaatgcccctggaaagacaggaagacagtgttgttatctgcattcctcttgatgacagagtgacgatgaatgatttccctttattggttccctcttgctgccagtgtggagcaggccgcctcattctttaagtgggtttgcaggatcaagagcgtgggtatggcctcagagcctctcatccctcaccccaggctgtggcatgagggggcacatcttaaatccccagaagctccctactgccacccctggtacctcccaaggcgggacctgagtcactgagggccagagctctgcccatccaagcccagagcctttttaggtgctctgggactctaacaagaaggctctggtctctaaggccaaaaggatgaactctctggccacacagagcttcacccatcaccccctccgcctgctggctggccctctcccccatcatggagggttggaccagatatgagaggtgacaaacctaagacaagcagccctgcgttatgggggcgcttgagggttactttcctcactgggtgtctcagtccattttgtgttgctgtaacagaatatctgaggctgggtaatttattattatattttgtttttattttttgtagagacaaggtctcactatgttgcccaggttagtcttgaactcctgggctcaaggaatccttccgcctcagcctccaaaagtgctgggattacaggcatgagccaccatgtgtggcctttttaaaaaatatattttttatagtaatttacaataagcagaaactttttatttggctcacagttctggaggctgagaagtcaaagatcgaggggcacatctggcgagggccttcttgctgcctcatcccatggcggaaggtggaggggcaagagagtgtgagagaaggggaagccgaactcatccttttaccaggaaccccctcccaagataacagcatcaatccattcaggagggcaaagcccgcctgacctcatcacctcttaaaggtctcacacttcaattctgctgattgaggcttaagttgctaacacatgaattttgggggacacattcaatccatagcactggctcagttttttctgctatcaaattgggatgataatctagactctcttgtgacttcaaggagcagttttagggctcaggtgaactgaaagctgtgaaaagataagtcaacgttgggcatttttatcactatattcacatagatgacttggtggcacgtggcctgagcctgagccccacctgggaccaggctggtttctgttggaccattcttagtgtgggatgagggtctttggcccacatttccttgtgatgccagcagggtgctgagaagacagggagggagtgcctggcagagacagggacctccaagatgccttcgaggttctcctacggttggttggctgggatggtttttaaaatgagtatcagagctggctctggaggaggcacctgcaggttggagcagggccttcaagttcatctgacctggacctgagtcccactttgccttcactcactgaccaggttctgtaacctctcagaacttcagtgttctcatctgtaaaacgaggcttgctataccaagcacctagggctgttgttagaattaggttaaataattccataagttagtggcccagtcattgggattatttttatgtttttcactttgaagcatagctgccgggccatgttcagatgctcttggttctcgggggggagtggaaacctggtgccaagccccaaagactcattgcagtaaagccactccgtcctctctgagtccacaggggaagctggccaaggtcacagaccctagctgccttgtggacaggacaagagtgcacacagtgcaaggcccagcctgaccttagctacggggagggcagcctgctttgcgggggagaatgagctgagggacgagggagataccttgggtaatctgtgcccgttggggcagaggctctgtggtggcaggctccggggaggccctgacctaccgccatgccggttcagcatctgttttctgacttgaaggaggaaggatgtgccgagcagctgaggaatgacactcagtgcctggcattttggaggtgccctgacactgggtggggctcagtgcacaaacagcagggtaccgggttcctggggccagtggcctctgctgcttatgccccatgtctcagggtccaggacgcaccaccagctctaggcttctttctctgtgttcatttccggagctgtggcaggtggcttagaggggtctaggccatgagaggacatggaatcttgcttctgcttggcaggaaagttcaataggagcgtcttggctctgtgacctctgatgagatgattttattgtgagctttctgttcacccctcgccagtgctgcctgaggtcacattccctgatgggaaagtagaggagacgaaagtagagggttctgcaggcccatggtgtggggggtatgagggtgtgtcccccagcacctgctcagtggggatcagaggcccctccctacccaccttatccctgggctggcacagccccacacacacaccctgagccctggctcaggactctgggaaaaccttaagctgatataggctcctgaagtccatcaccaaccctgatgaggaagcctgtcatagattcagatcagaatgatacttgagcactgctggcttaattaagctccagaatcaattttttcaaaaaaaaaaaaaaaaaaaaaaaaagaaagactcaccctacatggagagagaaggtaatgcggccctttctccctgtccagcagccccctccccaaactgtcctttactgtgcctttggctgtacctcctgcccagagaggggaccttctgtgactgggcccccttctcactccccatcacggggactcacttctagaacccgggatccagaggcctagccacagcctcttgactgacctggagggctgggccaggcagtgctccaggatgggtagaggcccctacagacctagaacctgataccagcccaggaaggggaggagaaaaggcccagccactggccagaggagacggctggcaaggaagtcaatttcttggaggttcgtcaggctgcagagtcccccaggatgtgacccatcgggcccctggccgctggtccctgcccctctgaaaacagacaacccttagccccagctgaagaggcctactggtgttcttctacatctcacttgtaaaggaccccagaagagaaagggacaggtactcactaccccaggagacccccacctaggttgggctccttgtgagtctgggctcttctcagcaggagcctcttcttttgaggcccagggggctctggggtgaacacatcccaccccagcactgggtggggctggaagggtttgctcccctccccacatcagggaagtaggaccctgtggctttggagctgccctggctccaggaggcctgtggtgatgggagtgggaggttttcagcctggagaggcgcctccctccctcccgttccaggtctggttggacaggttgaggctgacacacctgagagaatccggaatgccagagagcctggagctgggctggaatgccagcctccctggaagggtgtgtctatgttccagggtggcgttagggagggccctttctgtagagcaggctcctcccagcagccctggtgtccccaaacgcaggctccagggaccagaaggctcctgcagcttccagctgattcctggcttcccagctggaaaggctgttacagaatcccaggaatgtgccctgagctcagaaagaaaattcccaaaataacttctataaatacttgagggcaggggtggggagggagggctcagcctggcccacagctggcctagcgccaaggctgcttcccagggcaggcccccctcaaaggaagaagaagcatgcacacccctagacctttgtgctgctctgcccttggagggcatcatcaggcactgaacttatgggctgggatggtgtgcagtggaattctgaaaaggcaaggcccttttcccctcatcccctcccaggccacagcccctggccacacactgtgcctctgcagatgacctgggtcccacagggaggctccccactgagtgtgagcccagaccctagcaagaccttaggccccttaggttctgcacctgcgtggccgtaagaggcagggcttgccaagctccacgtgggcagcatccctgatcggaggtccacatctgtgtgtgtgtgggtgtctctgggttccctggctctgcatttgggctacatcctgagctctgagccttgttgagctgctgtcctttggggaataacaaagcaggcaggaggctggggcgctgtccctctcagcctggggaggggcaggacagggatcacatccatgagccccacagtaactaagcgtgaccttgaggcggttgtgtggtcaggaggagctccgccctcagggaaggcttcctgggagagcagagtctcgagcacttgagatgtggccacacatccccactccctgagatccaggaagggagagaaggagggtcctgaggtgggaatttctggggacttcccccagagccctgcacctccctggaatcatgtctgtggctataaccagcccaaagcgcccccttggaggtacgatgtctgatcaccataaacaacttggacatcactttcgaatccctgtgggctggcagcacagccatggcatctcccaagggacggtcaaaaactggaagcctctcagcagatctggtctcctctctcagcgtggggcacatcctcaccaggatgagggatgggggattcacttgggacatttggatgaaattgagatgtcagttcttgttcccaccatctcccaggaggcctgttctctgggagggtcggggtgccaggaggattgtctgcaggtcctaggtgcagcgctgggctcagggcagagtaggtgagacctcgcatcttcctggggctgtgtcttgcccagttgtcaggcagcaaacagcgctgagttgctaccaaacatgaactcggctggtgtcaggggcaggtggcagaagatcctgttacaggccctgggcctctgggccccagcctgaccccagcctggtgtctcctttcaggttctaaggtcaacatcccagggtggggggacatgagccaacccaccctagcctacagtcctcccccacagagagccatgccctctcccagcttctagagagatcagtcactccacccgctccccacctggaaggaccctctgctcatcttgaaggcgctgctgtttgctgtctgcccccgcggtgatttttcaagttgatcattgcagaatcctcacaagagccccgcgaggaaggactgtttcattgctttggtttacagatgaggaaaccacagctcagagaaagttggccatttgcccgtggtcacagcacttgtcagtggcagagctgggattccaacctggccagggcttccggccagcaagccctgagctttttcctccctacagacacacacaggaagttactgcaaacctccgaaactgagaatacacacacacacaccagcctgcagacacatctggccccttcccaaacacccacatacttcttgatatcaggggttttcagacttgtttttagcagttgagcccatttttcaaacagaatcccatgtggaagctcaatatagaaaacttaacgtgtggaagccactccggccctggccctctctgggaggccttgccggcctttcccttctgtcctgtgtggctccctcctgggcagaactcacagggctcaaaccctccatttttggtgcttaattttgtgtctggcggcccgtcggctggcctccttccctcctccctgtgggccgtgttccattgtgagctgctggggtctggcccttgggtctggtgtgggtggaacagctaggcctggtgccctgctggccagcctggccactacccttggtcccaggcagccctgagtcagcaccgctcccatctggcgagagcgtaagaccctgcctgaggctccaccccgcctgcagccaccctgtcctcccctggcctctgcacgcctcatccgtgtgtgtggttccttgctacggctttgcccagggctgacagaggcgctgtgaggacagcctcttcctcccccgccccctggccgcaagatctccagccagcgcctctggagagggagaggcctttcctagggcttcctgagcgccatctttcactcccaccgaactggttgtgttccaagctctccgaggacttgatgaaaccaggcatgcgcatcttccccagcgcgtctccatagcaacagagggcctaactctggggagctcgctgaggaggaaaatgttccagctaaaaatgtacatggccgtcagtgggcgggcaccggagagggggctccaggcacatagaaggcagctccccacccccactgcggcccccgcctgtccaggaagtcggtggtgggctttacctcccgtcttggaacaagagaagggccccccgtgctgtcatctcatgccaccctcagggctgaaacagggatcagtgggacggcatgaagcaacctttgtgggacctgaggctgaaagggggccctgccctctccctccactcactaccctgtccaccctacccacttcccagtgtgggtagaagaggatgtagaggggacaaggtgccagtttcacttcccagcctcttcttatgactattcctgttagttcctctatctctttggtaacagggttgtttgagccaaacagcagggccaagcttccctgtgcgtgacccagaccccccaggcctttcatctttcagccaatccagcccgttcacccagcaccccatcccccgccatctgactctcctcccatgaccctctcctgaggagccaccgcacacgcacacgtttgagcttttcctccctggtggcagtggtgaaggcctgtaatgcgtcctcctccgtctctctgcgtccctggagtgaagggcagctctgggcagcaggaaggactgagacgcatggccccactgagtgagaacacactcctgccagacacttctcagagctttacacctcctgactcctttcaacctcaccgcgctctcgagagagatgctgtgatttttcccatttacagatgaggaaactgagggccagagagctgggatttgcctaggatcccccaaacagtgtgacacagccaggtctgttgacttgaaagccagttcctcgggaccggcaggaacagagctcctgcagtgggtttcccaggaggctggggttaaagcagggcttgggcagggccaggtaggatttgtatggggaaaggcacagtcacttaacagtgcccaagccagagacgcgggaatcctctcgagctgatggctgctgccacccgtgcacctgtgcttggcccagttgccaagatgcctgtgccatgggacacccctactcaccctgccctgtgcttcgtccacagggtctgatgctgagtcggctgggccacaagagcttggcccagaaggtgcttcgtgatgccgtggagaggcagagtacgtgccacgaggcgtggcagggcctgggcgaggtgctgcaggcccagggccagaacgaggctgccgttgactgcttcctcaccgcccttgagctggaggccagcagccctgtactgcccttctccatcatccccagagagctctgacgacgctgcagccgcagggagggaggggctggccagagggagaggcagcagggaacgtgggtcagggtggggcaacagtggcatcaggtgcggggcctcagggaaatacatctttagtgaacgcctctgcagctgcagccctcgttctcttggctgggccaagagggccttcctggatttctttgttggtgccttgggaaacagtctgacttgaaccctaagtgcctttggagagttttgtggtgaccagacttgctccccaagagctgggcagcggggagcctcacagctgtccttcaccctcacccatgcctctggcttggagtctgggtggggggttctcactccccactctcagcacagtacagacttctggatctctctcaggtcttgcccagggcggtcacaatgtgaagaaactgcgggcaagtgggaagactatgagatttctgggttcccttctcagacttggagttagtagatgattcctgcattgcccctgcttgccctctgagaccagctgggccccaccttgctctttccccctgctaccaagtgcctttggggtctgaccaggggtactgagcaccggccctaacacttccatctccacccaccccatctccctggcgatgtgctccagcccaagcagcctccgtaggctttagatcctgtggttgctagatccagtcctttctaataccctgagtcaacacattactcctgcaggtcttaggctacaatgcaggtcccttgagggccaccaacatggaggtaggcagtttctaggactgtccccagtacatctcaccacccacagccctttttttgccttgattcgagcctcaccctggccttttggcttcccctgcctgagagagacctgaggaggggacagagcccagcccctctcctgtggctgagcaggcctctgtgtccatgacacctgtcttccgggcctgggggctgtgggtgtatgtcctccctactggcttccccggcccctgctgcatgatgctcttggaactcttctccaaggagtcagtcccccaggcctatcaggggatccttttgtatctgcactttgggttttagtttcaaagctccatcaggtacagcttgcatttcaggatgtgtggaaagctcgggtgagggctgccctggttcatcatagctccaccttcctcggaaggagtgggctgttggagaccccccatccatggcacactagctcagcactgcatttcccgagatgattcccaagacagctggtgcctcctggctttcctgtgccaggccaaggggcaccacagaggaccctggatcctttgcctcttcttggttgaaggatctctatgtatgtgtgtatataaatatagttttttatctatatatataaaatagagatctattttttttctggaattctgttagaaaagtaaagaaaaagcaaatgctgttggtttatctcagggtgcccaaagtggttatagtcaatttttggtactaggaaaggcacccaatgcatttcctgacttttaagcatttccttgttggaagcagcagagggccaggccaagttgctgacagtgactttgcaggttgaataaagaaacccttggaggggaagcaggcttgtctgaagcagcatgtatattcactgggcatgtagctcccacaccagccttgagccaggccctggacaggaggggctgttgcaggatgagggaggccagagaaggcatcgaagccaagacctgggcccacctggggagggatgtgggaaaggaaggatgggagggaggaccctctgggaaaatgtggatttgagctggtgagagtgttgctaaggctgggctaaagcctggagagggtaggaggaggcaagaggggtccaggcagggctgatcctggcctctgacctgtccagggcgacccctgaagcccctgctgcctctgggcattgctgggagaggccaaggcaggactcacgtctgaacagagatcccctcgggcattgctgatgggccaccttcagctgcagggaagaagcctaggagaggaggcatgggagggacctgggccttgttcagattggccacctctgctgagaagtccataccagtacacccctaataagttatgccacataccaacgtactgtggatattataacctgcattaaaacaactctaaagaacgctgctcattta

SEQ ID NO: 2136 - DNA, 30045 bp, Homo sapiens
  source 1..30045: mol_type = genomic DNA
tccagcagagaaaacatgagtttattaccagatggtggagatggtgggcctcaagtttggaagctgggggatttaagggctggattagtgcccctacaaatgttgggtccctcaagatcatggttaggctcacggccaagaaagaaaaataagttcacagaggtggggtctctagacaggagtaaggcacacggtgtgggtgaggctgacatccccctcttggtttcatcctggagcagggagcaggaggctccctctgcagccactgcctggtccagtcctcccaggcagggctgccattgtgcctcagcacacgctgaacactgaaggggcctggccttggtacttctcatggactgtcttcagaatgggtatgaggttctcgaaggttgggcgaaaggacgcctctgtctcccagcagttcttcatgagatgatagacctagaaggaaaaaccagggctggtgggggctgccctctccacagcaggatagtggggtcagggaaagacaaaggaagtctcacctcacagggacatttgtcgggccgtggcagcctctcccctcgttccagcaactcagtgagtctcagaactgtcatctgaccctgagcaatgcctatgagctcaaggaatttctacagtataaacaagacaagctcttttcaagaggcaatgaaaggcaggcacggtggctcatgcctgtaatcccagcactttggaaggctgaggtgggtggatcacctgaggtcaggagttcgagaccagcctggccaacatggtgaaaccccatctctactaaaaatacaaaaattagctgggcataatggcaggcgcccgtaatcccagctacttgggaggctgaggcaggaggatcgtctgaacctgggaggcggaggttgcagtgagccgagattgtgccattgcactccagcctgggatacaagtgtgaaactccatctcaaaaaagaaaaagaaatcactctgcaacttcatgaaatcgactgcatgggttccaatcccacctcttacacttctcagctgtgtgactttgaatttgagttcacttctctgggcctgttttctcatccgtaaaatagggtaataacatctgccacctgggattactgtgaacgttaaactaatattcatagagtaagcgtgagtcaggtgtttgccgttattattaagcctcacagcagattgttcttaccgtccagaattttttttttgagacagtctctcgctctttcacccaggctggagtgcagtggcatgatctcggctcactgcaaccttcgcctaccgggttcaagcaattctccctgcctcagccgcctgagtagctgggattacaggcacctgccaccacgcccggctaatttttgtatttttagtagagacggggtttcaccatgttggccaggctggtctcgatctcctgacctcgtgatctgcccgcctcggcctcccaaagtgctgcgattacaggtgtcagccaccgcgcccggcctatgcctttctttcctttcttttctttctctctctctccgtcctgtcctgtcttagacggagtctcgctctgtcacccagctggagtgcagtcgggagatctcggctcactgcaagctccgcctcccgggttcatgccattctcctgcctcagtctcctgagtagctgggactacaggcgcccgccaccacgcctggctaattttttttgtatttttagtagagacgggtttcaccgtgttagccaggttggtctcgatctcctgacctcgtgatccgcccgcctcggcctcccaaagtgctgggattacaggcttgagccaccgcgcctggcccagcctatgcctttctaattgctctagcaaactcccggtggggctgcgggcctggctctcaccgtgggggggctctggctggagtcacagtgcgtcagcagctcatacagggtcaccccgaaggaccagacatctgacgcatagtagaacttatactccttcaggcactctggggcatacctagggggaggggggcactcaggccacggggggctgcactgagggcttggggatcagaccaggctgaagccctcacctgagactgaaggaccctctgggctcagttgggacccacccttaagagcgcagcctgagcggggtgatatgctcattggctaggccgctcattggctaggccgggttaaccccgcccaccaggccaagccgcactctatacaccgccccttgcctccataggccccacccccgcaccgctaggccccgccgcgcttcactgggatcatgccctatcatgatacccagcatccgtctactccaccctgcctgttccaagtgaccccagcaccccctcagactgcaccccgcctggtcaccagaacacggggctgtccccatcctcgcgcacgcggtagtactcgtggccttcgggcacggccttggctaggccaaagtccccgatcttgaccagcctgtcgttgtccagcagcacgttgcgcgcggctaggtctcggtggatgtagtgctgcgcgtgcagataggccatgccctggggacggggcagggctcgtgagtttcagtggggcggggttcggccgggggcggcggcaggacctgagcagccaggagggctgggggacagtcaggtcaggccggtggctacccggccgctggagagggccggatggcacgtggcaccaagcaaaaggaggctgagccagaaagcagggacggggctagacgagcaaagctgggcaggagggcgagttgggaggggccgagccggctgtgcgtggtcccttgggaggagggggtgtggccaagcaagccaaacagttcggaggtcagtgcaaggacaagacagcctgggcaaacgagcaggggcggagcgtgagagcagactgcaccggatcgctcaggccagcccaagctgaagaggaaggggcaagctccagaagcaggggcggggccgaccaacctcgcagatctgctgggcgaagagcagcagctgggccagcccgatgctgtgccggggcaggtagtctcggaggctgcccaggggcacgtactccatgaccagctgcagcgacttctcgcctgccgcggagaggggcggccccggtgggggacgatagagggcgggccggggaccgcctaccttgagcccagcagagcccctccaaggtcgggagggaaggccaagacccgcgcacactagacccagttctcaggtgggatggacccatccagaaccccattctcacttgagggagctgctggtggctcccgtccatcctggccccagcaggtagcaccccccagatgggaaggaggcagcccagccacgctcacccagatgccaagaaccgcgtactgcagcctggggttgagagtctctaattggctaggccagactggccccgcccacaaggccacacccacgctctaaccacgccccctcaagtctctaggactcgccgggtcccgcccaccttggtcctcgcagcagcccttgtacttgatgatgtgctcgtggtagagcgtgcgcagaatgtcaatctcctgcttccagcccgagcggtgctgggggccgcagtctgccttgagggctttcaccgccaccatctcgccagtgccgtcgttggtcggatcgtagcagtacaagctgaccttgccgaagtgaccctggtcgggagcgcacgagggtcagctccacctccccaatccctgcaccactccccaacccccgatttcccgggccactcctccaggcagatcctttcggaataccccaggccccgcctactccgctctattaagactccttggcacctaggcctccctcaaagcagagggtcccacccacatctcctgagaatcaccttaggtaggaatttatcctcaacccccaaactccttcccgaccaggcgggccttttagcagctcaggcccgtccctcacctcgcccagatctcggatctttttcaaatagcgcttgtggaaaaccgtagggtccgacgccggtgagtccgggttcacagtcaagacgtcagcaagatctggaagagttgcggtgggtaaaggcctgaccccgatcctttccccagcaggcccacacttgggagtcacaaagccagccacagctaccccaggatccgattctagaggtaagaaaactttttcctgcaacagctgaaagagtccacttattgtacaaaatgatgcagagttggctgcatcaaaactgacacctgtttgggaggccgaggcgggaagatcacttgagcccgggagttcaagaccagcctggacaacatggtgaaaccccctctctacaaaaaagttaaaaaaaaaaattagccaggtgtggtggtgcatgcctgtggtcccagctactcaggaggctgaggtaggaggatcgtttgagcccaggagttttgaggctgcagtgagtctgggccacagagagacactgtctttaaaaaaaaaaaaaagaaagaaagaaagaaaaagaaaaaacagaaaaacctgacatctggaagttccgagattgggtagagggcacagatatttcatagagaaaagagaaaaactggccaggcgtggtggctcacacctgtaatcccagcactttgggaggccgaggcaggaggatccctagagcccaggagtctcaggctgcagtgagccatgatcgtgcctctgaataaccaccacactcctgcctgggcaacacagcaagacctagtctttaaaacaaaaaagagaaagaaaaatgtgatatgaccagttgaaaatggcatattaggccgggcgtggtggctcacgcctgtaatcccaacactttgggaggctgaggagggtggatcacctgaggtcaggagtttgagaccagcctagccaacacagtgaaaccccgtctctactaaaaatacaaaaattagctgggtgtggtggtggacgcctgtaatcccagctactcgggaggctgaggcaggagaattgctcgaacccaggaggcggaggttgcagtgggccgagatcgtgccattgcactccagcctgtgcaacaagagcaaaactccatctcaaaaaaaaaaaaaagaaagaaagaaaaaaaaaaagaaaataggtcaggcgcagtggctcatgcctgtaatcccagcactttgggaggccgaggcgggtggatcacgaggtcaagagactgagaccatcctggccaacatggtgaattcccgtctctactaaaaatacaaaaattagcccggcgtggtggtgggcgcctgtagtcccagctacccaggaggctgaggcaggacaattacttgaacctgggagacggaggttgcagtgagccaagattgcaccactgcactccagcctggcaacagagtgagactccgtctcaaaaaaaagaaaaaagagcatattaattttttaaagagaacaatacaaaacttttttaaaaagaaaaaaaaaactgcagtggtctaattctctaatccaaagaagttgtgtctctccccagacaaaacattaaggaggccaggcgcagtggctcacgcctgtaatcccagcaatttgggaggctgaagcagatagatcatttgaggtctagagtttgagaccagcctggccaacatggcaaaaccccacctctactaaaaatacaaaaattagccgggcatggtggcacacgcttgtaatcccagctacttgggaggctgaggtgggaggattgcttgaacctgggaggtggaggttgcagtgagccaagatcacgtcactgcgctccaggctgggtgacagagcaagattccattgcaaataaataaataaatacattaatgagagctcagggcagccaggcagggcatgcttatgaatgccactgcaagaaattggcacacaccctgaaccactgtgcagagacctctcgtgcgctataggcatacagcagggatcccagccccgtcccacttccccagggtcccagcactgggatggagctcactgtggggctgcagccgggtgaggtcacgcaggatggtgcggaatgatggcctctgggttggctcataggtcagacactggctggtgagtgtggccagctgtgggcaggagggctcgggcagccggtgctgcctctggtagaaatgctccttctgttgggaaagggacccagaggagtcaacatcctcccctcgcccccaacccgttccccaagaggcagagtcaagtccccagagtggaccgccaggtgcccgctcttatcagttccattatacagatgaggcaactgaggctccacaaagtgggaggacgtgctcacagccgtagaaccaggactgggacccaggtccagtgattatgcagagctggagtgtcacagtcagcctcctgccccaagcttccctcctgcccctcctgtagaccacagctccttaatacactgaagcctcagcctttgcacaggccatgcactctgcctaggctgcccttcctagccaggcttgttggcataattctacacttagataaaacctcttctggggccgggcactgtggctcatgcctgtaatcccagcactttgggaggccgaggtgggcggatcacctgaggtcaggagtttgagaccagcctgaccaatataatgaaaccccatctctacaaaaaatacaaaaattagccgggtgtggtggcatgtgcctgtaatcccccctactcgggaggctgagacaggagaatcgcttgaacccaggaggcagaggttgcagtgagctgagatcacgccattgcattccagcctgggcaattagagtggaacttcgtctcaaaataaaaccaccacactcatgaacctcctttgggaagccttgtctgaccccactgctgggtgaggcgcatcctcagcccttcttccccactctgcagcctgggcgtctcccatcgctgccctggtcactctgcctaaaactgaaatcaagtctcttacttgccttctgtgtgccaggcacaagtgacttccacaaggacctaaaaaggctgggactacattgagccccagcgagtggcccacctgctggtagcccagagagacttgaagtcacgaggccagaagggatgcagctttgagctctgattctgtcctctggatttcttggaggggcccccactgcggggagggcccaagggtctcctagacatacctcggagggactgcggctctgcagaggggcctctccgtcaaagcagatctccaggagggtggcgccaaacccccacttgtccatggcggtgcttaggctgttggccccacctggtaggcattcgggggccagccaggggatcctctccacccgctctgggaggccaaggtcagaggtcaccaagggtgaaaggagcaggggaagccccccactgtgcccaggtcccctcaggtactcaccctccctggagagggcgcccaggcccacgccaggatcactcagcttgatgaaggggctggtgccctctgccaaccccagccgggccagcaggatgttccggccacacacattaccatgaaccaggttcttgttctcctgaggtgggcaggagagggggtgtggccactcaggagaggcacagacgccaaccccaaacctggtccccatagggacagccaatgtgaaaaggacaactgtgactatcactgggtttctttctgttttgttttttggggggttatttttttcttgttttttttttttttttttttttttaagacagggtctcactctgtctctcaggttggagtatagtggcacgaacatagctcactgcagcttcaaactcctgggctcaagccttccaagtagcgagaattacaggtgcacatcaccacagcctagctgattcttaaatttttggtggagatggggtctagctatgctgctgcccaggctggggtgcagtggtgtgatcatagcttactacggcctcaaattcctgagctcaggtgatcctcccacctcaacttcctgagtacctcggcctacaggtgcaagttaccacattggctaattttttttgtatttttagtagaggcaaggttttgccatactggccaggctggtctcaaactcctgacctcaggtgatccacccgccttggcctcccaaactgctgggattacaggtatgagccaccacacctggctatttgtttatttttaaaagatggggccagctgggcgtggtggctcacgcctggaatcccagcactttgggaggctgaggcggatggatcacgaggtcagaagttcgagaccagcctgaccaacatggtgaaaccccatctctactaaaaatacaaaaattagctgggcgtgatggcaggagcctataatcccagctacttgggaggctgaggcgggagaatcatttgaacccgggaggcgaaggttgcagtgagccgagatcatgccattgcactccagcctgggtgacagggcgaaactccacctaaaacaaaacaaacaaaaaagatggggtctcgccctgttgcccaggctggtctcgaactcctgggctcctggccctccctgaccgacccaggccccacacacaggccacacaccaggtagctgagggcgctggccagctgctgggccaccaccatcttccaagccatgggcacatggccccgctccctccgcagccacacatccaggggtccgtgctccacgtactctgtcaccatgatatctgtaaagacacagctgctctggggcaacctgcctgcttctgccctctggatggcggggaattgggggagacgccagggagggacttggcatgtggctggggaggtgtcagggcagaggtgtgggtggagtttggtctgggttgaaagtgagtttggggagagaagaaatgcggaatgcagcagaggcagcggtggatgagggcattggggtccaagtgggatggggcacggaagaagttgaagttcaagagagaaaggtgggctgggcgtagtggctcacgcctgtaatcccagcactttgggaggctgaggcaggtggatcacctgaggtcaggagttcaagggcagcctgcccaacatgatgaaactccatcactactaaaaaaaaaaatacagccgggcgcggtggctcacgcctgtaatcccagcactttgggaggctgaggcgggcggatcacaagttcaggagttcgagaccagcctggtcaatatggtgaaaccccaactctactaaaaatacaaaaaaattacagtgaaaccccatctctactaaaaagacaaaaaaattagccaggcatggtggtgggcgccggtagtcccagctacttgggaggctgaggcagaagaatggtgggagacggagcttgcagtgagccgagatcacgtcattgcactccagcctgggcgatagagcaagactccatctcaaaaagaagaaaaaaaaaaaaattagctgggcatggtggcacatgcctgtaatcccagctattcgggaggctgaggcaggagaattgcttgaacccgggaggcggaggttgcagtgagccgagatcacgccactgtattccagcctgggtgacacagtgagactccgtctcaaaaaaattaaaaaaaaaaagagataaaggtggcagggtacagtggctcatgcctgcaatcctgtcactttgggaggctgaggcaggaagatcccttgagcccaggagtttgagatcagcctaagcaacatagtgagaccccatctctacaaaaaatttttaaaaatcagccgggtgtgatagcacacgcctgtcatcccaggtgctcaagaggctgaggcggaaggatcgcttgagcccgggaggtcgaggcttcagtgagccatgatggcaccactgcattgcagccggggcaacagagggagaccctagtctcacaaaaaaagagataaaggtgagcctacaaagtaagcaactagggatgggggggatgggcatggataagcagaggctaggggcttgaggttggggtgtaggagatgtttgggtaccagagtagtcagagggatgtgggtcagggtgtcggccagggtccaggggaaagtgggggagatgcacacacacacacacacaggggggttgagggatgggtgggtctagggttgttctgtacaagggctttattttttatttatttattatattttttgagacagagtctcgccctgtcgcccaggctggagtgcagtggtacaatcatggctcactgcagccttgaactcctgggctcaagtgatccttccattccagcctcacaagtagctaggactacaggcataggtcaccatgcctggccctgatttttaaattttttgtaaagatagggtctggacatgttacccaggctggtcttgaactcctgggtttaagcgatcctcccacctctgcctcccaaagtgctgggataggtgtgagccaccacacctagcctatacaaggagttttgagctacctgcagaggaaaggaagaggtggggttaggcagggttggatgtgcaggggctgaggcctaggagaatcagcacacatcagcactggagtctgcctgaggccatagtgctgatggggccaggagcagatgggggctggactgtagaggttgtttgggaggttgatggaagtggggatgtagttgggaatcagggtgggggttgagactgagggcaggtgagggtcgacgtgttgggatgtaagttatgggctggaatatcgttaggggttggggtctaggttgaaggtcaaggtgtagcccgggatcagagtacaggtgagagttgagaaataggcataggttggggtgtaggtcgagggttggggtacagatcagggagtgggtataagtcaggggtggcctgccaaagggggatgggtatggcgggacccactcactttcagggccgcgcacacagacgccatgcacgaaggccaggtgcgtgtgggagacctggctcatgaggctggctgtctcgtagaaggcctgtggggaccgggcaggtcaggtggctgcaaagccgacccctcccatcccacctcctccacggacacacccctcccatcccacctcctccacagacacacccctcccatcccacctcctccggccacctcctccacagacacacccccaggcctggccctgcccactcaccagggcgatgtcatggtgactagggtccagcactttgagcaccactcgtagctcctgcccacggtccctgccaggcacgagggggtcctcgtcatccatcttgccctcctcagggtccccgctgccctccactcgcaggcggccctcatacacgttggtccttgtgccctggcccaagtgggacagctgcgggatcatgtggcacagaataccgccatggtgaaagttagcagctgatctcccagggcccccagcacccacatccccaggggccctgcccttgccccgggccccttccctgcacccacctgggtgatctccttctggtcaacccggtggaagctgagctggctgaggttgagtgtcctggggctggcccgagccccccgcatgatgatgagattggaggtttctgggggcaggcatcaagtcatggagggcgggcctgggggagagatgccacatcccacccagaggtccccctatcatcgtacctcctggttggggcaggcaacagcgacgcagagagaagcagtcatccccggccctcagcaagcagccctgcaaggcagccccaagttcccgaacgctggggaaggaccggccccagccctccagcacgaaggccccgtcctgctgctcaatggggaactttcggagccgcaagctctgcatgccgtctggtgcctggcaggaggtggcagaggtgggagcagtaagcaggggaccaggcagggaacgtgtccagccccagccccagcccccagccctgggctcacctggctacgctgggccactgtgaggatcaggcggtaggggtggctggtgctccagtgaatgaggtacaggccgtcctcgggccgcagcttggcctgcacaaatggctccctggaaggtggtccagggggactatcaggccacctggggccactctggacccatacccgggaacaatgacactcattacctacttagagggcacacacacagctaggacaagtgtcagacacagccactcttgtggggacactaactctggacacacagccacttacatggagacacaatgcagcagcaggcacacacctgcttttttgtttatttgtttgtattttttagacggattttccctcgtcacccaggctggaatgcaatggcgtgatctcagcttattgcaacctctgcccacctgggttcaagcaattctcttgcctcaacacctcaacctcccgagtagctgggattacaggtccctgccaccatgcccagctaatttttatatttttagtacagagggggtttcaccatgttagccagcctggtctcaaattcctgacctcagctgatctgccagcctcagcctcccaaagtgctgggattacaggcatgagccactgtgcccggctacctgatctctcttttttttttttttttttttgagacagggtcttgctctgttgcccaggctggagtgcagcggtgcaatcttggctcacttcagcctggacctcccaggctcaagagattctcccacctcagcctcctgaggagccaggattacaggtgtgcccagctaatttttgtgttttctgtagttaaaagaccttgctacattgcccaggctgctcttgaactcctgggctcaagtgattctcccacctcggcctcctaaagcgctgggattacaggtgtgagccaccacacccagcctactcctactcttgtacttgacgccagacgggccctgacaaggtgacacacactccaagattggaaacagccatcaggagccggatgggcacacacccagccatgaccatcgccactcacaagggtgacacacggtggatggccaatcacacaagcaaaggacaacgatcccagacacaactaatcacccaatatgacagggcaacataggggccagggcatcccagacacagaggtgacacaaacatgcactataaagtgtcatggtcacataggtccagacacctacatgtgcagtggctgacacacgtggtccccaaacacctgtctgtacgggggcagcacacatatagccttgacagcaggcacggccacaggcctcacaaggtgaaatggccacttccccctcccctggcatcacaggtaggacaagggacagagagtcacagggccagtgaccagacaaagagacagtcacaaatcacgacttggcagcacacaggacagccacacactcccctgcacctgatgatgacataagtaccgacaacttcacgccctcaggcccacaagtcacacacaggaccccgctgagatggtgactcacaagttaccagcacaggcagccgcctgcagaggtggaagcatccaacatacgcctgaatggtcaccagcgtcagggtaacacacagtcccatgaaaatcaccagttctgtgcaatgacaacctcaacacacaatgacagtcatggccgggcgtggtggctcatgcctgtaataccagcactttgggaggccgaggcgggtggatcacctgaggtcaggagttcaagactaggttggccaatctgatgaaaccccatctctacaaaaatacaaaaattagcctggcatggtggcgagtgcctgtagtcccaggtagtcagttgggaggctgaggcaggagaatcgcttgaacccgggaggcggaggctgcagtgagctgagatcatgccactgcactccagtttgggcgacaaaaaataaaaaaaaaataagacgtgcacctacacacacaccctgcacagcccctagggctcacagtctagttggcacccttggcggtggcccccagcgccccccacccagcactcacagcaggggtccgtggatcccatcccggatgctcatcaccagccgtgggggagccacctcgtggcacaggtagtggctggagtcggccgtcaggcggaaatagccgtccaccagcgacacgaaggacagcgccgcagcccgggaaggcaagctcagctcctgccagccaggggcgcatcaggtgggtgtcctcccaggccatgatgggccctagcccagcccctaccctgggcctcaccaggcacttgttgtcctgccggtggatgctgacacagtgctctttcagcaccacgtgggtgatgtcccggaagtcacagaagtaggcccacagtggctcccgcggcctgtctgccggctggccgactgccttgtgagccttggccttcttcccaaacaggctggcttgggggttcctgccactgctgccactagaaccctgaacacccagcaagtggggcagaggatggagagggcaatgcccgtttatacctcctgcactttcccctggggagagactggagccagaagggccaggcaccaacctaggttgacctcccaagtcccagtgtcacaggtgggatggggacccaccccaaaatcatacacatgctggaagccggacccttagggaaggcagagagaagaatcctgaccccctcacacccaggtgccagtccccagatgaaggggttccctggaggtgcagaccccagaaataaggtccccagggggtaagcagatggaggaccttctccaagaaactggccctagcggacaggtgccccagagccatgtggggagagggctcaggtcagccaccctcagaggctagggtcaaggatgaacacagaaacccaccccagcccaacctgaacccccagggcggaaggggcgccttgctcacctcctccttgttcacctcctcctctactggccaccactggatgccaccagtgcctgtcaccagcacctcgtgggttgggggcccagcagcagactcagggccagggtctgtaggggccaccccactgtcccggatgtagcagggctccccctcggcctgggccagcagcctcaggtggcacacgggcacacgctctgtgccgaagcggggtgccagccgctcgagtgtggctaggtatttgaccatgaccatctgctgggagagtcggcccggctggaagtcccgcaggaacctgcggaagacgttccgaaggcgcagccgggtcagggcgctgtgctgccggatatgccggcggaaggagcgcgggatgcagtccttgaagctggggggaaacacagtgaggggctggtcagggacctgggttgcaggcccagctgggtgacacagggcaagtggcttaacctctttgagcctcagctgcctcatctggaaaacaggcacactagccaggtgtggtgacttgagcctgtagtctcagctacttgggaagccaaggcggaaggatcgcttgaggtcaggagttcgagaccagcctggccaacatgatgaaactcagtctgtctctactaaaaatacaaaaattagctgggcttgatggtgggcacctgtaatcccagctactcaggaggctgaggaaggagaatctcttgaacctgggacgcagaggttgcagtgagccaagattgcgccactgtactccagcctaggtgacagagagagactccggctcagaaaaaaaaaaaagtagaggcacggcaatatgcaaagtctaccctggctcccagatgctcaggacatttccccctgcctacacagcgtccccaccccattcccagacacctggtcttcttggccacctcctccagggggatgccatggcggagagcgaggtgacagaggtgcagaaaggccatgcccaggctctcattcttaaagtggtggatctcctcctcggtcgacagctcccacagtgatgccacgtcattcacaaactcatgcttgccctgggaacaggaaattgagcagaaagggaggtgtgagaatgcgttcctctctagcccagaggtatccaatcttctggctaccctggaccacactggaagaagtgtcttgggccctacataaaatacactaacactaatgatagctgatgagctaaaaaaaaaaaaaaaaaaagaatatcgcaagccgggcatggtggctcacgcctataatcccagcactttgggaggccaaggcgggcgggtcacctgaggtcaggagtttgagaccagcctgaccaacatggagaaaactcgcctatactaaaaatacaaaattagccaggtgtggtggcgcatgtctgtaatcccagctactccggaggctgaggcaggagaatcacttgaacctgggaggcagaggttgcagtgagctgagatcatgacattgcactccagcctgagcaacaagaatgaaactctgtctcaaaaaaaaaaaaaaatcacagcaaaatctcagaatattttaagatagtttatgaatttgtgttgggcttcattcaaagctgtcctgggcagcatgcagtccgcaggccaggggttggacaagcttactctagccagagaactctaatttcctgcgtcttaccaccttgaggaggggagagaccaccatttactggaaaggccaaatacacagcatacacccctcctcttgtcaatcttgtgcctgtggcagacattactaatcaatcacagcactctatccccttcaacctgaactcttggctgggcatggtggctcacacctataatcccacaatttaggaggctgaggcaggtgaatcacttgaggtcaggagtttgagaccagcctggccaacatggtgaaaccccgtctttactaaaaatagaaaaattagcctggggtggtggcgggcttctgtaatctcagttacttgggaggctgaggtggaagaatcgcttcaacctgggaggtggaagttgcagtgagctgagatcacgccactgcactccagcctgggccacagagcaagactccatttcaaaaaaaaaagatcggctgggagcggtggctcacgcctgtaatcccagcactttgggaggccgaggcgggcagatcacgaggtcaggagatggagaccatcctagctaacactgtgaaaccccgtctccactaaaaatacaaaaaattagctgggcatggtggcgggcgcctgtagtcccagctacttgggaggctgaggcaggaaaatgacgggaacctgggaggcggagcttgcagtgagccgagatcacatcactgcacttcagcctgggcgacagagcaagactccgtctcaaaaaaaaaaaaaagatccccagatagcatgagttgaaacctattagctatattgaatcagggagggaaatgggggctcctcaactgcccctaagtctcccacaaatagtcttgccaccccagccctgctcatacctgctcaaagaggtactcaaatgaggctgggtccaggagttgcatcccctgtgctgtctgatctgaggatgcctcggttcctgggggcccacaacggtacacagccggttcccgaggattcatgccatgccagttccggaaataaaacctgcaggaaggagggacgcagctggggcttagcacagagtcagaccagcttcagcacaggaggggacgagctttgcaaaggtctccacccaccttatgcggaaatatagcatcaggcttgcatctctggggatctctaggatgtggtttgggggcaaccagacttgggcctgagcatcgaagagggcaaagagattgaagcaaggaggagtgatacctggatcaggtgagaaacgaggtcaggagtcacgtcatttgctaccgtcagccccaaagaccccccagacccaatgtctgccttcacactccctctgaggccccctcccccacctgcagcttcagtctcacgttgcccctgggcagaggacagtgcgtatgttgcccatgctgtggcctcacaggaggactacatttcccagcctcccttgcagctaggatggagccaattgcactgctggtttctggccaaagggctgggtacatttccaagcctggaaataaattctcttgccaccttcaccacccgaggtatgatgaaggcttcttgtgacagatggtgaagctgtaagacagaggtgaaccatccaacctgtacttgattttaagtaaaactttttttttttttttgagatggagtcttgctgttgcccaggctggagagcagtgacacgatcttggctcgctgcaacttccgcctcctgggttcaagtgattctcctgtctcagcctcctgagttgctgggattacaggtgtgcgccaccaaccccggctagtttttgtatttttagaagagacgaggtttcgccatgttggccaggctggtctcaaactcctgacctcaggtgatctgcccaccttggccccccaaagtgctgagattacaggcatgagccactgtgctcggccgattttaggtaaaccttgattaagatttggggggattgcttattcctgcagcaaaactaatcctagcctgacccacataactctacaaactgctgcaattgtctggcgtctccctgaactccagccccaaagaaacatccagtcacctcctggctgtctccccctggacatcacaggcccccccttagatatggcttgttccaaacaacatatcttatctgtggttggcaaactccaaccttcccttcctctgcccttttttttttaagggtcagggtctttctttgccacccaggttgcagtgcagtggtgcaatcctagctcactgcagcctcaacctccagggctcaagcgatcctcccacctcaatctctggagttgatgggattatggctatgagccagggtgtgtggcttctgcccagttcttcaaaccaggaacttggtccttatcttcaacctctcccacctgctccaaaacagatcggtcaccaagacctgctcttcctgcaccctccatgtcctggggctccatccaccaccttcaaatgcaaacctcaaccccaatccagtctccagacttgctgtaatttcccacaccagctacccagggtatctttcttctactgatgtcatttaaaaattgtacctgtcggccgggcgcagtggctcacgcctataatcccagcactttgggaggctgaggtgggcagaccacgaggtcaggagatcaagaccatcttggctaacatggtgaaaccccgtctctactaaaaaatacaaaaaattagccaggcatggtggcggatgcctgtagtcccagctacttgggaggctgaggcaagagaatggtgtgaattcaggaggtggaacttgcagtgagccgagattgcgccactgcactccagcctgggcgacagagcgagactctgtctcaaacaacacaacaaaacaaaacaaagaatcagccatggccaggctcgagggtgcacacttgtaatcccaacactttgggagtctgaggcaggtggatcacttgaggtcaggagttcgagaccagcgtggccagcatggtgaaatcccatctctattaaaaaaaaaaatagctggacctggtggcatgtgcctgtaattccagctacttgggaggctgaggcaggaggactgcttgaacccgggaggcggaggttgcagtgagccaagatcgtgccactgagctccagcctgggcggcagagtgagatctgaaaaaaaaaaattggctggccatggtggggtgcacctttagtcccagctactccggaggttgacgcaggacaatcgcttgaacccgggaggtggagggtgcagtgagccgagattgtgccactgcactccagcctggcgacacagcaagactgtctcaaaaaaaaaaaaaaaaatggtatctggctgggtgcagtggcccatgcctatagtcccagcactttcggaagctgaggcaggtgaagcacttgagggcaggagtttgagaccagcctggccaccagagcaaaacctcgtctctactaaaaatacaaaaattagctgggtgtgggggtgagcacctgtaatcgcagctactcagcaggctgaggcaagagaattgcttgaacctggaggcagaggttgcagtgagccgagatcacgccactgcgctccagcctgggtgaaagagtgaggctctgtctaaaaaaataataataaaatgaaataaataattttatctaaagctgggtatggtggctcacatctgtaatcccagcactttgggaggctaaggcgggagaatcacttgaacctaggagttcaagaccagcctaagcaacatagtgagacccctcatctctaaaaaaactaaaaataaaataaattagccaggtgtggctggagtgcagtggtgtgatcatggctcactgcaccctcgacttactgggctaaagcaatcctcctgcctcagcctcccaaggagctgggactacaggcgcacgccaccatgcccagctgatttttgtagtttttgtagagaaggggtctcaccatgttgtccaggctggtctcaaactcctaggctcaagtgatcctcccacctcagcctcctgagtagctgggaggctgagctactcagcctccaaagtgctgggattacaggcataagccagtgtgctctgccctgaagtagtgtttataattttcatatcctctacaatctagccttaaatgttatgaactgtggctgggcacagtggctcacgcctgtaatcccagcactttgggaggctgagggaggcggatcacctgaggtcgggagttcgagaccagcctgaccaaaatggagaaaccccgtctctactaaaaatacaaaattagctgggcgtggtggcgcatgcctgtaatcccagctactcgggaggctgaggcaggagaattgaacctgggaggtggaggttgcggtgagctgagatcgtgctattgcactccaacctgggcaacaggagcgaaactctgtctcaaaaaaaaaaaagttatgaactgtaaatgtgtggtattatactgcagacgtccctctgcaatgtgctttttcaggctacgagaggttataaagcttcatgcagaatgacatgagtaattctggttaaattccttctcccggctgcgcagtagtccagtattcaaccagattgcaatttacttaggcagtctcttattgagggactttgcaatggtctccccttttccatatgataaacaaggcggctctaaacattctcataagtgtccctgggagcacatgagctgactgtttatagagtgactgtcactgtccaggagtggaactatatggcctcagggaagatgtttctgagtttttgtttttttttttgagacggagtctcgatctgtcgcccaggctggagtgtggtggctcaatctccgctcactgcaagctctgcctcctgggttcacgccattctcctgcctcagcctcccgagtagctgggactacaggcgcccgccaccatgcccagctaatttttttgtatttttttagtagagacggggtttcaccgtgttagccaggacggtcgcaatctcctgacctcatgattcgcccacctcagcctcccaaagtgctgggattacaggcgtgagccacggcgcccggcctgggtttttttttttttttgaagcaggatcttgctctgacatataggctggaatacagtggtgcaatcatggctcagtgcagccatgacctccctggctcaagcagtcctcctgcctcagtctcctgagtagctgggaaatacaggaacacgccaccacacacagctatatatatatatatatatatatatatttttttttttttttttttttttgagacagcatcttgctctgtcacctaggctgaagggcagtggcatgatcactgtagcttcaacctcccgggctcaagtgatcctcccacctcagcctcctgagtagctgggactacaggtgcacaccagcacacagcacacctggctaattttttgtatttttagtagagacggggtttcgcgatgttgcccaggctgatcttgaactcctgggctcaagtgatcctccacgcttagcctccaaaactgctgggattgcaggcgtgagccactgcatccagctttgactgtgttatcaaatcactctccaaagtcacaccatggaattatactgcccctctgtgaagggaggatacctccctgtgaaacaatatatattttttttagatggagtcacccagactggagtgcaatgttgcaatcttggttcaccgcaacttctgcctttcaggttcaagtcattctcctgtctcagcctcctgagtagctgggactacaggcatgtgccaccatgcccagctaattttttgtattttttttttttttggatagagtttttgctcttgttgcccaggctggagtgcagtggcgtgatctcggctcactgtaacctccaccccctgggttcaagcgattctcctgcctcagcctcctgagtagctgggattacaggcgcccgccaccacgcccggctaattttttgtattttcagtagagatggggtttcatcatgttgaccagactggtctccaactcctgacctcaagtgatccacccgccttggcctccctaagcgcaaggattacaagtgtgagctacggcacctggccaatgtttcatatttttgttttttgagaccgagtctctgtcacccaggctggagtgcagtggtgcgatctcggctcactgcaactccgcctcccaggtttaagtgattctcctgcctcagcctcccaagtagctgggatgtgcgtcaccacgcccagctaatttttatatttttagtagagacggggtttcaccatgttggccatgctggtctcaaactcctaacctcaagtgatctgcccgcctcagcctcccaaagtgctgggattacaggcgtgacccactgtgcctggcttgagacaacttcttaaagaaccagtcaaaaataaaaaataaaaataaaagaactagtcagactgcttcactctctggcttaaaccttccatggctccccattgctcccggagaatgcccaaccccttgacccttgattctgagtacccccaccctggcttttgcctgctatgccccaatttcaattgttacttccccttccaaactctcaaaattgataccccagtcaccctgaaggtctttcgcttcctcaaacagatcaagctctccgggcctccatgcatgctgttccctctgctgagcgtgtttcacatcacccgcacacctgtctgaatcctttaataatcagtcatgggggcgggcacagtggctcacacctgtaatcccagcactttgggaggctgaggtgggcggatcacgaggtcaggagatcgagaccatcctggctagcacagtgaaaccctgtctctactaaaaatacaaaaaattagccaggcgtggtggtgggtgcctatagtcccagctcctcgggaggctgaggcaggagaatggcgtgaacccggaaggcggagcttgcagtgagctgagatcgcgccactgcactccagcctgggcgacagagcgagactctgtctcaaacaacacaacaaaacaaaacaaagaatcagccatggccaggctcgagggtgcacacttgtaatcccaacactttgggagtctgaggcaggtggatcacttgaggtcaggagttcgagaccagcctggccaacatggtgaaacccccgtctctactgaaaatacaaaaattagccaggtgtggtggtgggcgcctgtaatcccagctactcaggaggctgaggcaggagaatcacttgaacccgggaggcggaggttgcagtgagccgagatcacaccactgcactccagcctgggtgacagagcgagactccgtctcaaaaaaaaaaaaaaaaaaaaaagccgggcacggtggctcacacctgtcatcccagcactttgagaggccgaggcagggggaacagcatgcatgttcaagaccagcctgaccaacatggtgaaaccccgtctctactaaaaatacaaaaattagctgggcgtggtggcaggcgcctgtaatcccagctactcaggaggctgaggcaggaggatcgctagaacccgggaggcggaggttgcagtgagccaagattgtgccattgcactccagctttgaggactgagcgagacttcgtttcaaaaaaaaaaaaaaaatcagtcatggccaggcgcgatggctcatgcctcccaacactttgggaagccaaggcgggtggatggcttgagcccaggagtttgagaccagcatgaggcaacatgcaaaaaatacaaaaattatccgggtgtggtgacatgtgcctgtagccccagctatttgggagactgaggcaggaaaatcacttgagcctgggcagttagaggctgcaatgcgtcatgattgcaccactgcatttcagcctgggcaagagagagactgtctctacgaaagaaaaaaaaaaaaagactcagccatcaatggggaagtaggaagtgttataaaaattgattacaatgcccccatccagtcatggaaagctgggaatgggggaggtaagaggagtttctggaggaaggtatatgtaaccaaagccgccttagaaaggcctttccttggttgggcatggtggctcacgcctgtaatcccagcactttgggaggctgaggcaggtggatcacttgaggtcagaagttcgagaccagcctggccaacatggcaaaactccagctctactaaaaatataaaaactagccgggcgtggggtgtgcacctgtaattccagctactcaggcggctgaggcaggagaatggcttgaacctgggacatggaggttgcagtgagctgaggtcacaccactgcactccagcctgggtgacagagtgagaccctatgtcattaaaaaaagaaaattgggccgggcatggtggctcacacctgtaatcccagcactttggagggccgaggcgggcagatcacgaggtcaggagatcaagaccatcctggctaacacggtgaaaccccacctctactaaaaatacaaaaaaaaaaaaaaaatctagccgggcatggtggcacacacctgtagtcccagctactcgggaggctgaggccggagaatcgcttgaacccgggaggcggaggttgcagttagctgagattgcgccattgcacttcagcctgggacagagcgagactccatctcaaaaaaaagaaaaaaagaaagactgtagtagatatatttggaagtgcaatttcctgtgcaggaggagggaaagcctttctttcttttttttttttttttttctttgagatggagtttcgctcttgttgcccaggctggagtacaatggcacgatctcagctcactgcagcctccacctcccaagttcaagcaattctcctgcctcagcctcctgagtagctaggattgcaggcacctgccaccatgcctggctacattttgtatttttagtagagatgcggtttcactacattggccaggctggtcttgaactcctgatctcaggtgatctgcccgcctcagcctctgaaagtgttgggattacaggcatgagccaccgcacctggcctttttttatttttgaaacggagtctagctctgtcacccagcctggagtgcagtgctgtgatctcggctcactgcaacctccatgtcccaggttcaagctattctcctgcctcagccttctgagtagctgggattgcaggcacctgccaccatgcctggctacattttgtatttttagtagagatgcggtttcactacattggccaggctggtcttgaactcctgatctcaggtgatctgcccgcctcagcctctgaaagtgttgggattacaggcatgagccaccgcacctggcctttttttatttttgaaacggagtctagctctgtcacccagcctggagtgcagtgctgtgatctcggctcactgcaacctccatgtcccaggttcaagctattctcctgcctcagcctcctgagtagctggaattacaggtgcgcaccccacgcccggctagtttttgtatttttagtagagctggagttttgccatgttggccaggctgctctcaaacttctgacctcaagtgatccaccagcctcagcctcccaaagtgctgggattacaggcatgagccaccgcgcccggcctgactttctttttttaatgacactgggtctcactctgtcacccaggctggagtgcagtgacgaaaccatacctcattgcaggcttgaactcctgggctcaagcgatcctcttgcctcaggctctcaagttgctgggactacaggcatgtaccaccatgcctggctaatttctaaaaattattttgttgagacaaggtctccctatgttgcccaggctggtctccaactactggcctcaagcaatcctcctgcctgggcctcctcaagtactgggattacaagtgtcagctactgcacctggccaagttttctgatttattatatttcttgctgtcctccctactaaaatttcagctctacaaaggcagtgatttgcagctgccacacagtagatgcttacaaaatgttcaccgaatgaacgggtggatggatggatggatggatggatggatggatggatggatggatggatagatggatgaataggtgggtgggtgggtggatggatggatggatggatggatggatggatggatggatagatggatgaatgggtgggaggatggatgggtgggtggatggatggatgcatggataggtgggtgagtgggtgagtgggtgggtggatggatggatggatggatgggtgggtgggtggatggatgggtgggtgggtggatggatggatggatgaatggatggatgggtggatggatgggtggatgggtgggtggatggatgggtggatggatgaatgggtgggtatggatggatcgatgggtggatggatggatagatggatgaatgggtgggtggatggatgggtggatgggtgggtgggtggataggtgggtggatgggtgggtgagtaggtggatggataggtggataggtgggtggatggatgagtgggtgggtggatgtatggatggatgcgtgggtggatggatgggtgggtgggtgggtggatggatgcgtgggtggatggatgggtgggtgggtgggtggatgaatgggtggatgggtggatgggtgaaagggtgggtggatgggtgaatgggtgggtgaatgggtgggtggatgggtggatgggaggatggatggatgcatgggtggatggatgggtgggtgggtggatggatgggtggttgggagggtggatgggtgggtggatgggtggatggatggatggatggatgagtgggtggatgggtgggtggatgggtgggtgggtggatagacggatggatggggcccagctgctgcttgcacacccaccccagtccccatggtgccaacgccccagactcaccaactttatgtgcaatgtggatgcagacttcctcagctgtcagcgatgactcactgaaagtgacccagggctccccgccgcctggaccagcccagtgcagaagcaccttcaggcctcccatggcagccatgggctgggctccatccccaacgggcttactgcccctggccatcccccagtggcgcagaggcatgctcccggcaggtggctcagctggaaaggggacaatctgtcagctcccaagtctcagcccagagacccctgttagctcttcaaccttccacccaccccagctaaggcctgaggggaagattctgggctcccatcttggcatgacattagagacccgattccctctctgagtctcgttttccacatttattggacagggttggggtatgcatccccacctagatctctcatcaacaataacactgaaccctcctctctttccacaaattgacacagatataaaaatctgctctggccaggtacagtggctcacgcctctaatcccaggactttgggatgttgaggcaagaggattgcttgagcccaggagctcgagaccagcctaggccatatagcaagaccctgtttctacaagacgttttattttatatcttatcttatcttatcttatcttatcttatcttatcttatcttatttttgagacagagtttcactcttgttgcccaggctggagtgcaatggtacaatcttgctcaccacaacctctgcctcctgggtttaagtgattctcctgcctcagcctcctgagtagctggcgcctgccaccacaccgggctaatttttgtatttttagtagagacagggttttgccatgttggccaggctggtcttgaacctctgacctcaggtgatccacccgcctcggcctcccaaagtgctgggattacaggcgtgagccactgtgcccggcctctacaagaaatttttaaaatttagccaggcgtgggggtgcacatctgtactccaagctactcgggaggctgaagtgggaggatctcctgagcccaggagttggaggctgcagtgagcagtgatcgcaccactgcattccagcctgggtgacagagtgagaccctgactctaaaaatataaataaataaataaataaataagtaataaaaatatataaaaagggccaggcgcggtggctcatgactgtaatcccagcactttgggaggccaaggcggacagatcacgaggtctggagattgagaccatcttgaccaacatggtgaaaccccatctctactaaaatacaataaataaataaataaataaataaataaataaataaaaagtaaaataaaaatctgctcttaacacacctccccaaaataaccagacaggcagatgtggtcaaacatacctgagggtgagtcctggagctccctgtgtcaactcaagcaagccacttagcaattctgggcctcagtttccccatctggaaaagggaggtcctcagggtgttgccatcaaaagatggttgtaatgtttcaatatagttccgcatattacacattcagcacagaccctgattcaggcacacacaaaaagaacaaatatgaccaaaacaagaataacataattgttattagtttcatcgtggtgatggcctctttcaggccacaattctcctctcccacatttacccccatgagtgacctcagtccctgttgactccccaaagcctaggagagtttatgtccagctccatccccccaatccagggcctgagcctcctgagggcgccagtatggaagtggaggggctgtcacttccacccatgttgctggtttcctcatctggaaaatgggcatgtaacagtgtctacctcaaaaggctgctgggaggatttaacgcgaggaggcagagaaagtgcctggtatacagtaagcgcttaattagcctttgccattaatacctattcatgttatagatgagatcccggggatggggctttcgcggagcctacttcctccttcctcctttctcgtccccactggacccagacccagctttgaagacagggtcggagtgaagtttgcaactgggaaggctgcacgcccccatgtcctccccccaaaacctctaaacccggccggcaacggcgggaactgggatgtgcacccaccgggcatcggagcagtcccgaggcaccaggtgctcccatccaagtgcagcctgtcaagcgcagccagtccccgcggcttcttcctgaggacctccggccgcgctccttccgcgcccgcgtccagactcacccttccgggggaacacaagctcgaacccggacccctccccgctcccgcgggtagctactgctt

SEQ ID NO: 2137 - DNA, 5922 bp, Homo sapiens
  source 1..5922: mol_type = genomic DNA
gaacagaaaaggaaaaagtttattgaaaactatatacagttggtccagctcctaccatgggctgcaatctcagccagtccctcccacaccttaggcagtgtcttggcccctcatggggagggatggggctaggcctagggcccagactcccttgggtggcttggcagctggagcccaccgtggatctttgtaaatttacaactctaaatggcctgaaggtagtgggcaggggacagggaatggatccctgcctgatctagtcacagccttgataggggaacactattctgaaacttgggcccaagtagggcccagctaagttgtccggaagtcctgactgctcctctcacaggccttcctagacgtggaggcaaacagcctccctacgaccccaccccatgtagcaggccgcatgggcttcatgggcttgactggggacaccaggtacccttcctcccaacattgactcagggtccggagctcctggagaactccccaagcagaggacttggggttgaggggtgagcgttggggaggtcacagctcccagcccagaactggagcctcctggggtcagggcagccgtggggtcagggtgtcccgctgtaggaatagtctgctttattgtgcatcaccagccggtcatccacgaagtagaagctgtcagactgggtctcatacgggtggcggatcatctcgctgactgcaagagaggcccagccaggccgggcaaaggtcaggagcttgagtcccgccactgcaggggcttcaggactggggtacagggacagccaaacagcctgaaatatccccagcctctttctctacggatgatatgggaatggtggcagacacagaagagccccagggtggggagaaatgggatcagacccacaagtccctctccctcccgcagctcagtctctagacgcccccacttccccactcccagaagaccctgcccgcgcactcagctcctcggagagaggggggaagtcgtaaatgtgctcgcaggtgttcttgctgctggggatgcagaagccaaagtggaagtcgaagcttttgagtagctggttgcggaagtagtgcctctcgatcatgcggaagttgttgacaggcttgtctcccactgtgaactccaccctgagcaagaaaaggaggcagggctaagtctgtccttgaagtcaactagccagccaggctcaggacaggccacccctacgagaggctgagaagggcccactcacaccctctccctcacccccaccaccacccatagcccagcgactcacgtggctcccacctgcctcaggcggaggaaggcaggcgtgaactggtagcggacaaagcgcccagcattggggtccaggtcccgccggttgatgggcaaccgttctgcaatgtaccccagctggggctcagtgggcttcaggctgggcccttgtccacccagggttctacccttgggtccccatctatctgattttttttaaactccccaagaaattccggggcacactgagggctcagaccattggccaaatagtgccacctaggggttctaggtctgcatgttcccaatcgccactgtgcttccccgggccacaggatgctgaggcctgggacccgtaggactgcagttcccagagagccctgcagagggcaggttggcagggaccgaaggggtagggctgacctcgcaagatgtccagcctcagaaacatatgggaaggaaaagaaagggcccccctgcctgcagactcctgagaatgctggggtccaagccccagctctgtggactcctctgtggcccaaggattccctgggcagcccactccgcagctcctatctgcctccccatcaatggcccacccagcccactcacctgagactgggggcttcttgatttcaaagaggacagtgcctgagtccatgtcccgaatcttaaacctgacaaagtcgatcttgtagatattctcctcaggggagcagaggtagtctaggggaaacaggcagctgagcaaggaaggggccgcaaagcccctgctgccaggtcagcttgtgtgggaccccagagtagctaccatcttctcatccctgggatcactgccctctggaaagagggacctcagtccctgcccttggggtacacccccagtgtggaagagacataactccgccatggggatctaacaggggataaggagtgccatcctactggtctctgggggccagggaagggcagggcagagaagggtagaggacaaggccacctcctgaacactctctctcccactctggagttgagggtcctcattctggcctccgctctgccaaggctggctagatgactttgggagaattaggtatccagcctggtgggagcctctcttctcatatgggaacaacttcctgcagtctgacctgtctcttctactgcaactcagtgtatcaacttctctggtaccctgcctttgagaaccacctgtaaagggggccacacagctctgtcttgggagagtcactgtccttctctggaggatactcctaccctcaccccacagctgcccctggcatgacatctagatgtatcaggtgaggctgatgttaaggggactttccctgatatgggtggggctggggcaggtgaacaaccccttccctattcctcctctcctccaaaccccctcctctcagtaagaagcttacaccagcccagctcccttaagcagcttaaccaaagctctgctgactcaagcccagagcctgggatatggcaggtgggaggaggccaactttgctctcatcctttgttgatctccaaatgggaggaagtcttagcaagcagagagaacccccttagaggtcatttacgcagccctggctatgagccaccaccatggagaaagtagtcctggacccccatagagaagaacacaggctaggccaggaggagggtgtggcaggtgcagcagtgggtgtggaaggggtaaggggagtcctcaggcccaggaagggaaccaagaacagtgggaggccctgcctgaggaagctcagggagctacagggcctgatctaaccctcacagctcttgcagcagcaacttcaagtgctcagggaggccctggcaacaaaaagagctgagaggtgcagggagggactcgtgctgtcagcctgcacagcatcacatcctcccctggtggcccacagaggcctggaaatcaccctccaggcccctgggccacctcctattcctctggggcaggaacaggaagtgaatataaagtcattttctcttccccaggtctgcttcttccccaagcctgacgctgtcccctccaggaagccctcctggcagccatctggtaccctggggcccagcatggactttatacagcttggggaagaggcagggccctgagtctactacagcccacatgtggggtggggagagaatggaagtgggcaacccctatctcaccccattcaccctattttcacagaaagtaagcaccagtataaagacatagaaagaaggtacagagcatagggaacggaggtggcagagtggggagcaggatcccagtgcccaactcccagatccctgtaaggccttctcttctcccattctccaacttttggagcctctctcatttgggaacaacttcctgcagtctaacctcagtctcttctactgcaaactcaatctatcaacctctctgtccttagaagaagtgaggaacacggatatctatggctcagaacaccacggccactccttctcttctagaaaggatgaggcctgggacccagggtcaggtcagaataaggggcagagtggccaagggctcagaacacaactgctctattcctctcagccacaaatagcttcctaagctggattcagggcccagtaatctgggaacagcaaacctcagacctgcatgattagggtcagaagagaccaggcaaggggtgccagggtggaaatccctggaactctgttctcaattcctgcacaggaaggggttctcatgaagccctttcctctacttacccttcacagatgccccatctctaagggctatgaatttcctccaaattaggagacaaatggtggtacatgagctggaagctccctctagttgcaaaataaacccccaaagttactcaggactcagtcagtctgagaaagttctgccccagagctaagctgaatcctaaatgctgctattgcaaattgtagcccaactggcttcaacatcagcctggtccagcctccctctctccattgatgcctgcttgggcaagggagctcagtactctgggggcccagctaagaatggctgctgcctagctcagtaaggagagaggaattggcccccagggacccaggagcacaggctcaaggctgtctcccctccacagctctgtctgggagtccggtgttctgctgctttggaagctctagggctcaggtccactccaatacatgccccccatacccacagagaggccccccccaacagttattctcacaaagggggccagggcaggttgctggtgaatgtggccaaggtggagagccactgtctctccatgcacctttcatcctttgaggctcatccaaagcctctgctatgaggtttcctagccctcgttccctgcctatgatgaccccctcccctgccctgaaagccaagttgtttgactccaggcagcagctatgagcagccctgtagggcccaaaaatactactgatcaaagagcccaatgtacacagcatgcatagatgccaggcactgtacagaatcagaggacttatcttcacaataatcttacgagaaaggtatcattatccccattttacagatgaaaagacatgctcagagaggtgaggttacttgcccaaggtcacacagacaattatatggcagagttggaactccaacccaggcagtccagctcagaaactcttaaccacagtggagaccaagcctcccttgatgacagagcccccagaagaggacaggtgctagtccaggcttggagggacattatgccactccccatgagaggaaccacagccaacacactaaagctgcctgctcagtttctttcccggggaagaaaatggcccaagtcttcctggaggatcagggtgagggtattaatggttggggagacatgaagagtctgaatgcctcccaagtaactcagcctccacctagcctccagcgtgggggctgaggacaggctgcactcagcccctctcttcattagtgcagggacgggcctcaaagcgctctggagactccacagctacagggctatggttgcagctgctgccgcacgtacctccacgctgggaaaaggggacgggcccctggaaaaggaaggaataaatctcgaaagggagaagaaggaggcacagagagagatcaagggaagggggtacacagagatctcagacctggcggcagaagggagagcaggggacacaggagaggggactcggtgggggaggggaggcgggaaagggggcgggggccagggcttggcgcgccgggagggcccctcgcaccctctccccttcccacccgcgggcggcgctccctcgcgggtgctcaccaccggtgatccgctgcagccccagcacgtcctccggcccgatcggctgcttcctctgcagcggccccggcctgggccctgggcctgcgtccggctccgactcggacccagattcggattccgcaggcggctgtggtatgggggccacgctctggcccgagggccccggagcggactccgtcgccgtcccggccccaccgccgcccttcttcaccttcatggccttgcggggccgaggctcgcctgctgctgccgccgctgcctgcgccggctggagccgggggaagtggg

SEQ ID NO: 2138 - DNA, 5922 bp, Homo sapiens; identical to SEQ ID NO: 2137
  source 1..5922: mol_type = genomic DNA

SEQ ID NO: 2139 - DNA, 17492 bp, Homo sapiens
  source 1..17492: mol_type = genomic DNA
tttaagaggacaatggatttgtttttattaatttttttgctaagaaagtttctaggtggcaggtgctgtccggggagggggcgtgcgcagcagacacagcagccaaactgtcctttctgcttccgtctgtctgtgccagccctgccgcctgccagctcttgctccctcagagccagaaggttcttggctccaggcttcctggcctggatgctggcagcccctggggagaggacccaggccccctctagtaatggccaccaccctccccccagggcagctggagcctcatctttggcagggtcccctctcccttttccaggagactctgtgcctgtagccctggtcccagtgaacctggcccccaccccagtggctggaacaggaaggccaggaggcagatgggccagggccaggagacagatggcccaatcccctgcccaccacagcagcttttctgagaggcgggcaggggcagggtttgctccccctggtgctgggatgtggtagagacattgcagccagggctggaggcagggaggcgggagtagagatgtcgctgctgagcccccatcaccatgggaggcaggggaggtctgcactctgggcactccgcatgctggggctccccaagtgttaggccaggctggagggccgcgatgtggcggggaagccccagaccctacaggaaagcccttgcaagtccccaccggggacccagccccaccgcaaacctctacggctacggtgccggccgcaaggcatgctgggaggcctgcttggcccggtgccgccgcagcctcacaaagacctgggcttctcggtcacccttccggccctccagcagctgcaggattgggtcccctgcggagagaggggtttgggggtcagatgccaggggagagggcagtgcctggtggtggcagagaagagtgtgtgggggggtacacaacactgctccatctccccaacaacctggaaggaaacaagtgacagacccgcgccagcccagcccaggaggtggtctgacagacgcatccggtcgggtcgcgtaacagacagagtgctgctgggacactgtcctgactgcagcgaggggctgagatgtgcctgaggtttgactattacctttttatacgagaacctaaagctagcaagttaaccttttcatgcctcggtttactcatctgtaaaagagtgctaatatctgcttcgttggctggaatgcataaagtgcttagcacttgctcataataagtgcacaagcatcagaccgttgctggtatcaaaaatgctctgcagggaagcggccccgccgagtgagatccaggcccttctccccagttaaacttcttggtgacttccccatgcaaggagagtcacgttacacttagcttaaagttcactggtctcttgattagaccgagagatgggccgtggctgtcccactggctcccgtctccagggaagctgttctccgaccctggcatcacctctctggggcccctgcctgagctttacaggctcccgtccccgcaccaccctgccctgggctcaggcctaccgttgggtgcggggtacgtgaggggcaggcgggtctgaggcacctcaccaggctcctcagagccactcagcccgggcacctcacgcagcggcaggaaggcctcgccttccaggtcgtcggcccccagcgtgtcgtagtccagcacggtgagcaggaggcatgccccagccttgcggcacggctcagcaggcaccaggctgcggggagagtcagggctctgctgccagccccagcacagccaccccagcctcggcacatgggttcacccacttggtgttgggaaccagccagggtttggactgcaaagccagctctcagcctggcacctctcagccatgtggtgcaatgcctgctctgaccgtgggctgatgctttaaaccagcggtcctgtgttccctgttcacctgtgctgaggaactaggagcaggttactgagaacctcagagacaggacccttccctggaagtccctaagttaaacacctgggagtccaccccttcccccaagggaagcaaacttttttttctgagacggagtcttgctctgtcacctaggctggagtgcagtggcgccatcttggctcactacaacctccgcctcccgggttcaagtggttctcctgcctcagcctcccgagtagctgggactgcaggcgtgtcccaccacacccagctaattttttgtttttagtagagacggggtttcaccatgttagccaggatggtcttgatctcctgacctcgtgatccgcccgccttggcctcccaaagtgctgagattacaggcatgagccaccacgcctggccctctttttttttttttttttttttgagatggagtctcactctgtcgcccaggctggagtgcagtggcaccatctcagcagcctctgcctcctgggttaagcaattctcctgcctcagcctcccgagtagctgagagtacaggtacccaccatcatgcccggctaattttgtatttttagtagagactgttggccaggctggtcttgaactcctgacctcaagtgatccgcctgcctcggcctcccaaagtgctgtgatgacaggtgtgagccaccacatccagctgcaaactcttgtcccagatgccccatcccttgggcccaaatgtggccatctcaggggagccccttggccccagccaggaggagcaggcctgagggagcccagtggggagagatgaggggagggactgggagaagaacgggacccactcacaattcaaaggtctcatcaaacaatgggtgaaggtccttcttgtgcttctgggtctcccgggcggccagctcagggaactcatgcctgggctccaaggtcagctggacaaaggggtcgctggagcctggtaagtggccggggagtgtgcgtcagctgagggtctcccaggcaccccaccccagcagctatgctctgctcagcggcactgacccctcctggtaactggaggaaatgcacccagagctcctgcagggtgagcgaagcccccagggtcgctgagacaggagggccaggacgggaccatggagagtggccaaaggcagcctccactcaccattggagtccaggggcagcaggctggaggcgctgagcagctccacacgcagcttctgctcagaggcgcggtaggaggccttgactgtcacagcccccagctcctcagaggtggtttctgcctggggtggggagcaggggcagggtcagcagggtcacagcgggagcggggtgctccagggcctgcagagggcgcagtgcgagggaggggcctcacctgctgctggattcggctgcagaagtacttccggatgagttcccggctggaggccgcctgcagctccaggtccctctgcagagcctgggaacacatacagctgaggatccacctggactgcacgcccaaccacagcccaggcctgccctccaggagctcactgtcaagggtaacatgtccgtttgaaatggaaagtattgggtcatgggacaacgggctggggccaccctcaggccagacagacagcaggagaggcacagacagggctggcttcacaggcgtgcttccccgaccccaccccccatgcgggcacacagggcccctgtgcttaggaggacccaggcttggtttcaggttctgtcgtcaccgttctaaaatttgtaataacttttgaataaggggcccagtttttcattttgtactgggccccataaattatgtagccgaccctggacataggtgagtgccaaaaggcaggctccccagacttcctacggggaagctcacccaaagcccctacctggaaggtggcagtgtgcagggccttgggtggcaggccacagccctcagcgtggaagcagatctccaggttctgggggagatatcagaggtgaccccaggcaccctcccaccagggttatcattgctgtgaccggttctgttacctgcagggcaatcttcagcctgttggaagccagggatgagctgcgctgggaggcggccgcctccaccagcactgtgagtgtgtgggtccagagcagggtcaggaggctggggcggggccggagggatgcggacacagcacggcagggcggtggcggaggaggaagcaaagacgctcttgagaaaggggcggcctcagtgacccagccccaccccagctcctcccacccccaacctccccctccgcctcccaccccaggtgaggctggggagagggtgggtacaggaccagcaaggggcaggtgggatcagtcctatccaacacacctctcaacctcagtgaggaaccctccccagcacactaacggaatgcacaaacaaggctggagacagggaggaggccaggcccccagtgacaaccatgatttaagacagaaccaggccgggcgtggtggctcacgcctgtaatcccagcactttgggaggtcgaggtgggtggatcaggaggtcaagagattgagaccatcctggccaacatggtgaaaccccgtctctactaaaaatacaaaaattagccaggcattgtggcacgtgcctgtagtcccagctacttgggaggctgaggcaggagaatcgcttgaacccaggaggcggaggttgcagtgagccaagattgcaccactgcactctggcctggcaacagagcaagactccatctcaaaaaaacaattagccaggcataatggcatgcacctgtagtcccagttactcagcaggctgaggcagggaatcacttgaacccggaggcggaggttgcagtgagctgagatcgcgccactgcactccagcctgggcgacagagcgagactccgtctcaaaaaaataaaaaatatatatacatggtttaagaaataaaaacggccgggctccgaggggccctggcttatacctctgggggtggaacagaactctaggagggctgcggcctcttcagggcccagattccacagggaggtggggcgctgtcatcatcatcgtcactaccgctaatagtcactgaccacttcctttgtactgacaccacgctcagcacctcacatgacccatttaatcctcaacagaagccagaactactctcatctgcaccgggaacttgcccaaggctgctaagcagtgatgaagccggagtctgaacccaggtggtccagagcccatgtgctggactccaccgcctgttgcctggcatgctgggtccctgctataagacaccctagctagaagttctccctgcaccgtgggcagggaccacctgtaacctaatgggggcagaggagcaggcagggaggccctgaagacaggcctgggactaaaggagaaaggacaggtagattttggctcagcctaaggaagaactcaaagcactcagagctaggcagcaggaaatggggaggcctgagaagtggcaagctccccgtccctgcagcgagccttagcagagcctgttgcacccataagggaggtcaccaaagggattcacctccacccctcagaacggatgctgaggcccaggaaagaggggccgtgggaggagagggggaggtggcgagcgcgcccagggcaggggctgctacacccctcagaacggatgctggggcccaggaaggaggggccgtgggaggagagggggaggtggcgagcgcgcccagggcaggggctgctacagacctgctgaagttctcctgcaccaagttggtgttcatgtagcaaagctccacctccaggaacttcatcaggggcagaatggcctggggagggagatggggagcaggtgtggctccggcccatgttggccccacccccatccccttcccctgacctggagggaggaaacagggctgggaaccgttctgtgagagcagtttgtagtgtctgtaagaggccggcctgcccacctctctgccttcccctctccgttgctcagcctgtcccagccacactggcctcctctacagccctggaaccttccaggcatggtcctgcctcagggtctctgcccttgccgttccctctgcctggaatgctcctcccctagaacttctcatgcctcctccccttgcttcccgtaggtcttcgctcagttgtcacggccttccctggccaccatctaaaaatacaaccctctgacacttctcagccgcttctctgttttaaattttctctgtagacttatcattatctagcacactgcatgtgtgtgcacgcgcatacacgcctgtgcatagagttaacagctataactatcactatagttatggatactcactatgtagctcttttttcacctccactactagaacgtgggctccaggaaagcaggtattttgtcatattgttcactgacctatccccagtgcttaaatcaatgcataggacaaagtggggacctaataaatagttggtgaatgaatgaatatccttctacccgccagtcgaaggtgtgcatcatgatatgcccccacttacaggtcagctggcttgtgtgaacaggacggcaaagctaggaggcagctgagaaggatgtgcaccctggcctgtttggctgcaaagtctaagccgtccccaactgcagccccctcattgactgtcagtgctgggacagccagtggagtgacccaacccgttcctgtgagcatcccaggaggaaactgaggcccagggagagaacatgctttgcctggtctgggggacttatctttgacaccaaggccttcaatgaccccagatctacagagctggcagggtggtgaaggccagcaggcagaagggccacttacatcctcaggcaggacagactccctgacgcccaccagtttctggatgtgcttggcgatgcccacctccaactggagacacaaaacggaagaaggagggaggtcagggcatgagtcggggatggaagagttccttagggcctgagtttagacgcacgaaggggtcagggttggaccttggcccaggtgctgctggagccaggtaggctgaagacgggatgggatggggtgactgtgcggtcggacaaggtacctgctcggccagggtgcggacgccagtgcggatctcatggcccagcccggccagcgcgctctgcagctgggcatgcagcgtgttctgcagctgcccctgctccagcacggcccctacccgctgctccagggcctcccatgccagctgggcgggcaacttgccgatcaccagccgcagctgctccatgtcattcaccaccacacacagctgggacagagatgcagagcttcctgaactgtgcccaggctggtccccacacccagctagactcccagccccagctctggccttaccatgttggctgcctggccttggtccttctggcctgaagagagctcgcgggcccgggcctttataaggctgcagtacaccagggccaggcgacaggtgtcctagggtggggttggacagagggaactgatccatgggtggggcatccaggaagggcaggtgggagggcatgggaatttcagcgacttgggggatttagaatacaggccttgggaggctgcctgggtgagagcacgggagaaacggtgggtggtagtgtggctgttctagaaagagggggaaggacacgtggaagatgccgcacctccacaaacttgacggtaatcatgaaggcctcctctgggtctggccagtccagctgccgggcagtgtggctgatctgggcaaagcaggtggatagatccaccgctgatgtgctgtgcttggtcagttcacccaggggcaccagctgggggaagaaaggaggactcaggatactgccaaatccacccccttccctccttccttcattcatagagcagctaccatcaccaggcacagagctgggcagggagcttcacaagagacaagcacggctccgcccagacccccaggctgcaggatctcaggcaaagtgaagccacagccccaaggatatccagaggcagcgttttgcacaaaactggactcaagtgcacccaaaagggatgttcagagcgggttactggcttttactacgctttggaggtccaggcagaacccaagcctcacccccaaaccggggccccgccccctgccctggccacgcccccacctcatccatctgcacagcgcgctgcacccgcgccagggcctcgttgtacgtcttctgcagccaggaggggatggccggctggaaccagcggtggaaattatccagggccaggactccatccctggggattgccggggctcagcgtcgggaaggctggggccaccatggaccctggggcctcgtccaccctcccctcccctgtgcccctgcagccgcccacaattggcctgctgcccacctctctgaggagctcatgcgcagctggcagagctccttgaggctgatgtagagctggaacagactctcgcccatctctggggacactacatcacccacaaccgtcgtgtggtcctgcacccgcttggccacctgcaaaggaaaggtgtggagggcggggcccacagctctgttggagggcatgccctagagacgggggagggactcaccagccactgcagctcccggaaagccatggagaagaggtggatcttgagggtactggaggaaaggcagcaggtgtcacccagtggcatacaccagggtccccatggttccggctctgaggcaatgccccactacctcccgacctggctatctgctcacttgtggaagatcttgtcccatgtgcgctggcactggtgcaggtcgccaatgacatcctgtaccaggcccagcaaggccttgcctgcctccgggatgccctgcagagacagaggtgggctgggcagggctgccagaggcaggcaccaccccccgtgaccccctgccctcccccttgcccagcccctcacctgcaccatgggttgatggtgctgctgcttcaggtggaaccattcagtggtgccagtctgtcgacaaagaggcagtgagcagggagggactgccaggcccaggcgctggtctcccccatccccagcgcgagtaccatacctgcagggcctcagtcaccagctggggcaatggggcggtgttggggcacagttctccaaaggccttcatcttgcacatctgtaccaggaccctgcaagatggaaagagctgtgtcgaaagtgcctgctgccccacactgcactcactcctccaacaattctcccactcctgcaggcaccccagctgctccctcatccctgaccccaccgaggaagaggaaggcagccactgacctgagaagagactgcagccgggctggggagtccgagacagagagggggaagacagagcggaacctccggatgagggagaggccgtaggtcagcagggagctgaatgaggcggccagctcctcctgctgaagagccaggagatgctttaggggcctagacagctgctgctgctcccctgccccttccctgagccctgcctgctcagtgccccttgccactgcatgcctacctgttctgccttgagccgaccctggatccactggtactcgatgctggtgatggggtgcaggaggcagctgctggggaactccaggctctggtagaggcggctgtaggccagccactgcctgcaggggacaggaagccctcagctggacagggaggaggaaattgccttcccctgttcacccggcctcaggtggggggaatcgcctcccatccaccagtacaggctgaaaactagtggctcaacaggacatgcaggattgtttttgttttgtgtttttttttttgagatgtagtctcactccgtcacccaggctggagtgcagtggcgtgatctcggctcactgcaacctgcgcctcctgggttcaagcgattctccagcctcagcctcccaagtagctgggactacaggcatgtaccaccatgcccagctaaattttttatttttagtagagatggggtttcaccatgttggccaggctggtctcgaacacctgacctcaagtgatccacccgcctcggcctcccaaagttctgggattacagacatgagtcactgtgaccagccaggattttttttctttgtttccatagatgcttttcaaattgcccagattgagatctttgtgattttaaaacttcaggatttcttgctgtttttgaaaaattggattagctgggcacagtggctcacacctgtaatcccaggacttttggaggccgaggcgggtggatcacctgaggtcaggagtttgagaccagcctggccaacatagtgaaaccccatctctaccaaaaatacaaaatttagccaggtgtgatggcaggcacctgtagtcccagctacttgggaggctgagacaagagaatcacttgaacctgggaggcagaagttgcagtgagctgagattgtgccatggcactccagcctgggcgacaagagggaaactccagctcaaaaaaaaaaaagaaaagaaaagaaaaataggatctatgaacctgagccttcgtgcacatgtggcaagcatcagtgagaacttcctttcagatggtttggggggatatcacacaaacgaggtcccgtgggagggcagaggatgggggagaggagcagcctggggacaggccgaagtccctattggacactgcagccacctgcattactgtgcttgggccctgcaggcaaaccaggtccctccccatctggtgcctgctccagtctccagccgcaccaccattccacccttgtctccgaatcacccacctgcctgaggtcctagcagtacacaagctgaccccagcccagaaatgcactcccctgggctccctccgcctcccactcagactccaagtcacagcccaggcctgagtcggcatcctgctcctgttcctcccctggccagcacttggctgtgtcccatctctttttttttttttttgagacagagcctcgctgtgtcgcccaggctggagtgcagtggtgtgatctcaggtcactgcaacctccacctcccgggttcaagtgattctcgtgcctcaccctcccgagtagctgggattacagacatgcgcccccacacctgactaatttttctatattttgtagagacaggatttcaccatgttggccaggctggtctcaaactcctgacttcaagtgatctgcctgtctcggcctcccaaagtgctgggattccaggcgcgagccaccgtgcccggccggctatgtcccatctctgccctactcacatgcactggaatggctgtgaccccctgtgccctccccggcattcctaggacttgacgtgagttgccctcaacatagatttgtccttatcagcgcgtagttttgctgagttgaaggctatggcattgggaagcggggctggggttagggaccgggtccaaattcaaatgcccaggactcaggagacgaaagcaactgaagtgggcccaatggcagccatgatgggcagaggcacacacatcgctccgctctgtccactcaaaaaagcagcaaaggctgggcgcggtggcacgcgcctataatcccagcactttgggaggccaaggcgggcggatcatgaggtcaggagatcgagaccatcctggctaacacggtgaaaccccatctctactaaaaatacaaaaaattagccgggcgcggtggctggcgcctgtagtcccagctactcgggaggctgaggcaggagaatggcgtgaacccaggaggcggagcctgcagtgagccaagatcgtgccactgcactccggcctgggcgaaagagcaagactctgtctcaaaaaaaaaaagcagcaaaatggctcggtgcagtggctcatgcctataatctcagcactttgagaggccaaggcaggcagatcacctgaggtcgggagttggagaccagcttgaccaacatggagaaaccccgtctctactaaaaatacaaagttagctgggcgtggtggcgcatgcctgtaatcccagctactcgggaggctgaggcaggagaatcacttgaacctggaaggcagaggttgcatgcagtgagtcaagattgcaccattccactccagcctgggcaacaagggtgaaactccgtttcaaaaaaaaaaaaaaaaagcagcaaaatgatgaccctgcagttccagcacttgtgtttcatgagaagctggagatctggatggtatgtcaaatctccagatagctttttctaatattttttggaaatgaggtctcactctgtgatccgggcaggagtgttggtgtgatcatagctcactgcagccttgaaatcctgggctcaagtgatcctcctgcctcagcctcccaaagtcctgggattacaggagtgagccaccgcatcagccgaatctctagactttttaaaattggcaactgattcaaaacttaaaacacacattttgggccaaagggaactctgctgagaattacactttgggctaccggcttggaggagggcagggggcgtggggggctggtggctcaggggttctgcccagggctgtgtactcacgccatggactggtggaagtcggataggtccttctgtgtggcgtgcagaaagaggacggtggcagcctggggactcagcgacccgtcccaggaggtgcttcccgcctgaggggagcaggtggaggagtgtcaggacctgaagggcagccccggctgcgcccagccccaggagggcaatacctcgtgctgggtgacctcgtgggacacaagctgctgcaggaggtggaggtgcacggtgtagctcggctgcgagcggctggccgaagtggctctctgcaatgaggcctctgtgagcagacagggcctcacactgggtgcagccagccccgcaacccagcagaccgccgcaagagctgggcatggccactggcccagtacccgacctacccgcttatggatgagttggaactggaggtggcactggcctcggtctgggtaggtctcagtgcggggttccagggggtaccactggtcctctcggcagcgcaggtcctgacaggcggggatgcccagcccgtgagcgtcagaacctcatagagtcggggcagcggaggcgacaggaggtggaccccaggctcagctttgtgaggacacagagcctctccccagaacccctcccaaccccctccctctgcctcgctcctgggcccctttcctcatcctcctcacctgcagcctcagaaccacgttccccagaaagtcgtcctggcctttgtccttccgggcctctttaaagatcctgcgtcaggcagggtcccataagggggacgcagcaagggtcggaagggattaggctggaatccacccccggccgcagccacctggaccccaaaggagcctgcaccccagcatccagtgtgcatgttgggggatggagggcaaaaggagccccaaccccttccctgtgagccctgcaacacgaacctgcgaagcccatgcagatccgtgagctccccaagcttctgtcggacagactccacagtgtccaggtccctggcaggacagaggtttgagaaggaagcagagagagtgcctacgacctcttccaggaggaggttccgcctctctcaccccagatcccttcccttcccatccctaggggcaggccaggtcactcaccacatgtccagatgaaagctcgcattggtgatgtcctcaaactccctgtatggagaaaagggcgtggttgagggccctggagggtggatgcccccagacgaagcagtaagtgaccacagcccagagccatggagttgtagcctatccctgccaaacttccctcctcccagccgcatccctttttttttttttttttttttttttgagatggagtctagttctgtcccccaggctggaggagtgcagtggcaggatctaactcactgcaacctctgcctcctgggttcaagcaattttcctgcctcagccttccaagtagctgggattacaggtgcccgccaccacacctggctaatttttgtatttttagtagagacggggtttcactgtgttggccacactggtcttgagcttctgacctcgtgatccgcccgcctaggcctcccaaagtgctgggattacaagcgtgagccaccgcgcccagcctttttttttttttttttgagacagagtctcactctgtcacccaggctggagtgcagtggcgtgatctcggctcactgcaacctccgcctcccgggttcaagtgattctcctgcctcagcctcttaagtagctgggattacaggcatgcacctccacgcccggctaatttttgtacttttaggagaggtgggccttcattgtgttggccaggctggtctcaaactcctgacctcaggtgatccacctgcctcggcctcccaaaagtgctgggattacaggcatgagtccctgcgcctggcccccactaatttttttttttttttttgagacagagtgtcgctctgtcaccaggctggagtgcagtggtgctatctcggctcactgcaacctccgcctcccaggttcaagcgattcccctgcctcagccttccgagtagctgggactacaggcgcctgccaccacgcccggctaattttttgtattttagtagagacggggtttcaccgtgttagccaggatggtctcaatctcctgacctcatgatctgccctcctcagcctcccaaaatgctgggattataggcgtgagccaccacgcccggccttttttgtatttttagtagagatggggttttgccatgttggccaggctggtctcagtctcctggcctcccaaagtgctgggattacaggtgggaaccactgcacccatccctgcctcctttcaggtacagcttcaggcacccccagactcacccacaagggcctgaccctccttgccccatcagcacgtgtggcattgatcttgttctgtcccatctgacctactgtccacctaacgtgcctggagatgggcttctcctctagtctttgcccagggccaaaccccctcccctgagccaggacgacctactcatctcattgtctggggcagaccctgctacccaggaaagacctggatagagtgggggctggagcacggccacgtacaggatgaaggtctcgtcccagacggggttgagtgtctgggtgatgacctgcgtgcggtgggtctcctcctcggggatggtgtgcctcaccacagccttctgccgatgccgggacccggggctgccccctggcacacctaccccctgctcaatgcccagcaggcagtaggggtcgctgaaccctgtggaggagtggggaagacgaggcagccagggagtcggctgggtccctgggagaggccctcatcacccccgcccggggctgagcctcctccgggggagagggaaggggaccagcagcatggggggccagcgctacagggcttcttggaagtgggtgctcccgccaagagtcctgggccaggctgtgatgggagaggaaggagccaggaagaagccccttggggaccccaccccatgctcaccactgacatctttgcccagaatgcccttggcctgtttcactgttgccttcagacaaaatattggcttctggagggacaggagggatggcctgagtccctgagggggctgggcttcccaggcccctccttgcccagggggaccctggccccaggttacctcaagctccctgacccgctgcagtgtctgctggtgctcctcgggctccacgtggaaggcctggtggggaggcaggcgggtgggtggctgggggcaccagacagggcagctgcaggaaggggggtggggtgggagccgggctcacctcctgcaggtatcgcagcagctcagaggcctccgtcacatggttgggctcaggatgacccaggcggtgcaagacagtgtagagtgcgtcctcgtagagcagggcccgctaagacacacggggtcaccttggggaccccaccagccacccctggcaccaacacctctcgccatgggcaggacaagggcggcttgtgcagcggagggagttgagacccaggagtcccctccccaccgcaagttgcttgctgccatcagcgtcggccggcaggaggacacacagccgccctccccacctctctgcaccccagcactctgactcttacctgctcgggggagaagtggtgggatggaggctggatctgcagagcaaggtggaaaggcagtgtcccgggaggcccagagcaggctcagatggacaggaatggctcctctgaggcctgatccaggccaagggtatgggggccccagcaccccggcctccagccccagtgatgccccgcacctgttcccccagcaggcctcctggaggtccgtccctgggcccgccgtggctgaggtccatgggtgcccagcagcgcgagccctccgcacccgcaccccacctccctcccttccccagaggaaacagctctgcttatcagtggcggctgctcctcacccagcagcggaagtgaggctcggcagcggaggtgaggggggtgccacgtcggcctgggggtctgctgctccccgaacagctcaccccacagcagggacacccccacctaatggagtcggctcttctgaagctggaggagtaggggatggggtcaggccaaccgggagggaggggttctgagagcctcagaccacagggcctgaggcccacagtggcccagagtccatctggcagcccctgctctgctggcccagggggctctccccagggtggagtaggcaggggagggtcgctggtccccagtcccagccttcgagaggtggggccagacagcagggcacccgtacccgagaccacagtgctccccaaggccagctctctccccagtgaggtcactcctacctccggggccatttggggcgggggatcctgtagatctctgactctgcggcgccttatcttgatggcctggcgcaagaagggagggcgctgctgcggatgggagaggagtgtcgccatggtggccttctctgcccttccctgtccgctggtgctgggtgaagacagcgaagccacaggattatgcaaagagcctggggctgccaccctctgtcaggggaagttttagggagggtggctgggagggacggaagggtgagggtttcaccgcttcggagaggcagtctcccaggccccctgcaccttccccagctgggatccctacaggaccctcctctggctggagcagaaggtggaccccgtgggcaggcctggccccgccccaccctcctacagaggccctgggaaggggacaacgctctcagcagggggcgggggggcccagaacaggcgggcagcatcctgccccatccatgtgctgtgcccaggctgggctgaac

SEQ ID NO: 2140 - DNA, 13019 bp, Homo sapiens
  source 1..13019: mol_type = genomic DNA
gacagtacaaaatctctttattgctcattttctgtaaaaaatcgtggctctcggcggaccctggggataggaggtgcaaagtgcgctcacacgcggcccgggtccgcggccgagagctgtggggatctggagcgggccgggtcgcaagaagaccctgaccgtgctccggcgctggggcgcgtgctaagggcccgcggggtttcagctgtattttcgaacccctgtgcttggccgaggggttcccaaggctccactccgccttggagggggctgcggaagcccggaggtgacctgggctctgggaggggcgtccccaacgtgggggaggggagacaggggcctttgaagacagcgcgggactcggagggggtccccccgacctcagacgtggtaaactgaggccggcgaggagggaggctgagtccggggaccaggcggcccctcactgctcctccggcccgtctcccccctgcgcctgttcgtacgggcagggccggcggccgagtccagcgggctcggggccaggcctgggccctgcgggcggcgcctcctcctccgcgccgtccccatgctcgccctccgcgtcgctctcgtccgagttgtcctcctccaagtagcggtaaccgcgcaccttgtgctggggccgcgggatgcggggctggcgcggggccacgccccggcgcagcttctgctccatccgcaggtaggagaccgcggccgccaccagcgtcaccagcagcaccgccagcttagcctgggcgtaaggagagggatgccagggacccgcggccgcctcgccccgcaccttccccgcctatgcccctcgctgagataggcccttccctcctccgggagcctcccgggccacgcggccctcaacttctccagcccctccacccatgcttcctggaccgcctcctgcaggcgaggctcacatccagcactgtcccttacagtcgccacgcccctggcgacctcagtgtcccacactgtaaggggacaatgcaaatccctttgcctcatagggtgcatgcgccagtgttgataaagtgctggccacaggccctgccttcccagggctcacaacactgtgtccctgacacacccgtgggctgtagtgatgcttttcatggggttttgactataacccgcagtcaggaatgatttcacaccatagcccagtacatacacacatatctgtatgcatacttcctgctcttttcttttttccagacacggtcgctccgtttccccaccgcgccccctccctcccttcccccacccactgctggagcgcagtggcacgctcacttcagcctcaatcttccaggctcaagccatcctcccacttcagtctcccaagtagctggaactacaggcacacgccactacgcccagctattttttaaattttttgtagagacagggtctcctatgttgcccaggctggtcttgaactcctggcctcaagcaatcctcctgcctcagcctcccaaagtgttgggattacaggcgtgagccaccatgcccagcccactcactgcttttcttttttttttttccttttttttttttttggaagacagagtctcgctctgtcctccaggctgaagtgcggtggcgcgatcttggctcactgcaacctccatctcccaggttcaagccattcttgtgcctcagcctccagagtagctgggatcacagggacgtgccaccatgcccagctaatttttgtgtttttagtagagacagagtttcacagcctgttacccaggctggtctcgaactccagatctcagaacccccacctcagcgtctcaaaatgctgggattacaggcgtgagccactactgccagcccactccctgctatttttagttctatttttatttttattttgagacggagtttcgctcttgttgcttaggctggatggagtgccaacgccccgtctcggctaactgcaacctccgcctcccagttcaagtgattctcctgcctcagcctcctgagtagctgtgattacaggcacctgccaccacgcccggctaatttttgtatttttagtagagacgaggtttcaccatgtcggtcaggctggtctcaaactccctacctcaggcaatccactcgcctcggcctcccaaagtgctgggattacaggcgtgagccaccgcgcccggcctttagttctatttttaaaaaatgtttagcaactgggacttgctagaccgagccaccattttttgtgagcagagcatgaggagcctgctccccttcaggccatgaagagagacagacccaacatctggagaacaaggtaccaaacagcccacaggatggctgtgatgcacccacaaatcccctcagagatgggcaaactgagactggctggaggtgggccagtaagtggggtgctgagttgggggccacccagtgggctgcaggaatggggccttggcccagagactggcttgggaaggggtggcatttaggaagctgtgaagccagggcaggggctaaggaagtacctgtcattgggcatggggcccccaaccctgcccagtctcaccttcatgtgcaggctcgagcccaggtacacggtgaagatggccacagcctgccaccagtggtagatggtgaagatgaagtcctgtctctccttgtcttcgtacaagattcccaggagtgctgcaggcaggcagtacagggcaggcaggggagaggtgtcacctggggcctggggctaccgagctaccatctacgaactttactaagccctgtatgggtcccagccccggaccagagagcgcctagaaagtgctgtgaggcggtcctggcctgccccctggtggagaccctggtcaccacactgctcacacgctaagcagaagtaggagcaggtgcctcgggctgtgtggatgcaggtgttcccgctccgcaccacatgcgtggcctcaaaagaagaaagctctgtgcttagtcatgtcctgtccccaacccaggtgtgcagtgccaagcttgcaggcgctgtttctcctcctcagccaggactagagagatcgaactgtttgcagctgccaactctgcaaatcaaacctgaagctaagcatggagaggggggattcctttccagtgagtcctcccagggtgggcaacaagagtaatggattgggagtcagaagatgcacgctcgttctcagggctgtaatgttggctctgtgggtgatttgggtacttaactccccagagctgcttttcccaatggtgagatgagcttatgcctattgtgtgctgtgttctgaagttctaaagtgagaaagtgggcatggcacctgccaaatcataggggccactattaacaccttcaccaggcactcaggatatgaacactcctgttttggggccctgcagggtgactttacccccacagtgctgctatgaagagacaaggaccccccggggttcaccggaggagatgggatatggagctgggcagaggggatgccaggaccagacagggcacaacatgggttcaagatacccaggctggactctgcccagaattggctatccttgggcaaaacggccaagagactgtggtgcagtatgaggctccagcccctgctacagacagagacacagagccagcctccgccctgccagcagcaggcatgacctcggctactccacacccccaaggatgacgttcaaaactgttcacagcttcggcccatcagaacagacactgacatggatgcccggcaggactgcccatgtgtgctagctgtgtttcactgcgtgtgcccatctgtggtcagggagcatcctggagctgaacatgggcccacccgctgccttctgcaaacagggccctgttccccagcagcccagacctggggcctggactctggtactgagcagactgggttggggctgcaggcctgctcctctctatacaaaggcccatgtctgtatctatgccatgggtgtacaacaggccacttgctcctaccacatgctccgtgaagcagagaccaaaacatctgctccaagtgtcatgaaaactatgccagggtaagccctgtcccctggtatgaaaagggagaatccctgatgtgtttttcacactgtccctaaggggtgtccacagagccccacacctgccccatgtagccacgagacttcacactgaccctccagtgttgatggggccctgtgcccgctctggggtattaacagaatgtccatggcatggaacccccatacctgtctccagggtgtccacaccctacccatctgtccccagtgtgtccataagacttcccttccacccccggagtgtccacaggaagccccacctgcctctgccatgtccacaggaccctatgtgaccatgggaccccatatctgtccctgggatgtctatgtctcgccaaccacccacagatagccataaagccccctgccccgcccccccccccccagtgcccacagctatactcactgctgagtccagtcttgttcagggcactgcccacaccccaaagggcagctgccacatagaggatccagctgtgttgcaggacccgaggcacaggggcccagaaaaagaggatgaaggtgagcagcaggtgcacccctgctccggccaccaggggcaccgggcgtggcagccacaggcccagcaggcccaggagtgaggcggctgaggcgcccaggctgtaagccacgaggaggtaagccagccgctccagccccaccgagcacacgccatagccctgcggggggacaaggggtgagtgttgaagtctggaacagcccagaccacagtctcagccctccccgcatcgcgggggtgcctcacccccctgcgatgggggtcctaagagccaggggggaagagggtctggctcttactccccgcatcgtggggggtgcctcacccccctgcgatgggggtcctaagagtcggggggaaaagaggggttggctcttactccccgcatcgcgggggggtgccttacccccctgcgatgggggtcctaagagccagggtggggagaggggccccccgcgatacggggagtaagagccaggtggggagaagggctggctcttactccccacaagaggtgttccttaggccacaccctgccctccctggactgcctgacctcgctccaaggctcaggggaaggttctgagggcaggtgtgaaaatgcttggaatgtccctagacaccgtgggctgtaccccacaaggaactaaacactctgtgggtgctatcccatttcgattcagagaagttaaaataacttgcccaaggtaaaggggggacgggggtaagagagggaagagaaagcaggagggggatatttgggatatacatgtacacacttacatatgtaattaaaaattattctttgtttacttgaattcaaatttacctggctatcttgtcttttgtcgggcaatcctttgcaggctgtacttaccaaggcgataccagtgcaggcaaagagcacctcgaagccgctgtagataaagaaaggcacgaggtggcgcaggcggtagtcacgcacgtgcttgaagggcagctggaagatgttgccccagcccacgctgcgcagatcgatctcctccgtgggccggtaagcggctccgcacaaacccagcacctgcgaacccattacttgaaggggcggccagccaggcccaggcctggcctccaggcttcagccccgcccttcagatgcaccacgtgcctgggccttgccccagctcggccccgcctcccaaaccagggccccgcccctgagacactcccacagacccaggtcttgccttatcccagctcaaggccccgcctctcagcacaaagccacgccaccacactccgaaagacggtggtcttgcctcccagcccaaggccccatcccctctctctcacatacacacacttcacaactcacattcagacaaatccatagacttcaaccttccttctcagccccgcgccagacctcagccccgccttccaggctagtccccgcccctcggacacacccacagacttcggccccgcgtcccagcactaggccccgcctgacacagccacggactgggccttgcctcccagctccatcgccaggctgcagcatgccaacgccttagttctgccgtccagtatcacttccagtttgagccacaccttccagccctcacccttggtcctgtccccaaccccctcacaggtctcagtcagtcttctaagatcttgtctccagctcgaaactgtggaccaagcctgttccctccttcccctggcctctggatgcccacgcctgcctcggaccacaggcctcagccccgcctccgagcctcatgcccgctctgcagcactcggccctagctccccaactcagatcgcgctcccaggcctacggcctgccccgaggccacaacccgacccaggccatgccatccgatccagaccctttctcgcagactcggtccccagaaccacactctgcttcactgactgtcctgcccccatcccgggccgcaccagcagcatggccaggaagccactgccatgagcacgctctccaccacaatgaggtttccgctccgcgggagcgtccgcagaaccgtcttgttgaagccgctgaggatcccgtggctgttggtgcctgggaagggtgggggtgagggcaccgtgagcagagagtagggcacacagtcaatccagccaccagggtggagccacgcaggccgcggaggagcggtggagggcgggagagtgagagcaagggcagagttccttcagagagcagtttggaggtttggaccactggggctgggtttggaccactggggctgggtgttccccgggaaaggggcatctttcccctgcttcccaccctatttccccaaggctcagtggacctcacatttccatgcacaccccctgcactgattgagctctgactgtttgcctggccccaagaaagatcccactggcagcctcagcccagatggtgccttctccaggcagtcttccccgcccacccactctcctggctgggtcagatgtcctaactacttactcctacagggccctgtgtcttgcccaccagagccgtggggcactgggctgccagccctgaatcctgtgagtgagggcccagtgtctgctggggaagtaagcaggctttgtggactcctccccaacccccaacaaggactaaccgcagctctgcacattgtacagcgtgtggttcaggtcatacaggtagtggttcaggaaataaatcatgggcagctgggcgcaggcgaagctcagctgcagaaacaagggcagttgggaccagactcaggcacagagccaggcaagggacacaggcatggtctggggaggggtccaggcacagccttgggggaacaggggccttcccagttctgggagtagtgtggttacagggccgcccaatgaggaagacctcctcctggccagcattgtggaaaagggcagatgagatctctatctctatggatgagcaagctggggtgggctcaagaaaggaagatgggcagcctgggcaacatagtaagatcctatctctacaaaaaataaaaaattagctgggtgtggtagcacacgcatatgatgccagctactcagaaggctgaggtaggaggatcacttgagcccagcagttcaaggttgcagtgagctgtgactgcactactgcactccagcctgggcaacagtgcaagaccctgcccccaacccccaccaaaaaaaaaagaaagaaagaaaaagaaatgaaggtggggcagatacagtggtgtgcgcatgtagtcccagctacttgggaggccaaggtgggaggatcactggagcccaggagttcaaagccatctgggcaacatagtgagaccaggcctcttaaaaataacaataataaaagaaagaaagtgggactagagggttgagactgtggatgggctccaatgcgtgggtctgcccctgccacccaacaatggcccacgtggcactcacatggaagaagctgtagaagatggcttggaagaccaggagatagggcgcgtgggagccccgcggaggccgctgcttcatcccctgcccatcctgctccttgtagtgggagtactcatggtacttctgcgccatcctggaccacaaaggagagaaggctctccccagcccgacctgtgccactcctgtgtgtcctgcacccagagctaggagcagaccagccccggtgtggggaaactgaggcccagagggcggaaggggcttcctgtggtcccccagccaaagttggcaataaagtggaggcttggccaggtctccagcctcctgccctgctgcccaccaggctcacctggtgatgtagttgcccatggaagcccaaagaggcacgatggccatgcccagggccacagccgagggcacaagcgtgtagtagcgctcccagtagttggtggagacaaagagggcgtagatgcccacagcgaggaacatcatccacttcgttccaaaaaacctgcggacagtgggagagatgctggcaccacaggcctgctggaccactgtggcctgaagccaaacggggccacaaccgcaggtcccagctcacagggctttgtgaggtagagagagtcgagggcactgagatggaatatcagatacacagacttgctgagtggcctcaggcaagctactgtgcctcagttttcccagctgtaatatgggcacggagcccaaaccacaggcctctcatcaccactgtgaggatggagagtgacccatgggtgtaaccagccctcatgcgtgttctgggctctctgattctcccattcccccttctcctcccaagctcatgcactgtgtctgtagggcccaggggcttgactcaggctgggagaagagaaaggaagaggccccactgctgggagcagcagagccagagtcccggcacccctgcctccagtccattgcttttatgaaccatggtggtcagtcaggaagtttccacctctctgggtctgggaaaaggtcacacagtgacaatagaaggggcttggtgagtgacaggatgagggctcaaccacccatggaggctgatcaggccaaaaaccactactggtatcttcaagttttctgtatttatgctccttaagtaaaaatgccagtaaaaatgtgcattcactgctggtgaggatgtggtttgaaagtggcacatataggccaggcacagtggctcacatctgtaattccagcactttaggaggtggaggtgggcagatcacctgaggtcagaagtttgagaccagcctggccaacatggtgaaaccccacctctactaaaaatacaaaaattagccgggtgtggtggtgcacacctgtaatcccatctacttgggaggctgaggcaggagaatcgcttgaacccaggaggtggaggttgccgtgagctgagatcgcgtcaccgcactccagcctgggcaacagcaagattgctcaaaaaaaaagtggcacatatagccagtggtcacacacactggcataaccctttgggaaagcagcctggtagttttggcagggggtgaacatgtggatttgagtccctctactggggttcaagccttcagtctgccagttactgcctgtgggacctgggcaagttgtttaacaccatggtttcttcatgtctaagactggagcagcttcctcaaattattgggaatgaaattgcgcttataaagtgcccagcacggccgggcgtggtggctcgtgcctgtaatcccagcactttaggaggtggaggtgggcagatcacctgaggtcagaagtttgagaccagcctggccaacatggtgaaaccccgtctttactaaaaatacaaaaaattagctgagcgtggtggcgggcgcctgtaatcccagctactcaggaggctgaggcaggaaaatcgcttgaacctgggaggcagaggttggagtgagccgagattgtgccattgcactccagcctggtgatagagtgagactccatttcaaaaaaaaagtaaaaataaaaataaataaataaaatagagtgtcgggcagacaggagacaagagttcactgctattagtagaagtgataggtttcaaaagccataaagccttttgtatggcttggacctagtaaagacattgttgaaaatgtatcctaggaaaaataattgtttaaaaaattgggggagtgctggatgtggtggctcacacctgtaatcccaacactttgtggggctggggcgggtgaatttgagactggcctgagcaacatagcaactccccatcgctacaaatactttaaaaatcagccagatgtgatggcgtgcgcctgtaggcccagctactcgggaggctgaggtgggaggattgcttgagcccagtgtgtgggggttgaggaggcagtgagctgtgttcgtgccactgcactctaacctgggtgacagagtgagactctgtctcaaataataataataataaaataaataaacacataatttaaaaaaaaaaaacaaggaaacagatgtaagcacagaaggaactgcagtgtccaattccaagccactgttcagtgccaccgtatctgcagaagatgctaccattgcaaagtcgtaactgtgaaggctgtagagtaggctaagatatgctcagtgaaaagaaggaagcaagctctgggcactgtggctcatgcctgtaatcccagcactttgggaggccaaggcaggagaatcacttgaggtcaggagtttaagaccagcctggtcaacatagtgaaaccccatctctactaaaagtacaaaaattaaccgggtggcaggcgcctgtaatcccagctactcagggtgctgaagtaggagaatcgcttgagcctgggaggcagaggttgcagtgagccgagatcacaccactgcactgcagtctaggtgacagagcaagtatctgtctcaaaaaaaaaaaagtaagcaagcaaaagcaaacatagcccgcttgcatacacacacacacacacacacacacacacacacacacgggcacgtccacacacgtgctctggggacaaggatgtgaatgtaatccatgcatgctggtgggacagcatgggtagccgatttcctggagggcttagatggggtttcttttttatgatttcagttattctaatcctgcctgtgcaacgggagatgttttaaattttcaaatttttgtttaaatggagttttctcttgttgttttgtttgtttgtttgttttaaagatgagggagctcaaattcacctaatttgtccactggtctccaggtcccatcagggagggcactgtggaccggtgatggggaggctgaaccacatacctccagggctcagatctgggggagagctctggggcacctgcccagccatgcctgtctgtgagaaacaccccctcagcaccagtcacagcgactgggccaggcatgggtgcctggactttgctgaccgatcagaaacccctaactctacagccccaaccctgaaggccacagtggctctgggaggcctccaaggaggccacgaggagggtgccacgtgaggcccaggcaagctgggagggagctcagcccgtgtgaatctgttgctggaaaccaaatgtgccctgaggcaaagttcctgtttccttccccaaatccgagtttcacccccttcactctcaggcttccgggtagaaaaaaacctctcccttgttccctcgccccacaaacaccccggcagatggacacctcctggcccgccggcctctgtacccctccgaaatgggagtaccgcagcatcccacaggagcagccgcgcccacctgatgagcacaggtgtgtagagcagggcggcgatgggagtcacgttgatgcccatcagcattttgctgtcgatgtcgggcagccccatgttgccatacttcacctcgcggtaggtctcgtcgtagtgcaggatcagctgcatctgcaggaggcctggggacaggacagagagcggcgtgcagggagcagcctagctttgggcgccaccgagcagaagacggcatgcaggcctcgcagggagctccaatcaccgaaggcattcccgctgacagcgcccctcaggacagcggggttcccgggctgcgccacgccttctgccagcccgcggccacttggccagctaagcccagacccccacccgccttgctccgccggcctccaattctgacggtggcaggtctgtccgggagcccggacccccgtcccccacccacaccgaggctctggctgggacccggggacgctgcgctacttgaccccccaaccccacccccgccgcggggggccgtggctgcagctgcgagggcagcggaggggaagtgagagcgggcgggaggcggcggcccgcggtttctgtttcccgggccgggctgggagcgggcggggcggccccgggtccccgagcggcacctacccaggtagacgccgtaggtgagcatgcccccggcgctggcagccagcacgttcttgagcacgcccaggcgcttgcggcggtagtagcggcgctcctcctcctcctcgttgtagttggggtacgcgcccaccagctcgtccagctgcgagccacgcacgccgctcgcacccgcgatcgcgccccgaacccgtgtcccccggtgcccgccgccccccggcccgccccgcccccgccggggggaccctggcccacaggggacgcccgcgcctcgcactccgggtccccgctcaccggggcctcgggcccgtccgggaccccgagcaggtcctcgtcgccctgcggccccgcagcccccgccatcgggtagagcggcggctccgcctccatggcccgaactactgcggactcgcggcggtcgccccggagtccctgcgaccgcccggccacttcctcccggcggccgggac

SEQ ID NO: 2141 - DNA, 13400 bp, Homo sapiens
  source 1..13400: mol_type = genomic DNA
gccaattgctgaccgccacagccacagccagggctagcctcgccggttcccgggtggcgcgcgttcgctgcctcctcagctccaggatgatcggccagaagacgctctactcctttttctcccccagccccgccaggaagcgacacgcccccagccccgagccggccgtccaggggaccggcgtggctggggtgcctgaggaaagcggagatgcggcggtgaggcgcggcttgggccggggctagggggtgaagggggaggaaggcggtgggccccgcctgacggagggcgtgcaggatcgcgcctctgactcggtaaacccgggctccgctttccaaatagcctccacgtgttcaaaatagccgccgctgtcccccatgggccgccatgctaaagggccagccaatgggaacgcgtctcggggcccatggcgccaatccgcgcgccgcaggccctcctggctcggtgcgctgtccaatcagaggggagagggggcgggacccagagggaggttttttgccgcgaaaagaccacgtggggacgcggtggggcgggtctggcgggggcggggcacctctgtgcagggttcccagtcaccgcgacgctcctcgggaagccatagggcgcctcccagcccgtctccccgctccagtttagaacctaattcccaattcccggaccgggcccagccctgggctcttactgtccgcttttgctgggacctgttccacaaatgggcgtcttctgccttgggccgtgggggttgggccggaagctgcggacgcctgggaaggggccgctgcagctcttgagccgcctctgcggggaccacttgcaggccatcccagccaagaaggccccggctgggcaggaggagcctgggacgccgccctcctcgccgctgagtgccgagcagttggaccggatccagaggaacaaggccgcggccctgctcagactcgcggcccgcaacgtgcccgtgggctttggagagagctggaagaagcacctcagcggggagttcgggaaaccgtattttatcaaggtaaatatggaaatgcaccttccataagggtaaatgtggaggctgccggcccttttgtcttgttagtgtagccggccaagttcatgtttccgtaggcttaggttgtacccccttcaacctcctttactcacaaagggggtaaaagaaagccatgatgtttcactctgcagctttatattggttaaagttgttaacgacccgcgagatgatatcatggattcatttaagtcacatagtctattgtccaggaaaggctggcgtagtaaaatcaccaaccatcctgaatgaaacctggcttgagctttaaaaagccgagaggagtggcactgtcaggacccagcccagagaaagaggcaaggaattgacctgattgaaccacttaggtgggggggcaggcactgtttttgtttgttgttttttaaaagaatttggacataacatgacaaagaactaatgatgttccaaataacttgcactagaagctttcttattgaattcttatggtttccaatgagaatctgattttaagtctagtttatctttaaatcagctaatgggatttgttgcagaagaaagaaagcattacactgtttatccacccccacaccaagtcttcacctggacccagatgtgtgacataaaagatgtaagtacaacttgttgataatttttattggggagaaggagtcaaatagtatttttaaattagggacactggagttaagccacagtccatcattcagtagtaaataaaacactgaaatcccgaggtttggctgactgtatttcagcctgtatttactctttttaatgtttaccacgtggtatttatgtggcaaaaaggaaaactatgtacatcctgtgctcttatttcttgtattttttttaaatcctgaaactaacctcccgcggtgtcagatgttatggtggtggtgaagttcaaactgacacacaaagcagttaaatcttttgcagcttgttatagtcaaccccaccttgacctgaccacactgccttatagttagcactttcaagctcttgacttctggcctgaacagttttgtggttctgttatcagatccctttgctttagtttgtcttatataacagttgctggttggcggctctcatccatcttgtgttcagaagttcgtggggctgggcacggtggctcatgcctgtaatcccagcactttcggaggccaaagtgggaggatcatttgaggtcaggagttcaagaccaatgaaacctggtctctcctaaaatacaaaaattagccgggcatggtggcgcacgcctgtaattccagctacttgggaggctgaggtgggagaatcgcatgagcccaggaggcggaggttgcagtgagctgagatcacaccacttcactccagcgtgggcgacagagccagaccctgtctcaaaacaaaaaaaaaaccgtggcttctcactgttgaactatgaaagcagagcaaccctctttaaatagggccacgtcctacctctcagccttacctccacctcccactctcccactccagagttggacagtgtggcaaacccctccccacttctgtctcttaaaaatcaagtagatgcctctgtggcacctccttgaattgaagtccgttgcctgccacctctgtgatccagttttcctctgagctgctacgatgcatttagcacctgctgacactggacttttaggtttcttacccgttttcctcccccgttttgtaaactggggcaagaatcttgtgatttaatgaatatctgtgaaatgacatagaagtgaaataggtgaataaatcatcttgataaggcagccacacctaatacttagaaaatctcgtaagcttaattttagagtaagaatttagaatctagctctttggttttgaagctaaattaaatcctattaagatcaatactaatttgcttcttgtttgaatgccctattctgaataccagtaatcagtataaacagggaatattaaaaggaatattttgagggaatgctcaaaaaccagtttcaaacctatgaggatcagatgggccagcagggcttcttgacagaccagcattgggagagttgtttcacaagagaatatgttggcatggtgtgaacaccaaggggagggacaagaggtccccaaaagcctcctggtcatggaacatctggagctggattctgaaagatagagtatgtcagctgtggaggaagattctaagaacgcaatggcagaagcttgagaatgaagactaggtgggtgggccctggatgggaaggacgaggcggcctatgtttcaacacctcccgtgacaggaacttcatttcatttcattgtctcttgccacctactcccatggcccttttgatctgacctcattctcttctggctccacctgttagaggatataggggagcagacaccctcatatgctgctggtgggaaatctgaattgctttttttttttttttttttttttttttttgagatggagtgcagtggtgcaatctcggcttactgcaacctccaccccctgggttcaagcgattctcctgcctcagcctcccgagtagctgggactacaggtgtgcgccaccacacccagctaatttttgtatttttagtagagatggggtttcaccatgttggccagatggtttcgatatcttgacctcgtgatctgcctacctcggcctcccaaagtgctgggattacaggcgtgagccaccatgccaggccctaaattgctttaattcatcgaaaagtaactgggggctaggcacagtggctcatgcctgtaatcccagcattttgggaggccgaggagggaggatcccttgatctcaggaatttgagaccagcctcagcaacataagggaggccgtgtgtctacaaaaagtaaaaaaaaaattaggtgggcatagtggtgcactcctgtgggcccagctactctggaggctcaggtgggaggaccacttgagcccaggagggcgaggctgccatgagctgtgatggcaccactgcacatcagcctgagcaacacagcaaaaccgtgtctcaaaaaattaaaaaagcagctaggtacatatctttacaagtttaaaatacgcttagcctttgaccagcaactctgctattagcaatctatgccatagaagtgttttatttgttttgtttatgtttgtttgaggcagggtctgtgctgcttacattacagtattgtttaattcctgacccctggtggttcacaggtgaaggttgtcatcctgggacaggatccatatcatggacctaatcaagctcacgggctctgctttagtgttcaaaggcctgttccgcctccgcccaggtacagttgctttacaggtgactgcagtccagacatgattcctttcagatgtgtacttagcttattacaagtgggactatctggggcactgttcactagccttggaggaggatttctcggcctcagcaccattgacatttggggctgagtcattctttgttgtggaggaggagaggagtcctgtgctattgcaggatcttgtgccacatccctggcctctaccactggaaaccaggagcaacccccagctcgtgataatgaaaaatgtgcagacattgccaaaagtcccttgggggcgtaaaatcacccctggttaagaaccactgctttgggccgggcgcggtgactcacgcctgtaatcccagcactttgggaggctgaggcaggagaatcgctggatcccgggaggcggaggtggcagtgagccgagatcctgctactgcactctagcctgggtgacacagcaagactggaaaaaaaaaaaaaagaaccactgcttttggaggatttggtgtatgatatacataaatatgctaaggacagaaaactgtccctgagcaacagtgggggtctgggttgtaactgctgggttgatttacttaggttttccagagtgctgttaaatccaagtacagactaaagtaaaggtctttggcagagtcacctgttagaaggaggactggcagtgttgatctcattaatcggcgccatatgtgccagtgtcccttccaagggctggctgtaacttctaaccttttcacatatgtcttagacgttactgagctttcaaaattatgcttaagattctgttttttgtttttcttgtggcttgctttcagtttggagaacatttataaagagttgtctacagacatagaggattttgttcatcctggccatggagatttatctgggtgggccaagcaaggtaagccagcgactgctagattttttttttttttttttttttgagaccgagtctcactctgttgcccaggctagagtgcagtggtgcaatctcagcttactgcaacctctgcctcccaggttcaggcgattctcatgcctcagcctcctgagtagctgggaccacaggcatgagccaccatagctggctaattttttaatgtatttttagtagagacagggtttcaccatgttggccaggctggtctcgaactcctgacctcaggtgatccgcccgactcggcttcccaaagtgctgggattacaggcataagccaccacgcccagccccgactccattgttgatggtagtggctgctgccattatgccggctgcagcagggaagcacagcttgctacactggatcccatcaagcattggtttcatcatggatttagctcctgttgctgggtattgggctgatttgcctgagcctacatttaacctgtttctctcatgtgtataggtgttctccttctcaacgctgtcctcacggttcgtgcccatcaagccaactctcataaggagcgaggctgggagcagttcactgatgcagttgtgtcctggctaaatcagaactcgaatggccttgttttcttgctctggggctcttatgctcagaagaagggcagtgccattgatagggtatgttttgttttctttcttttttttcttttttttttaacactataaaaacaatgtaaagaattctaggagtccctgctgtgtttggtcctggaaaatccatgttataaaataacttttattttcccttaggcctgttataagggtttcccattgaaaactgagaagaatttggacaaattataggggtgatgagttgtgtatgaggaaagcaaagcaactggccaacttgtgactgaatgcagttggtgctgtaggcatgaacttggtgtctacaagatacaagtccctgggtaccattcacttaacaagtgatggatgaggcatgtttctggcttccaagaaatttgggaacatatagaaaacacaaagaattccactcaatcacaaatttaacttgcccatgaaaatactatcagtgatcattattgttttgtttctgggttttttgttttttgatggagtctcgctctgttgcccaggctgtagtgcagtggtatgattttggctcactgcaacctccgcctgctgggtttaagtgattctgcctcagcctcccgagtagctgggactacaggcgcccgccaccacacccggctgatttttttttattttttagtagagacagggtttcaccatgttggccaggctggttttgaactcctgacctcaagcgatctgtcctcctcaacctccaaagtgctaggattacaggcatgagccaccacacccggcctatcggtgatcattattaaccccaaggtctaattgcagatacccaacacgaccaaaccagtggctcccctccctacatcttccccctatctgctacctccctctttcccttcactcactgaagcacttctacacctggttgtggaaatcagagacctaaaagtcatccttgaatcctccatcccatcagtaaatcccatcaactctgcctcccaaaacaccccagtctactgcttctcattcgccactgctgcccttcaggcatgagtcaccatcatctttctccaggagaaccgtgatggactagagatggaggcttgatggagagccgcagagtggaggagggagagatagggggtgggaaggagacgagccaggggtgtgttcatccctggcaaatgggagagacattgggtgggggagaaattatagagtaaatgcttcaatgatcgaaggcaagggcttagcagaggtaacctgacaatagtttttggtgtatcagcaggaggtaacgggggtatcagaaatgtgcacgtatatttaacccctaccttgtgtgggtactaggttgagcacttttgttttttgagatggagtctttctgtcacccaggctggagtgcagtggcatgatctcggctcactgcaacttcgcctcctgggttcaagcacttctcctgcctcagcctcctgagtagctaggattacagttgcctgccaccacacccagctaatattttttatttttagtagagactgggtttcaccatgttgacaaggctggtcttgaactcctgacctcaagcgatcctcccatcttggtctcccaaagtgctaggattacagatgtaagccaccgcacccgaccaggttgagtactttgcatgcagaatcttacttaactctcagaaaggctttgaggtaggcatacacttgtatgagtgacctaagatctgactggtatgaactgctaagatgtgatcatctaggtatgtaagaagtgtgcgtgagagtaattgctaatctctatcccttagggaggtttacggccagtgttgctcttccgcagtatattggtaatctttaatcatggtttggtctgaaagtaaacagttgttaaagtagcttggtcattaaagccaaattgcatatctccagcccagtgtctcttctgatctatagagtgccttgttactactgccccatgaacatgccaaattcaacattttccaaacgaagtttctccttttctcatccatgcttcactaaacttcctcctctgcactccctagcagcaaaaagcaccatcatctgcccagttgtccagccagatctattactgacacctgcctacctctctttctcccctcttctgtcctttttttccaccttcccagtcagtcagtcattcatatctgtgttctttcttccccctccaaatctacccctgcctgaccacctttgccttcattcaggccctcacctgatcttgcctggagggttctgatgctttctccctggaaggccttgccttaggctgaagatctgatttcaggggggtagaggggtggcccccaatcggcctcccagacttaactctatccctctttgcactccgatccctaggctgacccattcccctttactttttcacggtgccccacttccctgcctttgcatatcctgctttctctgcctacagtgtagaggtcattttcttctgggattctttagagctctgcagggctgacatttacaggggcctgtgctgcttgcgtgtgtgttcagcatttggtgtgcatgacttcttatcacactcagcccctgtgatcctcatttgattggtcacagtaacttcataagctgggcggtattgttattcccagtctacagatgaaaactgaagcagcttagagttgcagcaacttctctgtggtacagctactgagggtagaggtaggcctcgaccccgggcagtctggctccaggctctgtactcttaaccacactggattgcctggctttagtcctcacccctcatcgcccctcctggactgagccccttgaaggcaagagtgttttgagaaacagtgatttgttcgttagtttttatatacagaaaagaagaggaaaacaaaaatggtctatatctccctgttaaaataactatagttgatattttaaaaaaatcaaagtagtcatttgccacataatgatgtttcagtcataaactgtatatatgacgatggtcccataagattataatattctggccgggtgtggtggctcatacctgttatcccagcactttgggtggccgaggcgagtggattgtctgagctcaggagtttgagaccagcctgggcaacatagtgaaaccctgtctctactaaaatacaaaaaattagccaggtgtggcggcgtgtgcctgtagtcccagctacttgggaggcagaggttgcagttagctgagatcatgccactgcactccagcctggcaacagagtgagactctatctcaaaaaaaaaacatatatatatatacacatatatatatacgtatatatatatgtgtatatatatatatataaaaaatatttttactgcatcttttctatgtttagatacacaaatgcctaccattgtgtcacagttgcctatagtatttagtacagtaacatgctacacaggtttgtagaccaggagcaataagctacactatatagcctaggtgtgtagtggtaggttatcccatttgggtttgtgtaaagatgccctgtggtgtacggatagcagtgaaattgcctaacaacacacttctcagaatgcatccctgtcattaggtgatgtatgactattgctttttttcttttgaaacagggtctagctctgtcacccaggctggaatgcactggcttgatctcaactcactgcggcctcaacctcccaggctcaagcaatcctcccaccttagtcacctgagtagcagggaccacaggcgtgcgccaccacacctggctaatttttgtatttttttttgtggagacagggtttcaccacgttgcccaggctggctcttgaactcctggacttaaacgatcctcctgcctcggcctcccaaagtgctgggattacaggcgtgagctaccacacctggccactgactattcctcttttttttttttttttttttttttctgagacagtttcactcttgttgcccaggctggagtgcaatggcgtgatctcagttcactgcagcctccccctcctgggttcaagtgattctcctgcctcagcctcctgagtagctgggattacaggcatgtaccaccacatccagctaattttgtatttttagtagagacggagtttcttcatgttggtcaggctggtcttgaactcctgacctcaggtgatccacctacctcagcctcccaaagtgctgggattacaggtgtgagccaccacgcccggccaactattccatttttgtggcgagatttttttgtttttgtttttgttttttaattcttccttcttaggagctgtaagactattcagagagttcagaaaggcacaaaatggaaagtaaatggcttccactctttctcttaaaggaactactaaatacagtgtcttgggtatttttctaaagtttttaaaaaatgaaattattttgcattttgttcacttggtaaattttggaggtcatctcatcagtatatttatctttcgcatgtttttctaggagttatgtggttttacattgtaagaactttagaaaaatacatttagccagttctgtaacactgaattgtatactaggttttagctgacataagcagtgtgtcagtccctttatatgtacctatttgtgtaggtacaactggtccctggcttatgaagtttgacctgatttttttcgactttacaatggtgtataaccatactttgagcactcacacgttgtttttttttctttctttaagagacagggtctcttggctgggagcagtggctcacgcctgtaatcccaacactttgagaggccagggtggcggatcacttgagctcaggggtttgagaacagcctgggcaacatagtgagaccttgtctctaaaaaacacaaaaaattagcctggtgtagtggcacgcacctgtggtcccaggtactcaggaggctgaggtgggagagtaacttgagcctaggaggtggaggctacagtgggccacagtcatgccactacactctagcctgggtgacagagtaagaccccatctcaaaaaataaaaaattaaaaaaaaagatcttgctctgtcacccaggctggagtgcagtggcacaattatagctttttgcagcctcgaactcctgggctcaagtgatcctgccacctcagtcttctgtgtagctaggactgcaggtgcatgccatcacacttggctaactttttaatttttttgtagagatggggtctcgctatgttgcctcagttggttgtaaactcttggtcccatgcagttgtcctaccttggcctcccaaagcactgggattacaggtgtaagccaccgtgactggccccgttctatttttcactttcagtacagtgttcaatgagttacatgaggtactaaacacttcattgtaaaagaagctttgttttgcccagctgtaggctaatgtaggtgttctgagcatgtttaaggtagggtaggttaagctatgatgttcagcaggttatatgtcataaatatatcttcaacttaggatattttctacttaggatgggttttccaagatgttaaccccatccattgtgttaataagttgaggagtttatctgtgtgtgtatgcatcatggtgtcctttagcaaatacagtcttagcagtggaaattgctggcagtatgatagggacacttgaaaattgcatagataattgccaacttgaaggcagagggtggtgctctttgcatctcagagcctagcaaaggtaggtagttgctcaacaaacggactaatgttctaatgcaaatgctgaatgctccactttggaagggggagaatttagagggcaaaggggaatcgcacagggtcttaaagtgcaacagccacagtccttcctttttggggaaaaaaaaaaaaagtcccggccgggcatggtggttcacgcctgtaatcccagcactttggggaggccaaggcgagcggatcacgaggtcaagagatcgagaccatcctggccaatatgatgaaaccccatctctactaaaaatacaaaaattagctgggtgtggtggcacgcgcctgtagtcccagctacttgggaagctgaggcaggagaatcgcttgaacccgggaggcggaggttgcagtgagtcgagatcacgccactgcagcaagactctgtctcaaaaaaaaaaaaaaaaaatttaaaaagtcccaaatctgccaccatttattcttgatctttttcagaagcggcaccatgtactacagacggctcatccctcccctttgtcagtgtatagagggttctttggatgtagacacttttcaaagaccaatgagctgctgcagaagtctggcaagaagcccattgactggaaggagctgtgatcatcagctgaggggtggcctttgagaagctgctgttaacgtatttgccagttacgaagttccactgaaaattttcctattaattcttaagtactctgcataagggggaaaagcttccagaaagcagccatgaaccaggctgtccaggaatggcagctgtatccaaccacaaacaacaaaggctaccctttgaccaaatgtctttctctgcaacatggcttcggcctaaaatatgcagaagacagatgaggtcaaatactcagttggctctctttatctcccttgcctttatggtgaaacaggggagatgtgcacctttcaggcacagccctagtttggcgcctgctgctccttggttttgcctggttagactttcagtgacagatgttggggtgtttttgcttagaaaggtccccttgtctcagccttgcagggcaggcatgccagtctctgccagttccactgcccccttgatctttgaaggagtcctcaggcccctcgcagcataaggatgttttgcaactttccagaatctggcccagaaattagggctcaatttcctgattgtagtagaggttaagattgctgtgagctttatcagataagagaccgagagaagtaagctgggtcttgttattccttgggtgttggtggaataagcagtggaatttgaacaaggaagaggagaaaagggaattttgtctttatggggtggggtgattttctcctagggttatgtccagttggggtttttaaggcagcacagactgccaagtactgttttttttaaccgactgaaatcactttgggatattttttcctgcaacactggaaagttttagttttttaagaagtactcatgcagatatatatatatatatttttcccagtcctttttttaagagacggtctttattgggtctgcacctccatccttgatcttgttagcaatgctgtttttgctgttagtcgggttagagttggctctacgcgaggtttgttaataaaagtttgttaaaagttt

SEQ ID NO: 2142 - DNA, 12876 bp, Homo sapiens
  source 1..12876: mol_type = genomic DNA
aaaagaccacgtggggacgcggtggggcgggtctggcgggggcggggcacctctgtgcagggttcccagtcaccgcgacgctcctcgggaagccatagggcgcctcccagcccgtctccccgctccagtttagaacctaattcccaattcccggaccgggcccagccctgggctcttactgtccgcttttgctgggacctgttccacaaatgggcgtcttctgccttgggccgtgggggttgggccggaagctgcggacgcctgggaaggggccgctgcagctcttgagccgcctctgcggggaccacttgcaggccatcccagccaagaaggccccggctgggcaggaggagcctgggacgccgccctcctcgccgctgagtgccgagcagttggaccggatccagaggaacaaggccgcggccctgctcagactcgcggcccgcaacgtgcccgtgggctttggagagagctggaagaagcacctcagcggggagttcgggaaaccgtattttatcaaggtaaatatggaaatgcaccttccataagggtaaatgtggaggctgccggcccttttgtcttgttagtgtagccggccaagttcatgtttccgtaggcttaggttgtacccccttcaacctcctttactcacaaagggggtaaaagaaagccatgatgtttcactctgcagctttatattggttaaagttgttaacgacccgcgagatgatatcatggattcatttaagtcacatagtctattgtccaggaaaggctggcgtagtaaaatcaccaaccatcctgaatgaaacctggcttgagctttaaaaagccgagaggagtggcactgtcaggacccagcccagagaaagaggcaaggaattgacctgattgaaccacttaggtgggggggcaggcactgtttttgtttgttgttttttaaaagaatttggacataacatgacaaagaactaatgatgttccaaataacttgcactagaagctttcttattgaattcttatggtttccaatgagaatctgattttaagtctagtttatctttaaatcagctaatgggatttgttgcagaagaaagaaagcattacactgtttatccacccccacaccaagtcttcacctggacccagatgtgtgacataaaagatgtaagtacaacttgttgataatttttattggggagaaggagtcaaatagtatttttaaattagggacactggagttaagccacagtccatcattcagtagtaaataaaacactgaaatcccgaggtttggctgactgtatttcagcctgtatttactctttttaatgtttaccacgtggtatttatgtggcaaaaaggaaaactatgtacatcctgtgctcttatttcttgtattttttttaaatcctgaaactaacctcccgcggtgtcagatgttatggtggtggtgaagttcaaactgacacacaaagcagttaaatcttttgcagcttgttatagtcaaccccaccttgacctgaccacactgccttatagttagcactttcaagctcttgacttctggcctgaacagttttgtggttctgttatcagatccctttgctttagtttgtcttatataacagttgctggttggcggctctcatccatcttgtgttcagaagttcgtggggctgggcacggtggctcatgcctgtaatcccagcactttcggaggccaaagtgggaggatcatttgaggtcaggagttcaagaccaatgaaacctggtctctcctaaaatacaaaaattagccgggcatggtggcgcacgcctgtaattccagctacttgggaggctgaggtgggagaatcgcatgagcccaggaggcggaggttgcagtgagctgagatcacaccacttcactccagcgtgggcgacagagccagaccctgtctcaaaacaaaaaaaaaaccgtggcttctcactgttgaactatgaaagcagagcaaccctctttaaatagggccacgtcctacctctcagccttacctccacctcccactctcccactccagagttggacagtgtggcaaacccctccccacttctgtctcttaaaaatcaagtagatgcctctgtggcacctccttgaattgaagtccgttgcctgccacctctgtgatccagttttcctctgagctgctacgatgcatttagcacctgctgacactggacttttaggtttcttacccgttttcctcccccgttttgtaaactggggcaagaatcttgtgatttaatgaatatctgtgaaatgacatagaagtgaaataggtgaataaatcatcttgataaggcagccacacctaatacttagaaaatctcgtaagcttaattttagagtaagaatttagaatctagctctttggttttgaagctaaattaaatcctattaagatcaatactaatttgcttcttgtttgaatgccctattctgaataccagtaatcagtataaacagggaatattaaaaggaatattttgagggaatgctcaaaaaccagtttcaaacctatgaggatcagatgggccagcagggcttcttgacagaccagcattgggagagttgtttcacaagagaatatgttggcatggtgtgaacaccaaggggagggacaagaggtccccaaaagcctcctggtcatggaacatctggagctggattctgaaagatagagtatgtcagctgtggaggaagattctaagaacgcaatggcagaagcttgagaatgaagactaggtgggtgggccctggatgggaaggacgaggcggcctatgtttcaacacctcccgtgacaggaacttcatttcatttcattgtctcttgccacctactcccatggcccttttgatctgacctcattctcttctggctccacctgttagaggatataggggagcagacaccctcatatgctgctggtgggaaatctgaattgctttttttttttttttttttttttttttttgagatggagtgcagtggtgcaatctcggcttactgcaacctccaccccctgggttcaagcgattctcctgcctcagcctcccgagtagctgggactacaggtgtgcgccaccacacccagctaatttttgtatttttagtagagatggggtttcaccatgttggccagatggtttcgatatcttgacctcgtgatctgcctacctcggcctcccaaagtgctgggattacaggcgtgagccaccatgccaggccctaaattgctttaattcatcgaaaagtaactgggggctaggcacagtggctcatgcctgtaatcccagcattttgggaggccgaggagggaggatcccttgatctcaggaatttgagaccagcctcagcaacataagggaggccgtgtgtctacaaaaagtaaaaaaaaaattaggtgggcatagtggtgcactcctgtgggcccagctactctggaggctcaggtgggaggaccacttgagcccaggagggcgaggctgccatgagctgtgatggcaccactgcacatcagcctgagcaacacagcaaaaccgtgtctcaaaaaattaaaaaagcagctaggtacatatctttacaagtttaaaatacgcttagcctttgaccagcaactctgctattagcaatctatgccatagaagtgttttatttgttttgtttatgtttgtttgaggcagggtctgtgctgcttacattacagtattgtttaattcctgacccctggtggttcacaggtgaaggttgtcatcctgggacaggatccatatcatggacctaatcaagctcacgggctctgctttagtgttcaaaggcctgttccgcctccgcccaggtacagttgctttacaggtgactgcagtccagacatgattcctttcagatgtgtacttagcttattacaagtgggactatctggggcactgttcactagccttggaggaggatttctcggcctcagcaccattgacatttggggctgagtcattctttgttgtggaggaggagaggagtcctgtgctattgcaggatcttgtgccacatccctggcctctaccactggaaaccaggagcaacccccagctcgtgataatgaaaaatgtgcagacattgccaaaagtcccttgggggcgtaaaatcacccctggttaagaaccactgctttgggccgggcgcggtgactcacgcctgtaatcccagcactttgggaggctgaggcaggagaatcgctggatcccgggaggcggaggtggcagtgagccgagatcctgctactgcactctagcctgggtgacacagcaagactggaaaaaaaaaaaaaagaaccactgcttttggaggatttggtgtatgatatacataaatatgctaaggacagaaaactgtccctgagcaacagtgggggtctgggttgtaactgctgggttgatttacttaggttttccagagtgctgttaaatccaagtacagactaaagtaaaggtctttggcagagtcacctgttagaaggaggactggcagtgttgatctcattaatcggcgccatatgtgccagtgtcccttccaagggctggctgtaacttctaaccttttcacatatgtcttagacgttactgagctttcaaaattatgcttaagattctgttttttgtttttcttgtggcttgctttcagtttggagaacatttataaagagttgtctacagacatagaggattttgttcatcctggccatggagatttatctgggtgggccaagcaaggtaagccagcgactgctagattttttttttttttttttttttgagaccgagtctcactctgttgcccaggctagagtgcagtggtgcaatctcagcttactgcaacctctgcctcccaggttcaggcgattctcatgcctcagcctcctgagtagctgggaccacaggcatgagccaccatagctggctaattttttaatgtatttttagtagagacagggtttcaccatgttggccaggctggtctcgaactcctgacctcaggtgatccgcccgactcggcttcccaaagtgctgggattacaggcataagccaccacgcccagccccgactccattgttgatggtagtggctgctgccattatgccggctgcagcagggaagcacagcttgctacactggatcccatcaagcattggtttcatcatggatttagctcctgttgctgggtattgggctgatttgcctgagcctacatttaacctgtttctctcatgtgtataggtgttctccttctcaacgctgtcctcacggttcgtgcccatcaagccaactctcataaggagcgaggctgggagcagttcactgatgcagttgtgtcctggctaaatcagaactcgaatggccttgttttcttgctctggggctcttatgctcagaagaagggcagtgccattgatagggtatgttttgttttctttcttttttttcttttttttttaacactataaaaacaatgtaaagaattctaggagtccctgctgtgtttggtcctggaaaatccatgttataaaataacttttattttcccttaggcctgttataagggtttcccattgaaaactgagaagaatttggacaaattataggggtgatgagttgtgtatgaggaaagcaaagcaactggccaacttgtgactgaatgcagttggtgctgtaggcatgaacttggtgtctacaagatacaagtccctgggtaccattcacttaacaagtgatggatgaggcatgtttctggcttccaagaaatttgggaacatatagaaaacacaaagaattccactcaatcacaaatttaacttgcccatgaaaatactatcagtgatcattattgttttgtttctgggttttttgttttttgatggagtctcgctctgttgcccaggctgtagtgcagtggtatgattttggctcactgcaacctccgcctgctgggtttaagtgattctgcctcagcctcccgagtagctgggactacaggcgcccgccaccacacccggctgatttttttttattttttagtagagacagggtttcaccatgttggccaggctggttttgaactcctgacctcaagcgatctgtcctcctcaacctccaaagtgctaggattacaggcatgagccaccacacccggcctatcggtgatcattattaaccccaaggtctaattgcagatacccaacacgaccaaaccagtggctcccctccctacatcttccccctatctgctacctccctctttcccttcactcactgaagcacttctacacctggttgtggaaatcagagacctaaaagtcatccttgaatcctccatcccatcagtaaatcccatcaactctgcctcccaaaacaccccagtctactgcttctcattcgccactgctgcccttcaggcatgagtcaccatcatctttctccaggagaaccgtgatggactagagatggaggcttgatggagagccgcagagtggaggagggagagatagggggtgggaaggagacgagccaggggtgtgttcatccctggcaaatgggagagacattgggtgggggagaaattatagagtaaatgcttcaatgatcgaaggcaagggcttagcagaggtaacctgacaatagtttttggtgtatcagcaggaggtaacgggggtatcagaaatgtgcacgtatatttaacccctaccttgtgtgggtactaggttgagcacttttgttttttgagatggagtctttctgtcacccaggctggagtgcagtggcatgatctcggctcactgcaacttcgcctcctgggttcaagcacttctcctgcctcagcctcctgagtagctaggattacagttgcctgccaccacacccagctaatattttttatttttagtagagactgggtttcaccatgttgacaaggctggtcttgaactcctgacctcaagcgatcctcccatcttggtctcccaaagtgctaggattacagatgtaagccaccgcacccgaccaggttgagtactttgcatgcagaatcttacttaactctcagaaaggctttgaggtaggcatacacttgtatgagtgacctaagatctgactggtatgaactgctaagatgtgatcatctaggtatgtaagaagtgtgcgtgagagtaattgctaatctctatcccttagggaggtttacggccagtgttgctcttccgcagtatattggtaatctttaatcatggtttggtctgaaagtaaacagttgttaaagtagcttggtcattaaagccaaattgcatatctccagcccagtgtctcttctgatctatagagtgccttgttactactgccccatgaacatgccaaattcaacattttccaaacgaagtttctccttttctcatccatgcttcactaaacttcctcctctgcactccctagcagcaaaaagcaccatcatctgcccagttgtccagccagatctattactgacacctgcctacctctctttctcccctcttctgtcctttttttccaccttcccagtcagtcagtcattcatatctgtgttctttcttccccctccaaatctacccctgcctgaccacctttgccttcattcaggccctcacctgatcttgcctggagggttctgatgctttctccctggaaggccttgccttaggctgaagatctgatttcaggggggtagaggggtggcccccaatcggcctcccagacttaactctatccctctttgcactccgatccctaggctgacccattcccctttactttttcacggtgccccacttccctgcctttgcatatcctgctttctctgcctacagtgtagaggtcattttcttctgggattctttagagctctgcagggctgacatttacaggggcctgtgctgcttgcgtgtgtgttcagcatttggtgtgcatgacttcttatcacactcagcccctgtgatcctcatttgattggtcacagtaacttcataagctgggcggtattgttattcccagtctacagatgaaaactgaagcagcttagagttgcagcaacttctctgtggtacagctactgagggtagaggtaggcctcgaccccgggcagtctggctccaggctctgtactcttaaccacactggattgcctggctttagtcctcacccctcatcgcccctcctggactgagccccttgaaggcaagagtgttttgagaaacagtgatttgttcgttagtttttatatacagaaaagaagaggaaaacaaaaatggtctatatctccctgttaaaataactatagttgatattttaaaaaaatcaaagtagtcatttgccacataatgatgtttcagtcataaactgtatatatgacgatggtcccataagattataatattctggccgggtgtggtggctcatacctgttatcccagcactttgggtggccgaggcgagtggattgtctgagctcaggagtttgagaccagcctgggcaacatagtgaaaccctgtctctactaaaatacaaaaaattagccaggtgtggcggcgtgtgcctgtagtcccagctacttgggaggcagaggttgcagttagctgagatcatgccactgcactccagcctggcaacagagtgagactctatctcaaaaaaaaaacatatatatatatacacatatatatatacgtatatatatatgtgtatatatatatatataaaaaatatttttactgcatcttttctatgtttagatacacaaatgcctaccattgtgtcacagttgcctatagtatttagtacagtaacatgctacacaggtttgtagaccaggagcaataagctacactatatagcctaggtgtgtagtggtaggttatcccatttgggtttgtgtaaagatgccctgtggtgtacggatagcagtgaaattgcctaacaacacacttctcagaatgcatccctgtcattaggtgatgtatgactattgctttttttcttttgaaacagggtctagctctgtcacccaggctggaatgcactggcttgatctcaactcactgcggcctcaacctcccaggctcaagcaatcctcccaccttagtcacctgagtagcagggaccacaggcgtgcgccaccacacctggctaatttttgtatttttttttgtggagacagggtttcaccacgttgcccaggctggctcttgaactcctggacttaaacgatcctcctgcctcggcctcccaaagtgctgggattacaggcgtgagctaccacacctggccactgactattcctcttttttttttttttttttttttttctgagacagtttcactcttgttgcccaggctggagtgcaatggcgtgatctcagttcactgcagcctccccctcctgggttcaagtgattctcctgcctcagcctcctgagtagctgggattacaggcatgtaccaccacatccagctaattttgtatttttagtagagacggagtttcttcatgttggtcaggctggtcttgaactcctgacctcaggtgatccacctacctcagcctcccaaagtgctgggattacaggtgtgagccaccacgcccggccaactattccatttttgtggcgagatttttttgtttttgtttttgttttttaattcttccttcttaggagctgtaagactattcagagagttcagaaaggcacaaaatggaaagtaaatggcttccactctttctcttaaaggaactactaaatacagtgtcttgggtatttttctaaagtttttaaaaaatgaaattattttgcattttgttcacttggtaaattttggaggtcatctcatcagtatatttatctttcgcatgtttttctaggagttatgtggttttacattgtaagaactttagaaaaatacatttagccagttctgtaacactgaattgtatactaggttttagctgacataagcagtgtgtcagtccctttatatgtacctatttgtgtaggtacaactggtccctggcttatgaagtttgacctgatttttttcgactttacaatggtgtataaccatactttgagcactcacacgttgtttttttttctttctttaagagacagggtctcttggctgggagcagtggctcacgcctgtaatcccaacactttgagaggccagggtggcggatcacttgagctcaggggtttgagaacagcctgggcaacatagtgagaccttgtctctaaaaaacacaaaaaattagcctggtgtagtggcacgcacctgtggtcccaggtactcaggaggctgaggtgggagagtaacttgagcctaggaggtggaggctacagtgggccacagtcatgccactacactctagcctgggtgacagagtaagaccccatctcaaaaaataaaaaattaaaaaaaaagatcttgctctgtcacccaggctggagtgcagtggcacaattatagctttttgcagcctcgaactcctgggctcaagtgatcctgccacctcagtcttctgtgtagctaggactgcaggtgcatgccatcacacttggctaactttttaatttttttgtagagatggggtctcgctatgttgcctcagttggttgtaaactcttggtcccatgcagttgtcctaccttggcctcccaaagcactgggattacaggtgtaagccaccgtgactggccccgttctatttttcactttcagtacagtgttcaatgagttacatgaggtactaaacacttcattgtaaaagaagctttgttttgcccagctgtaggctaatgtaggtgttctgagcatgtttaaggtagggtaggttaagctatgatgttcagcaggttatatgtcataaatatatcttcaacttaggatattttctacttaggatgggttttccaagatgttaaccccatccattgtgttaataagttgaggagtttatctgtgtgtgtatgcatcatggtgtcctttagcaaatacagtcttagcagtggaaattgctggcagtatgatagggacacttgaaaattgcatagataattgccaacttgaaggcagagggtggtgctctttgcatctcagagcctagcaaaggtaggtagttgctcaacaaacggactaatgttctaatgcaaatgctgaatgctccactttggaagggggagaatttagagggcaaaggggaatcgcacagggtcttaaagtgcaacagccacagtccttcctttttggggaaaaaaaaaaaaagtcccggccgggcatggtggttcacgcctgtaatcccagcactttggggaggccaaggcgagcggatcacgaggtcaagagatcgagaccatcctggccaatatgatgaaaccccatctctactaaaaatacaaaaattagctgggtgtggtggcacgcgcctgtagtcccagctacttgggaagctgaggcaggagaatcgcttgaacccgggaggcggaggttgcagtgagtcgagatcacgccactgcagcaagactctgtctcaaaaaaaaaaaaaaaaaatttaaaaagtcccaaatctgccaccatttattcttgatctttttcagaagcggcaccatgtactacagacggctcatccctcccctttgtcagtgtatagagggttctttggatgtagacacttttcaaagaccaatgagctgctgcagaagtctggcaagaagcccattgactggaaggagctgtgatcatcagctgaggggtggcctttgagaagctgctgttaacgtatttgccagttacgaagttccactgaaaattttcctattaattcttaagtactctgcataagggggaaaagcttccagaaagcagccatgaaccaggctgtccaggaatggcagctgtatccaaccacaaacaacaaaggctaccctttgaccaaatgtctttctctgcaacatggcttcggcctaaaatatgcagaagacagatgaggtcaaatactcagttggctctctttatctcccttgcctttatggtgaaacaggggagatgtgcacctttcaggcacagccctagtttggcgcctgctgctccttggttttgcctggttagactttcagtgacagatgttggggtgtttttgcttagaaaggtccccttgtctcagccttgcagggcaggcatgccagtctctgccagttccactgcccccttgatctttgaaggagtcctcaggcccctcgcagcataaggatgttttgcaactttccagaatctggcccagaaattagggctcaatttcctgattgtagtagaggttaagattgctgtgagctttatcagataagagaccgagagaagtaagctgggtcttgttattccttgggtgttggtggaataagcagtggaatttgaacaaggaagaggagaaaagggaattttgtctttatggggtggggtgattttctcctagggttatgtccagttggggtttttaaggcagcacagactgccaagtactgttttttttaaccgactgaaatcactttgggatattttttcctgcaacactggaaagttttagttttttaagaagtactcatgcagatatatatatatatatttttcccagtcctttttttaagagacggtctttattgggtctgcacctccatccttgatcttgttagcaatgctgtttttgctgttagtcgggttagagttggctctacgcgaggtttgttaataaaagtttgttaaaagttt

SEQ ID NO: 2143 - DNA, 27405 bp, Homo sapiens
  source 1..27405: mol_type = genomic DNA
gggaagctcgggccggcagggtttccccgcacgctggcgcccagctcccggcgcggaggccgctgtaagtttcgctttccattcagtggaaaacgaaagctgggcggggtgccacgagcgcggggccagaccaaggcgggcccggagcggaacttcggtcccagctcggtccccggctcagtcccgacgtggaactcagcagcggaggctggacgcttgcatggcgcttgaggcaagttcggggctcattttggaagttttctttctagcacagacatccaactctgctcctatgccagtcagataattaaggaattaagtaataattgtgctctgcaaattatgatagtgatctgtatttactacgtgcatatattttgggccagtgaatttttttctaagctaatatagttatttggacttttgacatgactttgtgtttaattaaaacaaaaaaagaaattgcagaagtgttgtaagcttgtaaaaaaattcaaacaatgcagacaaatgtgtctcgcagtcttccactcagtatcatttttgtttgtaccttatcagaaatgtttctatgtacaagtctttaaaatcatttcgaacttgctttgtccactgagtatattatggacatcttttcatggcaggacatatagatgtgttaatggcattaaaaataaaacaaaaaactgattcggccgggtacggtggctcacgcctgtaatcccagcactttgggagatcgaggagggaggatcacctgaggtcaggagttacagacatggagaaaccccgtctctactaaaaatacaaaattagcctggcgtggtggcgcatgcctgtaatcccagctactcgggaggctgaggcaggagaatcgcttgaacccgggagcggaggttgcggtgagccgagatcgcaccgttgcactccagcctgggcgacagagcgaaactgtctcaaacaaacaaacaaaaaaacctgatacatggtatgggaagtacattgtttaaacaatgcatggagatttaggttgtttccagtttttactggcacagatacggcaatgaatataattttatgtatacattcatacaaatatatcggtggaaaattcctagaagtggaatggctgggtcagtgggcattcatattgagaaattggaaggatgttgtcaaactctgcaaatcagagtattttagtcttaacctctcttcttcacacccttttccttggaagaaagctaaatttagacttttaaacacaaaactccattttgagacccctgaaaatctgggttcaaagtgtttgaaaattaaagcagaggctttaatttgtacttatttaggtataatttgtactttaaagttgttccagaaaacaaggcaaatactgaaaagcatttcatctgaagtttctttctggtattgaacagagttggatggagagtgaatgcaggttaccgatgtgttcgcaggaacaaaacgggagggagagtaacacaggtgcacggcttcatattgatttatcaaagaacttgcttttggactgttaaaaaatgtgttgcacagttctgacacttttacacaatgatgagcttacaaaggggaaaatgcttaacataaacatagtttcaaagaaggtaagtcctagtttttccacgagctgtttttttttttgagagagagtagtcccaaaatttccctattatgtggtttttcatccaaagtgttgtaatccgtgtgttctaacccgcatattacgattactcaagaaatgcaaaataggccgggcgcggtggctcacgcctgtaatcccagcaatttgggaggccgaggcaggtggatcacgaggtcaggagatcaagaccatcctagctaacacggtgcaaacccatctactaaaaataaaaaatattagctgggcgtggcggcaggcgcctgtagtcccaactactcgggaggctgaggcaggagaatggcgtgaacctgggaggcggagcttgcagtgagccaagatccggccactgcactccagcctgggcgacagagggagactccgtctcaaaaataaaaataaaaataaaaaaagaaaaaagaaatgcaaaataatgtgaacacgtcatcgagactgcggtctacaattgtggttgccatgatggggtgggtcggaagacaccgaggctgcttgaatcatgttcctggcaggttaattttgttccttttagggcatctaaatgttggagttggctttcctggcagagagtccagttgtgagtggagtattgggtggaggccccaccctccccaggttttctgcagcttgttcctggctcttctggggcttctctgaggaccccgattggtcctggggcttctttagtggtgggcctgggccagttccttccgttgctcacctctccccgaagcttaaggataacatttcgggaagatcatgagagaacgtgaaccaaaaaaaaaaaaaaaaattcaggtagggtgggagctaagttagtttagtatttgggatttttgttttgttttgtttgagacagagtctcaaacaaagaccccgcgcctggcctgggggtctttttttgagtcagcagttgagtttgaaaatccccttccttggaatccgcccaggctgttttctctggtggatgcttattgcccctgctaacttcagctgcggtctctctgctcgccttgccctccccatcctccttagaccttttaagcttcactttcctttccttgctgccccgcctccctgtctccccagtgtgatctaccctgaaaggctgctgtattttgtttccctttgggaccgagcctgctcaaatgatctgctccatgaggttttactgctatatcctactgaagtatctgggaggtcttggcggagaagaggacaacatcttggaaaatgcagcctggaacctctctgctctctttcatcagctttccctcaatgatgagctcaaaatcctctttcttgctgatggaattgtctgctgtcatcatttcagttgagtcctcctaggctgggccttgtaagaagaacaactgtttataactattgaaagtcaatatttactaagaaaaagaggttgttgttatctgagccatccaacatgaatttaagaatatattccaggctgggcgcggtggctcatgcctgtaatcccagcactttgggaggccgagatgggtggatcacctgaggtcaggagttcaagaccagcctggccaacatggtgaaaccccgtctctactaaaaatacaaaaattagccatgcgtggtggcacatgcctgtagttccaactatttgggacactaaggcaggggaagtgcttgaactcgggaggcagaggttgcagtgagctgagattgtaccactgcactccagcctgggtaaaaagagtgaaattccatctcaaaaaaaaaaaaggagacagggtcttgccctgttgcccaggctggagtgccgtggcacgatcataactcactgtggcctcaaattcctgggctcaactgattctcctgcctcagtctcccaagtagctgggaccacaagtacatgccaccatgctaggctaattttatttttatttttagaaaataaaatattttttattttatttaggcaacatgctatgttgcctagactggtcttgaactcctggcttcaagctatcctcttgcctcagccaaccaaagtgctgggattgcaggtgtgaactgccatgcctggctttctattctctatttctaggagataagctttttgagctttcacatatgagtgtgaacatgtggtatttatctttctgtgcctaggttattccacttaacgtaatgtactccaggctcatccatgttgatgggaattacaggatttcattctcttgtaatggctgaataacatcccattttgtgtatatagtccacatgttctttatccattcctcttttgatagacacttaggttgattccgtatctcgggtattatgagcagtgctgcagtaaacatgagagtgcaaatatctcttcaacatactgattccctttcctttggatatatattcagcagtggcattactagatcatgtggtatatctatttttaggtttttaaggaatctccatactgttttccataatggctctactaatttacattcccaccaatgatttggttgagtttattcctcactctgagcagcatgttagctggacttaaaccccgtccagcttgtctacatctggcccatcacttgccagtgggaaaggcacttacttctttgtatctcagttttctcatctgtcaaatggaaatataacagtaattaattcacatggctgtgtaaggataaataagacagtacatataaaaggctttcaccttttataagaaatagtgcttcgatgttacccattattattattttatttcatcttatttatttatttagatacaaggtctcatttgttgcccaggctggagtgtagtggcacaatcatagttcagtgcagcctcaaactcctggcctcaagtgatcctcctccttcacccttctcagtatttggggccacaggcgtgcaccactatgaccatctaaatttttttttagagatggggtctcagtatgttgcccgggctagtcttgaactcctgggctcaagtgatcctcccacctcagcctcccaaactgctgggattacaggcctgagccaccatgccaggcctcatctctatatctttagggttagtcactggcaccttaatttgttcatttggtgatgtcatgtttctctgattgaccttgatccttatggctgtgtgtcaatgtctgtgcattgacataggtacctaagccagtcttcattgcctggctttgtttgggctcgtctttcatcaggaaacccataggagattagggagaggctgattggtcaggaccctaagcccatgactgcttcagctgttgtagtgctggggggtgctctaagcccagcatcactgtggttggaattctttggccactgaggctgacacagccctgggttatgcctgaaggccatagctgccgagactggcacagcactggggcacgcccaagacccacagctgtgatggcgtgcttgctgctgctgaagttattcagggcccagggccactgtagttgtcaggtagtgatgtgggccagatcgccagtccctgttactggggctgtgggttctcatctggcactagggtggggtgagatctgcctgtgggtactggtctagtatcagggtgatgaggctctgcccagtactgggttttactgtagtgagcctagtcctggtgacaggtgacagcgtgctggcagccatcacagccctcgctcgctctcggtgcctcctcggccttggcgcccactctggccacgcttgaggagcccttcagcccaccgctgcactgtgggagccccttcctgggctggccgaggctggagtgggctcccttagcttgcggggaggtgtggagggagaggcaggggcgggaactggggctgcacgcggtgcttgtgggccagcgcgagttccgagtgggcgtgggctcggcgggcccgcactcggagcggccagccggccggcctgcaagccccaggcagtaaggggcttagcacttgggccagcagctgctgtgctcgatttctcgccgggccttagctgcctcctggcagggcagggctcgggacctgtagcccgccatgcctgagcctccccaccccgcagccatgggctcctgtgcggaccaagcctccccgaccagcgccgctcccggctccacgccgccgagtcccaccgaccacccaagggctgaggagtgcgggcgcacggcgcgggactggcaggcagctccacctgcggcccaggtgtgggatccactgggtgaagccagctgggctcctgagtctggtggggacttggagaatctttatgtctagctaagggattgtaaatataccaatcggcactctgtatctagctcaaggtttgtaaacacaccaatcagcaccctgtgtctagctcagggtttgtgaatgcaccagtcgaccctctgaatctagctactctggtggggacttggagaacctttgtgtccacactctgtatctagctaatctagtggggacgtggagacgttttgtgtctagctcagggattgtaaacacacccatcagcaccctgtcaaaacggaccaatcagctctctgtaaaacagaccaattggctgtctataaaatggaccaatcagcaggatgtgggtggggccagataagagaataaaagcaggctgcccgagccagcagtggcaacctggtcaggtttccttccatgctgtggaagctttgttgtttcattctttgcagtaagtcttgctactgctcactctttgggtccacactgcctttatgaactgtaacactcaccgcgaaggtctgtagcttcactcctgaagccagcaagaccacaaaccaaccaggagggactaacaactccagacgcgctgccttaagagctgtaacactcaccgtgaaggtccgcagcttcgctcctgaagccagcgacaccacgaacccaccgggaggaacggacatctccagatgcgccgtattaggagctgtaacactcaccgcgaaggtctgcagcttcactcctgagctagcgagaccacaaacccaccagaaggaagaaactccgaacacatccgaacatcagaaggaataaactgcggacatgccccctttaagaactgtaacactcactgcgagggtccacggcttcattcttgaagtcagtgagaccaagcacccaccaattccggacacactgggttccaaggcgaagtactccacttacctcttcttcccccaagcaaacagtgtctctcttcacacagctgtgctgggttgggggagggtacacgggtacccctatggccactgaggctgagacaatattgagtcacacccccagaattcatgccatgagaccagcccagcaccaggatgtgcctaaggccgacaggtagctacagcctgcctgcagctaaggtttatctgactgctgcagctggccggcagtgttgcgggccagaacacgaggctgttctgccagggccgcaggtccccttgggtgttgggcgggttgagaggcttcccctgtatgccagcctggcatcaggggctgagagttcttgcttagtgctggctttttactgaagtgggcctggtcctgggttgtaaagcaaagtcctatgcgcgcttccctgtcctttcccaagagggcgctcccggttaggatttggcagtcggctctgaggatgaatggaaacgcctgggacccaggttaggggatgtgtagcctagctgtcatttccagcctagagctctatgagtcagtctccccaaacatttatctccctctaagacctgctctttggcatcagaacggattacatgaatacacattcctccttctctaattcttgcctacccgcattgtattttcacagagattccatcgtgcctggctcacataagcgcttcctggaagtgaagtcgtgctgtcctgaacgcgggccaggcagctgcggcctgggggttttggagtgatcacgaatgagcaaggcgtttgggctcctgaggcaaatctgtcagtccatcctggctgagtcctcgcagtccccggcagatcttgaagaaaagaaggaagaagacagcaacatgaagagagagcagcccagagagcgtcccagggcctgggactaccctcatggtcattagacccctcccgttttcctcttcttgactgcatgtaaatgttcggctcaccccctccgctctgaagccgcagagctttgtattcgacggctcatgctttcctgtgcctgagtttctgcatcttttagatggggatacagcctgggccatagtgaaaccctatctgtaaaaaacaaaaacaaggtcgggcgcggtggctcatgcctgtaatcccagcagtttgggaggccgtggcaagtggatcatgaggtcgggagtttaagaccagcctggccaaaatggtgaaaccccgtctctactaaaaatacaaaaattagctgggcgcagtggcaggtgcctgtaatcccagctacttaggtggctgaggcaggagaattgcttgaacctgggcggcagaggttgcagtgagctgagatcacgccactgcactccagcctgggtgacagagtgagactctgtctcaaacaaacaaacaaacaaatgggggtaataatagtaccaagcacatagggttgttgggaggattaaatggggtcatctgtggaaactgctttaagccagtgctgggattctagaggcacttagcattagttcccatctttactgctacctttgtatgggtctgtctggaagcaatgtgctcctgatagtctgggagtagaaatctgtgctcacctgtgaccccaggttgttactttcttactgtcctatcttgtaagccaaagccctttccccaagaatcctgagattagtggtacttcccttgtggggtctgctgagcctaaggttgggttggaaaagaggaggttggttgctaggggtcagacaaatgttatcttttgtttttctcgtattcttataagttccttctgcctttcagcctctcagggtgacactggattaggtgaatcttccccaaagtaaccttctgatttatttcctgcctccctgtagtgggaactgggcagagacctctccgctggactccaacatagacatactggggagtccctcttatccctgagccccacagatgcacatttggacttagctccgtggagaacgatttgaatgaaaggaagccatattctcagttatgctttctctaatgtttttttttctctcccaacaattgctcatactactcatttggcagtgagtaatatatacttttggtgacatctcacttttcctaatggactatattaaaacttttcttgttatcgaactttttgtgtgtgtgtgtgtgagatggagttttgctttgtcgcctaggctggagtgcagtggcacgatcttggctcactgcaacatctgcctgccaggttcaagcagttctccttcctcagcctcccgagtagctgggattacaggcatgcaccaccacacccggctaatttttgtatttttagtaaatatgaggttttaccatgtaggccaggctggtattgaactcctgacctcaggtggtcttcccgcctcggcctcccaaagtgctgggattacaggtgtgagccactgtgcttggcccttgtgatagagctttttaaagattcatgtttgatatcttctctccgatttgtttgcaagctgaatgaacacttcgtacttgagagactttacaggacttcatgtccttagtagctttaagaaaaacattagatttttgtcaactttttttttttttttgagacagaattccactcttgttgcccaggctggagtgcagtggcatgatcttggctcactgcaacctctgcctcctgggttcaagcaattctcctgcctcagcctcccaaggagctgggactacaggcacctgtcatgacacctggctgatttttggatttttttttttttttttttttgagatggagtctcgctctgttgcccaggctggagtgcagtggcgtgatcttggctcactgcaagctccgcctcctgggttcacaccattctcctgcctcagcctcctgagtagctgggactacaggcgcccaccaccacgcccggctaattttttttgcatttttagtagagacggggtttcaccgtgttagccaggatggtctcgatctcctgacctcgtgatctgcccgcctcggcctcccaaagtactgggattacaggcgtgagccaccgcacccggctgatttttggattttttttgtagagacatggttttaccatgttggccaggctggtctcgaactcccgacctcaggtgatccgcccacctcggcctcccaaagtactggaattacaggcatgagccaccatgcccagccttgtcaacttctttaccctaggccttgccctcagcatttttttctcttccccttataggcctggttggtttacacaacattggacagacctgctgccttaactccttgattcaggtgttcgtaatgaatgtggacttcaccaggatattgaagaggtaagactgttcttcaggctgatgagcatttgtattatttctttttcctttttttgagatggagtcttgctctgttgcccaggctggagtgcagtggcatgatcttggctcactgcaagttctgcctcccgggttcaagcgattctcctgcttcagtctcccgagtagctgggactagcccgccaccatgcctggctaattttttttgtatttttagtagagacggggtttcaccgtgttagccaggaaggtctcgatctcctgacctcgtgatccacccacctcagcttcccaaagtgctggaattataggcgtaagccactgcacctggcctgtattatttcatttttaatatattcagttattcacagtgacttggactttttgagatcttctctcaaaagctggcagaggaaagattggcttctgcatattctggcctacacattatttctaaaacttcttaggttggtctggggtgcgacccaagtattggtactttttttttttttttttttttgagatgaagcctcactctgtccccaggctggagtgcgacggtgcaatctcggctcactggaacctccgcctcccgggttcaagggattctcctgcctcagcctctcaagtagctgggattacaggcgcccgccaccacacctggctaatttttgtatgtttagtagatatgagttttcaccatgttggccaggctggtctcaatttcctgacctcaggtgatttgcccacctcagcttcccaaagttctgggattacaggcatgagccactgcgcccggccaggtattggtacttttttaaagccctctttgggtgattttaaatgcggccaggattgacagccactgacttggttaaaagacagagttgggactagaccaaagtcggagaaggagtaagtcagtggggagtacacacccctccttccaccaacactcacacaatgcactctctccctctgtctctctctatcactccttttctgccctgtgctctctcctttttcccatccgaaaaatgcctgtgattaaatgaatcattgccaaaccacacggacagcctttcatgttgcctttcttcccaggacctaacccagcatgtgcctctgcagtctggagagctttaggctggacattttgctgcttgcccgagatgtggagccaggacctcgtgcatctgccgtctgctctagcacgattgctgggcagggtgcagaggggccaaggcagcagtcatgctgatccccctctctagagggtcccctgtagagcagattcactcacatggtgcttctcaaccttgaccacacattgaaataatctgaggaactgaaaaattctgataactgcccgcgccccgccccccggacccagaattctggtttaatttgtatgggagtggcctggatatgaagatttaaaatttctcccaggtgattccagtgtgcacctagctttgagaactacatgtaaggaggtttctggctgttcttgtgtggcaggatcacggtgcccaggggagctgacgagcagaggagaagcgtccctttccagatgcttctgctgctggagaagatgcaggacagccggcagaaagcagtgcggcccctggagctggcctactgcctgcagaagtgcaacgtgccctgtaagataccctcccactgggctcctggctgctgatccaaaggggatgggaagcttagagagtgaagagaggaactaacgggcagtgaagcaacaagaagcaagttaggtagcctggacccctcagattatagagacatttgtgtaagaggcacacatctttggaggtgcagaattgatattatttatggacattttacttccatacctaacctttctctgcctctcagtagagtaagtgaaggcatctcctccaagcttattccaccacagtcagggaactgcaggaaaacagaataaaggaataaaaaagagaaaacatgttctacaaaataattcacaaataggttaggtttttttttttttttttagatagctatattgggttgtgcatcacatactgtaaaattcatccatttaaaaacatacaattcaaaggtttgtagtgtattcacagagttgtgcctccatcatcacaatctaatttcataacattttcatcacccccagaagaaatcctacacttacgggttttcccttgtgtataatacattgcttttctcttgctgctttcagaattctttgtctttaacttttgaaattgattatgatgtgtcttgatgtgggttgctttagatcagtcttattggtgtcctttgggcttcctggatgtggatttgtatttccttccctgggttgggaagttttcagtcattataggtatgcgttgcttaccaacagggatacgttctgaaaatgcatcagaaggtgaatttgtcattgtgtggacatcatggagtgcacttacacaaatttagatgggacagcctactacacagctaggctgcatgctatggccactgtgctcatgtggtctgccattgactgaaatgttgatctgcaactcgtgactgttatttctttggataagctttccatctcttctcactctcctccttctgggactctgataatgcctattttggtcggcttgatgtcccctaactctcttaagatatcttcactctttttcattctttttcatttttgctcctctgaatgatttccagtgacctatcttctagtttgctaatcctttcttctgcttgatttagtctgttgagcttctcttttgagctcttattgcagttattgtattcttcagctctgttatttcttttgaacttttttctgtctctttgctgaaattcttactttgttcatgcattgctgtcctagacatggtaagcatcttcatgatcattattctgaattgtctgtaaggtaagtcacttatcttcatttcaccaggggcattttctggagatttatcttgttcttttgcttggaacatatttctctgtttcttcattgttcttgattctctgttattttctgtactttagttaagaaaaatacctctcccaggctgggcgcggtggctcacgcctgtaatcccagcactttgggaggccgaggtgggcagatcatgaggtcaggcgatggagaccatcctggctaacacggtgaaaccctgtctctactaaaaatacaaaaaattagctgggcgtggtggcgggcgcctgtagtcccagctactcgggaggctgaggaaggagaatggcgtgaacccgggaggcggagcttgcagtgagccgagattgcgccactgcactccagcctgggccacagagcaagactctgtctcagaaaaaaagaaaaaaaaaaagaaaaaagaaaaaaagaaaaatacctctcccagtcttgtcccacgggccttgtataagagacgaacttaccaattagccctgccggacactcggagcacctgttgaccctttgtgttgtccagactgtcatctatgttgttagcggccctcaggagattagaatgtgtcaagtcctgtcagtgccctagacaggggagatagaaaccagccccttgaggtgcaggtggagacgttggggcattaaatgtgtgttccagtttattctatcctcagggaaaagctgggagcatgagttaatccgccacttgctctgcaaaacgctggacagaggatctgtggcaagtgcctgcactcatattgaaactgcacactccttcacgcattgttttactctttgtcacccccaggggcctagcgaatgctggctgctctctgcttagagacggacaggttagttggaagcttgacgctatctgttgagcaaaccagtgggagcagctgtggaggtgctcacctgcctgttcagggtctcagaggagcactggtttcctgctctgtcagctcccagatgcatagaaaccccagggcagcagctgcactgtgcagacaaactccttctagggagaaagtaggagccgggcctttttgcctgttcacgctgcactgggcctggggggatgttctttggtctctgtgcccctgtgggacttacaaatacagagccttgtcagctcccaaagctcggtggtcgaggagctagaccttcatttgagaggggtaaatgtgtactcaatgtgtgaagttagagacctgattttaccatacagcagggggtgggagaaggcatgggacttgcccacaggcctgtccagactcctggaaatctattgtttacctgcctcattggctccaggtgcaggccagttattaatagaagcccatccctcgggcaacagctaggagagcccgcagacatatccttccagggagaaactggaagcctggcatttctgcctgtttgctctgtgctgagcacagctgctggaagtgctcacgtgcccgtttaaaactgcctctttgccctctgtggtcgcagaggattcataactgctgacccatgtctgctcccagagctaggtgacccagcagccaagcccttgagtgggaactgcaaaagctggggctgcctatgtgtggtccaaaccctcccctctccaggagaaagctgggagtagggattccttcctcacagtaaggtactgtgtctggggtggggcttgtggtgcgagtgtgtctcagcttttccaaccggttgcgatgtgggtgttctccccattgccccctgtgcaggcctctctcagctggtttctgggtttctttcagagggagttgatctgtgtgtagatgagagttttaccgtgtgtccatgggagaaggggagcaccaggagcctccttctctaccatctcgcttgtgtcaccctctgtgattctttttatacatagttgaatttgattcactaatattttgttgaggaattttgcatttatgttcacgggagatactggtttttaggtttttttcttacaatgtctgtctggttttggtgttaggataatgctggcctcagagaatgagttaggaagtgttctctctgcttttgtcctctggaagaggttgtagggaattggtataatttttcccataaatgtttggtagaacccatcgttcactagtgaacccatctgggtgtaactgagtactcccattttctaagagatagttatattagttttcttattactttcttttcacttctcctcttcccatccctcacccctcaccgcggccgtgtttcctgtttcctgttagccctttagaaatgcaaatatcacctttcgcctacccctctccagacattccctgctgggcaaaaggaagaatctgtaaatggaggtaggctgatggaggtttgattgagaacgggcaagttcttccagctgatctttcctgagacttggcagtagatttgcagcccaaagcatacccaccagggaactctccctgccagggggtggcttcgaaacttccaccctctaggggtttgtctttcacccactaggaaggcatggagaaagcatgcccactcggccacttttctgcccggaaaggcgccaactcagctgctgggaacttgataactgcccggtagaaaaccgccattgctcactccccccacccccacaacacaccttatgaaaatgcccctctctcctccaaaggagaaatggcacattaaaaggcaggatgtgtcttgctccttgccccaggctggcttcagaataaattcacatttgtgtataaaaccttttgtatcacatttttttttgtatcagagttagttgagctctacacgcagtgagcagctcctcagcttttcgctgcataggtactgtgttcagctttccttccgtcctcagtctggagaacctcaatcaacctagctccaggtttatggattctttcttttgccagctctaatctgctattgacctcctctagtacatttttcatttcagttatggttctcctcaactcaagatttctgcttggttcttcttttatagttttttctttattgatactttttatttggtgaggcagcattttcacactttcttttacatcttttgacatggttttctttagttctttgaacatattataacggctaaagtctttgtttagtaacgccaacatctagggcttctcagtgaaaggttctacgattgctgttttcctgggtggccatgcttttctgtttcattgtaggtcttgtctcttttgttggaaaatgaacattttagataatgtaaggtggcaacactggacatcagagatccccacagcagggtttgttgttgttgctgttttatcgtttctgggcagttcatgattctgtattcgccttcattgctttcttgcatgtggccttgttgtcagccagaggggagggatctgagccctctcaggtcttacttgggcatgcgcctggccttctagatcctcaggaatgtatcagtgcttttcaaagtccctgtggacatctcattccccaggctgagtgcagtggtgacatcacagctcactgtagcctcaacatcctgggctccagtgatcctcctgcttcagcctcccaagtagctctgactacaggcgtgcaccgctactctcaagtacttttttaaattttttatcgagacggagtcttgctatgttgcccaggctggtctcaaactcctgagttcaagcgatcctcccaccttggcctcccgaagtgttaagattataggcatgagccactacatctggcactggagcttaagttttaagaggcgttctcaaaaatcaataccaaacttactgttcatttattgatcacttcttctgtcgtgccaacttagccttgcagtggggtggagggctaggaagagacaaagtgatgagtgttcatgtgtgtctaagtaccagggcatgagaagcgactctgaagacctcactaattggctgttccttttctctgtggccagtgtttgtccaacatgatgctgcccaactgtacctcaaactctggaacctgattaaggaccagatcactgatgtgcacttggtaagaacctagaaccagagcactcggaagcttaagatgctgctcatttcactcattcagctgttgttcccgtagtgtgtagaggaataaaagagttaatcccctgtaatcccagcactttgggaggctgaggcaggcggatcacgaggtcaggagatcgagaccatcctggctaacacagtgaaaccctgtctctactaaaaataccaaaaaattagctgggcgtggtggcgggagcctgtagtcccagctactcgggaggctgaggcgggagaatggcgtgaacccgggaagcggagcttgcagtgagccgagatcgcgccactgcactccagcctgggtgacagagcgagactctgtctcaaaaaaaaaaaaaaaaaaaagaaaaaagagttaatccacataaaacacttatcacagtttcataatattgttactggtattattttgcacctttgtgaggagcttctgtctcttggctccaccttctggcagttggcctgacctggcttatggtggtgttcccatctcacctctccgctctccctcttgcaggtggagagactgcaggccctgtatacgatccgggtgaaggactccttgatttgcgttgactgtgccatggagagtagcagaaacagcagcatgctcaccctcccactttctctttttgatgtggactcaaagcccctgaagacactggtaaggggattctcttggtatttgctgcccctgtatgtgttagtccattttctgttgttataactcaatatctgagactaggtaatttatttcttacagttctggaggctgggaagtcaaggttgaggggctgcacctggtgagggcctgcttgctggtgggaactctcagagtcctgaggcgaggcagtgcagggcatcacatggcgagggggctgagcatgctaatgtgccagctcaaatctctcttcctcttcgtatgaagccaccagtcccactcccaggataaccgattaacccattaatccatgagtggattaattcatttatgagggctgtgccctcatgatgcaataacctccccccccccttttttttggagacagagtcttcctctgttgcccagactgaagtgcagtggcacaatctcagctcactgcaacctccgcctctggtgttaagtgattctcctgcctcagcctcccaagtagctgggattacaggtgcccaccaccatgcccagctaatttctgtatttttagtagagatggggtttcaccatgttggccaggctggtctgaaactcctgacttcatgatccacctgcctcagcctccctgggattacaggcatgagccaccttgccctccccaattatctctcaaagtccccacctttccatacagccacactggggattcagtttcaacctgggttttggggaggacaaaccctcaaaccattacaccacacagcacagtgtggccaattcccccttgcctctttgatctatctctggcttctggaaagtcacttatttcattttcatggcactggccaatttctcctttgtttggcaaaaatgtttttccctcctacctccacttccctcatactgctcccttaataggagccccctcctgttttgttcctccagtcagtaggtgccctttgagatcctgccaagtggaccacaccaggccaggcattaagggggatatgaggagaaccagaagaaaagctgaaaccctcagctgcaaagtgtggggaggctgtaactgatacagtttgggactgtgtccctgcccaaaaatctcctgttcaattgtaatccccagtgttggaggtaaagcctggtggaaggacattggatcatgggggagggtttctcgtgaatggtttggcaccatcccccgtggtgctgtctttgtgacagtgagctctcatgagatctggttgtttaaaagtgtggagccaggctgggtgtggtaactcacgcccataatcccagcactttgggaggctgaggtgggtggatcacctgaggtcaggagtttgagaccagcctggccaacatggtaaaaccctgtctctactaaaaacataaaaaaattagctgggcgtggtggcgcagcctgtagtcccagctacttaggaggctgaggcaggagaatcgcttgaacccgggaggcggagattgcggtgaactgagatcgcgcccctgcactccagctccccacttggtctcttgcacctgctcctcccaggtaagacacctgctcctcccaggtaagacacctgctcctgcttggccttccgccatgattgggagcttcctgcggcctccctagaagcagatgctgccatgcttccggttggcctgcagaaccatgggccaatcaaacttcttttcttataaattacccagtctcagctattgtctcacagcagtgtgagaacagatgaatatagtattctaggtgggaaataccaacgctgctttttccctgttctcttgggtgggacaggaggacgccctgcactgcttcttccagcccagggagttatcaagcaaaagcaagtgcttctgtgagaactgtgggaagaagacccgtgggaaacaggtactcattccctaaatcagactcagctgtccctcggtgcatatgggggatttgttccaggacccctgcttttaccaaaatccacacacactcaagtcacacccagtcggccctgtggaacccacgtataggaaaagtcagtccctcatctatgcggttgtgcatctgggatactttatttttgatgagcatttggttgcagatgtggaactcgtgcctatgggggagggcagactgtatttatttacaacaatttgtgtataagcggacccatacagtccaaacccgtgctgttcaggggtcatctgtccttcactagtctggggttgccccccgtggatttcctgatagaatcatcagaggccccgaggacaccccatggtgggtgagaaagggaatctgggtctggctagtatctgggacgctgtggttctgatatctggagccgtggatgtggcttctcatgtcgcatcactgagagggactgcaggagggcgcctgagagcagccggcagggcgtttccctccaggcgagaccagctccctggagcagacgcggtggctccctgggtcctggtacctgtgcagagccctgtgcccttgtgcctcttgtggggggccacatggtggtagaatagccaagttttgcattattctcagaggagctcagcagattcggcgaacaggagccttgaactccgtgatgtcgccccgctcccctctttttgggaagaacgcgttgctagccctgacatttctctgactctctcattccaagtagacttcatctccagagtgattttgatttttcaggtcttgaagctgacccatttgccccagaccctgacaatccacctcatgcgattctccatcaggaattcacagacgagaaagatctgccactccctgtacttcccccagagcttggatttcagccagatccttccaatgaagcgagagtcttgtgatgctgaggagcaggtgggatgatcccgacctccttgccatcctgcctctccccagatgccatgtcctttctgttttcccttccttcacccccagtctgctaggagccacctgttcctcagagactgtccccagcctcaaaagcctttcttctttctaaatattggatttgtgttcatatgcctcacagcactgagggacagaatccagaattcagtaggcttctttggaaataatgtggaatacatagaaatgcataggcaaacatgtcattgtgggttcatagtaccaaccaaactttcttcctcagatggcctgtgcccactttgaggataatcataaagtagccagttgactggaccacatttaatcagagtaaagtttaattcacttgtcctgagataataacttatcaagagattctgagaaaaaaagagacacaaggccaggtgatgtggctcatgcctgtgatcccacacctcaaaaggctgaggcaggaggattgcttgagcccaggagttcgagaccagcttcagcaacataatgagacccccgtctctcaaaaaaaaaaaaaaaaattagctgggtgtggtagcacaaacctttagtcccagctacttgggaggctgagttggaggatcacttgagcccaggagtttgaggctgcagtgagctatgatctatcattgtactccagcctgggcaacagcgcaagaccccgtctctaaaaacaaaacaagaaaaactaaaaaaaaaagacacaaatatctttttttccatagatttgaaatgctacataacaaattttgtattcctgtatgtacgggtctatttttggagtgtctcttctgttttattggtctgtttggctatttatgctctagaaccatgacatttagaaaattaagacctgataatatgttacaatagctcctattataacatgatttctttacctacttaggccgtatacatttcataggattctctttttctttccttctagttctttttatttctacctgcagattctgcccaatgaagtgtatttaaaattgtttttcacttaaaaaagacttttttgactggatgcagtgggtcacgcctgtaatctcagctctttgggaggccaagaggattgctggagtccaggagtcgagcccagctggacaacaaagcaagactccatctttgcaacaacaacaaaaaagactttgttatggaacattacaaatagataccaaagtgtgtagtgaaggaagagttagacagtgaatccttggctgtaacagttaccaaaactcatggcaggtcttgcttttcctataacccaccctcttgtttcacccaaccctgtactggatttttttgaagcaaatcccagacatcatactatttcatttataaacacttcattatgtatccctaaagaataagcactcaaaagataatcatctccatcttgcaattccttaatagcatcaaatatctggtcaacgttcagacttcctgactgttgtgtaatctatgtggtttgtttgactctagatccaaacaacgcctacacttgcatttggttaagtttctttcttttcttgagttccttttagatttccgctccttttcttttccttgcagttgatttggttgaatatttttttcatatgccagcactggctggttgatatcttttaacatgttcctgtaacccttttatttcttgtaaactaatatttagatacagatattgccctgcattttgtaaagttctgcacaaagtctgcaaatggaaatagggataatttcagcctccactgtgggtgactcagctttgcgtctgccgcccttgccctctgtctcccctccccctacaaaagacttttttggctgggtacggtggctcaggttagggtcattcctgggcttgtggagaaacagaactgtgttctgatgatccccacccctcccaggggaaagttctaatcttgccttggctttgggggcctctctcatgacctgccttccatctcttgcgtgctctgccctgccaagctgctgagccttcgcagttcaggatccacactcgggaaagcccctcctggagggtgcccactggctgtgggtcgggactgttttctaatattctaaagtcccagagtcgggcctagtgtgggcaggtataaatgtgtgaggcagtcgtgtttgtggtggtgggtgaactgtctcgtgcctgtctctttccagtctggagggcagtatgagctttttgctgtgattgcgcacgtgggaatggcagactccggtcattactgtgtctacatccggaatgctgtggatggaaaatggttctgcttcaatgactccaatatttgcttggtaagaaacatcatccacaattgcctcctgccctggattggccacctctagcaaatgctgggctcagggctgcgtgggtctctgagatcaagacacactgtgatcctgctgtctgggtgtggggcctttgatgagggttcaagcctttttcggtctgaagtccccatgtggtttgcacctctgtaagggttcaattcacttcacttctaagtttttggtgctctaggctcatgctctgcagcttcctgctttgtgggaaatgtctagagagcaacgagtgttagaaatatgtaagttaggcctctgggataagcatgaccaagtttaaacacagggacaagggcactaaacatacttcattgcacaagacatcctgctgctgttgctccaggctcttgggagttgctaggggtgggcttgtctggaggatgaggggcacattatagcatcctgtcctctgtgggtgcttgtgtcagctggctgcttgaccccatttgtttctggcttccaggtgtcctgggaagacatccagtgtacctacggaaatcctaactaccactggtaagaaacagatttgggtaattggagtctgatgagctcacatagggtccttggagctgcatgaaacgcccatggattcccctgttactaacatgctgatggctcactgtccgcctcatctccagcactcaccccaccaccccatgtttgcctcacacgtcacactccaggaatattaaagtacaggtagctgccaatcagccgtgccctccatctcccgtctgctgtgcacatgcacttcctggccgtattgtcctctcctcgtttaccatctaggccaactccccactcatgttttcatactcatggccttttcctatcctgtgaagcctttgctgattcacccagattcgtaggggcttcttgtatggttttcttttcttttcttttctttttttttttttgacggagtctcgctctgttgccgggctggagtgtagtggcacaatcttggctactacacttggctcctcctcccaggttcaagcgattctcctgcctcagcctcctgagtagctgggactacaggtgtgtgccaccacgcccagctgattgttttttgtatttttagtagagacggtgtttcaccatgttggccaggatggtctcagtctcttgacctcatgatccacctgcctcagcctcccaaagtgctgggattacaggcatgagccaccacacctggccttcttatatgcttttattgcatttgagcatacctcttttacagcgaagatcttttttttaatttaattttatttttagagatggagtcttgctttgttgcccaggctggagcactgtggtgtgatcatagctcactgcagccttgaactcctgggcacaggtgatcctcccacctcagcctcctgaatagctgggactacaggcatacagtctgtacaccatgcttggcatattttaaaaaaatgtttgtagagatgaggtctcgctatgttgccaggcttgtctcaaactgctgggctcaagccatccatccatttcagcctgccaaagtgcttggattataggcatgaacactgcgcctggccatcacactgtttttttgtttgtttgtttgtttgttttgagatggagtcttgctctgtcacccaggctggagtgcagtagcaggatctcagctcattgcaagctctgcctcgtgggttcatgccattctcctgcctcagcctcctgagtagctgggattacaggcgcccgccaccacgcctggctaattttttgtatttttagtagagatggggtttcaccgtgttagccaggatggtctcgatctcctgacctcgtgatccgcccacctcggcctctcaaagtgctgggattacaggcatgagccaataaatatttttataatcattaactaccgaggagaagctggagagaaaaaaggtggatgaagttaaggcagagagactttgtaagtttcttagctgagcttttggagactgtatatcagagatcctatttgaggtgattttcagctacagagataggcctggtcatttgaaaaataatggattaggtgaagcttgcgtttgaaatcctccttctacttttcatctttctctcttgtttattctgaacatccatcttagacacccaatctttgtcactttgtggttgtcattgatttccctgttattgagatcagaggttggcagactttctctgtaaagggctggagagaaagtacttcagactttgtggtctgtgcggtgtctgttgcaaccacttaactctgccctgtagagcaaaagcagccgtagacagtacatgggcagatgagcatggctggggtccagttacatttacttgcaaaaagagggttggagactgggtgcgatctcccacctttaatcccggcaatttgggaggccgaggcaggaggatcacttcaagccaggagttcaagaccagcctgggcaacaaagcaagactccatctctacaaaaaaataaaaattattatagctaggcatggtggtacacatccatagtcctagctactcaggaagctaaaactgaggcaggagggtcagttgagcccaggagcacgaggctgtggtgagctattattgtgccagtgcactccagcctggtgacagagcaagaacggtctcgtcaaaaaataaacaaaaggctgggcacggtggctcacgcctgtaatccctgcactttgggagactgaggtgggcagatcatgaggtcaggagattgagaccatcctggctaacacggtgaaaccctgtctctactaaaaatacaaaaagttagccgggcgtggtggcgggcgcctgtagtcccagccactcgggaggctgaggagggagaatcgtttgaacctgggaggcggaggttgcagtgagccaagattgtgccactgcactctagcctgggctacagggcaagactccattaaaaaaaaaaaaaaaaaaaccagcaaaaaccaaacaaaacataatgcatgttctctcttataaatgggagctaaacatggggactcattgacttaaagatggcaacaactgggaactgctggatggggagggaggggaggggtgaaaggccaactgttggggagtatgctcatatccacgtgacaaacctgcacatgtgcccgctgaatctaaaataaaagttgaaagtagatttaaaaaaccccaagagggctgggtttggcttgtgtgtccatagcttgttaacctccgctttagatattaactaatagaaacatagtgcttatcttcccaggccacctattttgttcctctccaaggtgatggatagatgaaggcctaatccagccgcctggaagtttgctgacgcttgtcctgtcacggattaatgaagcattgttttctgatgaaggtttcatgccgctgtgctgatgtgtcttctcttctctctaggcaggaaactgcatatcttctggtttacatgaagatggagtgctaatggaaatgcccaaaaccttcagagattgacacgctgtcattttccatttccgttcctggatctacggagtcttctaagagattttgcaatgaggagaagcattgttttcaaactatataactgagccttatttataattagggatattatcaaaatatgtaaccatgaggcccctcaggtcctgatcagtcagaatggatgctttcaccagcagacccggccatgtggctgctcggtcctgggtgctcgctgctgtgcaagacattagccctttagttatgagcctgtgggaacttcaggggttcccagtggggagagcagtggcagtgggaggcatctgggggccaaaggtcagtggcagggggtatttcagtattatacaactgctgtgaccagacttgtatactggctgaatatcagtgctgtttgtaatttttcactttgagaaccaacattaattccatatgaatcaagtgttttgtaactgctattcatttattcagcaaatatttattgatcatctcttctccataagatagtgtgataaacacagtcatgaataaagttattttccacaa

SEQ ID NO: 2144 - DNA, 46422 bp, Homo sapiens
  source 1..46422: mol_type = genomic DNA
ccagacggccccacaaccctgcgcgtcgcctcagagggggcgcgcttgactgacaggcggcggcggcgcagttgcgagtgcaggtgagttccgggccgccaccggctgcttctgtgggccgggcctctgagcattggcgaccccagcccggctccgggctgacagggcctggcttcgccaggtacgccagacgcagcggcccggtgagcggagcccgggacccccccggccgccgccgcccctctcccctcctccggtcggcgcccaggggggcctctgggccccagcaccaccccactctgagctccctgggggctcgtggcttctccagaaccggggccgcccccctctcatttctgccggggcctgacctagcgttgaaagcatccgcgtggcgtctcgcgtctcgggcgctgacttttctttcctcgggctctgagccctgacgtgcgtttttttctttcggaacaaaagatgaccacttctctgcggtgctgacttagagtcccagcgccgactgcctcacaaataatggcccccagcttctccgcgaggagaggcgcgtctgatgttttgaagccacgcaagagggtttgagccgggggactcctcctcggtgcttgccggccacccccctggaccttcacgggtctggttttcctccttcggcaggtctgtcgctctaccctctgccccttccaccccgaagatgctgtgaggataaagtttatttgaaaaactggtatcagcaaacgcttaggaaatacctaaatgcataaataatggcttctaggacttttaagaaccccttaagtaacagtagttttccttttctcagtgtcatcccttactttgagaactacctcttattaagcagttactatgtggcaggccctgggcaaagcatcatctcattgaattctcccagcaatcctttgaggtagattgtttttcgttttacaaatgagaatgcggagtctccgaggggcagtgcacgcctcaagttacccagctaggaggtggaacaggaattggttgcaggtcagtctctgccgcacggtttgcacagggcctggcacggtaggagtgcagtagatgtttgctgctgctgcagctgctgttacatctcattggctagggggaggggccgatgggggctgtctggggttcccctttctggaagaccattccgaagcagggcagcatttctagaatgccttacgttttctctggaacagtctccactgagattgttcttctcttccttgggctggaaaaaatagtagactcgggacttcttgcaccagcgttttatctttggtcaaaagccatatattaaagtctcaaagtcttgccctctgcagactggttcagccaaacccagatgcacgtgcactcactggatacggagtccctgtcagatgatggagaggctccttgggaattgctgcaggagtccagggggtcaacgtctgcagctctcacgctctcagaggtggctctgaatctgcccatcaagcagcccatccaccagggggtactggacactactaaggaaagggcaagaaggccaggggcatttctggaccctcctcctcagctgaagtcccagggtacagatgagctgctcccacccttgctccatgaggccagaggacccagtgataaccaccacctgtgctgtggcagatctaattgagtgctctttagcaaaaggaatgctgaaaaagtggcagctatgaatctggcagtaagtggctttgccaagagactgcagcccaagtctcactgggcccttttaagcgtaggatgagactgtctctcaaaaggaccctccgagaaatacaggttctatgcagttcaaagatgaatccaaggtcttagtcttgtttgggagttcagttgttttaagaaaatgtacagattcaacctaggttttggttggtttcctagctcctttctggagccagatgaaatgttggcttgtttcagggttcagggagcattcatgtccgattggatttgggatccagcaacgtgatacagttcacagcccagctatagtcggcatccaataaatgtatttattggatcaatgtattcaacagattcttagcatttactatatgagcaggcactgttctaagtgcttgaaataagtcagcaaaagagacaaaagatccctgattagttgagtgtatgttctcacagtaaagtatgtaaagtgtgttagaagatggtaagtgctgtggaaaagaaacaaatagagcaaaacaagggaatcacctccgggagggtggcaaggttgagttgcaaattaaaattagcgcattctggtttgggatttggttggaaacatgacagataaagcagtggattgaatgataggccttgggttccagtcactgcctggtggttttaggggtctgtaagcttgaactttattttacaaaagcttttatttagagtgtacaccctgaactcaagtcctgattgtggggtatttaacagtgatgaaagagccaggctgttcttagccttttaccttagcaagacaaacagtatccaactggttctcattagcatgaaggaggaaacttggagaagccatgcacgttgacaacaatttttttttttttttttgagacggagtctcactcagttgcctaggctggagtgcagtggtgcgatcttggctcactccaacctccgcctcccaggttcaagtgattctcctgcctcagactcctgagtagctgggattacaggcgcccaccaccacacctggctaatttatgtatttttagtagagacggggtttcaccatgttggccaggctggtctcaaattcctaaccttgagtgatccgcccgcctcagcctcccaaagtgctgggattacaggtgtgagccactgtgcccggctaacaacaaatatttaaaggcaggaaagtggcagtgctctttggctccagtgagcagtcatggctcaataaatagaaatttcaggagagccaatttccattgattataaagacttaggtttgtagcaactagagctgccctctgggaaaagggtgattttatcatcaacgactgctcaaactgggtttggagaacaacccagtatggcttttacagagcagagttgtgccttaaggggaagatgcatggtttctaaacccctttaaactctgagattgcatgggggaaggcagctgcagatcatgctgcctgaaaagagaggatctgatttcaggccccagaaatcatgattttcctagttcttagtttccgcatctctaatgtgagttttttctaaggtttctagtctgagcttcgagactgagtttctgctcatgcttactcaccactgagtgtgaggcttttaatgacctgggccagtgactggctgcagcctagggtagccccaaacccacgccttctccaattaagggactcttccggacagagctcagagcaaagggtagtagcaggctttgagctgcagggagatactgtcatatcctagactgaaggaagttaagctgagcagaaaaatgctctgaagaatgactcagaagaggctcttgtgaggaagcttccttggagtacgcgtgtttggatttggggaggtgaaggtcgtccccatgccaggctggccggggctgtttgtgacatcgtggagctgagtgttcagagcatgggcttcagggcaggtagtcgtgggttcgaattttggttctgcagctcagtagctgtgtgaccttagccagttattccacttctctgagcctcggtgtctccattgttagtgatggagatggatttagtttggaaccttgccacctcccagggtggttgtgagggtccagtgaggtcacatgtgagaacaccagactaagatgttagtgtcagttccaatattcagggccgtggggcagggggaagggcgatgaggagacacagaagtgtgtgggcagcagagactgtggaagtgtggaggcatggggaggcctgagggctctgcttcgagagtcagaggatggtggcctccgagtgaggactgggttaagggaaggggtgggtgtgtctgggacttagggagaatgctgttgtgtggaggtagagtaaagacagcaggagggagagaaagggtgtgcgagggccagaggggactgtggagggggtgggcacacaccctgtgcggggctgggggtgtgagatggctaatgtggttggggtcagcgtgggcagggctgtgggcatcgttgtgtgggtgggaggcccagaagtgtcgccctccccatcctgagggactggttcctcgctgggaggaggaggatgtagccagaacctctgggaaaacaatgagtaacaggcaccagaggcagccaggtccagatgtgctgcctacctaggaccacaggctgtgctggctggtccctcccctgcccttcctcaggccttgcccctccactttgcccctgtgggtggagtggcactttcccccaccctggaggcccagggaaggaaagctgcctttatgagcctgaagcatcttggaggtctcctggggccagcaatggtgggctctttgccaaaagtctcaggccttcctccccccatcctgtgctctcctgccccaagagaggaggctctggtgggccgggagggcggggcacacgctgcaccttgctgacttgttgtacagtaggtcctactctgcgtggctgcacctggaagcacgttctttcagctgcacaggtgtctttcccttttggcctttatgaaatgcctgctgtgcacactccatatatttgcacagaggcacaggtgggacggaaagagtggggaaagcagacacaacctgctcgcttcctgctgtgttgcttcctgtctgggaccttccattcctcctctgtgagatgagaaacagccgcccttgccctagagagtgggtgaacaaagccctgggtaccaggtctggaggctcagtgggtgctgggtcctggatcctgcgatggggctgcctgttccagaaaacccgctccctgctcccacctcaaaggtgagaaagggaatctatttttttaaaaagtcaaacttaagaaaaattacaagaatacaatgaactcccacatacccctcacctagattcacgaattagtaacatttgccttatttactctaactctaatctctatagttattgtcataattattgctgattcaggtaggagtaagctgcagacatcacagtccttttcccctaaatatcccagcgggaattaactaagaataaggatattatcatacataaccaaagcgtgagttccacctttagaaactttttttttttttttttttttgagatagggtcttgctcttgtcacccaggctggagtgcagtggcgccatctcagctcactgcaacctccgcctcccaggttcaagtgattcttctacctcagcctcccgagtagctgggactacaggtgcccacaaccatgcccggctaatttttgtatttttagtagagacggggtttcaccacgttggccaggtttgtctcaaactgctgacctctggtgatccgccagcctcaacctcccaaagtgctgggattacaggcgtgagccatcactcccggcctagaaactttcacattgatggaatcatgtatttgtttcccagacctgccataacaaagtaccacagactgggtggcttaaacgacagagatttattttctcacagttctggaggctagacgtctcagatcaaggtgccgacaggtttggttcttctgaaggccctttccttggcctgcagatggccatcttctcactgtgtcctggcttggtctttcctctgtgtgagtccggattttctcatctcataaagataccagtaagattagattagggcctgccctaaagatcttattttaacttaattacctctttaaagacattatcttcaaatatgattacattctcaggtcctggtggttagaacttcagcatatgaatgggggagagagaacaattcagtccataacaaatactatgatctaacaggcagtccacactcaggcatgctggttgtcctggggatgttctttgtggcatccccccacattgacccacaatccagctttgttatgtctcctcagtgtcttgcctggaacagtttctcagccttggtggagaaagggaaccttcacgttgcagggaagcaaaggtgctcagcaggaatgggggttcagaagcgcaggctgccccaggacagggaagctgttgaagggtttgctctagtccatgaagttgcctttcctggctttttctttgatgtcaaaagcaccaggaggtgagcttagatctcaggaagcgcaccaagaatccgtgcatgagtcccctgcggtgtgtctgactccatcaccatggcgcctgttcgttgctgggctggttggcctgcagagccctgagtggtctcatggagggtgcccttctgagtgaccttgagcatgtgacttctattcctaccaatttcagtgtcctaatgtatagaacagccagtgacacaaattatagtagtaaacattttttgagcattcttgtcatgcaaatcaataaaaaatctgagccacccagaaagtccatgaggccctaagtcattcaacttagcgtttactgtgcattggctcacttcatcttctcagtaaccctaggtgctgtcattgtccccattttatgaatgtggagactgagcgatttatctaaagtcacagacttgcaaggggcagagtgaggtactgaacccagggctacttgtccctgtaatttccttccatagtgaccgttacctcccgggataatgtatgtgcagcagctaaccctcagtgagtgtaggaaacagaggtgctggtggtgattatcacctccctagtgtctgcttgcaagtaccctgaggttgaagtatgggactctgtacactacaagagcagggcctatgcctggctgtttcccagcaccccaagtcactgttcctaaggaggtacatggtcagtgttggttgggtaccaaaaggaagcaaaatgataactttcagacagctgagatatgcaccctcttgtcgacccccatgcttccgatattttaggtcctgtgtgtggaagtttttttttttttttttagacggagtcttactctgttgcccaggctggagtgcaatggcgtgatctcggctcactgcaacctctgcctcctgggttcaagcgattctcctgcctcagcctcctgagtagctgggcttacaggcatgtgccaccacacctggctaattttttgtatttttagtagagatgggatttcaccatgttggtcaggctggtttcgaactcctgaccttgtgatccaccctccttagcctcccaaagtgctgggattacagctgtgagccaccgcacctggccctttgtgtggaatattaagcacccagtgttttctgtactaccgccctttttccttcatagaaatgatttttaaccattaatttttaaaatgttagtaaaccttaaactttttatgttgcacatactcatatactgctgataggcagataaatgtatatactgtttctaaagggaagcttatcaatatctatgtagagccttcaaagcacacattttgaccaataatttttttttttttttttggtcaaagatgtaggccgggcatggtggcgtacacctgtactcccagcactttgggaggccgcagtggacagatcacttgaggtcaggagttcgagaccaccctggccaacgtggtgaaacctcgtctctactaaaaatacaaaaattatgtgggtgtgatggtggattcctgtaatcccagctactctagaggctgaggcaagagaaacgcttgaacccaggaggcggaggttgcagtgagcagagatcacgccactgcagtccagcctaggcaacagactaagactctgtctcaaccacgacaacaacaaaaagacagtctggtcgcagtgactcacgcctgtaatcccagcacttgagaagctgaggcaggcggatcacctgagatcaggagttcaagaccagcctgaccaatgtggtgaaacctcatctctactaaaaatccaaaaagattagctgggcgtggtggtgtgtgcttgtaatcccagctacttgggaggctgaggcagcagaattgcttgaacccaggaggtggaggttgcagtgagccgagatcacaccactgcactccagcctgggtaacaagagtgaaaactccatctcaaaaaaacaaaacaaaacaaaacaaaaagatttagtcaaagtttcacattcctggtggctcacacctgtagttccagtactttgggagtccaaggcaggcagattgcttgaacccaggagttccagaccaatctgggcatcatggcaaaactctgtctctataaaagaaaaattaaaaagtagccaggcttggtagtgcatgcctgtagtcctagctacttggggggctgaggtaggaggatcacctgagcccagggaggtagaggctgcagtgaaccatgatcacaccattgcactccagcctgggtgacagattgagacttgtctttaagcaaaacaaaagattcatattccaaaatgtttctcagtgccttctttataatggcaaaacacacatacacaaaatacaaaaataccacgtcctatgatggataaataattcagtaaggggttgtatagcttaaattatatgtggtataatattattcacctattagaaatgaagctgaaaagaaatttagtgacattagaaatatataaaccaaaaaaagctgtatacaaatttattggttatattgcagtttatttttaaaatttatatatctggttgggcatggtggctcacgcctgtaatcccagcactttgggaggcccaggcagatggattggttgagctctggagtttgagaccagcttgggcaacatgacgaaaccccatatctacaaaaaatacaaaaattagccaggcgtgggagtgtgtgcctgtaatcccagctactcgggaggctgaggtggtaggatggcttgaacctgaagtggagagtgtgttcagtcgagatcgcaccactgcactccagcctgggtgacagagcgcgactctgtctcaaaaaaaaaaaaaaaaaaaaaaaaattatatattcgtacatgtaaataagacttaccaaaaccaaaaaggtaaccatattttttttcctgtacagcaggattacaggtgatttttatttcattttatgtctgtgtctgtttccagcttctatgaaggtatatatcaaatttatgaaaaccagacaaaaatgcctttaaaattttcaggacaagtaggagaagatgaaaaatttgaatacaacatggaggtaaatgaggcaaaaatgaatattgagagggccggtcatggtggctcatgtgtgtaatcccagcactttgggaggtggaggtgggcagatcacttaagcccaggagttcaagaccagcttgggcaacacggcaaaaccctgtctctaccaaaaatacaaaaattagccagtctcataacctggtctctaaataaataaatagataaaaatacaaaaaacacatgttgagggcacttcttggcccctgtgagtcacctggagaagtgtgcttaggagccatccaggtagcagctttggggacttctgggaccactcagatgctcccaccccttctctgaaaaccaccctgtgtaggctcagggcagtgcctggcacaggggcctggagagctccagggaacagaggctctgtcccctatggtgccctcaggagtttggggaagagcaacatacctaggaagccagatgcacactcttcttattttcttattttggaaacttgaaaaaccattaacagtaaccgatttaggtattttttttggtttgtttttgtttttaggagcagaggtttaacaggcaaaagaaaaagaaagaaaggaaaacagctctctctctagtgagagaggggacttctgagaggaaaagcattttttgttgttttttgattttggttttgttttagagatgggttcttgctctgttgcccaggctgtagtgcagtggcacaatcctagttcactgcagccttgagcttaagggatcctccctcctcagcttcccaaaagcactaggattacaggcgtgagccactgtgactgaccttattagattattagattagaatgattataacacagtcattcaggaagcaagtataggaagaaaaaaaaggcaacacaagttcattgtagaaaatgcagaaaagcaaaaaggaaataaaaatcacttgactctatcctccagaaaagatgatagcatcctttctctaggcctaaaacacattatttcaccaaaataagagtttactgtaataataggttttttttgttttgttttgtgttttgttttttttgagacagagtctcgctctgtcgcccaggctggagcgcagtggtgcgatctcggctcactgcaagctcagcctcctgggttcatgcctttctcctgcctcagcctcccgagtagctgggactacaggcgtccgccaccacacccagccaatttttttgtattttcttttagtagagacggggtctcaccatgttagccaggatgatcttgatctcctgacctcatggtcctcccgcctcggcctcccaaagtgctggggttacagtcgtgagccactgcgcccagccatatatatatatatatatattttttttttttttttttttttttttgagatagggtcttaccctgttgtctaggctggaatgcagtggtgccatcatagctcactgcagcctcatacttctgggctccagccatcctcccatcacagcttcccgagtagctgggactacaggtgcgtgcaccaccatgcccacctaatttttaaattttttgtagagatggggtttcaccatgttgcccaggctgatctcaaactcctgggctcaagcagtcctcctgcctcggcctccaagagtgctggaattacaggcatgagccgcccaacatggcctaatagtgttttataactttgtattttggggccattcagcaaatattttctgagaagttactgtcttttttttttttttttttaagatggagttttgctcttgtcacccaggccggagtgcagtggcacgatcttcttggctcattgcaacctctgcctcccaggttcaagcgattctcctgcctcagcctccctactagctgggaatacaggctcccgccaccacgcccggctaatttttgtatttttagtagaaacgaggtttcaccatgttgcccaggctggtctcaaactcctgacctcaagtgatccgcctgcctcagcctcccaaagtgttgggattacaggcatgaaccaccatacccagcctgacttgttttactgagtaggtgtctttagggttcatgttgtagcgtgtgtcaaaatttccctttttaggctgaatcatatttcattgtatgggtatatcatgttttgtctattgatgggcacttggtttgcattgtcttttggctgttgcacataatgcagctatgaacataggtgcacaaatatttctttgagttgccgtttttagtgcatttgggtgtatacccagatgtggattgctcaatagtgtggtactattttacagttcttgaggaactgccatactgcattctgcagcagctgcaccatttcacattcccaccaacagtgcacagggctccaatttatccacaccctcgccaacagccaacacttttttttttttttttttttttagatggagtcttgctctgtcgcccaggctggagtgcagtggtgcgatctcagctcactgcagcctccgcctcccaggttcaagtgattcttccacctcaacctcctgagtagctggaattacaggcgcttcccaccacactcagctaaattttgtatttttagttgagacagggtttcaccatgttggccaggctggtctccaactcctgatctcatgatccgcccgcctcagcctcccaaagtgctgggattacaggtgtgagccactgtgcctggcctcattctgatttaaaatgcttttaatcaactttattgaggtataatttacatataataaaatgcacgcactttaaagatacagtgcacacgatttgacaggtgtatacacttgattaaaccccacaccagacaagatctagaacattccaacaccacagaaagttccttcttgtctgcaacataactctcccctttgccccaggcaatcactgatccagtttctatcatcatcagttttgtctgtcttggaattttatataaatagaatcatatggtatatatgtttttgtatctgatttttttttttttttttgctcagtttaatgtttctctaaatccgactcatgatttagagcaagactctgcaccacacagatctgatcagggccacacctgttacaaactagccaggtgggccgagcacggtggctcacgcctgtaatcccagcacttgggaggctgaggcaggcggatcacctgaggtcaggagtttgagaccagcctgaccaacatggagaaactccatctctactaaaaatataaaattagctgggcatggtggcgcatgcctggaatcccagctactcaaggggctgaggcaagagaattgcttgaacccgggaggcggaggttgcggtgagctgagatcgcaccattgcactccagcctaggcaacaagagcgaaactccatctcaagcaaaacaaaacaaaaaaaactagccaggtgattgacctctgccaagttcctgagttacttaagttccaattctgtgtcttcatctgtaaaatgggagtagtgagaatacattgagggctgttagccacagggctgatttttctctctgaagttgcaagaatgtaagtccaattgcacttgcaaatcaagagtgagtctgttaaattagccgggcatggtggcacacagctgtaatcccagcaactcaggaggctgaggcaggagaatttcatgaacccgggaggcagaagttgcagtgagccaagatcatgccactgtactccagcctgagcggcagagtgagactatctcaaaaaaaaaaaaaagaatgggccaagttataacctgcccactccctccccagccacccgactggagagatgatcacttaccaaagatgctagcaaaacccacaccactgcagcttaaaatagtgtaagactagtgccgactcagggcacatggcctcagcagaaacaatgaagaaaactaaaaaacctggcttcaagtgaggaggtttggaatttggaatcttgaagctgtcattgtcatgtgactattttaaatggtagcttctaactgcctctccctctttgagctgtccacatctgggaaactgtgacctgccagtgaagtgtgggtagtggcaatgtgtggatgagcccggttgtgcctgcagcctgggcctgctgaacacttgagggtcgggggttctcaggaaatccctgagagctcaaaggatggcctgaggggcctggtggcatgtgtggaaggggccaggccttcctgtccagagggttgatggactgtggtagcctgatgggacaataggagaggccctgtagacccctccagcagacctgtgcaggtttcctcctggggagcaccaaggtaatgcctcagcagtgactagtgaaggccagcactccctaggaggggctgcccctgcgtgccagctctgcctgagccttggccagctggcccaggagtgatgtggtggtattgctctctggctgcacagggagtagtctagcctgtggacatccccaatatcctgaaattagttcctcccaggaggaatgctgggccctttttagcttctagttggtgctaagagtgattttaaaataacggaactgtctgggcacagtggctcacgcctataatctcagcactttggaaggcctgaggtgggaggactacttgagcccaggagttcaagaccagcctggacaacaaaacaagaccctgtctctacaagaaattttaaataaattaggtgggtgtggtggtgcacacctatagtcccagctacttgggaagttgaggtgggaggattgcttgagcctagaaggtcaaggctgcagtgagctgtgatcatgccactgcaactccagcctgggcaagcgagcaagaggctgtcttaaaagtaataataacagaactgtgtgaaatgctctggttcatcccccaggctccttgccagaggcctccactcactccagacccctatagcccgtcgctgtcagctgtcaacaaaggatgcgaatgctggccgcttcctgtgggcttcgtgtcacccagaggtaagcccatggcctcctctcgggtcccttcaacacggactgaggaggacacatggatttttctctttagatgaaagaatggaattgtgattatggggtttttttttttaagtctttatctcttagaaaaatacagatggaatgtgatcgcctgtgtgtctgggacttgctacaaaagcaagaggaagcaggaggttgagatgaagcaagattggccatgagttgttaattgatgagtctaggtacatggaaacatggaagtgcgttatatagtttggtctactttgttttttccttttttttctttatgctcatctttaatgtgacggtaagttctgcctgcttttcacatttacattttctataagttagaaagcaactgagcgggcccttaggatctgacccacttgaggttcagctctagcgccaacattcctatgagaccttagacaagaaggagcctctgttccttagtctgtgaaatggggctgatcacagctgcctcaacgattgctggaagagtttttcataaacgaatgcacaaaaagcacttggtttggtatctgacacctcatgagttttagtaactcacgttctgaatgagaatctggccagttgaccctggctgaccatttgggacagggaggggcacgtaaggaggagtctgggggtccacctctcagatcaggtgggcacacatgcagcttctgcctttgttttttgttttttgtgtgtgtgtgtgtgttttgggatggagttgcgctcttgttgcctaggctgcggttcaatggcacgatgttggcttgccacaacttccgcctcctgggttcaagcgattctcctgcctcagcctcctgagtagctgggattataggcttgtgcatcatgcccggctaattttgtatttttagtagagacgggatttctccatgttggtcaggctggtcttgatctcctgacctcaggtgatctgcccgcctcggcctcccaaagtgctaggattacaggcatgagccaccgcacccagtcttttgttttgtttttaagactcatgcagtcacagaggcttctgcctttggttaaagcagtcttggctccagttacatctttggttggtttggaccttatttggcaacagtttgaagctataatcagcagtcagattcctggatttgattctgctaaaataccgtaggtgaagcatttatttagttactcatttttaaatgttttcttttgaaataattatagattcacaggcagttgcaaaaaatgtaccctaaggtcctttgtaccttcacccagtttcccctaatggtaagaataacacatactttttttttttttttttttgagatgaggtcttgctctgtcacccaggctggagtgcagtggcatggtcacggctcactgcagccttgaactcctgggctcacatgatctcctacctcagcctcttgagtagctgggactacaggcatgcaccagcatcccagctaataatacatcttagtatgtctgtagtacaatcagtaaactgacattggcataatccatggagcttattcagatttcactagttctgtaggcactcatgtgtgttcagttatttgcacttttaacacacgtgtagatccatgtaaccaccccacactcaagatacagagctgttcatcttcaccaaggtgctcccttgagggaagcatttattttctaagacagatatctttttatacccctgatttaaaagggaaagaaacgcaggagaatgttgggaaagatgtttgctacttgttatcagtgatttattttactttgtgctttcttgtttgagttttgtttttataatgaacgtgtatcagttagacagaagcaacagagctttttttttttccatctcttgaaacccatcacccagctgcaccactgctgatgttttggcaaacacagactgctttctaggttgttctcctgcctttctctctgactttctccctgctctcagaagacgttctctggaggcagtgctgcatggcctgctcccatggtggtctggtgttcaaacctcactccgcagggggctcccacaagacgtgggataagtggtctgccagcacttggcctccagaggctcttgagaagacctatgtcaacatctgctgcttgcctttttgaaacccagcctttctacactgccgccttctctgcctgtatccttggacggacatggatttggcctcctctaacaaaacatctgtggttttagattgtctggtgtgcagctccctgcatgcatgcaggactcccatgtcttccctaccaataattctgatcactacacctgtcacctgccatgggctttccctacatcagggactacaccaggcatttgacagacattgtctccgtgacctaggagcgacccactggggcaactgttatcttcttagacaaggaaagtgatgctcagagaggttaagcaacttccctgcgttaccagctggtttgtggcagaccaggactcaaggccaaagtcatgtacttaaccactcacctccccacctcctgccaacactggctgccattaacccgggattgcttgtgtcttctcataggtgagcccaggccaggatgggggactccagggacctttgccctcaccttgactccataggagaggtgaccaaagaggacttgctgctcaaatctaaggtaaagggtcagaccttacggggccagggcccacacccagggctgcctctttcctggggtgtggacatttctgaagcagtggaaaaactggttccctgacagtctctgctcagctttctgtgtaaatggaaatgctggcatctgcttgggaggccgccttccggaggctctgtcctaatagccattaattatagtttagacaaggccatttgggaaccactaatgctctctgtccattagctgttggggcggtgcacagagcctctccaaggcagggaatgaatgctgctttccaagttcaggagcgtttttacacaggtggctccaggagggctcagggaagcctgagcaggaagctgggcctcttctcagagtaggaggatgtgttgccatccttttggtgttgtgaaatgaaaatttttgaaaaggtaatacttgaacagggttacaaatgaaacaggacaaaaagataaatgtcaagaagtccttctctcacccctgtgcccaccctccccagcccacccccgggtaagcacttattctcttttgtatcttttcagtttctttatgtgaatacaagcagataaactcattttaagttttgccctttcttacataaaagatggtatacgatcctctctgttttgtaacttgctttattcacatgacagtgtatcttggagctctttggacatcagtgcatagagacagctttcacatttgttaccttgaagctgcatcatatttcatcatgtggccacagtgactgatgctctctgggtggacacctggaccctttgcagcctcttgccgatacacatgatgctgcgatgaatggccttgtagaaaagtcattgcatccatgggcagagctgcatgcaggcatgttcccaggagtgggattcctgggcatattggcacctaatgctggtcgcctggcctcgctgcaccagcaggtccttggtggcctttggcctgagctggttttgtcatggggcctggcatgggagcagttcttcatagtgcctatagctgcttttgaagtgactttgcctcttgcagcatgaagtggggcagagtgaggcccggatgtgtttgcactgtctggtgctgggtttctctccacttcttagggaatctgagagcaggggggggatgaagcaggtggcagaagagaggtggagcacaggaaggtttgcactgggcctggcagccgttcagaagcctgttagtgcctctagatcagagactgggcttgtctggggtgctctggggctgtgtgtcagagatcacaacttcagctcctctttgggtatccagaaagttacaaaataaaaccaacaccgttctaaaatactcagaaagagcaaggatatgagcaggtccttcccagtaaaagaggtagaaatgacaagaaactttctgaaaaagatggctgacttcactctcattcttatggatattgctaatgaaataggatgataccattttgcagatgggcggaaagagactgatcccattcatagctgacagttatggagaaaatgggccactcacgttgtggtagggctaggaattaccgtaacttttagggaaacaattctgcttctgggaatttatccagtagaaatgtaatcaccagttataaacatatgatacagcagtatttattgagcgttatttataaaagggaaaaactggtggcacctgaatattcctcaagaaaggaatgggggaatcaattatggtgtgtccagagtgtgcagttatcacagaggaatgaagtcttcatgtacagacttgggtgaccctcaaaggcacattacagagaaatatgtattgcatgatcttatttttactaaaaatcaccccctcaagatccaggcatacgtgttttatgtaagaagaatgtacggagggaaatatttcatatcatacacagcatatagatgtcatctgaattgttatagcaagcattcgatacttttataaatcaaataactgaaatggaaaaaaaactgggaagaggagggtgaattgtgaagtcaaaaaatcatgagagagatgacaaattcaggaaggtttggggctgcggttttgagtctgctaagcagactgatctcctggcacccacagcatcctccgtgagagaccctaaaccacagagtgcagatctcagcttcatcgtatgggacaagctgcttcacttcaaccccatgttcaggctttttacaaacacagctggaatctgggtgtagtgacaatgagaaggaggccatggaggcctgggagccaacatggccaccctgggggaagccaggctttcttggtgagaggtttgtgaccttgctgcactggggtccaggctcactggcttcacctgctgaccttgctctgtgacaagggtgtgacctctctgagtcccagtttctcatcagtgaaagggggatgttgctgggccctgctacagagactggaggggattatgtgagcagtgtgtaaagaactcagtgggctgggcacggtggctcacgcctgtaatcccagcactttgggaggccaaggcgggtggatcatgaggtcaggagatcgaggccatcctggctaacatggtgaaatcccatctctactaataatacaaaaaattagccgggcgaggtggtgggtgcctgtagtcccagctacttgggaggctaaggcaggagaatggcgtgaaccccggaggcggagtttgcagtgagccgagattgcaccactgcactccagcctgggtgacagagcgagactccatctcaaaacaaaaaaaaaaaagaagtttcttttctctcacagaacagaccacaggtaggtaggactggtagggtagctctgccattctcaacatgtggctttcatcctgagtccaaggtggttgcttcagctcctgccatcacatccacattccagccaatggtaggaggagaaagagcaagggtagcacacagcacagaagtggcacacatcgtttttgctagtttgactagaactgagccacatgatcatggtggaagctggaaaacgtcatctgcagcaggctagctgtgtgttcagctaaaatccatgcatcccattgttaaagcaaggaggagagaaaggattccagtagacacggagcaggctttgacgcccagaccgccagaaacctgggcgtttcctggggtttgccaggtctagtgaactcttcatttataccaggccctgtgaactcacaggggtaggcagaacagaccatccctctttcatggcgcccttgtctaatggggagaaaggctgaaataattcagtgcaagaaaggaagagtaaggggtgggaagagagcgtgttaacgagtctcttacatgattttattttccaagattaggttatagacactaaaatcataaaatgttgatttgaaaatgtttttacaggcacaggatagaattcaaacagtaaagtataaagtgctcccctgggagcctaatttggacaggaagtctggcgaaggcctttctggggccagggcttgaagctgagaccttctgagtgcatgtcagccaggtggggccctccaggcaggagcagtctcagtgctcagccccgcaacgggctcctcatgcctgctctttttctctcctctcaactcacacagggaacctgtcagtcgtgtggggtcaccggaccaaacctatgggcctgtctgcaggtaaaagacccttgtggccatcaggggtgtagagctgcttccacctgttatcagcactgcacaggctggtgcagtgggctagactctgggctgggaacttccatccctagtgggcactgccagaaaccttgggctggggcacaggggcacaggactccaaagtcagcgaatcctgggctggccattctggcagcaattaaaaatgacaggagaaaaaaataggtcggagaaggctctagactgaaggctcccttcttcataggacagtattctagcttggcatgaatatgtgtgagtcaacgtgggtgtcttggctttgaggcctggcactgctgctcagcagcgtctctacctgggccagtctcattttttccctgaaccttcattacccatctataagaaaggggctgcaacactgacagctgacaaccgtccccgcctcatggggttagggtagaactggacaagacggatgcctgtgactggccaggagacagtgtccgggagaagctggaagggtttgggtgattactggttactaaaaagagtaaaagtagatgtatgaaaacatgacagtttcctctgagtggtagaattatgggtaattttctttttttctctgtagtatttaaaaaatgtttccaagtatgtatttttatagtcatactaaaaatgactgttacttaaaatttctttaaaaaaaaaaacccacgagtaaaaacaacaaagacagcagcagcgagtgaagacagccagtcagtctttgcagaagtgcaggggcctccagtgggattctggcctcttctgctcagccctgtcactcagcacaaagtagatggcaagacactgcgtatccagggggcagcaagaagggctagatgttatctcctgggctgttacaagtgcaggacgtggtcctacctcataggagccacagtcccctcagacagatgtaggagcctgatgcagaaaatggcacgtgctttctgagtcagccacatgatatgattccattgttttcccagaaggccctgctgatcacaggtggcagtgacagcaggcgctcctgtaggagtatggcattggctactggctggcgtggaggctcacagtggaagcactgagcgggccttggaggatgggtagatttgggataggagagtgcgagggcaaaggcagtgtcatcaggggcatgtgggccctgctctggggcactgggtcagtactgggttcccactacctgtgacccttgtttcaaacacctggtccccattcatcatcccccattagaaaatggctgtgaggcctaggatccccaccaaaaacacaggtcccaataactgaccccacttcacatggggtttttgtggagggagagggtcttggtcccgagcagccaggccccagctgggaccccgcctgggcttcttgctggagagcagcagcccagggcatactgctcgtctcactcagagggcagggacgctgtttactgtccatcactgcccagcagaacttcaggtgtacagacctacagacccgtgttcctttgagatggcagagcctcagtcccttgtggcccctattcaggagaggtaggggcactgactttgggatggaaccagagacactgtgttgacaccatccttttggcaagctccagtccactctccttccctctcttcccaggttgcctgcccctatgttggctgcggagaatcctttgctgaccacagcaccattcatgcacaggtgagtgtggtggctgagagtatgggccctgcagttagatggcctggggttcaaaccccagctccaccttcccactctgggcctaaatggctggggcaataaatggtgtcatcctagcatagcttctgcaaagaagcaagagagaatgcaggtaaaaacattttgcatctgcaccatttgataagcagcagccctcagggtcctgactgggggtgggtaagcaaaatttgagcttccggcctctgtcctgacagggcctcttactgagaggctggggagcggagcagccattacaggttggggcacttgttaggctagagtgccctggaccttgttttggatatcaccctctaggcaaaaaagcacaacttgaccgtgaacctgaccacgttccgactgtggtgttacgcctgtgagaaggaggtattcctggagcagcggctggcagcccctctgctgggctcctcttccaagttctctgaacaggtaacctgtgtggtgggctctgtttggttgttggtgacactgtgttgaggatgaggcagtgtgacctgagcatccgtggagcatggggcagtaggtcccagaggtgtctgtttctgggtcagtatgttttcaggtgactttgaggagctcacatcagcacatgctcactgagcccaactctgtgccgaggcatgtgtgagaccatgagggtgcagaggtgactgagagtagggcctcccttgaggagctcggagaccatggggtggccgtgtggagtgcaggggttggggtgggcccagggccatgaggtgagtgtagacccttccaggccttatggagagggttgacaaggtcacagatggccctctggccatcccagatctgaaaccattcctaagggaattccaggtagttgctacagcacacttctctatgggaaatgcccagaaaccacctgggtaacgtcaaccagagaatggtcctttgatcaacagtgtgctgtgcaaccttagagatggcaggtcagcaagcctgtgacctggagggcccggccccaggtgtgtcctcagggaatggtcagtaatcctggatggcagagctgcctgctagaggagaagccaggacatgtgtgcagcatctgcatggctctctcctccatttattttattttattttattttattttaattttttgagaccgagtctcgctctgttgctcaggctggaatgcagtggtgcaatctcatctcactacaacctctgcctcctgggttcaactgattgtcctgcctcaacctcctgagtagctgggattacaggcgcccacgaccatgcctggctaattttcatatttttagtagagtcagggttttgccatgttgactaggctggtcttgaactcctgacctcaagtgatccgcctgccttggcctcccaaagtgctgggattacaggcaggagccaccgcacctggcctctccttctgtttagacagtcacatgatagggctcaatattgctcaaaatgcttattgaatgcatttgtgaacttggtagatatttatgaatttttatagaaaaggctataaaacagtatatgcaatatcttgtttttgttgtgcatgtgtattaacagttaaaagtctgtataatacaggctgggcgccatggctaatgcctgtaatcccagccctttgctgggccaaggcaggaggatcgcttgagcccaggagtttgagaccagcctgggcaacagcgtgagaccctgtctctacaaaaaataaaattagctaggcatggtggcgcatgcttgtaatcccagctacttgggaggctgaggtgggaggatcacttgagcccgggagttcaaggttgcagtgagctatagttgtgctactgcactccagcctgggcgacgagcaagactctatctcttaaaaaaagtccacatagcccaggcgcggtggctcattcctgtaatcccagcactttgggaggccgaggcgggcagatcacgaggtcaggagatcgagaccatcctggctaacacggtgaaaccccgtctctactaaaaatacaaaaaattagtcaggcatagtagcgggcacctgtagtcccagctagtcaggaggctgaggcaggagaatggcatgaacctgggaggcggagcttgcagtgagccaagattgcaccattgcactccagcctgggcaacagagcgagactctgtctcaaaaagaaaaaaaaaaacgtctacataagatacatacagactattaacagcagttctctcaggaaaatggggttgcatgtttatgtttctatttttctccaaatttattataaataaaatattttttttattgccaataaaaaaatgcaagtcaacatctggacacagtggctcatgttatcctaacactttgggaggatcactggagcccagtagtttgagaccagcctgggcaatataaaaaggttagctgggtgctgtgcatgcacctgtagtctcagctactgagaagggcgaggtgggaggatcccttgagcccagaagttggagtcagcagtgagctctgattgtgccactgcactccagcctgggtgacaaagcaagaccctgtctctaaaaaaacacagacacacacaaatcaaggagttcccagggcaaggccaccaatcctatctcttttcacagtaccttctgctcagctggactggctcagcccagtagggccttccgggcagtagggctggacttccagcccttgggagacacctgggcctctgaccccagcccctctgttcactgttttcctcactttgggtctttaacacaggactccccgccaccctcccaccctctgaaagctgttcctattgctgtggctgatgaaggagagtctgagtcagaggacgatgacctgaaacctcgaggtaatggcccccacagcaggggaagctgatgggctgggctgggggccctcatctggaggctggaaaccgccagagtcttggtctctatttgcacctgctatatgggcaaggaaggatggggtgacggataagctgtttagcatggtggcttcaccccagaagttggctggcctagctaaggttctggagagctggctatcttgtcccctctcccagctgggtgaccctgggcaggccgacccctctgctgtatggtctggacagtgggcctggctgggcggaggggcaaaggagttcatctgtttaaaacactcaggtaaccgcagctgttgtgagcaggaaccacgttagtttactgggaagattcctggggtggaacgcttccaccatgtcctcttcttgggtcttgggcagttgagagccacacctttgtgccaaatgtgacttgcaaggtttcctcggtggggcagggtgctcacctgctcctccccgttgtgtttatttcccaggcctcacgggcatgaagaacctcgggaactcctgctacatgaacgctgccctgcaggccctgtccaattggtaggtcgacactttgtccgagggccgagagctgtccctggcaaagccccggaaacagcagcagtagcagcccccagccggttgcccacaaacacatgtataggatgcacagcaaaatgcctgaaagcatgtataccctttgacccagcaatcctcccagtcagaatgtatcctgaggagataaccggagatgctggggaagttgtacgtgcaaggaggctcagtgctctgttgtttactggaaatgatttaaaggcccatctgcaagagagtataaattctcatagcccttgcagcaagtgcaggaaaaatggcacaagacaacatgcattgaaacaagaaggggttcagaatctggtgagtgggggaaaaaggaggttataaagcattgcatggtacaatcccgttttatgggagaaatgcgattttccattaaggataaggctgtgagctccatgaggccaaggatgtctcctgtgtctgacgtgcttctcctacccagtggaggttagagatgcagtatatgtatgcgggaagcagagagggaatgggtacaaatgcgtagaaaagtctggaaggctatgtcccaaaatgttcctagtaactatcctcaggtggcaggatgcaggtcaattattgttaataattgaccacacccaggctgggcgcagtagcccacgcctgtaatcccagcactttggtaggccgaggcagatggatcaccaggtcaggagatagagaccattctggctaacatggtgaaaccctgtctctactaaaaatacaaaaaactagctggacgtggtggcacgcacctgtagtcccagctactggggaggctgaggcaggagaatcgcttgaacccgggaggcggaggttgcagtgagctgagatcatgccattgcattccagcctgggtgacagagcgagactccgtctcaaaaaaaaaaagaaaaattgaccgcacccaatccgttttaactttaataacctctttaaaggccctgtcttggctgggcaccgtggcttacgcctgtaatcccagcactttgggaggtcaaggcaagtggatcgcctgaggtcaggagttcaagaccagcctggccaactagtagagcctgtctctactaaaaatacaaaaaaattagccaggcattgtggcatgtgcctgtaatcccagctactcgggaggctaaggcaggagaagcacttgaacccgggaggcagaggttgcaatgaaccaagattgcaccactggactccagcctgggcaacagagggagactctgtttcaaaataataataataataataaaaaaataaggtaagatagataagatgagataaaataaaaatgccctgtctctgggagttagggcttcgcagatgaattttggaggatacaattttctcataactggtaggagccttctagtcaccttcaggagtttctgggtccagggccactgtgctccctgtgcgagcactcagggctccccgctatgcagccctttctaaactgccgcatgcctcatttgctctcctgacctggctctctctcccctgcacccagcccgccgctgactcagttcttcttggagtgtggcggcctggtgcgcacagataagaagccagccctgtgcaagagctaccagaagctggtctctgaggtctggcataagaaacggtgagcagctgcatccctagccttgggcggtgtgtggggactggggtttcctgtcagcacccatgattgagtacttcctgtggattcagcccccagcgaggacttgcctcactttgtcccgggtaatgcttgcagcaagcctgcggggtggaaattgcatccagtcctgttttacaaatagggaaactgaggtgcagagcactttaagtatcttgctcaaggtcatagaacctgcaaaaagtgagctagaatttgacctactgttgaccctaccgagcagccactggtagatgtctttgccaagagacatggtgacccggcctcagccaggactgtgtgtgtagaaggaggtgtggggcaggggagcacagactggatggagcttctggcacagtatgaaattaatttaaagatcagagtctgtgattagatctgtttctccaggaaaagtcaaagttgggaataattttaaatgagcacatagaaatatgtattatgtgtagaagcggatgaaaaaccagcgtagggccaggcgcagtggctcacgcctgtaatccctgcactttgagaggctgaggcaggtggatcacgaggtcaagagatcgagaccgttctggccaacatggtgaaaccccgtgtctaataaaaatacaaaaattagctgggtgtggtggcgtgtgcctgtagtcccagctactcgggaggctgaggcaggagaatcacttgaacctgggaggcggaggtggcagtgagccgagatcgcaccactgcactccagcctgttgacaaagcgagactctgtctcaaaaaaaaaaaaacaaaaacaaaacaaaccagcatgggagaaatatgtattaaatgtagaagcagattaaaaaccagcgtggggccagatgcagtcactgacacctgtaaatccagcactttgggaggccgaggcaggagaatcatttgagcctaggagtttgagaccggcctggacaacacagcaagaccccgcctctacaaaaactacaaaattagctgagtgtggtgtgagcacttgtggtcccagctactcaggaggctgaggtgggaggatcgcttgagtccaggaagttgaggcaggctgcagtgagcttgatcatgccattgcacttcagcctgggcgacagagtgagaccctgtctcaaaaaaaaaaaaaaaaaaaaaaaagtctgtgtgcagtggctcactcctgtaatcccagtactttgggaggccgaggcgggtggatcgcaaggtcaggagttcgagaccagcctggccaatgtggtgaaaccccgtctctactaaaaatacaaaaattagctgggcatggtggcgcgcacctgtattcccagcactttgggaggctgagacaggagaatcacttgaactcgggaggcggaggttgcagcaagccaagatcatgccactgcactctagcctgggaaacagagcaagactctgtcccaaaaaaaaaaaaaaaaaaacccagcatggtacaatataattccgcttgtgtaagaagccaagtttaaatgtgtatctgtatgtatttttgtatatgcatctgtagtttcacagaaccagaaatctaatggtaagtatctggtgccattggtggtggtgtttttctcttgtacttttctgaaattttagatttgtcaataatgaacatgtcttacttttgaaatgagaaaaccacagtaagtgtttcagaatgaaaacaaatcatgtttaggcgagtttgttgtgcaccagaaggaaatgatgctattttatttgagctctttgcttaattgaggcagctatgacttgacattttcttcttgtctgtagagatgtgtgagcctcttggggctcctggctgagtaggcccctccccaaatgtcaggaaacgccacactctgatccagcctgacgggctggctgcctgcttctctcgggaatgagcagctcaaggcaggctacctggactaatgggtttgggcttcctacaggccaagctacgtggtccccaccagtctgtctcatgggatcaagttggtcaacccaatgttccgaggctatgcccagcaggtaagccatctgagctgcccaggggacacccaaggccatgacccaccaggcctgactttgacgccaaaaccagagtggaaaatcgcaatggcagctgagcactggttggcaggtctcacggaccaggctctcactcctaagcccttcacacgtgtgaggacagtggagcctcccagcaacctgctgacatttaaccccacttcacagatggacagactgaggttcaggggccgagccacttgcacaggccacacagctagtaaatggtggaggggaattcttttttttgtgggggagggtgggtacagggtctcactctgtcacccaggctggagtgcagtggtgcagtcatggcttactgcaccctcgacctcccgggctcaagcagtcgtcccacctcaggctccgaaagtgctgtgattataggcatgagccactgcacccggcggaggggagatttgaacccaggcaaccttgctgcagggcctccgcgttgcacccaaaatgacacagggtttcatttccccaaaccacaggcaaaatttcacttttattaaagtaaaaagtttgattaaaaattttttttaaatctagagaacccttttgaaaccaatcacatttttctattttataaaataatgagaccaagacagagtgcagccacgcgtacacctcagccccgggctgatggctcctgccctccagcctcctgccccagatggcccacagcctgggctttcatgccaggcctgcaggcagagctggacctggctgggtcacctcttgtgctgcctgaaatgagcaccatggacggagtggcagtcatgtggggacaacttccgccctctaccccctgcctgctgtcccgtcccaggatgaagtctgctgggcctttggctcctgcttgagaagctcagcactgcctggacacctctctttttggggagtgataacatgcacaatgactaaaattcactgagcaccatttaagtggtcacaacttagtcctcatagaagtctcacaaagtgggcactgttgtcacccacacgttacaggtaaagagctgaggctcagagaggttctacccctcacccaggtcacacagcacatcctggcagagatggcattcaggcctacctgagcccatccctcagcacagcaccaccctgactgtgtgcaaggcgccctgccggctttcagctctgggtcaggatgccgttacggagggccatgcgctgcggcaggactccatctgggctccggcagaagcatccctttctgtggttttaggatatcgtgtggggacacttctgaggctgaactgtagacgcagctgcgggcgcctcttaagggccaaaagactcttttgtgcttctgcatggattgagattttggcaaggaacacatagtacttttgttgaaaggaagaaccagaaagagaagtagatggcagattgaaagcctcttcttgaaagggcctttgatcgtgcctgccacaggacacgtgtcccctccctgatgcaatgtaacctcgtggttcattcctctgatcttggagcctgacactttgccttggggagtccctcctgagccctcccttccctgcacatgagtggagagagccgggatcctcttcccagatgtgtgacatgaggctggctctggctgctacgtgacccctgcctcctggggatcagagcctgggctgagggctgcttctaacaaccaggtcagggactgctggggctgatttgggctcggaacccaagtccttctccaatgcccagcaccacccgagcacccgctagctgctggggtctgctgccaccaccacgttctgacctcccagtgcaccccctgtgtgagcacacagatctcagtggggctcactgggcgcctctgcccgagcccctgctgccttggcttcctgctgtgctggtggcccagtcacagagtggtcaggataaaatggtcattgctgggatttgagacccaggcagcctgcaggggcagcttagactgagtcatgaccaggtctgtgggaaggtgagagcaggcagtgagggtatgtgggggctggcacagggactgagggagcagggggagccagaggaagggtagagcatgcaggcagtctggcctgtgggtagcgtggcttggggcaggactcgggtgagtcctcttttggcatcacactccctcatccttccgccacccccctgcccacctccactggtctcatctgtagggagaaaggtggctcgggcttaatgtggtactgcctctctgtccctcccgtgctgagcttgcagcagaggcaggagattcagagccggagccggggagttgcatggacccaggtgcatacctggctctgacactttctagctgtgtgtcctggtaggtgtcctttagcctctccagtcctcactgttatcctcagaagaatggggttaggacagactgccatgggaggccgctgtgggggtgagcaactcttctgcagggggcgcccatgaggtcctcctagatggaggctggcgctctcatcagccacagggcgctggagactggttcctcctgcctccaggggagccctgttgatgcagcccctggttctaggacacccaagagttccttcgctgcctgatggaccagctgcacgaggagctcaaggagccggtggtggccacggtggcgctgacggaggctcgggactcagattcgagtgacacggatgagaaacgggagggtgaccggagcccatcagaagatgagttcttgtcctgtgactcgagcagtgaccggggtgagggtgacgggcaggggcgtggcgggggcagctcgcaggccgagacggagctgctgatcccagatgaggcgggccgagccatctctgagaaggagcggatgaaggaccgcaagttctcctggggccagcagcgtacaaactcggagcaagtggacgaggacgctgatgtggacactgccatggctgcccttgacgaccagcccgcggaggcccagcccccgtcaccacggtcctccagcccctgccggacgccaggtatcagctggccggggactgcgggaggaacctcagcctatggcccagtacctaccgggtgctgagcgccgacctgcagtagcccccgggggacgggttcttcactagacccgaatgacagtggggaagtcagcctccgggggggctcagtgatgtgcccagggtcccctagctcataatgctggagcccaattcagagccctctcccagagccctgagccttccagccggacatggattggacaggtctgctccggcctgtgtgctggggccaggagtgggcacatgacagaggagacacattagggtcaggctttcgtccctttaggaggggctggcaggtcatcttcctgcccactcgtggagctggcctggctgccctggcccagcatggtaccctctctgcccccagagccggacaatgatgctcacctacgcagctcctctcgcccctgcagccccgtccaccaccacgagggccatgccaagctgtctagcagcccccctcgtgcaagccccgtgaggatggcaccgtcgtacgtgctcaagaaaggttcggggggcacgggagggtgggtcagcttgaggctgggagtacagattacgcccgtagctgcctttctcatggccccctgtggcggagggccgggctatgggctcctctcaggtacacccctgagacaccagtgtgggagccacgttttgcagaggatgacacagaggcatgagatggtgaattgcttacccagtcatgtgactcacggatgtcactccacatcctgtcaaaggaagccgcagggcccgcacctcgccccggccaggcaggtggaggctgggctagtcctgtgctgtgtccccagcccaggtattgagtgctggcagccggaggcggaaggagcagcgctaccgcagcgtcatctcagacatctttgacggctccattctcagccttgtgcagtgtctcacctgtgaccgggtgggtgccccagggatggggggagctgggccaggctgccagtggcctcagcagctcttgccctgactgggtgcagggtgggctctccacgggtgctccctgcttttatccaggggagggccctgcctgcgtggatcccgtgtctatggcctggggagtagtccctctgcccctcacctgctgcttggggtttggggtgcagacattgccagaggatgggcagcagactgaccttcaaccccacaggtatccaccacagtggaaacgttccaggacttatcactgcccattcctggaaaggaggacctggccaagctccattcagccatctaccagaatgtgccggccaagccaggcgcctgtggggacagctatgccgcccagggctggctggccttcattgtggagtacatccgacggtgcgcccaccttgccactactgggcgacatgggctgggcctgtcctggttttcctgggcgggagacagtacacagtgaagtccatgcatttggggaaccagggaggtcctgggaggagctgggggccgaagcctgcagaggagttggcttaatatgcaggggatttcttggctactttgaagtggccaggattggatagtcccttggagctggagggcgatggacagcagggaggtgaccacatggcaggttgaagggagggcagcagcaggacacaggcctggttggcgggaagggcagcagctttcccagggctgcctctcctgcctgaggccagagacccgcatgaccccagggagggggtagcatgatcatggccgcaacacagatgaaggaggccaggcttgcggagagatgatgtcactcggcccaggacacggacgtgtctggctccaggcctctgccccgacccgccgtgcccggctgcttctctgggccttcagggtccttctgcggctcaggcctgacagacctcagccagagtcccttcagctcctgttcttgcccaggccctggcagcacccctgcactccttttctgtctgtaggtttgtggtatcctgtacccccagctggttttgggggcctgtcgtcaccctggaagactgccttgctgccttctttgccgctgatgagttaaagggtgaggggcctggctggcaagggtcggggaggtggagggttgtggggacggggatgtgcagaccccagcaggccagcatgcagcccagggcttgtgggatgcacagccaggctagacttggcttccaaggttgatcccatcagatacccacgcccactgccagccacgctggaccagggccatgtgctatcccaaccccatcatcttgcagctcttgagtgttcacttatttttatttttaccaatttggtgggcaaaaatgatgtatgttaatttttcatttccttgattactgatgagtttctacattttttgttaaatatactggctctatgtatttatttaaacattgcccattcctgttcttgttctttttctccgttggctatttggcatctaaacctttgggaaaactctctcttttttttttatttccaattttcaattgcgataaaatacacaaaatgtaaaatttaccaccataaccattgtaaatgctgtttttaacagaaagtgcacagtcgagtagtgttaaatacatgcacatggtcacgcagccatcctccccattcatctccagaacttttacatcttgcaaacctgaaactcagtatccgtgaaacagctccctactcccacctcccagcccctggcaacctccacattcaagtctgtgaatgtgactactctaaaggcctcatagaagtggaattatacagtacttgccattttgtgactgacggcttttactgagcataacgtccttagggttcatccacgttgcagcgtgtgtgtcggaatgccctgccttttgtatgctggttatttattgttccattgtgtggatggctggggcctttctgcttattcgttcatccgtcagtggacactcaggccgcttccctgttagctattgtgaggaatgctgctctgaccatgggtgtgcacacctctcttctttcatccctttgggtctatgcctatttttaatttctcgaggagccaccgtactgggttccacagtggccaccccatttcacattcccaccagtgacgcacaagagttccagtttctccacatcgtcgtccacactcattttgtttacttttttgatgggagtcaacctcatgggtatgaggtggtatctcattgtgcgttttttttgttttgttttgttttgtttttgagacggagtctctctcttgacgcccaggctggagtgcaatggcatgatctcggcttattgcaacctccacctcctgggtttaagcgattctcctgcctcagcctcccgagtagctgggattacaggcacatgccaccacggctggctaatttttgtatttttagtagaatggggtttcaccatgttggccaggctggtcttgaactcctgacctcaggtgatccgcctgccttggtctcccaaagtgctgggattaccggcgtgagccaccgcacccagcctcgttgtggttttgatttgcatttcctaatgatagtgatgttaagtgtcttttcatatgcttgttggccatttgtaagtgtttggaaaaacatctatgtgagtcttttgcctattttgttttttgttgcttgttatagggattcttttttttcttgagacagagtctcactctgtcacccaggctggagtgcaatggcatgatcttggctcactgcagcctccgcctcctgggtgcaagcagtcctcccatctcagcctcccgagtagctgggattataggcacgtgccaccacacctggctaatttttgtattgttagtagagatggggttttgccatgttggccaggttggtctcgaactcctgacctcaaatggatttgctgccttggcctcccaaagtgctgggattacaggtgtgagccacggtgccggcctcgttagttagaggagttctttatgtgtccagatacgtgacttataaccctgtcctcccatcctgtagggtgcgtttcattctgtggtttgtgtcttttgctttggttgcctgcacctttggtgttgtgtttcagagatcatcgccagatccaatgtcatgaaacttttttcctacttttctcctaaaagttttatagttttaggtcttatattgagatctttgatcccattttgacttaattttcacagtgtgcatggagggggaaactatacattaagattttaagctggtcatggtggcatgtacctgtgaccccagctactccggaggctgagggtcctctgagcctaggactttgggaccagcctgggcaacatagcaagaccctatctcaaaaaaattgtttcaaatacattttctgtaattaatgttgcacttcccaccccacctccattttgccttttgccttttaattttgcttttggtggtatcttacagatgttgaagtatttctggggtcaaatataaccatttctcccttgtatggattctggctgtggggcccagccagggccttccctccctccagtacctctcaggttttatttctttttctttttcttcttctttttttttttttttttttgagatggagttttactctgtcacccaggctggagtgcagtggcatcagctcactgcagcctctgccccgagccccccaggttcgagcgattctcccacctcagcctcctgagtagctgggattacaggcacgcaccaccacgtccagctaatttttgtatttttagtagagatggggtttcgccatgttggccaggctggcctcgaactcctgacctcaggggatccgcccgcctcggcctcccaaagtgctaggattacacgcatgagccaccatgcccagccaggttttatttcttaagcagaaatcattatagtcacttttttttgctccctcattttgcatccttgctaacctctgaccctttgttttactgccctaggtgacaacatgtacagctgtgagcggtgtaagaagtaagtgagccttcccccgccttctccctaactgccgtttctgtgccctacatattccccttgggttcctgcagagagccccctataatcctgccttcccagaagggagccgggtggagggctgcttccctggcccctggccctgatgccggacactgatgctggctcgtgcttcctccccaggctgcggaacggagtgaagtactgcaaagtcctgcggttgcccgaggtgagccagtggcctcggcagcctcctcctcagctatctcgggatgcacaccagcacacaccaggcaggggctgagcctgctccactgctcgggcacttctgtgctgcaggggccgtggagactccatagctttggctgagaaacctctgggaagggttggcagggggcacatttttccaactgtgacttggtgccctctctcggtagcctcagcacatgttgtctaacatgttgtatgagggcccaatgggaggcaggtgtgtgggacactgggttaccacccccagtgagacagctatggctcctgccagctgcagagtggcgggaggagagctggtccagctggggctgttgccaggggtctttctgaggagtaacgtctgagtggggcctggagggtgtaggctggtgtcagcgtcgtggatggaaggcacagaaggaacagacaaaaccccagtgcaggagcaggcttgtccgcaccaaggaaggcacgtgtggctggagcaaagaggagagggccctggcagagggggcccaggttggggctgtggtggctcggggaggctttgtggcttctcaaaggtagtgccgacagaactggtaaacttgatggctcattgcagctcttggggtccagttctcagcagtggagctgggagtgatctgtgtgacttagagcgagcccagtctggcccccacgtggaactcttggatttgttccaatggagtcagcttgcatgatcccatcagctgtcctgggcccgtgggcaaggctgcgagggcccgcatcatttcttcctagatgaccggcgctctctctgtccccgcagatcctgtgcattcacctaaagcgctttcggcacgaggtgatgtactcattcaagatcaacagccacgtctccttccccctcgaggggctcgacctgcgccccttccttgccaaggagtgcacatcccagatcaccacctacgacctcctctcggtcatctgccaccacggcacggcaggcagtgagtcatgtcccctcccctgccgtccccatccgctaggatccctgtgacccgtctgctctgccgccgcaggtgggcactacatcgcctactgccagaacgtgatcaatgggcagtggtacgagtttgatgaccagtacgtcacagaagtccacgagacggtggtgcagaacgccgagggctacgtactcttctacaggtgggcgctgggccaggcctggtggaggaacctcaccatccccgtcccctgggacccatgggccttctgggtgtgtgtaggggacagcgcctggattaagccagggaagtaaggacttggattgttaagaaacagccctctggctgctgtggggaacccaggaaggcagcttggagccttctccagggccctggctggcggcacagggggctgctcacatgtccaggacccgtgaaggacccaggaggtggtggacagggccggtagcccgaggtgcactgggatgggggctctgcatgtgtctgaaggtggcagccgtcaggcacagcttctcgccccctcctcaccccacaggaagagcagcgaggaggccatgcgggagcgacagcaggtggtgtccctggccgccatgcgggagcccagcctgctgcggttctacgtgtcccgcgagtggctcaacaagttcaacaccttcgcggagccaggccccatcaccaaccagaccttcctctgctcccacggaggtgaggcgccccctgtggtgggagagcagggtgggcagctgggccgagccacagcttcgctccctgtaccttcttcccaggcatcccgccccacaaataccactacatcgacgacctggtggtcatcctgccccagaacgtctgggagcacctgtacaacaggtgagagcctgggaggccaacttgtctccgtcctgtccagggcccagctgggcaggaaaagaggggagggcagggaaggaatgccaccaggaccccacaccacactctggcctccacgtgggcagcacagagccgccttcacttgtctcatggagaatgacacatgtcgtttgtgggaatccgcttggatccttccagcggcaagggacaggaaactggctgaagcacagctgagtgtgttggccatctgctgaagcacagctgagtgtgttggccatctgctcttcagccttgaagcaggacctcccttgggctgtgggcgcgctgctccgttgcaggctctgtggtgctcacacagaggtgcatgcaggcctgcgacagcgctgagggggcactgatggcttgagggggaagtggaaggcagtgatcactctcccctccctggtaccccgctcaggccgtgtctctctctcccaccctgggcacagattcgggggtggccccgccgtgaaccacctgtacgtgtgctccatctgccaggtggagatcgaggcactggccaagcgcaggaggatcgagatcgacaccttcatcaaggtgcgtgcggcgaggcggcgcgggggcggctctgccagcctctgcctggggcagctggggacttggggacagaagaatcctgtgcagtccctgagcaagtttgaaagcagtcttttgaggctgggcatggtggctcacacctgtaatcccagcactttgggaggctgagacgaacagatcacttgaggtcaggagtttgaaaccagcctggccaacatggcaaaaccccgtctctactaaaaatacaaaaattagctgggcttggtggcaggtgcctgtaatcccagctacttgggaggctgaggcaggataatcgcttgaacctgggaggcggaggtttcagtgagctgagattgtgccactgcgctccagcctgggcaaccgagtaagactccatctcaaaaaaaaaaaaaaaagaaaaagaaaagaaaggagtcttctgcggggaactagatggccaggtgtctaggagggcttttcctggtgggagggttggcttgagtaagtgaagcctcatcgcccgggtgctgttgagcttaaagaaccagtagatggatcccattctcagccttggctgtgttattttgggctgaattattctttattgtggggccgtcctgtgcattgtaggatgtttagcagcattcttggcctctacccactagtgctagtgacaaccaaaatgacctccagagattgcccagggtcccctggggtgcagagtaccctccctgccctgggtgagaaccactgggctctacagactgcccaagataaagcaggaagtgaaaaccaaggtgcaaaccaggactcaagtgtgactgtgtttagaagagggacttctgtgagggagctgagtgcaggcgaggctcctggcgcactccctccctgccacgctacttctaacagggttaggacgtgttccactcacagggagggcctggtgagagacactgagggacgcccgtgctttgtggccattaggaaatgattctgctgcctgggcatggtggctcacgcctgtgatcccagcactttgggaggccgaggcaggtggatcacttgagcccaggagttcaagaccaacttggccaacatggcgaaaccccatctctacaaacaatacaaaaattagccaggcatggtgatgtgtacctgtagtccccgctacctggagggctgagtgagttgggaggatcacctaagcctgggaggttgaggctgcagtgagccgtgatcatgccactgcaccgcagcctgggcaatagagtgagaccctgtctcagaacacaaacgaaaaagagactgtcagggctgggcctagtggtatgcacctgtggtccaacctactcaggaggctgaggtgggaggatcacttgagcccaggaggtcaaggctgcagtgagccatgattgcgccgctgcactcccgcctgggcacagagtgagaccaccccccatctcgaaaaagaaaatgctcctgtcagaaggagagctgcctctctgagcagataggcacattctattcaaccggagaaaattagcatctcccaggccgggcgcagtggttcatgcctgttatcccagcacttttgagaggtcgaggtgggcggatcacctgaggtcaggagttcaagaccagcctggccaacatggcgaaaccccgtctctactaaaaacacaaaaagtagccaggtggtggcacacacctgtaatcccagctactcaagaggctgaggtgggagaatcgcttgaacctgggaggcagaggttgcagtaagccgagatcgcgccactgcactccagcctgggtgacagagtgagattccttctcaaaaagtagaatctcccttgtggtctcagttgggtcaaacagttattgaagagacccacaaaatgttaccaccgtcctctctgagtgatgggtgtgttcattttgtttgagcttgtctgggggtttgatttttcaccttgagtatctggtgtttttgtaagactcttgggtgagggactggggcgggggcatttgggaaatccttgctgaaggtaaatagagactgacctgccctctgtctcctcccgtccctgcccgcctgccagttgaacaaggccttccaggccgaggagtcgccgggcgtcatctactgcatcagcatgcagtggttccgggagtgggaggcgttcgtcaaggggaaggacaacggtgagctgaggggggacctggcacttacctgccctgggggcctcctgggagatgggatgctggcaggggagggctggcacacaggggctcctgcaggccccatgcctgcccccaggtgccacccatccagggtgaacagagagcatggggctttgccagtccccagtggggatcactgtccccacccagaggcaggaagctgctcctgctctgcgccccctgcccttctccactccctgccatgcccagcaagctgctctgccctcctgcaaggccctttcctcaggggagtgtgtcgcccgaaatgacagatttgtcatctgactccttggatttacagaggtggagacaggccccatcacaagctcccagggtcccccaagtccccagtgaagaacagcagaaccaagccatggaagcccacaggctctaaactattaaacctgcattaaaaatttcggctggggcgccctcggggcataatctaacctgtggctccggggcccggcagggtgggtagagcccacggttctgctcacgggacccttggtgtggagcatgagcacccacctgtgcttgggaagggaggcctcattgccatcccgctagtcggggaaggtgccagggccaccgtgaggcctctctggtggtggctgaggccttcagcatggctgtggttgagaatgtagctccggagccctcgccctggcctggacgctggccttgccttctaccagctatgacctgagtggttacttcaccttcccaggcctcggctctgtctctgtaaacctctgtcttgtcctgtggttgccgaggctaaatgagatagctgggcagaggggaaggggcgtggtgagcggcagctgccagcagagataagggcatgggccatccaccgcagctcctgcggccagcacagagtctgagaccatctcgtgtgtcctggaaattccctctgctgggtcctcagactgccacagaggagcattgggtggctcaggcgcctcatccattagagacttcacgctgacccccaggcctggggcggccccacttgggatggctctgctgctgtggagggtggagggcatggcaggggctgaacccgagcccgctgtgtctgttgcagagccccccgggcccattgacaacagcaggattgcacaggtcaaaggaagcggccatgtccagctgaagcagggtgagttccccctggggtcagccaggctcctctctgcccttcctggctgccaggctgctgcccagtcccgtccttccaggagcccccttaccacctgtcttagagtcaggctgagacgtccacctgagtccagacccaggcggctgagagatggcccaaggggcttggtctctgcttgtgtcctccaggtcccacccctctgcctgctgctggccttgcccaccctgctgtttatgtcagccccacccccaggaacaagggacacagccagagatgtgttatccggggcccttagcgggatggacattcctctgggaaatcctgatttccatctgacagctttgcatagaagccctggttgccgtcttcccgcttcggggcctggccctgcggagcccccactgcccaggccggtggcttccttgaggaggcaaaggtgagcctaggggtgcctctcgtgccctgcaggagctgactacgggcagatttcggaggagacctggacctacctgaacagcctgtatggaggtggccccgagattgccatccgccagagtgtggcgcagccgctgggcccagagaacctgcacggggagcagaagatcgaagccgagacgcgggccgtgtgatctgctgggctagtctgtaagtcgccccggctggtccctccatggcactctgggtcctctcctcactctccagagaccctcacatgtccttttgaacatccaaagagcaggtccctgaaagcaccttcctggaggatgtgggagggccctggacatggcccggccccactgctgagtgcccgtgtccccacagccccatgtgccccaccccgcggaaggcgtgtttgtgcccagaagagaggccgggctgctgcagaaccccgccgtgtaaagaggcagaaaagttggtttggtttgcagtaacgctgcaactagaaaatatatgcacttcaggcttgttgaaacgaccaagactctgtgacgttaatttgggtctttgtcctggcagtgcctctgccagtcactgtcatcgttgtgtcccccacaactgtcctcttgctagctcggcccagctttgtccctggagcccgatgctacccctgtcagacagaggctgcggcctgggccagagtcagggagtagctgctgcttcacggcgtctccactgtgcgattggcccggagccccgaagactcggagggagctgctcagggccggtgagcgcagccagaagccctggccagtgaggagctcacaggtcctccctggtggtcccgccgcacctctgcatctcctgggcgtcaccaggaaggctctgaagtcccgggctgctctcagcacttctcctgcagactgaagactctggactcattgctgattggaacaccaggaggaggttggatttctgccagtgggggatgtttctggaggcagctggtcccccacaccgcgtcctgctgagcctgccccctggattggctgtaatttgcctcgaagttcagcagttcatcttcatgggaaatttgctgagcccccaccagggaaccggatgatgaaacagggatacctcacagcttggccatttgaggcaaaggcagcttcccgagctgatgctaaagaagacagactttcccttcctcccagcagcagcagtgcagagcccacctggagggatgtgggggctgtgcagggtgcagcgctcaggtggatcctgggaagcagcctctggatgctgagtggagggagccactgagcacagcaaggcaccaaagcccctggagaaaccgccagggcgaggtgcgaccatcatcaggatcaaagcagacggggcgtgggtggggaaggggctctgggaccagaccccccacactactgcgtctttgtttctatcagtctttgtagaagcaggtggtggtggaaattccagcaggtgggtcccgcagaggccctgaggcctcacttttcggatcttctgtcccagatcctgctccctccctgctgagcctggggttcccctggcattggccccagccttctgaaagccggcgctgcagccagaggccgcacgctgcactgtcgcgacgcagagaggcttctgtgcaggctgggatcgggccccatgtctgtgctgtctagtttgtgttcaaaatgtcagaataaacacagaataaatgttcccacggcca

SEQ ID NO: 2145 - DNA, 46422 bp, Homo sapiens; identical to SEQ ID NO: 2144
  source 1..46422: mol_type = genomic DNA

SEQ ID NO: 2146 - DNA, 46422 bp, Homo sapiens; identical to SEQ ID NO: 2144
  source 1..46422: mol_type = genomic DNA

SEQ ID NO: 2147 - DNA, 46064 bp, Homo sapiens
  source 1..46064: mol_type = genomic DNA
agaagctcccggccgggggcgcgcacgtaggcacgcagaggccgtcacgtgggtcgccgaggctcgcaagtgcgcgtggccgtggcggctggtgtggggttgagtcagttgtgggacccggagctgctgacccagcgggtggcccaccgaaccggtgacacagcggcaggcgttagggctcgggagccgcgagcctggcctcgtcctagagctcggccgagccgtcgccgccgtcgtcccccgcccccagtcagcaaaccgccgccgcgggcgcgcccccgctctgcgctgtctctccgatggcgtccgcctcaggggccatggcgaagcacgagcagatcctggtcctcgatccgcccacagacctcaaattcaaaggtaggcagaacggggacacccccgggtggggtggggcgcgcggaccgctggctgtcggcgggggggcgcggagggcacgtccgcggccctggcccgagggagcgccccctcccccacgccccggcgccttccctttcccggctgctttcttgccgccacctcggccggcctgccccttgctccggcccgcttcatcccctcccgcccgccctcgctgcggtgcgcgcgccggccggggcgaggcggaggggagcccggccctggcgccgccgccgccgccatcttgcggtcccgcgggggcgcctcctgggcgtccggtcccgcccgcgccgcggtccgcctgggcccgcgtccttggccccagaggccgacggcgtgcttcggcggggcgtgggcggctgggcacccgagggcgtgcgctctgggctgcggcggggagtgggctctggaggtggcgcaagctgcgtctgtcgcccgctcccggctgtcagcggcgcggggaggctagggcacggcgcgggaccccttgggagtgagagccgccccccgacccctgccccggcccggggagagctcgctgcagccggccctcgggttccgcggagggcgtcgcttgtcacctttccgccaggtttagaactcggccgtcaggtgtaggacgcgccggggaggtggagagtccttggaggtgcctggcgagggctgcccggtgctgttggcacggacccaggtgcgtgcgggcaggagcgatgcgtcagccgcaaacggagagttgtaggttcatagtagcggggcttcctgccttctacgacatttcagtgtgccacccgcgtgcttttatttagccctttagttgagctcctctgctgagaaaccttcagtgcgtgtgacttttttgcttttacgtttgcggtttccgacagatcctgagaaggctgataaggtgtcacccagctctggaactttgtaggtttttgtagtactgcctgtgataagttttttagtctgacttggtgatcctggaagaatcccaggggcttttggtcggtttccttgtcaatatgtagtgtactttaggaaagagagttaaaatgtacagatttttattttttttctttgtttttaaggaatactgaaagagtgtgaacatctaatagaaagtaggttccttcctatctttagttaagtgtaaagtgagtcccgttttggaagtctatgtcttgtatttcaattgttgaatgagaacaatttttgtgaggtgtatagcaattctagtgctaaaagaaaaaattaaatcctttattgttgtgtaaggctgagtccaagagaaagccaactacattgttttccataggaaaaacttcaggtttaggaatttaaaatatattctggaattatgagattaatattgcataactacattgcaagctttttagtgcgtttacaaatttctttgaatagaagtgtaagtgagctacttgttgggtaaggatttggttttaaggtgcagtgaatgtattttattgcaagtttatgtaagttgtgtgatttttacgtagttgtagctgggggaaaacctttgaggaattatgaagagtcctgactcagccattatcttgagataatttaatgtaaatctgtatggtgtgtttttttttaatatttcgtttttatcttttgattggctgtgtttacagtgaacatttcctctactggataactatgtgtaaattgccattagggatttataagcctttacaaccagttttaggccaggaaatgtccacagagtttgaagttttctccttagggaagttgttatgttgctatagtaagggagtaataatagtggagaagcaagtttaaaaaacaagcaaaagccctacacagtgacttactcatatatttccttttttgggggtgttggagaattacagctatgattatagaactcattgtttttgtgttgccagtaaaaataagactagccagggaagcagaaaaggtgtgtagatggtataacagagacacaaccgtgtctgaggaaagaagccctttctctatgtgccccatccctcccttaggaagcatttaaggaaaaggcttgtttttcatttcaggggaggtttaggccaagagagtggttgagtaaacacactgctgtgagagaatgcctggtacttaaatgcccaatagtttgttgtgtgtttcagtttaaagatggagatgatggggaggattgggaggtgacatttggtgtttgattccttaatattatcgttttagtcaaaggtaaattgttggctttgatggaaacctttgtgtatttaaatgcacagttcaacactgaggagattcatttagaatgtacagtctacttgggcttagtttatgatagaaaaaaatcatttaactgacttaccctaagtcattcaaaactttctaagtgaaggacttttagaagacagttttgcaaaattctttgtcatcttctagtaggtttattttagttattgattctgagtttgagatggtttctccaggagtgactcaggtaatcattctgagattggatggtttttcttttatacacctaacaagcatcttgaagatgaattaacagtatgttgcacaattttgcaaaagcagacaccaactatttcagtacatttttctgtatacctcagtatttaaaaaaaagtttgttttatacagtcgttaacatataaaagtgcatttacgatgtaatgaattctgaagtagatcacttgtgttagtaaagaaaaagaagtagacgctgctttacttcaaattctgtttaaaccttggaagtaattttacctagatttcagatttgaaacttggtattttatgtgaaagattttttttgtctttaaaattttttacatgataaaattccatttataatgtattacacattttatttttctacctattagcagtttttttaaatttttttattttttgagacggagtcttgctctgttgcagtggctcgatctcggctcattgcagtctctgcctcccgggttcaagcaattctcctgcctcagtctccagagtagctggaactacaggcatgcactaccatgcccagctaattttgaattttttgtagagacgggattttgccaggctggcctcgaacttctgacctcaggtgatccgcctgccttggcctcccaaagtgctgggattacaggcgtgagccaccgcacctgacccctattagcagttttgtagaaaagtttgaagaagaaagtttataaaatgctaaaataaatttcaaatatattcttaatgatcagagagagacgaaaataaaccaaaatccttatgttgagagtggccgataacaataaatcaacaaagaaaattaagctctctgagggatcgagggacgtatggtgttaacatcagctagtgcatctgcatagaagcagcacggggcgggggggaaattagagaatactcctctggatggatatttagcacatttttaggtgtttccagtcggctcttcatgtttcccagtggctatacaaaacgcctggggctctaaagacatgaatgtaatctttaatcatatattactccattccttagtttttaggtaactctcaattgctcacagaataaaagtcagatttttttttttcagtaagacataccatctcttccatgatgtgccttcctcttgtaacacctgttagtctgtacacatccatactttcttccctgagaaagaaaaaccctgctcatacccaaggttctttgttcctctatttttgctggctaaggtaaaattccttatgactcagaccatgttccatgagatgttttcctgctggttttcaatcactggctgcattgttttaacatataaatacaccagagtctttgattttaaaaacaaatgagcagacatgtacttctttgaccataactctttctagtatgtgtctctccctgtccttcatttcctttgcattcagactttttggaaaaatagtccatattcactgtttttccagttactcaccttttattctctccttagtccacggtacttttatcctctcactacttattgctaacttaatcatttccagtttttatcttacttgacctccccctggctcttgacagtaccgacagtttctctaaaaaaaaccctcaattcttctggcttctataacagcattgtcttctaattttcttatttgctccatttattgtcttatttgtggcattttcctcaaatgctcatgtttctgagattctgatttggtttcatttatctcactctgtgaactttctttgttcatttcattgttttgaggttttctctttatcttccttgctctctgcaggtattgctacacccccaagtctgttttaattcacattttaccgtcagtcaagagcacatactcaaacaacttattcactatttagatttgaatattgcacagatatgatattctaaactcaaaatatctcaaaatttttactacccatgcctactcttcttcccatattttttatttttatttttgagatggggtcttgctcagttgctcaacctggagtgcagtggcatgcacgttcttggctcactgcagccgtgacctcctgggctcaagtgatcctcctgaatagctaggactataggtgcatgctaccatgcccagctaattttttacgtacatatgggggtgccgctgtgttgcccaggctgatctcgaactcctgaccttgcgtgatcctcctgccttggcctcctaaagtgctgggattacaggcctgagccattgcacttggctttatttttattttttagtggcatcatgattactcacaccagaaacaatatgcatatctaataattaaaatctgtgtttctatttttgacataatccctttgtccacttcaatgtgtttctacttccaaattcatttatttttaaaattcattcaattatggatctaatttgattagatttgagtatctgctacatgtcaggtatgatgaataaatattggaactacagttgtgagtgaaacacaagccatgttttcatggggcagttctaacaagagagatagatactaataaaataatcagaagaataaagtgtacccctgaagagctatatagtgctacgagaatgtaaaataagggtcttcgatcaggctgtcacagttgaactaagattccaacaatgagtaaaagttatcctggtgaagaagaaaggaaaatgcatgttcaaatatccggtagcaggagggactgtgaaacatttaccatactgaaagaggtcggcgtggcagtggtgaaaatagtcaagatgaatgtagtgctggtttagtaggtcaagttaggagttttgtttttatcctgagccactagggtttttaagtgaggggaggagcagtaaagatggagggaatcgaataacatcacatttgcatttaaaaataattctggtagcaatgtaaaattatactagaggggagaaagagatgaattaggcggctgcagcagtactggcaagtggtgaccccttggactgaggtcatggtattggaggtgatgaaaagttaggttgaatctgtgagacttggtggtctctatgtgcactgagagaaaagggtatgaatgtctgagatttctgcttatataactggggaaatggtggtgctatttgagaaacggtggatgtctggatgaggacgaaatgcatcttatttgggggtgtgtgagagagatggaggaggaggacgtatggtagatatgtttaggtctttcaggatattaacatgaaggtggatttggttaaatgggtgtgttacttaagaaaaggtctgggctttggataatttccttacttcaggtccttttatatttactagtcagcagacatctccttttcttttctttctttctttcatttttttcttgagatggagtctcgctttgtcacccatggtggtgtgcagtggcgctatctcggctcactgcaacctctgcctcccgagttcaagcgatgctcctgcctcagcctcccaagtagctgggattacaggcgtgcaccaccatgcctggctaatttttgtatttttagtagagacggggttttgccctgtgggccaggctggtctccctgacctcaagtgatccacctgcctctgcctcccaaagtgttgggatgacaggcgtgagccactgtgcccagcctcctttattgtcagctctttaccctgtcctccacactgctgctggaactacgctttggaaaaaggaggctgttactgttagtcccttgattgaagaactctaaatgttttcttactatgtacttgaaaaatccaaaatccactgcctaactctccagcctcagtgtctattctttttcttctgtccataactttggctatatgaaaccattttcccaaacactccaggccactgcaatgctttgcacaggctctgcttagaatattgtcctccctcacgtctgtcaggcagcctcttatttcaagaatcacttcctcttgagaagtcgttgatactctaccagtccaagttggtcagagccttcatgccactgttgaagcttgtgcttacctgtaataacagtactttcacattagatagtagttaggcttacatattctcccctcccaaactatactatgaactctgagtatatacctgttaatgtttgtagtaacaagttctggcatcataaaatgattgcccagtaagtgttgattgaattaataagactcagatgatttctccagtaatttttattttttggtcttggatcttgactcagttggagttttcacctgcttttgcaggtaatagtgctttcaaaattttgtacttccagaaaaggggtggtaggctattttgtaaagagctgactaaccctaaaggtaggttgtttgatgtttgtgtttttttcatttgtaaagtaagaggttaggactaggtgatttcttgggtgttctgtctttaaaagtttgtgtgaatatatgacaattgagtacaaaaagaaaatgctatttttctgtgaagcagaaaaatgcatataaagaatagggaaaactatacttttaatcctttaaaaagatttcattgtgtatatttgaggtatacatataacatgatgttatgggatacatatagatagtaaaatggttactatagtgaagcaaattgacatatgcatcatctcaacatagtttctttttatcttacctttactgaccatttagtgaaatcttatttgcctttcagaggtggaagttgatacaggatggatcttgctctcttttgatcataaagttagttttggaaaaaaattaaatgtgcgagaggactgttaacttgcaaatgcttgtttactggtttaattcattttataactgaaatgtgactcaaattagttttaaattagtaagttttaaacgtttgaaaactttcaaacatgagcaccttataatatgaacctcagtatgcgttaatttagtaaattaaatttaaatataaatttaataattgacattttactataatcatacgtgtttatttatatatttttgtttgcctccatgtttgtatttttttgcagcggtctcactctgacaccagactgaagtgcagtggtgctgttatagctcactgcagccttgaactccagggcccaagcgatccttctgagtaactaggactacaggtgcatgccactgtgcccagctaattattatatgttttattttttgtagagacagtcttgctattttgcccagccagatcttgaactcctggcctcaagcgatcctcctgcctcagcctcccaaagtgctggaattacaggcatgagctaccatacctggcctgcctcagtatttttaaaacaaatcctgaatgatagcataacatttcatccctagatacttgagtttgcatttataaccaaaaaaggacattttctttgcataatcatgatactgttaacacgtaataacattaacagtaattctttgatatcctctaatatttagtctattacaaagaacaaaatcacacttaagagtttattaatgagcaatctcaatggcataggaaatcaggtatacctggtctcacaggaagaggctgtttataatctagattcaaggccagccaatatatatgctggtgactgaccagtcaaaattttgatggctcaccttgaaacacaactataaatagatggttataggtttcagaccttcaaggtcatatggactgggagacaaaacagtggctaatttggaccagtggcaagcagaagcaactaattgagagaaaaaaggcagagaaacgtaggcagagaggtcttttgatcccaggaattagtttctcttgaatacagcctcttcctgtgatgccagttatacttcatttcctgtgccattgaattgcttacatctttatgatgaactcttcagtatgggtttttttaataataaaatattctttgcttaaatgagattgaatttgatattttctgaagccatatttgtaacacattattctttaacatttcactttataaaaaataaattctgtaatctgttatacatatttcactttgtaattgttattctgtaacacatatttcactttataaaaagtctaaactagtgtcttcaatgcttataaaagaaacctccgtatcatttttgctgacttatgcatcattaatataccatagcatgcttagctgcttttctctggtgtttggatgttctttataactagttatcactaatgtttgatactgttctgaaaattcagatttaaaggagtgagaagtttagttacgtatcttttagctttttaaggaaatgattagattgaattaccgttaaaaagtagggatgttaattaaaaaagaattgttgctatgagaggacttttaaacttttagcattttaaggaaatgattagattgaattaccgttaaaaagtagggatgttaattaaaaaagaattgttgctatgagaggacttttaaacgtatgtttatagtataacttgacaaatttctcatgggcctatgttttgacagctcttttgtagctgtatgtttcatgtatgtgtgtatatgtgtgaagtgtatatgaatatgtatataattttaattcttgaataatatgacatggagtgactgtcatactttaaagacatagggtgcctttaaatcatacagtgtttcctgtttagtttttcctgtgaaaaaattttactttttaaagcctgtagggccagaatctcttggtcttgttttctgagtactgttcccactgagaaaaacctcactaacaacagatccccaaaaaatctgtggttctgaattttttcagttttttcttccaggattttacaagtaagaggatttataagcaaattaagctactatgggtacatgtttaaaagtcccttgttatataaaatcagtgctaaattagaaaatggaaaaagtatagatattataaagctgtctatggccataccaccctgaacgcgccccatctcgtctgatctcggaagctagcagggtctggttagtacttggatgggagatattataaagccaataaaaattactcaatctcacaaaataacctctgttaacattttgataaactttttatagctatgctgtgtataattatatatttgtattttgtatgtttttagttaagattattgtgatcattttttcatgttatattttcccctagcaaaaactttagatctaaataataaaaaaaaaagtttgtttcaggttctctgaaaatgtaccttcttttctatttctttacatcctacctgtctagaatccaaaaacttaaactttagatgtggaccgctcgtttctattttaatcaagatgttaaattattagtaagtagcatgcactaatttcacgttcattcttgaacactaacattgttcttttacaaataatttacgtatgtgtacatcttattgttctttggaagtttagagtggagggacataaaattggtatgaaatgttgcaaatcaaagtgttccacttctgtgttaagactattgtttattttctctgccttgttttcaagattatgtcaccaggattgtttaggtcagactgagcagtgtatgcatcagaataccttaaaaagcactcctaaaacgtttaaggtagttttttaagatgaaatgtcaataaagctgtgatgggtttaagattgaattatctcccatctttaccaccgggtagaagacgttctttaaggtggtaagtaaagttaatcacaatgtcacatgacatgagagaagccttagagatcattttgcctacaaattctaaaatgaagcaggttagactgggatagagaggggaagtgatttacccaaggtccatcagctaggtaatggttttagctgttaagcctcagattgaacatactacattatgctttttttttttttaaagtcatagtataacatcagtaacaaaaatgagcatctcccttgccccagaaggctgccaaaagaatggaaagaagtgttttcattttttatttaggtacgtgtttatgtaaaggtgatggatgagtatttatacgaccagaacaatactacactgtatgaaaatggtgtaaaagaagtaaaagacatggtcccttccggttggtaactttttcatactgtaattttaggctcccagaatgggaatactggtttataaaaaatgattacatgaccatattaagtggattttggagagttttcatgatacattctgaaactgttgattgtatagtatggataaactgattgtataatatgattgtataatatgtttgtataattgtataatatgattgtataatatggacagtgaggcaatttcagtaattaaagcccttagaggcttaaataaaatagtgcagtcttgcttttccattaatctcaggatccatacttttatgatgttagtgaaatcttatgaagagatatgttttagtgcttcaatgactaagtttttaaaaatagaactaagactcattttttttcccagaaagtattactctatttgtacaaaaatatttatacaaaaatatttcttcagtacctactacaccaggcattgtgttagttgctggggatacagcagctaacgaaacaaagacctattcatggagcttacatcaagtctgatatttaaatgtgtttgaaaaaaacatacagtaagggtaaattcaagtgacatcatttaaaaaatttgtaataagaatgttttagggctttcttggatgtaaaaatgtaaaatattttttgagtgcttgatacttatttcaggaagtgttcagtgttgacctgtgtgaccaagagaaatacaatatcaatttaaaaatctttttcatatattgctaatttgactgcactttcatgctttattgtggcagaagtctacctggaatacttatgaattagaaaataaataccgtttggttatacgtacaaaatttatgagagttcaggccctagagtcagacctggtttgacttcccactttcattgctttgagttatatgaccttggactactgtttaccttctaagttgaatcatttgtaaacttggtatattaaaatgtaatgaaagtatctacttcatggacttgtgagggttaaataacatagttcatacaaagttattgatacatgagtgcccaataaacgctagctgttccgttagtagatattctgtgtactatatagtattaatatatgttttgtatatatgattaccttaacatgatgccacagatactcagcagcataacccttgtgtaactgggaaacagtttaatcagtgatacaacttaattagctaaaacctgttagaaacattgaaggtagtcatcacctgcattgctgtggctacattgtttgtgtatttgagcagagcacccagccttcctcattagtctgcactgcatagctaagaatttacaaagaccttgtcaagaactgtgaagggactgaaaatttagcctgctgcagttttgtagatgttggtagaagacatgagatttcctgagttagacagtggacatcattgttcatggcactgcaagtggaatgggctttatatttgtgttgttttccttgccctcctcaagttccatggaggtgacagaggtgttcgggtagatgctactcacatagtgagtttgcatcataactagaaaccctgagcttagagaaccggaatctttcatagtgggctgcacagaaacctacctgacctttgttccagtagaagaccttatcttgattatattggtcagtgaacaaacctgcccctctcctcagaagggaggtgttgtcttctaagacagttcactatttaatacattcttgaaaagatagcctgggtaaaaacccccaggactacttcttgcaagatgtgcagaaatgctagaggcccatggagaattgtctcctaaacacacctctgagtaactagcctaaatgggggtcacagagttcataaattaatgttcatgtgcattgtctgtttattcttaagttacattttagaagtgttttctgttttctgaaatgctctgtgtgatatactactgcttatcccatattaaaattttattctcttaacagaaaacaaatactaaagttgatatgcatactgagatgttcaggagtgactatattggtgtcttcagcttagtttgatgtgcatcaaaaattaagtggatgtctggacagggcagatagatatgctgcaaagtaaatacagcaaaatgttcatcgtagaatgtgagtgatgagtgtatgagtgtttatataattatctcaacttctttgtcaaatttttcataataaaatgttgggggaaaagctagctgttcccctcctccacaattgattctctttgcagctgaactcaactcagcctttcaaggtaactttgtcatcagtagttcacatcaaaatatggatgaatgataacagtttttaagaactgttacagtggttctttttttttttttttgatagctcttcttagcttagtgggattccttttaagactgggtggtttggagaataaaggtcccgctatttaaaaggaagtcattgttctgaatggttgaattttacacatatggactgactaaaaagggtatttcctgctggaaaaatgtttttaggcaaaggaggcaggccagtctcacttgactgacttttgggtgagctgccttaaaattttctaatatttttgacatgtcaggctctaagtttttttaaaacttatgttcagacttttttactcaaaggccacatttatgtatgtgttacatttctgtttgattgtaaaaatttgggactaggagtaggattttggcttaatggcagtgacagctgtagaggagttgggacagaatacttagtggcaggaaatggtagggcttccaaagaacaacagccacataattgaaaggtagaagtattttaattgtagatttttttcaatataagagtgcaaataaatgtaacgtatgcagttttcttttttcatatgggatagttcattataaacagtgacatatctctaatataagtttctatcaatacttttgattaaaatggactagttaaaaaattgtttcctaaatgttaaactaagcattcatattgggcaaatgataggatttccctgatttatagggattaagttttagaaatcctctaaacctatttattacataaattgcatcagatgttcactttgtcatcaaaactgcttttcactgttttttcaatttttcaaggttatttcaaggatcagtttttctgaaaaaacatttttattgtttttcgtaaataaaagatatatacagttcaaggaattatcaaaagttaaatactcatataatcacctccagggttagaaatagaacttggctagcattcggcaaagtgctccttttaccctctcccagttacttccactgcaggattaaccattatcctgacttttatggtggccacttgtttctcttgatggtttaatcacctaaggcttacaaaggatacattttcaattagtgaagcagattattggtttaattcaggggttcttaactctaacttcataactcatttttatattttgtaatgctattgctatcctgaaatgaaatgcatatataaaatgaccaacatatgtaattaaaaatgttaaaatatatttgccctagctataacataaggggaaaaaaaggaagtaattttataatggaatgctcattttaagtgtaaatgtttgggcgtgactacactagaagacataatgaagtagtcagatacttgtaccctacttaagtttgtaggtacagtagtcagatgtttgtatctacttaaggtgagtaagtttggatttaagagaaataagagttatccgagtagtactgacagttttcttaacattgttaaaagggcaaaataagaatatgccgttttagggcatataggtagattcatgtgaatataggtagattcatgtgaatgtgttacctacagatgcctgctgactaattcagatgtgttgtattggtgattcaggtatgatgagtggcattgctattgttagaatagtcttcagtaatagtgaactcaccttttaacattttgaagaaaagagtacacatttttcctgttcacgtaatagatgaatacttggaaaagaggtttttcaccaatatgaatttctggaggagtatttgaaaattcggtgcaatgggaacatagtacttcattgtgtgggtctgcattgcagaatgtctaccgtcctgtttcctgcccccaccccctgctcctaatgaaaggagcagttaccacctaaagggttatgtttgtagcactttcagtaaagaatataacttctcttttttgaagatcttaaggtagatttcttcatcaggccttttaatcagcagctcctggcggggtgggggtacatgatacaacccctccatccctgaactcagctctccaactcattttaccttccataaaagtcaatgtaaaatgtttttgaatatttacctatgtatgtttttatgaggtgggatatggctttcgtcaggttcttaaaggattctgtgactcacaaaagtggaccagatatttctttccgtgacttttttaagctattaaatctggttattcctttgctaatggtcatcagtacttgataattttctattttaaactaggaaaggggctcaaactcttagctatctgctgggagcaaccctcattgagaggctagagggatacaatggagcagaaaatctcaaattcagtagttaagtgggtttattatagataattctacgttttactcgcaagttaacatgtcctgttaagaatttagttttgaatgggtgaggtgtatttcttttgatatattatcatcatctttagataatttatatttttatgtctagaaagcccactatctgtattgacaatttataatccctggtgggcagtatcgtgaaatgtaaatactatttcagaattcgtacaactcttgtagagtttgttgatgaaaactgacccacagtcattttaaaaatcagtttaaaaaattattttaccttagtttggataattggtactttttaaaattggggagaattaaattaataaaacatttaattctaaaaacttacataattatgttatgaaaatacataaatatgtaattaaaataattaggcattcactatggattaggattgttcaaaattaaaattttgtgacatgtctttttgtcatgttactaagaaattggatctttattttaatctgtgattgctactaatgttaaagtcctagtcaaaatagtcctataacattttacatttttaagcgtttgtagtaattatgggtttgagaatgttaagaaatggaatttgcctttaagacttctagttttatcagttcaaaacgtatctccagccagccattttgtggattcatgtagtgaaatggacacattggagttttcgtctttactctcatactagttttatggtggagtttttaatcagatgcttttcaaaaagataatggaagctcttggggttgaagaagcagcaagggttgtatgttgtaaatggaatgattagtttgaccatataatgaaacaagcagttcagaagatcatactttgtcatatgtatgctttttttttaaaaaaaaaatgcagacctgttagttatattaaaatgctttcttttctataactggttctctgcctttctatgcttgcttctaattttcactcatttttatctccttcctctcatcctagttccaaatttttatttattagaaaatattttactactaacaaactttaagcatagcataaaatcattttgcttcttagggcttgaaataagtgtcttttaatgactttgtaaaattttaaaagacatgcttattcttaagattgaaataaagaaaagagagcctttataatagttgtctttgattccagccttctagcttttttaaaaaatacataactttaaacgaattgtttttagaacgatttaaaattacttttggaatacttagaactgtggttattgttcccaactggaacatgtttttatgttcttcctccaaattaacaggtatttattttgttgtctaaattaatctgcataatttttcttcaggcttttcttcagcaaaatggatcagccttttgggttctttgttttgtaattttatgttgtttgggtgcagaaccaaagcttaaaaactttgtatctagagcatatggcataataaacacttaacaaatatgtgaatgaatgaatggattgaatgaatgaacaaacaaaattgaggtgaagcaaaagcactgatgtcatagggtgtagggtcttcagatgtagagatttttgcagttggcctagtaaaatgaacttgaagattgacactggtttgcagacaactgggaaattctgttattttcagcaacgtattaacaacatactgtaaaaatacagttgtaaagttcatagatccaaagtttcatagtacttttttgatagaaatcatacatgtttatggtagaaattttgtgaaatacagggaatgaagaagaaaatatgacttgtttttaagtctgccacctcgagaaaggcagtgttagtagccatttgggatatttatgcctacaaatgtcagcacttaattaaaattgaggttatatattttcagttttgaatccttcgttgttgagaatccaattaaattttgttttctctttaatttttaaactttacaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcaggtagcaaatcatgttctgaatttatgtacatttgaattttgaccttttatgattatgtttttgtttaataaggtttcatctggagggagggaaataattcttatattattctggttttgcctttaaagatgtcttgttacagtactctgcaagctgtttcagaaaatttctcactcatcttctgtgtagggagtgtggtcagtttataagaaattattgtcaattacaaactttagtctttatttctacagctaaccactaccttctctgcctttgttattttatctttgaaaaattatatcatttttctgatgggtcattctccttcagatcatgatcatattacacattgcatgcagctatagaagtgtcataattcttttgcttaaaaaggtgcaatgccacttttttgcctactgtgtcaaatcagatgagtctttatgcctttcattgtaaatgtcaacagtgtcctgtgtgtgaaaactttatttttattttactactctcttatgtgtttacttgtcaaagaagtatgcttgccatatatggattacttactcctgctgtggagttgatactggtaccatatctaatgccccctataaactgtttctttctttctcagtccctctgacttcactaatatagctgagaaataggaaataggaagtaaatatgagaacttttatggttccatgtattttacttaggggagaacctctcaggctgcatttactctttctttacagcagtacttctcaactcccactatatgctgtaataacacagggagcaggaacacacatggattcatctctcccagattggaatctctaggagcatgacttagaaatgttacatttaggccgggcgcggtggcttatgcctgtaatcccagcactttgggaggccgaggcgggtggatcacgacgtcaggagttcaagaccagcctggccaagatggtgaaaccccatctctactaaaaatacaaaaaattagtcgggtgtggtggtgggcgcctgtagtcccagctacttgggaggctgaggcagagaattgcttaaaaccaggaagtggaggttgcagtgagcggagactgcacgagtaagactccgtctcaaaacaaacaaacaaaaaaagtgtaccttaaaaaaaaaaaaagcctgggtgatcttgataagtaatcctaagatattataataattctgtatcagttttcaagtccacagcagaattgggtacagagagagagaacccagggtaggctcattgagagagtatttagaggtggagcctgactacaaaggccatgaaggacagaccatagagttcttggtgacactaaatcttccctcagcaggtatagccaaaaacctcaagagctaggaaaaagatgttttagtgagtcttgcggtaaggaggcctgggaggagtgcttttcatgtttctttgctaagtctaattcatcagttcctgggaaagagagatgggaaataaagatgaaggaatgcatgcactctgcatgttgctgctttctactacatctttaagcctttagcacaattggaagaagagagaattctttcttttttgagacagtgtcttgctttgttgcccaggtaggagagcagtggtgtgatctcaggtgactgcaacttccgcctcctggattcaagtgattttcctgcctcagccacttgagtagctaggattacgggcgtgtgccaacatgcctggctcatttttgtatttttagtagaggcagggtttcaccatgttggccaggctggtctcgaactcctgacctcaagtgatccatctaccttagcctccccaaatgctgggattacaggcgtgagccactgcgcctggccagaagatataattatttcaatccacatggctaaaaatagtttattggtacaaacagttatatccctaggaatccatacaactatgcagaatgactttttctttgaggggcctagattgctggtttctgtgtattaatatttcttgagaaaacaacgtatcaaaacactttctcccacagaaacctgacttattaaaaccttcagacaaactggttactgattacgcaaacatgcccttggattgttctacttaattagaatttggcttttccagtttttagtgtagtgtatttccatttacagtcactcaaagctatgcttcttccaacaaccttctctggttaattctctgtactacatgctcatttctctttttccctgtgtccttttgacgctttgttttttgaatttgcttcaatttgtgcacatttttatatatgttttcaagatcgtctttgtcttgttatgtggtctgcaacctaaattagagtataactcctataaacttaaccatgttgtaagttttcgttttattcacaaatttttggttcatagtgattagcttataatcattaactcagtgaaggttgctaatggaattttatttagcttaagctgtattctgaggcattttatccagtacatttcctgctgctgtgtatttggccccttgaaaaagttgtcttaaccttgatagcagttaatggacttctcagacacaccttatgaataagactttattacataattatttcttacatttatttacccgtgtttatctttttgaaagtgtagagatatatcttagaaataatctaaagttagggaaataatttctataatgccatgtacatattttgtgtaactgttgattgattctttgtatagtctgttatattggactcatgttacataaatttagcatgacttacaaccacatggaaccttagaaaacttaaaagacgagaaattataaatgcttaaaaattgctcacgcctgtaatcccagcactttgggaggctgagacgggcggatcttgaggtcaggagatcgagaccatcctggataacacggtgaaaccccgtctctactaaaaatacaaaaaaattagccgggcatggtggcaggcgcctgtagtcccagctactcgggaggctgaggcaggagaatggcgtgaacctgggaggcagagcttgcagtgagccgagattgtaccgctgcactccagcctgggcgacagagcaagactccgtctcaaaaaaaaaaaaaaaaaaacttaaaaattttgaatgttattgagactgtagaataaattttagaactcaagaggctatatggtttccttgtgtacttttgttttcttagaagatttaaataaattcataaactctgaaatagatgtttatttaaaatacaattttgaaaaattaattatattaaaacaatatatgggctgggtgctgtggcttacgcctgtaatcctagcacttcgggaggctgaggagggcggatctcttgagcccaggaattctataccagcctgggcaaaatgacgaaaaccctttctctacaaaaaaatacaaaaattagctgggcatggtggcatgtggctatagtcttagctatttaggagcctgaagtgggaggattgcctgagcctagggaggttgaggctacagtgagctgagattgcgccactgcactgcagcgcagcctcagccacagagtgagaccctgttttaaaaaacaaaaaacagatggtagtgaggttttaagttactgagtatttctcctttaaatatctcagttgtataattttaaatcagaaaacactaaaatgaagcctaaattcatagttttaataacttatatttaatctgagcttataggcattatagttaacgttggcaaagttttgaaaattttcacaagctgagtttagaaagggcaaaatcatagattcatatttaatttttaattgtaattgtttattttgttggttgtgcaaaacttagtaaattagaaagacagacaatttaaaaatacttgggatccattaagttgattcttaaacattccagtgtttggtttcttgaacccttcttggttttttttaaatttgcatatttgtgaagtagtaggaatgatactattgccagatacggtttaaggcaaatcccagacttagtataatttaatctgtaactgtttcaatgtatgtctttcagacatgcaggagacaatataatatatcctttttttcttatttagtaatgctacagccctttgactatgatccgaatgaaaagagtaaacacaagtttatggtacagacaatttttgctccaccaaacacttcagatatggaagctgtggtaagtatagaagaagaatttgttttgggaagtggagtttaaactgtgggtgttgtttagcagtcagtagaaaaacttaatttctaaaaactaaaagttaaatttaggtttttaaaaaactgccaatttcttcattatagataatcctaacttaaagaatgaaagaatttttaaatagtatttttttttagaaacaatttagaaatgctgctactggcctggtgcagtggctcacacctgtaatcccagccctttgggaggccaagatgggagtatctcaagcccaggagttcgagaccagctcaggcgacatgacaagaccctgtctctacaaaaacaaacaaacaaacaaacaaaaaacaaaaaaaaccaccacaacaaaaatgagctgggtatagtgttggacgcctgtagtcccagctacccaggaggcatgggaggattgattgcttgagcccaggaggggcgactgcactccagcctgggaaacagaatgagaccaactggaaaaaaagaaagaaatgctaagaagaaagtcctatggttgctagtaatatcatcgtgattttaatggatggtgatagtaactaggattatataaaggttctgtgacattagccgataacaatggcagggtgatcaataaagagtgcaccagtgtgtttcagccaagccaggcagcttcactcatcttttagctgtcccgtgaggtgaaacttacttaccatgatcatacctcctatgtctcatgtttggttttgtttatttttagtggaaagaggcaaaacctgatgaattaatggattccaaattgagatgcgtatttgaaatgcccaatgaaaatgataaattggtaagtaggagaatgtaaaaaaaattgggagctgttgagctctcagttcctttgattaattttgcttttatttttgacctttgaggtatgtgtgatatggctattacacttcataagactcagtggttaagttttaaaaaacttggtatgccttttttttttttttttttaaagtaacattttgtttatccaagaagaaagaaagactcacttttaggtcaagactgcatcctggagaagaatcatttaagtctaccagattttttgtgacgtaaaccactgcaggttcttttttagaatgagatgtgtatacataatttaaaaatacatataaattgctttttggccactatgtaccggcagtttggggataaattcacttacatggacagtttattccaggtttagttattcctaggtattttgctcacttttgtttttagtcaaatccatctgattgtattctttagtaaataattattatgttgcttactcattagtgtaagtctaatacaatttgggggactgagggatgtatttgtttattcaaaaacaaacaaaaaatagtctgtgaatgtaccgagtgggttgtagtcacttaccttgtccatttccctgtctggattgcaaatttgaatcttttcctatggtgagagagacttgaaagataaatttttctgtgtgtgtatgtgacttaatacatacaataatatggataaatagaatggtgtggcacaatttggttacaatctgacatgactactgccttaatctagtggccatttgctctattgaaaagtaaacatgcagattaaatatgtgggctcagttattgtgttcctctttcaggataagcagaaatgaaaaggtctctggtaattaggtgttgaccaaattatattttgaatttttaaaatgcctcttttaagtgatttttgaggtatttgccaaaagcaaaaaattgtgaacacatgtattctctgtggaaagtgagtgttagatggcctgtgtatgcttcccatttggaggttttcttttttgcttaggcggagggaagctaatagcttgcccagctcttactgttgaaaccaagaaaacaaaacagcatgttgtctggattgactttttaaaaaaaaatttggatattttctcactgagagttttatgtcattttttacagtaattcggtcagcgtaaatctatcttctatctgggcttctactgtgctctggatagcacacactttgagatgtgtgaaaaggattggaaccccaggtatttgatactgctgattaagagtagctctcactggtttagaaaccaaaccagaagttgatgggaatgatacggcaatgacagttgaacctcgccatttacacatcttgggtgaaaagagcagttatgcctacctattggtctagcccatagttatccaagaaagtagttttgggtctgttttagcgcttgaacaaatactgaatggagttcccagaatcccctgcggtggaactcgagcaggagtagtttgagcctggaaccttttcagagcaggtattactagtaacctaaaagctgttaagtaacttcaaagtactttagagaatatctgagtctgaaccttgattagctagctgcagaatgtattttcactaattggattatctggacttgtatattaaattgtaggaaatatctgctaaagataatttttaagatttattttgaaaacttagaagcacctagaagagtaggtaggaggagtacagtgaacctctgtgaacttatgagcagctttaacaatgactagtttgtggttaagcttattatatataaatcctgttaattctcatcttaggtattgtttaaggcaaatcccagacttggtataatttaatctgtaactgtttcaatgtgtatttttcaaagtactttaaaaaaagagataaaagagttttaatgacaatactgttactatgcctttaaaaatttagtatatccttaatatcaagctgtccagacagcattaaaacttgtcacaaatgtcattaaaatttttttttctgcagtttgtttgaattagatgaaaataaagtccaaatagttcttcttttttttttttttttgagacggagtcttgctctgttgctcaggctggagtgcagtggcacgatcttggctcactgcaacctctgcctcccgggttcaagcagttctcctgcctcagcctctctagtagctgggattacaggtgcacgcctggctaatttttgtattttttgtagagacgggattttgccaggttggtctcaaactcctgacctcaggtgatccacctgccttggcctcccaaagtgctgggattacaggtgtgagccaccctgcctggccaagtccaaatacttctattggatgatacgtttcttaaatctcttagtttgttacgtttcctctcttttttttttttttttgcaaattattgaatgtttttattattaaactaggtttgcctatagactttcccacagaattgattttgctgattccatccttgtggtgctatttaaccttttttccctgtccctggtatttcctgtgatcgaaagtttgaaatgagtggttcttatccaggggcaatcgatttgctcctctggggaccgtgcttggaaacatttttggttttcacaactgagaggtaggtaagggtgctacagttaacctgtttagtgggcagaggccagggatgcctttcaacttcctgtgatgcacaaaacagcctccacaacaaagaataatctggcttaaaatgtcagtaaagttgagattgagacagtatgacctaggtctgttagtacatttaagattgtctgatggtcatactctgtcattcctacttcatacactacttacaatacttgtgtaaggagaaacttgtgcttatgtaatatttggttattcagtggtagagtttaaaaaggcagaacaaatgccaaagtttctctttagaggttttaaaaaatgagttggtttataagcatcccacctcgtgatgtacagttgatcttccaccttccatcctttctttcttccctgcttgcttctatattgataaaactcatgaatttaaacatatttgagttttaactcttggtagtttattattattgttgatgctcaaattgcctggtaaggagactttttaaattggttcttgagtttgtttgaccctcatagtctttggtaattttcttgtctaatgtggcaagatttttccaggtccagacctggaaagaagctcagggccatttcagtgggagatggtatttcacaactataatcgaccgggtacctgtgacaaaattgatttttaattttatcaaactttctgttcatttttttgaccaaggtaagagtggaggcccatttttcacttgaaggtgcttcttcaaatggtaaaattttaatgataaaactgtgtcagcagcatataggatgatgtggatccttttatttcttggggtaatgattgcattttatggttggattatgttgggtaattcaaaatgtgcaaaatccaatactgatcctgagaagaatgggcgggtacttctatgaaccagctgaagtggtgtttcaattacagcaatacataaatacagcttatgactttgatggctcactggcctcgtcattatgatttttgatggatgtttttgagtgtttataatttacatttcaagttttacacatagaatgagacttaaagattgtaatatatcaccatttcaaatttatgtaattcaaacttgcaaaaattgtgtctatactatttaggctggaagtggccttaattgattaatgtgtatgttaaagagaggctaaaacacaattgtgtttttataaggcagtatttcccagtgtattaggttggaagtgttctgtagacaggtgagcttggaaaaatactgtaaatgtctccaagaggaatcacattgcgtatttgcctattaaaggctctgagaaaacgtaacggtaaagaaatatatttaacccagtattttttttttaatttaaaataacctaattaacttaggaaatatctgatgttctgaaaaaatatactttgggaaatactattcctgcctaaactcactgttgtagtattaactaccctgcagattgtacaagaaatgttacttactgagaaatgtgtttaaactcagtgcaacctggcacagacccaactccatctgggttgttagttgattatgtgactttcaagttaatcagtttaatgttgcatctcatcttttacagaaaatatgaaatcttaaggtaccaaatctgaagtcttatgatagtacaaaatatataagaagtttttgtttctaacaattaaggataaaaccttttatgtctatctaaagataaacaaaacacctcttaatattttattcatgtggtaataagaccctattgataattgtatcctgctgtttctaggtcaatattctctatagacgaagttgataaaactggttaaaaaaaaagtatctttgacatgttggtttctttctagtatctgtagataaaattagtagttaatattccttttctttgtttagcatgaaatttggctctttggaaattagggcattattggatagtgtgatgcatagatacagtttgttaatttacttcagatgaattgataaaatgctgtatgatgctgaatcctgacttacacagttgctgaaatgacactcccttattcaaagaaaatacatttctaaatgtgcaaggttaacaaaaatggtttgaaaactgttggtgatgtattttttaaaagtatagagtagaaaatatactttttatcttatagttatgattgtgatatagagaattctttgagatcttttgaccctttattttagtttattagtatgttgtaaaaagtatgttaacttaagcaaaatcagttcagcttttaactgcgttgctggtaacaacttagtatttaacgtagaactctgtggatggcatttgtatttttttattcagctttatttagtgtttagagcagtggacaagttcataggggttccttacacctttattttttgttttaatatatgcatacattattaaatgatcaccacagtcaagctaattaacctatcaatcacctcagataagcaccatttttatgggtcactttattttaaagagtcgatcaaaatttcatttttggtagtcaacttagaaaaatttggttagtgttcaaagcagattctgcaatagctatcataattgttgatgcactctcctcaaatattgtagagataacaagtcttgaactttatgatttttttttagtgtgttttaaccccactccctcacttccccagcccccccttcctgtatctctttgcagaaagaagtacgctggtatttaagtactgtattagtctgttctcacattgctataaagaaatacctgagactgggtaatttataaagaaaagaggtttaattggcttacagttctgcaggctgtacaggaagcagggcggcttctgcttctgaggaggcctcaggaaacttctagtcatggtggagggcaaagggggagcagatgcctcacgtggtgggaacaggagcaagagagagcgaaggggcagtgctacactctttttaacagctagatctcatgagaactcttatcatgggaacagtgtcatggggatggtgctaaaccattcatgaaggacccaccctcatgatccagtcgcttcccaccaggttccacctccaacactggagattacaatttgacatgggatttgccgggggacacagatccaaaccatatcaagtatgttgtatgcgtataccccacttgtgtgaggattttgatctttttatggatgctgttaattcttgggtgtttacatgtttggaacacatgaaaaaagagtatgatgttattttgttgatttctttagactttttaggaccttgatactggatatataagtaaggaaatgattgaaggtttgtggtcatcttatagggtgaaaaatggagccagctttagaagcacagtggcttgagtccatgtttttatttttatagtttaaaaaatcatttatttgtgacaaaacaattctcatttatttgaaccatcactaaagtatgggctactttttgggaaatagctttctgatttggatcatagataaagtgccccaggaaacttaggaaccctttcattttagaacaaaaagactcaatattttttcctggataacaagcataagcaaataccatccttaagcacactaagatgtgtcattaccctagtcctcgggatcagcaggtgtgtgccaatacatttcattttgttaatggcccctagtgtcttcagttgagttgttgtcagtgctagtactgaaagccattgagcctgttccctgtattgttgacagctggaggcacatgatacgaaagcgctgttgtacaaaatagggttctttgaattattagctctgtttggattgtcagctctgtatatacgtaatgtccaattagtggtagtggttattttttaaggatcaaatgtggttttattatttttgaagttttatgacctattcagttctttgtgttcacttctaaaaaatttttgaggccttaactctgacattttctaaatttcttaaatgtattgcatttcatttatgtcctccatctgacatttgaaggtgacatatttccctttttttttttttttttttttttttttttttttttttgagacagtgtctcgctctgtcacccaggctggagtgcagtggcgcgatctcggctcactgtaagcgccgcctcccgggttcacgccgttctcctgcctcagcctctccgagtagctgggactacaggtgcccgccaccacgcctggctaattttttgtatttttagtagagacagggtttcaccgtggtgtcaatctcctgaccttgtgatccgcccgccttggcctcccaaagtgctgggattacaagcgtgagccaccgcgcctgaccttgaaggtgacatattttctagaaaaaaatactgattttttttaaatgaagactgaggggctgtaaagaacagggatttcaggggtcttataaagggatttcaggggtcttatcataaaatggttgaatatacattattttctgttgagacagaacaaatggggtatcagtaagtataattagggaatccctttcccacctgtttgtataatacagtattttatctattaaaggaatttgaaaagaaaggaagagaactatggacttaatggttatatgagtctttaagtgtttattggcctgggatgtgtgtgagagagtgagtgtattgggggataggctttaagtacaagagaggtttatgaaattgttcagattgagtgttatcaaagataagaagacatacaagtgcttgtttttcagattattgacaattattaattagtaaacattaaaagccacaaagaattagatggtattcattttaaaacaatgtaaggctggcataaattttaataaagtatgtacatttaataggtgcatgtaatgcaagtagattataactaattttgtttgggaaatacaaaaagcgagttcagaaactacttttgctttaacatagctattattagtattgtttcttatgcattaatgcatttttataaagtgttaatgtttagagcctaatgctttctgtgtcagtcattcccaatatcatgcagaagaaatcagagttcggtgagaatctgagaatatgtttcccatgccatctcagggtataactccaccagggaatgctccgactgtcacttcaatgagcagcatcaacaacacagttgcaacacctgccagttatcacacgaaggatgaccccaggggactcagtgtgttgaaacaggagaaacagaaggtttgttatagggagttaacagacttaggagtctactagtgtcaatggttaagttaatgtagatacctagcagataagtggtattgtgagtatgttgtatgaagtagatagaattgaactatgcctaaaattacaataaaactacaaagcacttaaaaatcatgcatacaaactattctgttctaaaaaacttctgaacttaactaaaatctatatagtgagcaggacagtataagtgtgaacattatgaagttgctgtaatttttttctttgagatttggggaatatactcttttttttttttttttttttttttttttgagatggagtctcgctctgtcacccaggctggagtgcatggcacaatttcagctcactgcaacctctgcctccccggttcaagggattctcccacctcagcctcctgagtagctgggagtacaggcacgtgccaccatgcctggctaatttttgtatttttttggtagagatggggtttcaccatgttggccaggctggtctcattaaactccgacctcaggtgatccacctgccttggcctcccaaagtcctgggattataggcgtgagccaccacatgtggcaaccccacagttttaacagattgtttatactttgatttggttttgcagatgatatgcatactaaggctttaaaaaattatctaaatgtttaataattttttgtttttgtgattgggaattatttacttctgggagtcatgatcctaaagaaacagtaaattggctgtttagagtgggaaaaaaaaacttcaggtaactttgttacttaaatcctgtctcttaattcataggttaagaccttaattttgcctctctcggtttatgacagtactcttgactttagccttttaactccctttatgtgcgtttttatccatcactcctgttagttgtaagaatgtaggcccacgtttatgtcttttatctcctttgttcttcccaaggcttctttgcaaactttttcttgtatttccaattcctagttccctctttttctaattaacccccagtaaaaatacttgggatattagaactgaaattctgatggttaaaaaagaatacagaagtacagtcatgcatctgttaaggatggggatatatattgagaaatgtgttgttaggtgatgtgttgtataaacatcatagagtgtacttacaaaaacctatatatggtattgccttttgctcctaggctacagacttgtatagcctgtggctgtactacaatggtaagtatttgtgtatcgaaacaatctacactgagcttattcaacctgcagcctgcggcccacacgtggcccatgatggctttgaatccggcccacctcaaattcgtaaactttcttaaaacactatgagtttttttttgtgtgattttttttttttaatagctcattagttagtgttagtgttagtgtattttatgtgtggcccaagacaatttttcttccagtgaggcccagggaagccagaagattggacacccgtgactatacacagaaaaggcgcagcaaaaatatggcataagagataaaattgtatacttgcatagggcacttactgtgaatggatcttgcagaactggaagttgttttgggtgggtcagtgaatgagtggtgagtgaatgggaaggcctaggacattactgtacactgtagactttataaacactgtacacttaggctacatttattaaaatttttttctttaatcttagctgtccgtaacttcataaactgtaaaattaaaatttttgacataaagcacaagcacagtgtatagataaataaaaatatctttttaatgtccttattcgctgcctttttctattttttaaataagatttttaaaaaaacttcttttcttaagactaagacatagcacacacattagtctaggcctgcacaggggcgggatcatcagtatcactgccttccacctccacatcctgtctcactgtaatgtcttcagggacagtaacactcatggagctgacatctcctatgttaacagtgtcttctggaatacctcctgaaggacctgctggagtctgacttagagtgtcctttttgttttcgtaagtagaaggagtacactctaaaataaatgataaaaagcataacagtaaatacataaacctgtaacatagtcatttattaccaagtattctgtattgtacataaatcatatgtgcaatacttttatatgactggagtacagtatgtatatttacaccagcatcaccacaaacgtgaataatgtattgtgataagacctcactaggtaataggaatttttcagtgccattattattgtatgggaacactatcatatgtatgaatcattgttgaccaaaacatcattatacagaacatgactggacaactcagatggaggattactgcagataggctaaataatatagtggaaactggacaagattggtttattgttttagttgatacacaccttgaccttccagcttattctgaattgcagtgttaaatgtaaggttaccattcatcaatttactaagagtcacagcatgttgaatctctctggtgtgcttgtttcatggttctcagaacaaccagtcttttctttctggaccagtttgaagcaactctcaagaaacaagctgttttattggagccaaacctcactaatagaggtcctggatggaagcatatacttaaagttacacctgcttaattttttccatcaggctcttcagattgtcactccatgcatgactcaaagcccaccctcccatcacacttccccccattacatatacatatatagcataacatatacatatgtagcatatgtatatgtaaataaattagattttcttgcacctgttatgtatgttcactggtttgtaaggggcctaggtagtatgtgatataacttattgggcacacttttgaaatgtgtttcggcttcactgtattctttgcattctattctgtttatgctccacatattggttatcatttcttctcctttttgttacaaaagcagtataacatttttaagagaaattcaacaacaaaaaaatctaattctatttgcttagataaattctaatctaattccaagtctaattctattagaattagaaaaatctaaatctaattccaatctagttatctttttatggaatgtcttcctatggacatgttatttaaaatttgaaagaatggaaagctgcccatcaaatgcttaacaaaagtgaaatgtttaattttggcaaggcatagaatagaatatttaatgacatgtcatttaataatagtaatataaataatagttttgttgatttgacaagattgtgagaaatgactttttcccttccctccgtaatttaaaattttatgcaatgtaaagaatttaaaaataatcagttgtcgagcttgatgattcttttagttttttttctctttggtgttgaccccatgtatatctttttttcccccttttggagatagggtctcactctcacctgggctggagtgcagtggcacgatctcgtctcattgcaacctccgcttcctgggctcaagccacctcagtctcatgagtagctgagattacaggtgcacaccaccatgcctggctaatttctaaaattgttttttgtagagacagggtctccctctgttgctcaggctgttcttgaactcctgggctcaagcaggccacccatctcggcctcccaaagtgttgggattacagacatcagacatggtgccctgcttcatcctctttaagtttttatcagttttctggtatgagtatgatactttttcccaatttttaaccaaaacctgaaagttcttctattgccatattggtggccattgccacctcctttatagagtaagtcagtgtgccaacctcattatcagaagttggatttgtgctaggatagaatttgaccacactgaaaatcacaaatgagttctaactactattaaggaaaagaacaggaaaaagtattggcagggtaaaatatatctgaaacagttttttaataataggggcggctattattagattggttggggtgggagaaatgggggtgaagaacaaaaaagctagcaagagaaaaactcagagaattgaagtaggctgctttaaaacgttgcttaactgggaagcttgaagaagaatggaagagtctgccgacaggtcacatacatgctgttgttcattagaacctcattataaattttcatttttaaatagattttacatggatttaggcatactaatcaaatcacatccccttcataagaataacaagttttgccctttgaacaatctgtttatacttaatataaaattggcagctgggatggtgtggtaggtgtgcagcctctgataaatcttataaaatgagtattgtggaatgccataaagttgatttagtaaatgtcttttttagcagtttatagctgaataaagcagattttacctaaaattattttaaagtaagtgaatttaattaaaatgaaaaaagcttgttacactaatactgctacgatgtgtggtgacataaatgctgttggagtgaaggatgttggggtactttagacaacgggctgaagaatacataggtgctgtcatagatatttatctccaggccttcactagcttcaaatggttcaatgttggtgaggattaagattttggggctcatagtcttcaaagcatgctaagtgctcctgtgatgttgaatcacgtgaattaaagcaaacagcattactaaagatgacaaattaatagaagttagcttttcttgggcatgttttttcttaggtagtttccgattttattggaatgattacgataatatccccctaccccccagaaccttatttgaattgcacaaccagagcacggaaaatgaccttcaatggattttgttgacgtcattcagcatactttcattgaataactactcttgaccaaagtgctggttttaggggtaaatacaaagagagatggctcttgctctctcagcctttgaagtattacaggaaagaacttgaacaataattattaagatacataataaagtgctatggtagaggtacgtgccagggattatgggaatagagggagtgggctggttatttagactaatctgactgctgacatgtactgatttaggccttttaaagagtttttcatgaacaaagatgtagaatttatattgttatttgtttaaaacctgtaaggagatttggttagttaaaaaattcccaatatctttgtaatgcagaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagtaagttctgttggttgaaaataaattgattgaaatgaaggtataggacatgtgagtgttattaggccattttagcaattagcttttaaatttttgcttggtcagttctttcttctttgccccagtgcctttgctccccaccctactcctcttttaacagtcttcccgtggtttctcattgctgcaagttccttactttagcacacattctaattatttgtgatctggcctgcagtattgccagcttctgctcttgtttctcatgtccttcccattttgtgccctagtcatactgaactgcctaggattgtgttgtcccacatcatagccattagtcacctagggctgttgagcactgaaatgggatttgttcaaattgagctgtgctgttgagtgtaaaatactgatgttgaagagttagtacagaaaaaggtaaaatcttttttttttaatggttacatactgaaatagtagtttgggtatattgggttgaatcaaatatattattaaaatgaattttacccatttctttttactttttaaatgtactgttggaaaatttaactttacatacggggctcacatttgaagctcacattgtatttgcgtggggcagcattgggctggagtatgctggagaagcatctgtttatcacccctctttgctttagtgtaagctcttcactgtgactggaaaggcccagaaccctgcccctcccgacacagcacatacacacattgacgttttgctactacagcatatagcctttgctgggaccctctccaaaagaagaaaaaaatcgatttgtcatgtctgctttgtgcctccactatgctgatcgccttctactgctcttacttgttagaggcctttctccctctagtgggcagtaattgccttggtggcaagggcagtgcttcatttatctctgcattcaccatacatgcatgtggtagtcattcatgtatttgattgaattaaatggatggcgaaggaggactgatttgaatatgtctgaaatttatgaataatttgtctttgacaagtaattacttgtttcaagacctaaatacctatacgttgctctctaggctttgtttgaagctctttgcagcaaagtagatgatacaaaaatgtatgtaactaaaataagctaaatgatgggagttatttgattattccttttgttaggtgtatgtaggaactacactctaaattaaaggcactgtgttttaagtcgatctgtgaactcctttgctgaaatgctttttaaagtgaatttttgtgtctcttcatgcttgatgtttcatagtaccccctcgaggggtacccgtctgcttccaagcacttgtctgggtagcggaaagaatatctttatttcacacctacacgccatggatcttttaaaggatgttgttggttacttttacttcatctgccatgacttccatagttctgttctttgataaagatgtgctccttagggtgctcaatagatttctttcaaaagccactgtttacctctggcagggaggggagaagtggaaacagtgagaatgacatagatggggcagggctggaaaataggaagagtgaaccagggaagtaggtgagagagactttattcctggtttctactctttttatgctagtgttctgtatgagattttatttgagagatgattctgctgctggaaaagtaaaacaaaaaagctgggctgggcgggtggctcacaccggtaatcccagcactttgggaggctgaggcgtgtggatcacctgaggtcaggagttccagaccagcctggccaacgtggtgaaaccccgtctctattaaaaatacaaaaattatccgggtgtggtggtgggtgcctgtaatcccagctacttgggaggctgaggcaggagaatcacttgaacccaggaggcagaggttgcagtgagcgagatcacgccattgtactccagcctgggtgacgagcaaaacatcgtctcaaaaaaaaaaaaaaaacaaaacccttgaagacccactggcttacagaatttcagaccctatacacaggcccaccataattttttgccaggttcactttcttgctcctgtctgttcactatcccttttaattcccctagccctgtggttcttaattcacactgcatgtgaatcacctagtgagctttaaaaagttacagttgaccaggcttgccccagacctaatgagtcacaatcacaggagtattaaaagttctgtagatgtttgtgatgtgtagctgaaactgagaattactgtttatataggactaattagcatgagaccaaaaaaacccaactccagaaaatccagtaatgcaaataaaactgtgccattaggtgtactcttttagttagtgtttatttataagcacaataaaggaatcatgggagaaaatattgccttgtactgaaaaaagtaaaaaactgtcctgccatttatcagattggttaacagacagagataaagacaactgtgtagttaacaggtattagtatttttcccaaggttcacattgcacacagtgtcataacaacctcctgcttggagtgacttctgctttcttctgagaaaccttctgctctaaagacatagtgctgtgtgaagccatatcagcaagaatgaagcagcctactcttgactggaggatctaagtcattttgacacagagaagcaccctcattttccagtccaggtgcagagcttcagataagggtttcctatgtacatttctcatctaaatttgtagtttctgaagaaacagtattctttctctgctttgcagtcgagacctggtgctaccactttacacacagccctctgctttgctttgagcatataaaaacactgttacttaaatttcacgctaaactgtttccttcccccaaattctgtgataccatatctctgtttacggcaagaacacccttttgtgcctctgctgttccggttccttagttgcagtgtgtcagtaaacccaaatggcagactacaggtctgggtagtttttggctgattgggctaggacggatgtaactgattttaaataccatgggccaccttggaagtactcttctttaattatatttttagtgggatttaaaaaaaggtaaatatagcctatctaacttttgctttttaggaatacatttctcagctccagttttaaaaaatcagtgttattgaggtataatttatatcccatggagacacccactgtgagtgtacaattcattgatacatagaactttgtaaccatcactatagttcagttttagaatgtctatcacccccggaaagtttccttatgtggttagcagttaatccccttttccgtccccagccataggcaaccactaatctactttccgtccctatagatttttagctccagtagtctcgttagtatgcttgtttttaaaaaccttttgtgtgtgtgttttttttctaggatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaagtaggtgtttttttcgtgctcaatttggcactcaaaataatgttcattatggaagtttggtaatactgagcaagcctgtggaattttctttatgaaaaatgattttagcctttgcaaatgttaaccatgtgaaacacattttcagtataagtatgcgttacagggtttgatactttcctgcacttaggtttgtcctattcttcatttattcatactaggatagaaaattttggaatcagaaaatagatccagtgtttagctacatacaatctagtacaagtgaatttttattcttaaacataggtgtgttggctctttttttaaaagatgcgctctacctgaaaaggaaattggattttagaactggatgtggtgcagtgaagtattttaggcccaggtctgtgtacacattttatagaagaatgaagtactctgaagtattttggttgccttttcatttcaactgtgttttgaatttgtcagatcacacatatattgtgttattgggcgctgtggtatcttttataaaacctcttgcttgtgtgcaaaagttcctaaaaggaaacacaagtaatgcctatccattactagcatgctatgctgcatgctttactgccattgctgtatgctttactgtctttgtaaaaatccccctctccccttttctggtaactggaaaagcatgctaaaaatagtcttatattttcaccccataaatgcagaatcagtaattccttggcttaaagctcttatataatcaatattattggtggtaaataccaagtttggtatctcatagctatctttttttaaagaaattaagttcttgaaaatttagccaaatcccgttttatgggaatgctctttagaattcattttgttcagcccctttgttctatggttgagaaatctgaggccttacgaaggttaagagaactttccccgtgtctcacaggtaggtagaggcagagctggaactagatatctggtctgttgactctagctcagtgtcttctggtaactgttgaaaattgtcttagtttgagagatggctgaaataatgaacataaaatgctatttataataacaagtatatgtgaaatttcttattgtaagactactaccggcttactgttgaatagtttggttatagtgtttaggctagaaatgcctcccacattggtaataaacattacaaaatacaatgtatttttaggtaggcattttataaaatgcattatgccatggttgcttttgagatagattgtagtctgggtagcatctttaaaatgtatgtgggcttaactgttgttcatatcaggagatgctctgattgtataggtgagactctgtttctgttatttttaattgctgtatgaaatgtgatcagattattttactaccaacagttatagtttgaaagtccaactgtattaattgactgataatatgataatatagagattaaattgtttgtcttcattccttatatgtttagaagtttttgctttgtctgcctgcttacttgtatatgtaagcatgagggaaatacactgttgctaatactgaaattacaatcaagtaactaaggccttgagttcatatgtgacactgaatgcactagcttccttcgttctataactaatgtaccttaacttcccccattcttatatttacaagaagctaagtcattatgttctgagtgtgtggtatgttcccttaaaaaaaaatgacacttggaagaaaaatgtatgaaattcagaaattccgatcaaagaaaagtaattctttctttttttttttgagacagagtcttgctttgttgcccaggctggagggcagtggtgtgatctcacctcactgcagcttccgcctcctgggttcaagtgattctcatggctcagccgcctgagtagctgggattacaggtgtgagccaacaagcccggctaatttttgtatttttagtagagacaaggtttcaccatgttggtcaggctgggctcaaactcctgaatccgcctgcctcggcctcccaaagtgctgggattacaggtgtgagctgccgcacccagccaagaaaaataatactcttaaatacttagatgttcacctaaagttgatattatttggtatgggaattacttttgaactgtaatctttcagattacaccactttgaaaacaagttttaacagtagggtaaaaatatagtttttgagggtattcccaacttgtgatcttctaccactttagagacattcaagtaatagttttcttagagctttgcacattcctattcactgagattttaaaaatttcacctttattcgagggaaggatcaatgcttattaccatttggaaaaacgaagatcagaaggtaaatgatctttattttctagctttaaagggaaattaaaccattcatgaataaactttaaaaatgtgaagtgtccttttccttttcacaatacaaaaaaaatttcaacagattgtgtggtttgtgcatttatatcctgttaagcattaatagctaatcactgggacttgaattctgatggcagatagtctcttgcttagtgagatggagttaactattttttagtaggaagtgagaacagctgattttcatgccacgtttcatagccccacttttggtagactaccaccacgcttcttcgcgtaagcagtggcatcttgggaatgaatgcccagccgctcgtgggttggtgcaaagaagtataaacatatatcactaaggaaaaagaaagtttgtcttgcccttctgacacagtgtgtgcacttcaggcaatttttggaaaatataaaaaattccaaattctgcctttcagcagcatcaattgctaggaacatttcattcatttccctgtaatattaatgttctttaagcataatcactaattataagttgtatcctatttttttccagcttaatttctgtggtttattgaaaaccaagtataaatgtgactaaaagcattttgctttgtttttatagttaactttcttaaggttatggacattttataatgtaacatttgattggcctggcctcttgacaattcccttctagttatgcatatcctcctgttgccacatttcttgttttaaaactcagtttcttgttttccagttgttgctatgtataacacccatcttgaaagagagtatataggaagttattcagataacttttgtagtagtgatattcaactatagcagtaccttaactcatgatgagcttaggaacataaaagataattgttgcttgaatagcacccccagagatactgacctaattggtctggggtggagatctggcatggtagtttttttcaagctccaatcatcggccagacagttgctttatgtaggtttttaaatgccaaaggcagatatgaagtagatttaattaagacttgacttcagcaatacaggggaacttaaaatacttatttttctttaaactgcaggagtcactgttaggtattgcttaaaaaaaattgcataaaagctttgcttgtcaagttaggattgctggaataccactaaagatttttgacttgtgaataaatgagctgtcatcgcaaaaaggcgatttgagaaatgtgggcttcagtattaattgccattttgctgacacccagtgtacctacctacctgagaaatttattttgtccatcatgtatttctcaaagcaaaaggtggttttcaagtataatgtcgttttcaacatgcttattacttagttttacgtcagctcatttcatcatcattgataacttgtgaaatacttatctccatcctatggaataggggagacgggtttagacaggttcaattagctcaagtctacacagctgaagtagcagagaaagtgggatctagatggtctgatcctagtgatctaccatatgaaggacatagtttgtgtcctggtccaagtcaaatattgactcctcacaaacagtaagtatggcaattttgtgatgcctttgattccactttacatggagtactattatttgtgaaatgtctttaagatttttggtcttaaatttttgaagactgctttccccctttatctcccagaaaattgagaagaagtaaactcctgcccactaacaatctcagtccgtgaacaaaaccaacatgaacattcctaaacaagagtgtgtgttactctaagaagaaggctatagaatttatggaaatggcttatgtaacctacaagactggagaacagaatgtgactggccttttctaatggtcctttaagatttaatgattaaagcaagagttttttataattgactttgtggtctaaattcttgatactgtttataattctacaaagaacaaaaattgttatgtactataggcacttaagaaccctgaggaaaaataatacaatgtgtgtgtgtgagagagagagtgagttactgacattgttccaaaaaaaaaaaaaaaaaaaaaaaaaatgtggagggttgaaatggtaaggaattggaatcttttgtattttcgagcaataagaattcctattcttgtttcaaatagaggtttgttaggaattacagttgtggggagcaaactttcttttttgtgctgttttaattcaaaatgtatatccttaattgtatataatatgtagataaatatatgagggtattaagctactttgaattaaatttaaggatatatttcacatgaaaacaaatacaaacgagaatcaaaataaagttttgcaaagta

SEQ ID NO: 2148 - DNA, 46064 bp, Homo sapiens; identical to SEQ ID NO: 2147
  source 1..46064: mol_type = genomic DNA

SEQ ID NO: 2149 - DNA, 16675 bp, Homo sapiens
  source 1..16675: mol_type = genomic DNA
atattaacaaaaagttttttttttttaatcaaagtacataaaataaaggtggacacaactgtaagtgatcaccaaccaggggatgtttgggatttttagatgcattaaaagagagtatagagaatatccacctgcaagtaagattgtattcttttgcaaccctgcgattttcaaatggcaccccaacacagtctttggtcaggataagggatcctgcaggcctagccttaccgtccacatcaaatataggtggagggatgccatattctccacatttggagctctgtcaggctgctccctttccaccagtcctatccagtgatactgcagacaaagggtgaggcaacaggagacatcataccgatgttgatcaggagaggaagaaggtgcaatcttacttccaggatttcacatttggaagaatgccttgggagtggtgggtagcccaaggctgttcccaggaaaagaagcaggcacagggcccaggactcaggctccattttgacccaacgtttattgtccttttacaacatgtcattttttggtttagaaactgcttgtgattagttttccaacattaactcaaaagcatgtaaaataaatcaacctactctctatataaacatccagcaactgtggcccctacccacctacccaggttggatagggggaagggagggctcgggcagcattgagtcaagtgcagatgctttactgtggcaggtggcagtagtgccttggttcacaccccacacaggtcccctgcactgccccaaactacaacagaaatggcataggcccaaggcccaattccctgttggtaattcactctccgcctaccaaatgaaaatcgcttttattttatcgcttttgttttgtatttttgcaacagaaaccccctgtccagagtcagactgtagctgaactgttcagactggagaatggagcaggctgtgggcgcacccctggtccctctcctgggcaagcgcccccacccccagggaacaaggtccaggcaggccagctcactgcacgctggccaccaccacttagccatacaggtcatcatcattgtcttctgtgtatacactgccacctgtgccgcctccactgccctgactggggccagctccaccctggttccctgaagggaatctgtgtacaagagcaaagccaaaaaagagggttaggacagggcctgtgtaagatttccacaactacccctctagcttccttaggactcccatcccttttggtgtaggtccccaaagtaacttaagcactgtctaatgctcccaaccaacttacctgaagctgccaaagccccgactctgctgaagggtctgggcaaacatctcatacttccgaatgtcattgtcactgacagaacggcgcgcaaagcgcatggcttcttcaaagtgatctcgacggatctcaggcactggatcatcctcttctacctcctatagttggtaaacacagatcactagggctagttaaagcccagcctggatttcatcccaggcctcccattactgcagtttattggtctccttgcccttccaatccaacctgaggtaagatgctaggccatgcttcctaaaattgagtcactgctctgcttaaaaacttgtcaatgcactctggaaaagggaaaactgtagggacagaaatcacatcagtgatggggcttaaggaggggagatgttgactgaagtggctaaggaaactttttgagatagtagaaattttaagtctcaactgtggtagtagttatagaacttacacacacttgtcataaagcatggaaatggtatatagaaagagtgaattttattgtatttatatcataccttaataaaccttaatactttaaaaggaaatgccaatggctttcagtgcttaccacatttggattacatcctacctagcggtctcacttccagtgacatatatactcttaaatctacccagggtttcccaatgattgcaatcctactactagagcacattatttgggctgcttattccctttattcaaattctactctcttcacagcccagctcaaaacctatctcttccattgagaggccaatttctgtgacttatgtgactacctcctaggattagttcatcagtagttgttaagcttttatgggagagagaagggatgtcacagacccttcaaaagggaaagaaagccatttatttgctcattaagtcccatgtttggaacttaatgaattaattaagggtaacacaagacatagtggaaaacaagtgagatgacagagatcttacctttatggaacttacaaacacatgaatttgccttttcattttgggaggtctgtggaccctatcccttccccaaccatcagggataagtatatgagtctcatctcagctcaaaaccttgctctgtggttcacgcctgtaatcccagcactttgggaggccgaggtgggcacatcacaaggtcaggagatcgagaccatcctggctaacgtggtgaaaccacgtttctactaaaaaaaaaatacaaaaaactagccggacatggtggcatgtgcctgtagtcccagctactcgggaggctgaggcaggagaatcgcttgaacctgggaggcagaagttgcagtgagccaagatcgtgccactgcactccagtctgggcaacagagtgagacttcgtctcaaaaaaaaaacaaaaaacaaaaaacaaaaaaaaccttgctgtgtttgctgcactctcatactttgatttccctcatggagcttggttcagactgagaatggagcctgaccatctcttctcggccttattccaaattgaatggattcacctcagcattctttatctttgatgccctattaaaattcttctcagttagatgatctttccaacagcttctactctcaactccagggcatggtggtggctgctgcctggctctccatgattggcacatctggggaaaggatgcagactcaccatggctgatgggtttgtctgcctctctcgttctcgcctaatctcactctcgatggattcacggatggccagcttgcaagcacgctggcaaatctctgtcaggtcagctccagagaagccattagtcattttagccaggaactccaagtccacatcctaaaagcagcagcagaggtaccttagcatttagcctctcctctcgagatacgcagatctttgggctacccgagcactcccaactacagtttgccccttctttggccaccccattttattcctgattctagattatcttgatatcctcaaaaattctaccttccctttagaccaaccctaaccccagtggaatcttgtccagaaactaaagagcactccgtaccagcctgaggactcatgcaagtctcccacagcccatgatcttgcacctgccttggcaactggggacttgcgcaggttagccttgaggatggcaacacgggacttctcatcaggaagtgggatgtagatgagctgatcaagacggccaggtctgaggatggcaggatcaatgatgtcaggccggttggtagcgccaatgatgaacacatttttttttgtggacatgccatccatttctgtcaggatctggttgatgactcggtcagcagccccaccaccatctccaatgttacctccacgagccttggcaatcgaatccagctcatcaaagaatagcacacagggggcagcttggcgggcctgtaggaggaatggattgattcaagcactaacaaaactagatgtctctaggcaaacgtggtggctcacacctgtattcccagcactttgggaggccaaggtgggaggatcacttgaggccagaaatccgaaaccagcatgggcaacatactgagactttgtctctacaaaaaataaaaaattagccagatgtggtgacgcatgcctatagtcccagctactcaggaggctgaagtaggagaattgcttaagcccaggtttcaaggttacagtgagccatgactgtaccactgccctccaacctgggcaacagagccagaccctgtctcaagagagagagagagaaaaaaaaaataacactaggtctctcagacctcagaaagaaaatcaagtgacttactgtgcagttgagcagccagcactaagaatatttcaaccctcttaaagaaaaacagcctctattccttgccctcaggcaaatcaatacatagttcagcctattgtagctcaccttgtcaaagatttctctgacattggcctcagactccccaaaccacatggtgagcagctcaggacccttgatggagatgaagttggcctggcattcattagcaatggctttggccaacaaagttttcccacagccaggaggtccatagaacagaactcccttggaaggtgtcatgccaaacttcaggaatttgtctgggtgctccacaggatactaggaggaaaaggaaagagggttcaaggctacctccacattttgaaagaaacctaactaaacagaagcatcccctccattatttcatggtgtacccaatggtatcagatccaggttctctagaagaagactccttagtgcctcaaacctaagaacagtaggttcctaagtcgtgctctcacaactcttgcagcaaatgtgttgacaccctgagatcacccagatcaattacaatgtactgagacagtgactcaccctggaccaagttgccctacctggaccagctcctgtagctcacgtttgacatcctctaggcccccgatgtcttcccaggttacctgtggcacctctaccacggtttcccgcagtgctgatgggttactctggctcaaggcccactagaaaaggagggaaaactggggatgagacttatcaagggaggggtcaaagcacgtatgtgtgtacctgaggcacgggtgtggtccttacccggaagtcatccatagtaactgctagagagttcatgacctcggcatcaatggtctcatcctctaggtcaatgagatccatcttcttgcggatggcttgcagagcagcctctgagcacagggctgctaagtcagcacccacatgcccgtgagtctcattggctacctgcagagaaagatctacttactatgctgcctcaaagacccagctgctgcaggaggctcagagacaatagaatccttcccctgactgctatccctgggtcctctcatttccttgaatatatactatcaatacctttatgggctgggttttaagtacttaattctggacttgggacctagaaataaggctgctccaacaattctgatttactctaaatgcagcgtcaactatgaaaaatgccaactcccatttcctggattcaatctcagattacttcctttcccctgtccagaaatcaaaacccatctcctcacatcttaaccttatgtctctagccagttcccagcaactgcctagagacactgtaacgcctggtcagccatcatcatcacttcacctgttccaggtccacatcatctgccagcttcatgttcttggtatggatctgaagaatctctaagcgtcctgtagcatcaggaattccaatatctacctccctgtcaaagcgacctgtgggacagtacacaaacataaacagggctcatctctagtccagaggtaagagacaggcctagggtgaccaaccatctcagccagcacaggattgtcctaatgccagcactaaaaaagtctcaagctctgggaaacctttcagtctcaggaaaaccagggtggttggtcactctagacaggacgtagggtaaaggaaaaagacccctggacccaatcactgtgaagggcttcaagaggattaggtgacttagatgaaggagagaagtaggacctaagcaaggacggggtcaaaagtatctggagtccttaccaaatcgccgtagagctgggtcaatgctgttgggtctgttggttgctgccataacaatcacatgtgccctctgctttaggccatccatgagggtcaacaactgtgatacaatgcgccgctccacctcgccatgagtctgccagaacaggatgtctggtcagaagtgaagtcagggcctttcaacccccctctatcccctcaggtaagctcctactttctctcttttgggagcgatggcatctagctcatcaatgaagatgatggcaggagcattcttctcagcctcctcaaaggctttacgaaggttgctctcagactcaccagccaatttgctcatgatctcaggacctgaaaggatacagaatggagacaataacaaaatgatagtctttcccaattcctcccaaaaatcagttatcttgcttgtttggcccagagacaggtcctgggtgagaaggtggtaacctctgcctacttctcacatcctctaccagccattatcccaggacagccaccaggcaaggctggagagaagcccagggactcactatactcttctcacagttgaactgtaaaggtgacagcaaatgctctaggacctctggctagagcaagagagatggcacaccagatggcacaccactaaacagcattctccaagagccagtgatcaaagttcatttgccccaaaccctctcaaatcactaaccattcaccctttgatttctcattctagcttgctcccgctctgcagtctgtccacaatctttctcaaagggggcaggacagggagcaccaatgtaaaatatcttccctttattgctcttctgtctgtaacataccccagcataagaaatatgctataaacatgaaggagggcatgggtgcaaaaaggatgtgttcataagtgctccagctcataagcccagttcaaaattgggtctagctagacataagatgaaccaaatatctcaccattgatcaagaagaagaaggctccagtctcatttgctacagctcgagcaatcagggtctttcctgttccaggaggtccgtaaagcaggattcctctaggaggctgtggaccaatgcagagtgtgattaggttcccaccttctcccaaaccctaaaatggcttgactagcgctccagagagggtgagaatcaggcttcaaccctgacaatattaagaataagccctccgcagtaaatgctaagaagacaattactttaggccacactcatttctattactagcagggaaaatactgctagaaagtgggcaacatttatgattgcaacttgcataggagactaagggcagagaaactgtagtccaaatgcgtttgaagatacatgactagggaaaggcaagaggccattacactaagggctcaattttagacagaccaagggccaaagactagctaagccatttaagagagcagggtctattttcttcattgccagaggatcactcactccagtaatcatgccctccagaatttatcacactggaatgctgttccttacaatcatcatttttcttcttcaacactaccctttctatggcctcatccacaagcagaacatgtaaactgtccacatagaaaatgaaattatttgtgtgccacccactaggaaaatgagtaacttcatcttcagtgtgttccatggaaacactttcccactaggaaaagattgagaagctacactctagaccaatagttctcaaatgttttagactcagaaccctttaacactctgaaaatttccttaacttccttacttctactgggtgacattgctctagacaggctggcaaactatggtgagatttgtttttacagggtccattgatacaagaatggcttttatattctaagagttgtaaagaaaaacccatatatatatgtgtgtgtgttttgtgcgcacacgcacacaacagacaatttgattagcctactctggttttagaccatcagctctaatgaatttagagccttaggtaaactaaaggatacgttattgcccctctaatccaaggcaataatgaaagccatgcatgaaaacagtcccaggattagacattgggacaggattagacattggcaccactttagacttgattccagagcccaggatgctcaccttcacaccaattgccttaaagagggcaggatgtctcaggggcagttccaccatctcctttatctgagctagctgcttcctgcagccaccaatgtcatcataccctacttcattcaaggactcttcctcatcctgaatatggaggagataaagaaaggagaaggcaagaatattatatcagcaaaagctgagtttctctaaatcattccactacctagtgtgcaaaaacctaccgtataagaagattctcaacccggcatggtggctcacatctgtaatcccagcactttgggaggcagaggtgggaggaatgcttgagtccaggagttcctgggcaatacagcaagactccatctcattaaaaattaaattaaatttaaaaaagattctcctctaaagggatccggcctcaaagaacaactacaaaaatcccaaggcaaagatttctagcacagtccttgcctctcacattactcgtagtcttactgagaaggggtctctaaaatctgaagctggaaaccctgggaatgggcagaggcctgaagccaccatcagctttacttcaaaaatgatttcaatcacttatatattttgggttcagtctagttttttgaaattcctggcattaggtaaatccaagaaacaattaggcccagaaatgaatagctggcaggtttctcatccctgaaagatggttagttctccaaagaacacccagtctttttcttttttgagacagagtctcactctgtcacccaggctggagtgcagtggcacaatctcagctcactgcaacctccgactcctgggttcaaccgattctcctgcctcagcctcctgagtagctgggattacagatgtgtaccaccatgcctggctaatttttgtatttttagtagagatgggatttcaccatgttgcccaggctggtcttgaacacctgacctcaagtgatctgcccatctcagtctcccaaagtactgggattacaggtgtcagccaccgcagccggccgagcacccagtcctgacagttaccacatgatgccacactgagtaatcataaaatcggatactggaatcagggagaaaactcacctctcgtttgataggctccccttcgcagtggatcactgtgtctggagcaacaatgcaataagggctaggatctgtttccaccactttgaactccacagcacgcatcccaccacggacaagaaaaatgtctcctgcgagagcaaacagtacaagcacagttagaggtgtcaactacaagacaaagtgagaactcatcagaccctggggtcaaaatgccaagctcattagatagtgcccttcattagatattgccctacctctccccaactccaccccacctgtcttaataagcagcaggcaagatgagaaaggtaaactgtgaagagtccctctgacaagaggtcagtgaacaaaacctgacatgtcagaagcccatcaagttctgacttctgccatataggtagcccaagttttcactacaaccaccaatggtagaactgtgcactctggaccctgacccagccaaaatggaccactttctccttcagagatccataaagatagcttactctcctggaacagagaaggggagagatggagcaaaggaaggatggaggaaaaaaagagggtaagacatatgaatatgtgtgcagggtttgcatgtgtgtgtatacaaatatatgaaaatgagtctagcggccgggcacagtggctcacctgaggtcaagagttcgagacgagcctgaccaacatggtgaaaccccgtctctactaaaaacacaaaaattagccgggcgtggtggcagacgcctgtaatcccagctacttgggaggctgaggcaggagaattgcttgaacccaggaggcggaggttgcagtgagccgagattgcaccactgcgctccagcctgggggacagcgcgacactctgtctcaaaaaaaaaagaaaagaaaatgagactaggcttgatggctcatgcctgtaatcccagcactttgggaggccatggcagatggatcacttgagcccagcagtttgagaccagcctgggcatcatagtgagaccctgtctctttttttttttttttgagacagagtcttgctctgtcacccaggctgcagtactgtggcccaatcttggctcactgcaacctccacctcttgggttcaagcaattctcatgcctcagcctcccaggtagctgggattacaggtgcccacgatggggtttcgccatgttggccaggctggtctcaaactcctggcctcaagtgatccacccgcctcagcctcccaaattgctgggattataggtgtgagccacggtgcccagctgaccccatctcttaaaaaatgaataaataaatacaggggaaaagcataaaagatttaaaaaaaaaaaaagaaaaagaaaatgagataaagatgttccaaggtttattccctacagtcaataatccttaagctcagaattagctctcacctttccggatgggtcgatacgcttccaggaagtacggcttaaggtatacctcgaagagattaccagtaatgccttccactgtgtcatcaatgggcagcacatggatacgtttgccgtacttcacatcagggcatggctggatgctgaggatgacaagcagactccatattaccaaccacacttcgggcccaagcactgggtgtccaaaagggcctggcacagatagctgatagtaagtgaaaaagaaaaggcaggatggctttaggcgaagagaggaaggagaacagggtggaagtgagggcgaaggaacagccccactcactcctaatcagtgagccaaaatcaagagccacacatttagaaaccccacaaagacatgcagggtcttcagggagatatccaaggatgatccccttctagctaatactggtgacccaatattacaagggaaggtcttaagctaacaattgtcagggtcagtgaaacagaagtgaaaaaaacaaaattatctcagccaggtggtcagaacaccttgaggaagtgactaagcactcccaagaagaaagctacatgaaacttagactccattcaaaagaatcaaaagcctgagatgatcctggccaggtgatggttggttgggtaggagtggctagagatgactccaagatggggtaacctcttgcctaaaattatgcaagaacaagcaaaatcactcacattgagagctatcccaggtctggctccaactattcctctctcccgggttaacttaggggcttaaaagacctgctagcagctcaccttccatgcccatacccccacctcattccaaccccaacacaagccatcaattagacatactagtgagagtagtgaggagattatttggcatatacatacacaccctcgagtggtatcctaagccaggatataagtatgataaattacacctctagtaggaaaaaataaagccatcaagaaagttacaggaacgccaatttgtctcaagggacctgcagaaatggattttgaagtcccagggaggcagaaccaaaacctaaagacaaccctgaagcataagtcttcccatgaccaggaggcttcctgcatcgacaggtgccaagaacttggtcctgcctgtaatacatgggtcctgcctgtaatgcaggctatctctggcctcccatccctgtgaagccaaaaaccccacacacacctgatgacatcccctaggcgtacacgaaggttattccgaacaactctattcatccgaatcttctcatcagaacaagtatcatcagaaaggacgatgcaaacagcttctcgtctcttctttcctttcagcaacactgtgtcacctcggaacaactgcaattcatccatcttgggctgaggaaagaaagttaaggcctttgggtcattgggctgacggggagtaagcagcagccctggagattgggattcccagtaaaccccactctatctgcagtcactgcaagaaaaatgagaaaagaaacctgggaaaatccctcaagtaagtgcagtaaggaaagactagtctgtggccacagcttacctgggacaaggacaccacactgttgtcctcattgatggcttcatcaacaattaaccgattgggacggttcttctgtttgagaatggctgttgataggtcatcaccttttgaactagaaggaggaaatggagtcagtagatactcctgccccaagcgcctcgccagtctctaaaactcatacttaggaaagaaacagtgaatagatgaagctgtccctagaccagaaagctcagatgaaggaaaggcagccaaggtcacgaggagcagtatctaccatacatattacaatacccattccagcagctcctggtattttgagcgtcagtgtcccagctataaggccccaagtgagtgatcctgccccagggtcagaaaataatggcctaagaagaagacataatagaaatggaggctgaatagttgttagagaaataaaaatagtcttagacttacagaagagtggttaagagcaggaactctatagtcagacccattgggtctgaattccaattatgccactgcttaattgtgatcttgggcaagttacctaacctctgaactttgatgtcctcctctataaaagaaggaatataatacttatctcagaggcttattgtcttaagggagataatgaatgtaaaatgcttaacataatacctggcacatggtattaatggtcaccatgattaacagtatagagtaaagcataagctaactttccagggaattaagtaagccagacaacctcccttgaggctcagggaggccttaagttctaccaagcaagcctggggacaacgaagcagaatcattggtgctaccctccttataggctaaacctactgatgccagggcattccatagtaccaaaggaatgccaagcataaagaccatcatatttggaaaaaacactaacagacatcaaaccgccagaaagaggctcaaggtcaaaaggaacttcacagtaatatctgcaaaagtacacaattccataaagttggctcaaaaaatcaaaaccaagaaatgctgagacatggggcaaatccaaatccctctcacccaaatcaaagtcgactgggtctacactcagtgttatttcctagaagctaggatcattcaccagacagtgacaccaacttattacctagcccgtttccagctgtcacttactagactcagcaagctccctctccctttttttttttttttttttttttttgagatggagtttcgcttttgttgtccaggctggaatgcaatgctgcgatctcagctaactgcaacctccacctcccgggttcaagtgattctcctgcctcagcctcccgagtagctgggattacaggcatgcgccaccacacctggctaattttgcatttttactagagatggggtttcaccatggtggtcaggctggtctcgaactcctgacctcaggtgatctgcccacctcggcctcccaaagtactgggattacaggcgtgagccacagcacccagcgctctctcttttttaagagcggcctcgtgttagtaaggctcaggaaaacataagcattaaccaaagtaggaaggccagacaatgaaggaagcaaagaaaataaatttttaaaacgaatttcttcattcaacaaattcatgagtctctattatgtaccaggcattgttctaagggctggggatactgaagtcaacaaaacaagacaaaatagtattcccattggaaatatcctcacaatttgcaagagacaaagaaaaatgctgtgctcagctaggaagccatggggttcttacatctttgggtcctgatacacccaagagaaaaacaaaccccattcatctaacaaaatggtaggccttctgctaaccctcacacataggctgcatttttaaccactgcctctaaactagtttctaacgacagtttcctctgctcaaatttgcttcccccattccaaaagtctgccactccaggcacaatgctgctgagtaggcagactcttccaatgcttatcaacacactagaggccaagcatgctcaatgtgacagttgagagcaatgtaaacccacgagctctcccactcctgtcccatcaaaatactcttccagggactgcccatcttcttgcttgacttatagaactgggactggagaaaaataaaacgccagatgcctctagtcaccatagttttttattttttgaaacggagtctccctctgttgcccaggctggagtgcagtggcgcgatctccctcactgcaatctctgcctccctgggttcaagtgattctcctgtctcagcctccagagtggctgggactacaggtgtgcaccatcaccatgcctggctactttttgcattttaatagagatggggtttctccatgttgcccgggctggtctcaaactcctgacctcaagtgatctgcctgcctcggcctcccaaaatgctgggattacaggcctgagccactgtgcccggtcaatagtttgtattttaatctcaaagctgtatcctaggaaaacctccattctgcctaccatcccggactctggctctggagatgagtggtatgcccttttcttaaggtaaagcctctaattccccatctacctactgagatcagatgtggtaatctctaaaagactgaatttggcctgaccatgggccaacagcagttctggacactctttggggcaatcctccattgtcttctgtataagtcaatccctttccagaactgcacaggggactccacgggacttggaagggtttcagctaagagtcatcaaggtgaccaagaggttagaaacagctgatgatgccaggttccaagaattttagatttttacttttgaaaataagaggctgactgcatataaaccaaaagaatactttcagaataagtgactcttttaaataagcaactgagtaatactttatccgaattcagaaacttgagaaaaaggaacacacctcaaaaaactaatctcttcaaggaaggaaggtaatttgcatagagtttccttgggctggctgtgtttttttttttttttttttttttttttttgcctctaaaagctctctattctaaattgaatgggctgaggtagccaagttttatctaacgctttcctaaggatggaggtggggtcagaaagccccagagcccgggtaatttctcaatatagctggttggggaaaggagtgcgcgcacgtttgtgtttttgaagagttagtgcaactctaaactgcacaccacgaaacctggaaatctggaaaggcgcacaaaacacgaactgagattccaactttagcaagaacctaaaatgttaaagaaaaattcctttctccccacccacgagtcataacattaaggaaaactggctcaaactttctagtatgaacaacaggcctaaagtaagaagaccagaagcgaaaggtagggctcgccctctccctaacagtccttcacgactcaggtcacacacagaggatgcccacctccggccccgccgacccggctccaaaaaggcggctgtgagcttccctgagctcggcgggccttccccgaccccgggctccgcctcggtggcagagctcctgaggccttcacatggcgcaaagtccacgcccaccgggcccggctggggcctcgggctcgcggggcctgctctctccggggaccaaaggctttcggcgggtggtaggccggacggcagactggcgccccaaagccccggggcgccgcgccggcggagtgggccggaagacctggccaggcccagacgtccgttctaagggagccaatcgggcgggccggggcctgcatgacacagcacgatccggcccaggctccgacccggacccaacgcaagccccgcctagggggcgcgcgggtgcgcagctggccccagccgggcctgccgggtccacggcccctcactcgccccctagcttcccttccctctttcctggtctccacctctctgacgcgcccacggccaggccccgccgggcctaccctgcgcggctggtcccggtgcgcgccgccgcagcaagcgaacggcgcgcgcacactcactcggctccagaagccatggcgcgcgcctctcccggccggcggctgtggcggcccgcgggtaacggctacgagcggtggcaagcgaccgactgggccggggctcggctcttccaggcggtgggcgagcagcggcgacaaacccgcaagcggcttccctctcgcttcctcccaccggcagcgaggcgtcgggcgaacaacgctggctcctgatccgcgaggtggcagtggcagtggcagcggcagcggcagcgacgactcaaacgacggtcgcagacgcttcgctgagactgagccgagaagagccgaatcatcggaagggaagctgctcccacctcagccaatcagcgcctgccctgcggactctcgcccgcctctccgcgcctctccccagcaacccgcagatcac

SEQ ID NO: 2150 - DNA, 33259 bp, Homo sapiens
  source 1..33259: mol_type = genomic DNA
gtttatttatattttattaataaagacaacagaagaaggatgaggtttcaatattttattcaagttttttaagtgttgttaattacagcatttgaaggggaggatctaattccaacaaaatggaagactctaaaatgtacccattaaactgctaaaaaacaaattgagtggtgagaatacaacagaagtccaatttagattctgagtgttgtcaccatgtgattacaatcacacagacacttccaagcttatagctggagctcctggaagctatttcatactctggtgcaagggccaaaaaaaaacacaacacaagaaggaataagtcctgaattattggcttcatcacatccaccttctccaccccaaaatggcacaaaagaaacagttaccacaccctgcagaccttttggtgtaaaagagatgatgatgaactggggtgggaacaggtcatgaagatctgtctaaaaaagtcccattcaggtgagtttgtacacaccatcaagcagcgagcctctcatcaattagggttagggaaccaaggttcgattctcaggaaatcacaatttcattcatttactcaatatgaatttacaaagtgcctacatattatccgcttccacttgcagccatttctagataaaaaagaaacctggcatctcaaaggggccaccaagttctccccgagtctaccactgaaaggaccttttttggaaataggtttcttctgtacctctggaagggtaacatcttaaagctgaatcaactttaacctggagggctaacatatttagcaatacttgcatcccagacatacaacattaaaagatacactaaattctgaaggtagctatgctgcaaaatagtttaaaattaaacaattgtacagtattcatttatgcttgaaattccagtcctagaccaagcttgtggccaccagcattgacgttcttgccatccagaagagctgacagtgtcagtttaatacctgcagggagaaaaatgagggagaggaaaggaggaggaatggaggaaagaaatgacaagaaagattaacaccaaattcagaacctgttccaggtattatcagcagggtccaaactacatggcccttcaatccttgttacttagcactatctgaccaacaggcatactacagtgggcttataaaacaactataattatcccaccgcccagagagcctacccaaatctacttctggaaccccactttcctttttcctctcactgttcccctggtacaattagtctatagcactggtagcatgcagtaagcttctttggcaatcatccctttaaatgaaacctcaatcctgaatccaacctaaggtcttacatgttcatgttcatagtgtacacacatgtgtagtgtgcatgtacatccacagatgcacacaacaaactgacattccctggaataacctgattcagggagtagctggtagtcttagatttccagggttcaaaagtggttatacactagaactataatacgccgtggactggcctagccaactgtgcagaggaaacctgcaaaccacttttcctatttctttgtctttttacagtggggctgatttataagttagttttgagaatctgccagaaataagtatcaagcattatgtccacactggaaaaaaggatggaagaaaatagcaaagaatatgtgttagcctcagcctttttcctcctgcttgctacatctcatattctccaaatgttttataatgaccccatactcctttataaacatttaattatactttacatatatccatttatatatacccactgtattatataaacattttataagcaatgacataaatcagcaaaccagcaccacaatttttttaagataaagaaccgatttcacacacaagcaacacatacctggctttagagtctgagtgtatcctaaacctatcaggctggagttgttcactttagcctaatcaaggaaatgacaaaacagagaaaacattaagtataatactttgcacttccatctccaaaattagagctttttagtcaaccaaccttggactttagaatcaaaatttttcatgaccaccttgttcatgagattcattaaattcaatacaaaatacatcaattttaggtgcatacctttctgttcaaagggtgtgctgagatctgacacccctcataagaacaaagcagagagaaggaaggcctcttaggggccagtgtccttttgctcatataaataatgaggctccttttctcttgtttttaagtgcttgctgttaagggagccaaattcggttctagtttaggagacttaaaaagggctgtccataaattacacaaaccagtacagacaccattctgcaacatgagattccctcatttcaccccaaagagatacagccgccagtgccctgtgacaacagaaatgagcccaataggatttactgcaaaaactgtgtagtagttcgagggcctgtgagcaatgccagagactctgcaagatgccaactgactattgatttcttaatatgcaatgcaggagctgaaaaggagaatgaaaagtgaggcggggcggggggaattatcaattagaaccctagatttcagagtgccccttttaacagtccgcatgatagaacaggaactggtattaatggaagaggcttaacagtaagccagtctggttcaaatccagctcccagcactttcctgctgtgtacctttgagcaagttactcacctaagtttctagttcctcatttgtaaaaacagagatgattggccaggggccatggctcatgcctgtaattccagcattttgggaggccgaggcaggcagatcacctgaggtcaggagttcgagaccagcctgaccaacatggtgaaaccccgtctatactaaaaacacaaaaattatccaggtgtggtggtgggtgcctgtgttcccagctacatgggagggtgaggcagtagaatcacttgaacctgggggacggaggttgcgcagtgagctgagatcgtgccattgcactccagcctgggcaacaaagggagactccgtctcaaaaaaaaaaacaaacaaacagagatgattggccaggcatggtggctcatgccttgtaatcccaacatttgggaggttgaggtgggaggacagcttgagcccaggagtttgagaccagcccaggcaacagagtgagacattgtctctactaaaaatttttttttaattagccaggcatgctggtgtgcctatagtcccagctacttgggaggctgaggtggcaggattacttgagcacaggaggatgaggctgcagtgagctgcaattacaccactgcatccaacctgggccttgtctcaaaaaaacaaaaaataaaaaaaacccagagatgattaaaaaaccaaagcacctatttcaaatgggattaaacacagtaatctacacaaaaggctctgcacagtgcctggtacccataagaagtactagtagtatgatcactgtactcatttggcactcttttcaaagtgagaacatctctcactttgtttttgtttttttgagacggagtcttttttttttttttgagatagaatctcactctgtcacccaggctggagtgcagtgacacgatctcagctcactgcaacctccgcctccccggttcaagcaattctcctgcctcagcctctcgagtagctgggattacaggcacacgccaccatgcccggctaatttttgtacttttagtagacagggtttcaccgtgttggcgaggctggtgtcagactcctgacctcaagtgatctgcctgccttggcctcccaaagtgcagggattacaggcgtgagtcacggcgcccagcagcatctctcactttgagtaagctgaagcacagcactccagcaaacctgaaggattccaacataaagagcagatgggcctgcctgtgagatgcgtgattccacagatacccaccgagaagcaggcgtcagggtcaatctgatacttggctgctattccgaagcgcgtgttactgtttcctgctgtccaggcaagattgacagcggtctccaacttcttgttcactttctggtaaatggagccgccaaactctgtcccgtcattcctgcaaacaagcacaggacagatgctgagcttcccagggaggtgagctgcagcccagacagatccacccaagtctcccagaagacagggatgacagaaatggactgaaccaatactggtattaagggaagtcagaagttcaccaaatttcacaaaacaggtactaaattacaggaagtctgataagtatggaacaggcacctagccaggcacagtggctcacacctgtaatcccagcactttgggaggccgagatgggcagatcacttgaggtcaggggtttgagaccagcctggccaacatggtgaaaccctgtttctactaaaaatacaaaaattgaccgggctggtgccatacgcctgtaatcccagctactcaagaggctgaggcaggagaatcgcttgaacctgggaggcagaggttgcagtaagccgagatcgcgccactgcactccagcctgggcaacagagcaagacattgtctcaaacaaaaaaagaaaaagccaggggagagggggtacgtggtgactcacgcctgtaatcctagcattttgggaggccgaggcagcaggactgcttgagcccaggatatagcttgggcaacagagcgagatcctgtctctataaggaaaaaaaaaaaaaagaagcagcaagtagagcactgagattctgagtgatttatttttactgctactgatgttattacttttataaacgattctaccagaaaaatggcatggaagtccgggtgcagtggttcatgcctataatcccagcactttgggaggccaaggcgggcagatcatttgaggtcaggagtttgagaccagcctggctaacatgatgaaaccctgtctctactaaaaacataaaaattagctgggcatggtggcaggtgcctgtaatcccagcaacctgggggggtgaggcaggagaatcgtctgaacccaggaggcagaggttgcagtgagctgagatctcaccactgcactccagtctgggtgacagagtgagactctggctcaaaaaataaaagtaaaaataaaaaatgttatggaaagagaagaaaatgagaagagaacacagccagaaatggcaagaaaggtggggctgcacatatgcctcagaaggcaagttagagcccttggcacaacctgctgcagccactgctggggagatacagttggcactgacccagcctcttggaggagcagcacttcaaaagagcttaatccacaattcatctcgtccacctatgcatactcctcacccatgctgcaacatctaagcctggcaggatttgaaagggagctttttgctacatcataaaatgtctccctctttcaaaaacattcagaatgaaaccccagctggccaagctccctcctctcttacaaacacactgaatgactccagttgctgggaatatccctttcccttcttcagtcattcaaattctcctcttcctcttttggggccctgcttaagctctcagaatttgaaagtctgccccacccagctgaacagcctatacaaactctgcagtcactgccacccctaaaaaggcatacgaagagctcagagtctacactttgtcctctgtcgggctggggtcggcacagatcatagactgtctctcattactgctttcagattgttgtttatacacacagtgcatactggtgcctggtcagaagcaaccttctccatggagggaaccacagaaaacaaaaacagttaaagtggctgccactgcggagctgggatgagcaggctgaggcaggctggaatcactgcttttcataggcccatctgtactgtttgattttacaaccatgggttcagactcctttgattaaaaaaattaagaaaaattttaatgctgcaattttttaaaaaggaatgaccatcctccttgcatcagatggtcttcaagcctgcctagaccctctcaaacatctttaacataaaatcagtgtctgagttctgcctcatcattgtgggcatttccagtggaaatggcattggttaactgtgagtcagagcccacgtactttggaatccagcaaagggcttcaggacctaagaacaaaaactctagtcttcacaagacactctccctaaatcagagaatacattctaaattttcttttttttttttccccaagatgggatcttgctctgtttcccaggctggagagcagtggcaaaatcatagctcactgtaacctcaaactcctgggctcaagtgatcacaggcatgttgccaccatgcccagctaatttttaaaaaatttcttagagacagagtatttctatgttccccaggctggtcccaaactcctggcctcaagtgatcctcccgcctcagcctcccaagtagctaggattacacgtatgagccacacattgtaaattttcgtttccccatgaaattcagcgagacagacattatgcttctagaaagtacagggagacccaggcactgcctgattcacagagaatcctgtcttctgtagacagcccaagtatgctacaataaaacagcagcctgtcaaaaataagatttttgaatgactttagtaatatattcaaatggggaagtttcttgggcttacatgtttttaaaaaaggccagacttttcagaatatcctaaaaccaggaacacaatactgccttcctgtacagagctttcaaaaccataaacagaaggcagatgcagtggctcacacctgtaatcccagcactttgggaggccaaggcgggcagatcgcttgagctcacaagttcaagaacaacctgggcaacatggcgaaatcctgcctccacaaaaaatacaaaaattagccaggtgtggtggcatgcacctgtagtcccagctacttgcaaggctgaggtgggagtatcacttaatcccgggaggtggaggctgcagagatcgtgccactgaactccagcctgggtgagagagtgagaccctgtcaccaaaaaataataataataaataaataaatacacaggtggaactgttcaaattcatctatatgaagcacaaagaatttctgttatgcatttgggcccctgcaagcaccagggcaacccagatgagttgtgtcagctgccttcacgctggttccaaaaataaaccatacccacttgttgcttatttaaaatgctgaagctcagatatgtgggggaaatggctaacagccattgttcctcctagaattggtactgaagaattggtgccaatgcccaatttcaaaccaaggaaaacacttcccatgccaatcagaattctacgttcaaaaacatttctatgcatgtggtatgtttcctatagctttttagtatgtttcacctcttcttaattaaacatataataaaattgatattttctttgctttttttttttttttttttttttgagacggagtcttgctctgttgctcaggctagagcgcagtggcgtgatctcggctcattgcaaactccacctcccaggttcaagcgattctcctgcttcagcctcccaagtagctgggattacaggcacccgccaccacgcccagctaatttttgtatttttagtagagatggggtttcaccttcttgaccaggctggtcttgaacttctgacctcgtgatccacccgcctcggcctcccaaagtgctgggattacaggcgtgagccacgacgcccggccaaaatggatattttcttggtatacatttttacgaattttaacacacgtacacagattaatgtaaccatgacgacagtcagaatatagaacagttccctccccgaaactccctcagtcactgctttgtagtcataccctccccgccccctgccaaccactagattgtccatctctatagttttcctgtgactttttagctgtaacagattccaaattaatgataaaaattcctcaaaaaatttattaatggaaatattagtttacacattaatatcactgatttgccttaagtttaagaagttacttctttagtgacctctagtggaaagaaataaacatggtaactctgcacccagcttgtgcctgtcacaggttaattcctcatgaaactaaataaaacaaggtttatggataaaacaagattcatgaatgaaatgtgtttcccttaacttaaatcatcaatctacttcaattctcaaggggctctctcctaacctataatcactgtttcccttcaccatactgtccaatagttacttttacatgcttcactgtacagagaagatagtttgtaactgagataatcagctcctaaatttgtctaccatgtctacatgtcatcaagcccagcaggctaatcctcaggcattagacagagaaagagagctgttttgttaactaaaacaaaaactgcagggaatggacacgctctggactgacaccatgtccctgctgtaattaatcagccactttgtgtacctgtggcaatatatactgttcacagagtggaaaggatctaagacactccaggaaatgggtaggtgggaaacaaaagatagcagcaggccatgtggctcatctaatgccaacaaactcactttacagtggttaaaaactgggctttcttaaaaaaaaaaaaaaaaaaacagtgaaaagcaatccccttaccacacatgctccaaccccacccctcccaccctgctgcccccatgtacacttacacattagtgtgaagctggaattcatcagtcttgtagccaactgcaaagttgctctgggtcactcgggattttgcagtctcaaaattcatctggtagccggccagccagccctcgtaacctagcaccagagcaccccggatggaaggcccagcaatgtcgaaatccatgtcgcagcccaggttaatgtgctcccgcttgtaccctgtcttgattttagcattttttttcctgaaggaaaataagttatattaagatcagaagctaactcaccttgaaatgcaagttgtcttttttttttttttaatcccaggtcaaataaagggagtggggtgggggtgaagtcagggctccagttctcccttaagccactgctgtaccacaatgagcaggacacaacctctcttccacagggactcagtctgcagaaaccccacaataacgaagtgagaacacagacaggaaaagcctgaaaaataaatacgaagtaactttcttctcctatcctctttgtatgcttaacgtagcagcctacacaggcattcattaggtagaaagccaccatgtaattatgaaacagatgcatctttgatattttccaaacctgtggaaaagatttatctgccatgaaggcagctacctaaatagcagcttttaaagagacggttttcttcttactctgtggctcacatggttaagtaaggaaacaaaggctatgttccctctaagtgagtacaacagtaaaatggatttcaattccatattcatgagaccccaatgagtacatatttcagagaaccgggtactgatgtagaacctggaactctgcagtcatgggggccaggaagtgttagttagccagacagtatcccaggtccaacctgatgataccagatgtgagtctataagcagttcagtgtctctactgccggttcctcaagacccagcatcccttaggaagagcaggtgaatagtgtcacctgcagacctattattaccatgtcttttaccaaaagtacacactggagaacaagatcacatccaacaaatacaacatggatcatttttatctgattgtctctatcattcagttacaagatcgacatctcccacaggaagctgcattctcagcagagaccacaggaggaaccagatccactcagagcctcaaggactacacagcactgttcacttctagctttattcacattgagattaatgcttcatcctcagcacctagaccatttcctcctaaatggaaccagtgctccttggagaaatggccaactacagatcttaggcaggaaatgtacacagtaacctaaaacatctatcaaagctattgaagactactggggtggaggcaaaaggacttacaaggtaacctgaagaggctcccaagggcttcgacaatggagcaatgtgagcctcaataagaaaaatattagcaataggctgaaacatattaaacagtatgtttattctaggcattataatgacactcggggccaggcgcagtggctcatgccagtaattccagcactttgggaggctgaggcaggtggatcacaaggtcagaagttcgagaccagcctggccaacatggtgaaacaccgtctctactaaaaacacaaaaattagctgggcgcggtggtgggcgtgtgtaatcccagctactcaggaggctgaggcaggagaaacgcttgaacccgggaggcagaggttgcagtgagccgagatcgcgccactgcactccagcctgggcgacagagtaagactccgtctcaaaaaaaaaaaaaaaagaattataataacgctcaaatcacatagctgtcatctttaaagactaaagaaccaacctgttattttaaaaacagcaaaaggccaggtgcggtggcttacgcctataatcccaacacttcgggaggccgaggtgggtggatcacctgaggtcaggagttcaaggccagcctggccaacatggcaaaaccccatctctactaaaaatgcaaaaattagctgggtgtggtggcacatgcctgtaatctcatctacttgggaggctgaggcaggagaatcacttgaacccaggaggtggaggttgcagtgagccaagaccgcgccactgcactccagcctgggtagcaagaataaaactcagtctcaaaaaaaaaaaaaaaaatcatgaaacaatcatgtaaatttgaacagactagagatttgacaatattaagaaatgatccactgggcgcagtggctcatgcctgtaatctcagcactttgggaggctggggcaggcggatcacctgaggtcgggagttcgagcccagcctgaccaacacggagaaatcccgtctctactaaaaacacaaaattagccgggtgtggtggcccatgcctgtaatcccagctactcaggaggctgaggcaggacaatcacttgaacccgggaggcggaggctgcgtgagctgagatcgcaccattgcactccagcctgggcaacaagagtgaaactccatctttaaaaaaaaaaaaaaagaaaaagaaatgatcaacttttttcaatataataataatatcatggttatgctcctttaaaatggattattgccatttaaagatacataataaaatatttacagctgaaattaagtgttgttatttacttaaaatagtatgtgcgtggaggagtgttatatttatggctgtataaataaaacatgattggccacaggttggtaactatcaaagctgtgtgataggaatagaatgagggttaaacatatttttctgtatatttttgtatgtttcagatttctcattaaaaaaaaataaaggttaaaaattccaaattctcaatgagacaagaattttagaggtcacagctgaaaataaagccagcacccctcccaagtgatgtaggaaaatagcctgttccatggcaagagtgacaccgtcttgaaacaaaatcaccactgatacagtttcgatgctgtatcttctgaatctcatgttgaaatgcagtccccagtgttggacctgctgggtggtggttagaccatgggggtggatccctcatggattggtgctgtcctcccaataatgagttatgagatctggttgtttgcgtgtggcacctccccaccactctctctctcttgctcctgctcttgccatgtgatgtgcctgctcctgcttcatcaatcaccatgactaaaagcttcctgacgccttcccagaagccgagcagatgcctgtgctctgcttgtacagactgcagaaccatgagccaattgaacctcttttcttcataaattagctatcctcaggtatttttttctttttttcagacaaggtctcactctgttgtccaggcaggagtgcagtggtgcgatcatggctcactacagcccctacctcctgagctcaggtgatcctcccacctcagcctcccaggtagctagaactgactataggtgcgcaccaccaggcccagctagtgtgtgtgtgcatgtgggtagacggggtttaaccatgttgcctaggctggtctccaactcctgggctcaagcaatctgcctgccttagcctcccaaaatgctgggattacaggtgtgagccacctcgcctggccaggtatttctttagagcaatgcaaggacaagactataggcgctcaccacaatgaccagcgtgtgtgtgtgtgtgtgtgtgtgtgtgtgtgtgtgtgtgtgtgtgtgtgtagatggggtttcaccatgttacctaggctggtctccaactcctgggctcaagcaatctgcctgcctcagcctccaaaaatgctaggattacaggcgtgagccaccttgcctggcaagaatagcctaatacagccatgacgaccaaggaatgcatcatagacaatcccataaaagaaacaatgccagccgggcacagtgcctcacacctgtaattccaacacttttagaggccaaggcaggtagatcacttgagcttaggagttcaagaccagcctggccaacatggcaaaattccatctctactaaaaatacaaaaattagctgggtgtggtggtgcacacctgtagtcccagacactcaggaggctgaggcagaagaatcgctggaacccgggaggcagaggttgcaatgagccaagatcacgcctctgcagtccagcccgggtgacagagtgagactgtctcaaaaaaataaataaataaaaatttaaaaagtaaagatgcttatctaacctccctttggtcacaagttttgcaagagttttctgcaagatggtctaagacatgcacatgtctttactctaaaagcttgctatataaagaatactttctggaggatgaatgcagggatccactgtctcttggctgcttgagacatcgcttctatttgtaagtctctattaaatgtttctttctgagaaactggatttgtcagtctctttctttggctgctcagctccctcagcagttgggagtaggtgtgcacagacctgctcaccaacagaacaagtgacaatgaaacttatgccttggaacctcaattttgttcaagttacttctgtacattttggcaaggtttgaaggaaaggagtaacaaccaaattatctctcaataagaaaaatccaaaactggtcaggcgtagtggctcacacctgtaatcccagcactccaaggagggcagatcacttgaggtcaggagttggagaccagcctggccaacacggaaaaaccctgtctctactaaaaatacaaaaattagcaggacgtggtggcatgtgcctgtaatcccagctattcaggaggctgaggcacgagaattgcttgaacctgggaggtggaggttgcagtgagctgaaatcacatcactgcactccagcctgagcgacagagcaagatgtctcaagaaaaaagaaaaagaaacctatcttcatctgcctgctctttggggaaagaagtctgggtttcagccaagtatgtgattggcaccaggctggttgagatgactgatgattagacagctgttgagaggctgacatttacaaagggaaaaggaaatataaaatcaggcatcttctaaccatctcctttttcaatttttaataaaaagctgctgatgatcacaaactatgatgcctatggcagggcctctgaccagtggtgtgcaccacctgcaccagttgacatggcacccccacccactgtctcactggattctggccagggcccacaatccccaagagaaagggcagtgctggggagtggctcaggcttctctccaggtctctttctaacactgcacaccatgtctgtggagtcttcctctttcagatattattgggatttatttttaagctatttcaacagtagtgctaatttgacaagcacccgagagaggcctgactgatttgtggttaacaagcaagctttatttgtgatggatactcagcgtgggtgctggtccttattgaggtctgtggcctcatccagatgtggtctacactccgctcctcctgggagccaggtgttttcccaggctgtaccctcagtcactttggaaagccagctttcgtttctaatctccatgatgcaccaccagaactttcctcaaatacccagtagcattatgtacatctagcacccagaattttagttttgttttttttttgagatggagtcttgctctgtcgcccacattggagtgcagtggtaccatctcggctcgctgcaacctccacctcctgggttcaagcaattctcctgcctcagcctcctgagtagctgggattacaggtgtgcgccaccacacccagctaatttttgtatttttagtaaagacagggttttgccaggctggtctcaaacacctgacctcgtgatccacctgcctcagcattccaaagtgctgggattgcaggcatgagcccccgcgccaggcctacaatcttagtttctaaatatcattctccaacataaagaaccaaggctccttggagaaatggcagatagcaggactggggaaaaacaagtactagatgagcgtggtacactttctaaaaccagaaataaagacatgctctgaaaaacgacagaggtttgtcaaaaagcacacagagtgtattctcccaaagcccatatctgggacaacttgagcgacaaaataaatgacactgtgcattatagcccatagagtaaatgtccatgcatctatactaatataaataaataattgattaaataaatacatggggaagaaggaatagctcttccttacggtagaataccaattaacaagtgaaggaaggatggcaatagaaaattaccatttgaggccaggtgtggtggctcacacctgtaatcccagaattttgggaggccaaggtgggaggcagatcacttgagtcaggagtttgagaccagactgagcaacatggtgaaacactgtctctaccaaaaatataaaaatcaaccaggggtggcagcaggcacctgtagtcccagctactggggaggccgaggagggaggatcccttgagccagggaggcagaggttgcaatgagccgagatcataccactgcactccagcctaggtgacagagtgagaccccatctcataaaaacaaaaaagaaaagaaaatcaccatttgtagccaggcgtggtggctcacacctgtaatcccaacaatttgggaggctgagacgggtggatcgcttgagctgagaagttctagaccagcctggccaacctggtgaaacctcatctctactaaaaatacaaaaattagctgggcttggtggcacacgcctgtggtcccagctacttgggaggctgaggaaggaggattgctggatcccaggaggcagaggttgcagtgagccaggatcacaccactgcactccagtcaccatttgccaagcgtaactgttgcaggcaagaatcaccaatggatgttactatttttgagcaaaagtatgatgagaaatagaatatctgcataatctcaaagtgtctacccacaagatacttactaattacaaagagaaaaatagtagctttacaatgaagagagttggcagacaccacttcaaaactgatcaccaaaaatgaggcctactgatatattcttcctaacatcaggtgcagagaagaatataacacaacaactacagttgccaaaaatgcataacctaaatttaatcataaggaagcatcagacaaatccaaactgagggacatcttaacaaaataattggccactctttttcaaaagtgtcagagtcagaaaatattccagattagagaagacttaacaattagatgcaatttaggaacctgaactggatcacagatcagaaaaaagacgtcattgtgacaacagattaattaactatatgatatcaacattaacttgctgattctgatcattatagttacgtaaaccattaacattaggagctgggtgaagaacacaggagaactctgcatactatttttgccacatttttttctaagtataaaattattttgaaataaaaagtaaattaaaaaaaaaaggggggcaggtgcagtggctcacgcctgtaaacccggcactttgggaggctgaggtgggcagatcacccaaggtcaggagttcaagaccagcctgaccaacatggagagaccctgtctctattaaaaatacaaaattagctgggtgtggtggtgcattcctgtaatcccggctactcgggaggctgaggcaggagaaacacatgaatctgcccagcactttgggaggccgaggcaggtggatcacgaggtcagaagttcaagaccagcctggccaatacggtgaaacccccgtctccactaaaaatacaaaaattagccaggcatggtggcccgtgtctgtagtcccagctacttgggaggctgaggcaaaaggatcacttgaacccgggaggaggaggttgcagtgagctgagatcacaccactgcactccagcctgggcgacagagcaagactccgtccccctcaacccaaaaaaaaaaaaaaccaaaaaactttcctttgtgttttatactgcatggcctggagacctctgcaaagctccctaaggtcatgggaaggaaatcacctacaaattccaaagtgtgctatcccagggcagcaggcaaagtcccaggcagcaaattcaagcatgtgggcacatcctccagcctctcatcctatcccaggatctttccagataaccgctccctgataccatggcagagttcctggggggagagtgcacagcactgcaaaaaggcagtgctcttgcaggagaaactacagcagcgaagaggaatgagagtaaatcagccccgtaacaatggtctcttcagatcatctatagccaagctataagacgacatctccagaggataggaaccatgtgtgcccagtcacttgtgtgcactgcacacccagcacaggtctgcacttggtagatcctccctctaataaatatctgttggaaaggaaaaaaggaagaaagaaaaaaaatgaatggcaaaactgaaaaattcatagtgccatttaactacacacttaaagatgttaagttttatatgtatatcttaccacaatttttttttttttttggagacagagtctctctctgtagcccaggctggagtgcagtggtgcgatctcagctcactgcaacctctgtctcctgggttcaagcgattctcatgcctcagcatcccaagtatctgggactacaggcacgcaccatcatgcctggctaatttttgtatttttattagagatggggttttgccatgttgcccaggctggtctcaaactcctgacctcaagcaatccacccacctcagcctcccaaagtgctgggatcacaggcatgagtcactgcatccgactcttttttttttttttcttttgagatggagtttcgctcttcttgcccagggtgcagtgcaatggcaccaccttggctcaccacaacctctgcctcccaggttcaagcgattctcctgcctcagcctcccaagtagctgggattacaggcatgcgcccaccaggcgcagctaatttttatgtttagtagagacagggtttctccacgttggtcaggctggtctcaaacttccgacctcaggtgatttgcctgcctcagcctcccaaagtgttgggattacaggcgtgagccaccacgcccggcccacaatttttaaaaactgaaattcagtacatgcccttgaccctaacatcactatataaaacatcttccccaggtttggaagacccaccaatatgagtggaaaaaaacaagggtgtattctaaaagggaataattccttctaggcactttgaaaagcacccaggaattgaggcagactaccatgctatcatgccaagtgatggtcaagaactaacaagcctattacatctgtggccagaaggcctggggaaagtgcagcctcaggagccaccttgcagttacacccacagggtctcagtgtccctaagcagcaggaagctgggagaaggacttccatgcctgaagaaatgaggctggcaacagtgaccagttaggccctgcttccaaatgtcacccactcccgtttggtcatagccacttacatcaccagcagcctaactcacatgaaatggctattactgaacagaaatcctgcaacctccatggcagaaactaggagaacactaacaaaatgcagaatcttattacaaaacacggctaaacactggtctgaatcctctattagaaagtgagctccttggcgggtaacaatcatggcctgggcacccttagatctccagatgggcacagggccaagcacaggtggcacttagaaatcgtttgttgggtaaacaccagtcctgaattaggaagtgctcattatagcatagtctgttagtgcatagatgtggatacgacccctgggaccaaatcaaaaccagaggacttaaatcgccaggtctcggagaccatattttaggtgctgtcagcccccaaaacattttgtcacaaagggcttccaccacctgcaacatcagagaacatccttgtggagaaaacagatgaaactcttacccagtgttaggtgagaaggatgaatcgaaggtcagcttcagtccacgtgcaagctgaacagaaaagaaatttgccactagatttagtcacaaggcaggctggcagatgcgaattaataaatccacatcttttcacagcagccattacctgatcttccacagtaatctcggtgcctagtgtattgtcggtattccatttctctgtaaacgtcaggccgtactcagtccatctgtacttggtttccagactgcccgtcactttggtggtctcagtgttggctgagcctgagcttgtaaattccttcaaaggagagagaagagtcacagcctgcaccatagcactcacttggcttcacttcactcctaaacactatacttgcctttctgcaagaggcaagaccctgaatgtgggggggccaaggctaactctacaattcaaatagatatttaaagtacagatgggagtaaaggagcctgctatgtaaagaaatcttatggggaatttgttgtcagcagacagcttccttcctccctgtaactcttcagtctggacaggaaagcatctcccttccatcctggctccagggcagtacagagaaaaagcactgagctaaagctgacacagcggtaattcaaacccaaaacttctttcttccaacaattactgcacacataatttcaaagggactactaagattactttaaaaacacttatgtggttgaatgcaggtgaatttgaaaataagaagcacaaggaaaactaaaactgagacctgacccattctcctctattacccgctgctgaactgggggcctactggcatggttcccctggaccacccatcatgcagaaaatggaatgaatgtgaaaaccacaaaaactgccagaataaaaaaaaaaaagtaccttcttttggctttgcgggccaggtcacgacagttatttgttgatctacaacaaattcccacgttccatacaatggtcactatttgggtaatgggtacactagaagcccaaacctcaccattacacaatacatccatgtaacaaacctgcacatgtacaccctgaatctaaaatcttttttaaaaataaaaataagccaggcgcagtggctcatgcctataattccagcactttgggaggccaaggtgggcggatcacctgaagtcgggagttcaagaccagcctgaccaacatggaaaaaccccgtctctattaaaaatacaaaattagccgagcatggtggcgggtgcctgtaatcccagctactcggtaggctgaggtaggagaatcgcttgaacccaagaagtggaggttgtggtgagctgagatcacgccattgtactccagcctgggcgacaagagcaaaactccatctcaaaaataaataaataaaataaaataaaaataaataaatactcatgttccatgtgggttggacaacttaccaatccattctcagattttgttttcaaatcaagctttattaagccaaatcctaaagaaagaagaagacaactgtcaataggttaaataactagagaacagcacctctgcctccctcatggttgcttcaggatgcttttttaaaaagaagcacactcctgccacaggggctgagggcacccagtctctgctgctgctcgtggggggagctctcagctgccatggaacagcagcagacagaatgggcacccccacctgggtcccacctgcactcccagcagggtctgataagaagacacctgacagctggcaaagacacagttactgggcctcgtgggcatgtgcctaagcacaggctaaatatagaagccgcgctccactgcagcagcttccacagggctgctccacacttggaaaagaaaacaagaatacccacttgacagcaccaatgcaggagcctgtccaactgggtgcacaaccaaagttgctacaattgccacacaaatgaaagcttcttttttccctcacgtgaaagttcagaacagctgacctacccaggtctcctaaacagttatcggtaaagtctcaaacatgccaactcagtctgtgagctgaaaggcaccccctctctgcaacactcaccatagcccttggtgaagacatccctggcagatttgccaagatcggcatacgtgggtggcacagccatcttctgctatgataaaagaatcaccagaataaatgcattgataattagggaaattagctttccatcaataacaattattagatgtaattagcaaccaataaaaatcacctagcactaagactaccaggtagcttatcctcccagatgggccaagaagcccttgctgtcttgtccttcattttgtggccagagcttgagacactcaatgagtctttgttgacagatgatcaacaatttagacctctcctcctcagcatccccaggactgagcccaggcccagaacagagtaggagtcaggaaatatttgcttaatgaataaactgtcaaagacacattcccatgagccagtgactttactgaattgtaggactgttgccaataaaacatatcatcttacaaaatgtcagctactaggacattaaatgtaccgaatagaaatcagagcttttcatgggaacatcattttccatgtggctctgatttcattcattcaacaaatatttatggagtacctactatatgccaggatgggcccaacttttcacaaaacttttggactttatgggaacccacttcatatttctcatagagaatacagtaaaaccaaaccagtttggcagctcttcacatggaaaaaacccaaatacatcctccaaatacattaaacaaatatttattgagctccagtgtaactttatttttaaaaccaaccatcaaaggactacttgggattgctgcatatcactaagtcaatcaacaaacatttattaagcacctcggtgttcaaggaaggagagtaactcaaatagtctttgccctaaggaccacactgcattcctggaaggctttgctttggcatgctgtatatgctgtgtacacaggattaatatcctaatctgggactgtacatggtgtgctctgcccaggaggagagggggtcatgcatgagaaagcctcatctcctgcaccttctccatccccagaatcattagtctcaaccagaaggaccattccattcgttttaaaatacagtatacctaaattatcaaaattcatctgcatatataccatctgaagttacatgtatatatattcacacaaataaacacatatatgacatgctcctggcatgtcatatgacatgatatgcttccatatcatcaatggaagttgcattcttggccaaagctttaacttcaaaggcattgcaggaggccacagactcactgagtatgttgtaaaagaaacagtataaacttctacaattttaaattgtgaagttgtgatccaggtcctactttactttttccagatgctttgttaattttatcccagctcacttttgtgtcagagcacagacagaagagcagcgagctgtttactctgtcctatttttgtcgctgctgtgttatttcttgcacatgatcaggctgaaaccatggacaggtcagcccacattagtatcagggtagagagatgaggggggaagatccattttacactgcccgccactggctctttccagtctgggggctcccctctccccacttgttcctccctcccaaactaaccctgtaggtgcatccccccgggatagaccaggaaaccacccaccagaacctcaagaaataccctttacctgacaccttcctaggagaacaactctggattgaaagctgaggcaatgtaaccccaggcagacacagaacataacagtaacgggcccagaacattctccacccgacagggttaacaaaccatcagtgaaccaagtacccctcttcagtgctatgcctcccaggggggccacaaactcagccggggtgggggctggggaagcagaaggagaagcagtccagtggtaatatctgtgggtcacctaagacctccctggaccttaggagccagagccttccccacgactctcccctgaccccacagaagagacgcctcccagacacagcagccttcacatctggactggtccccgctcaggataaaggcagagcactcatccattaaatgttccccaaatgccctctctcatcgctaatccccaaaatccaacaagcacagccacctgtcaaaaaacaccccacccacagcaaacatcagcctgaagtacaaggccactaaagagattaccacccaaggacaaggcactcagagagcagagctcagaagagcagaccggacccctcctggggcctctaggagctccgacacggccaagctcttttggggctgtggggttccacaacacaaccatgtagttggtaccagcagcacgcaagtgaacttgctggttcactaaaacatatccctatccaatgcctcactgtaaacatactggatgctggctttctcatctgtgtcttgctctcttccccatctccttgaacaccgacaatgaagcataatctcccccgttctgggcccccaagtaagcattctccccagcatagcacctggcaaggaagactcacagaaaccactggctgaatggagtcaagtccactcctgggcctgaagtgacaccaccgaggacagcaaaaggatgactcaccctttcactaaaggcccccaactgccaggtagtggtagcttcccctcctttttgtgcacttcggcccatcccctgctgcactgatctgacggaactaaggaaggcccgagacagctctgccgctccgagaagttcagctttcttacagctacagacagcacccccaaaatgcccatttttacacagctctcgaacccatttcagagacaattttatgatagaaataataatctgcattaattttctaaggcgaggactggaggaaagaaaagtcggcaacaaagcctgctttcacttaacaccctgccagggtgctgacttgaaggctgaaccctggcccccacccctcccagtcactccttccacccagatctgctccaaatcggagcctgtacagttagctactgatacacagctgtctctgcagcatccaccccccaggggccttcacaagctgagcctctagaggctgcgcatgaagcagggcagtctggcatcggcaaagcagctagccctggacagacagaagtcagagggcgtcctgggggagtcagaaccacaggcctctctgcctgagtgatggcttcagggcagagcctgggggctttgttcccactggttggtaggaaacagagggatgggcagggccaggctgagcagacctgcctgcagtcactgaagactttgagaaggaccagcaagtcacaccaggatacaggagtccctggttcccctccacagcctgccagtctacctacccaacctttccttggctgaccttgaacaaattatgcaagccccattccagctgaggaatgaaaatccggcccatactggaagcacagaggggaaggatagtgtatctatcacccagcacagtctgcataatacttacgtaacctctgtcttgggggtacacatccttcttggctcatcagctgaatggcaatgacagctgctgtgctcaccgtgcccccaccccaccctaccccatacacctacccccaaaatcacctctttgaattcaaagcaccccagagcctgtcatgcataaatttatccaaaatatggaaaaagttacgtatataaagatgctaagccctggcacataataggcattcaatataaatgtgtttgatgagtgaatgagcaatgagcatcaaagtattatttagcaatggggaaaaaagtagaaacttggaatctgacaataggaactcattacaatgcaaccaggaagtaagagctccctctgcaggctcactgttgcagcatcaccaagagtgggggagttggggagaccctcaactagcaatgacctccactccctgcctgctcccacctcggcctaaggagagctgatctcaggctgaggagaccaagtgccatcagaagcactggttgcttctgacctcaataccatgcatggattttattctaagggccaccaagagccactgttgagtgactaccacatctgtgtttcagaagctcacttaaccagcagtctggcaaaaacgtaaataatatccagtgtcagtgagggtgtggaaaacagtcactcttgttcacgccaagggggagtactacaggtacactctttttggagagcaattaacccagcattaaccctagtggcaattccacttctaggaacctgccccactgtagcaaccaaggcactactcaaagatgtgtatatgaggatgctcactgcagcagtatttgtaacacaaaacccagaagcaacctaaaagtccatcaaaaggaaaatgaatgaataaaaattaaggtactatacttgcaaactaaggagtaccatatggtaatcaaaaagaataaggtgggtggctcatgcctgtaatcccagcactttgggaggctgaggtgggcggatcacttcaggccaggacttccagatcaacctggccaacatggcaaaaccccgtctctactaaaaataaaaaaaaaataaaaaaaaaaaatcacccaggtgtgatggtgcacgcctgtaatgccagctacttgagaggctgaggcacaagcttaaaccaggaggcagaggttgcagtgagccaagatcatgccactgcactccagcctggatgacagagcgagactgtctcacaaaaaaaaaaaaaaaaaaaaaagaataaggtggatgtatgtggtggcatagaaagctagctatgaagctacgatagccgtgcgcagtggctcatgcctgtaatcccagcactttgggaggccgaggtgggcgggtcacctgaggtcaggagttcgagaccaccctgaccaacatggagaaaccctgtctctattaaaaatacaaaataaattagccaggcgtggtggcgcatgcctgtaatcccagctactcgggaggctggggcagaagaattgcctcaacctgggaggtggaggttgtggtgagctgagatcgcgccattgtaatccagcctgggcaacaagagtaaaactccgtctcgaaacaaaaaaaaaaaaaagaaagaaagctagctagctatgatacagttaaatgaaaaaagtcagaaaatttgtaattccatgtaattggaggaaaacctttttacacatctttctatgttcatgaatggatgggaaagcatgtggaaggatacaagccaatctgcaaattggggctggcttagatacgcttctggagaaggaggtttagggaaggaatgcacttcaaatcgaattttcattttttgttctgcttcattatttaagctgtttgtgtatactaataatttgtttaaggataaagaatttcaatacaaaaattagccgggcgtggtggtaagtgcctgtaatcccagctacttgggaggctgaggcatgagaatcacttgaacccaaaggcaaaggctgcagtgagccaagatcgtgccactgcactccagcctgggtgacagagcgagagactccctctccaaaaaaacagcactttaaaagccaaccactgtgcctgaaattgagctgtgttgtgtcccaaatcacgttccaaggctgctgcagtagcaatgccagaaggctacctagagtgtccatacagattgcaagaacagatttaaactacactgagatggaagagttatcaggcaaggtccgtcggggcacatttcactcccaggtgaccactagtggcttggccaccctgccagaaatcatgagcaggaaagagctccctaacttcagggtgcacaagaatcaccggaggcgcttgttcaagaagagcctgccagaagagatggaactcctcctgccctacctctcagcctgtgcctaacaggcagggctgcccccaggtgccactgagaagcagcagctcagggcggttcctgcactaagcacctaccaggcccccgcctggtagaaatatgctctcttctctgcagaggctccctcaaaaggattcaggcatgtgccaggcatggtggctcacgcctctaatcccagcactttgggaggctgaggcaggaggatcgcctgaatgcaggagttcgagaccagcctgggcaatacagtgagaccctgtctcttttaaataaaaaataaaaagaaataaatagtaataatagaaggattcaggcagatgagctttgcacccctagagagccaacaactactgcaatggttgatacagggagcagggtggccatgggtctccaagactcagctaaaaacagctgggaggaaaggccttaggcctaaggaagttgttacaaggaatgagtgaaacaggcagaacagcagaagtatctggcatggagtaagtgttcaacaaatggcagtaataaccataatccactacactggatactctgtctgcccctccagatccattctcctcccttccaccctgctctgtgcccccagaactgatcattatggactgctgtccatgggcttatgattgggcttagcctttcaacgtgaggtacttgcagaagacgggagtttagggaagaatgaagtcggggtactcaccccgagtctccctccctgctaggcttcagatgggcaatgactaccttcctctacccaaggccacagctcctgccaagaagctccctctcttgtaggcctcagggtgttaacagaccagacctgacaccccatccacagctttgcaaatgatgtcttcattaaactctcctggattaccaagtgtaagtgtgcaccagatccctgcaaagacgctaaccaacagagcaatcacaaccatcatcatcatcattgccatcatcttatgattctgccaaggaagagagtactatggaaaagtctctggccccgctgtttcaccaacaccattctaggtggtttgtcagggcagaactaggccagcctataggaggggtatcagaccagccagtgatcacagaaacagcacctcttcctagccctgaggaccaggaaaagcaacttccccagcagaaggcaaccctagctctaaaagccaacatgggggcgaacacaatcagcagctcgctcacacacatgcacgcatgcacacacacacactccagcactttctctttcttgccaggaagaaacaacccaggggaacagttcctggttcaagctccaggatgctggcaaaggctgatggccctgtgttctggtagcaggtctgcgtacccaatgcagctgttctctccctccattcttccacaacagtctcgcagtgggcagtagagctttccaggggtagcttctattttgaaacaccctggcagctgggccaccaccagcacagctgagttccatgctgagctcctgggctcaagaggttgctgactcagggcagcctgcccacccacctatcaaggggagatggcctgcgctggcagccagtacactatggtctggatcccaggcatacctggggctcctacctgacctaaggcacctcaagttccctggagcctcactgcttggcttgaccaggtagggttgagacagacagtgcttgggcaggaagcctcgggaatcaaatagacctgagttctaacccaccccaccactttctaggtatgtgactttgggcaagtcgcaacctctctactcctttttcttcagctctaatatggagaaagagagcctggatggcgtcactgtgaggactgaattagctcgttaatatacaacacttggtacagtggctggcgcttggtaagcagggaatacacacagtattttatcacaagttttcattttgtatatttattataataatggctgctaagcatgttcaaaaggtcaccctgaaccacagggtccagagtccttcatgtccacaatgaggcattgtttagctgaacaggtcctgaaagaatgcctcccaccagatcccagggaaaacggacccttataatagacactcagcaccactgtccttgcaagaaatagaggtgactccattgtccactgccagttggcccgcacacagccatgcacaagttcactctgactggtgtggaaaaataatgtctcccatctgaacaccaattttgactttccaaaaggcattcacatctgttagcaccttgcaagggtcccttggagtgcaactgcaatgtgagagcaccaccattcagaccaggccttgaatcccaactccactcctgccaggctgtgttacctcacctctctgtgctcgagtctgctgacctgtgaaatggaaacacactatctctctcccagggtatagggtggtgaactcaacatcacagaacattcgttgagcccccagaaaggtgctgagcaagccctcaatcagcaatcactgtaatgacgacaatcatacttttatagcagacaaactcggccgggctcagtggctcacacctgcaatccccgcactttaggaggccgaggcgggtggatcaggaggtcaggagttcaagaccaacctggccaagatggtgaaaccccatctctactaaaaaatacaaaaaaattagccaggcatggtggcaggcgcctgtaatcccggctactcgagagggtgaggcagagacttgcttgaacccgagaggtagagattgcagggagccgagattgcaccactgcactccagcctgggcaacagagtgagactccatctaaaaaaaaaaaaaaaaaaaagagagagagaaactgaggcacaagacagtgacttgacctgtatgagaccgaccctatggctcaccagacctgtgttatgggcctaagctactctccagtgctctttccagcacagttctgagtaaagaacttaaagtcccactcatcccaaaccccctgagtacgtggtaaaatggagaaatgcgcccagacccagctgaggagcccactggtcaacttttctcagtggctaccacaggactccatggaaaacccaaagccgcagactacagaatctctgagcaccaggaggggctgcctccaagcttcggctggtcctcaaccacacatgcgcctcttccagtcactaccaccgaagacactacaccacgggaaattccatcaaaggcgaagtggacttcagtgcttcaggagcatcttcctggtaagggtagaggttggatgcccttcacctccccagcatggagttcactgtccacacctgcctagtgttcagcaaggccaggggcccacaggcacctcatccctgtatggtcccccactttctgagctacgaataacccctgcctatagccccactctagaatagcaaaaataaaactaaataatcaacaaggagtagtccccactacccacaggcaggcaccctactcaggacaaccccagcacaagctgtccatccacccaccatgagggaaggggtaacaggcccaacaccttctgtagaatcccagtcacccatgtcaccctccctgcaagcccagaaacaccagttcaacaagtttccctcgggacttggaaaaccagagaatgaagacgatgtgtttaaagcacttatttcaagagactatacatactgttacagttctttaaatatttgtgactctctgctaggtgaggctgttttccacaagtgagatgtctgtgtccctcaaaaggatgtccaggaccgggcatggtggctcacgcgtgtaatcccagcactttgggaggcggaggcgggtggattgcttgaggccaggagtttgagatcagcctggcaaacatggtgaaaccccgactctactaaaaatacaaaaattagccaggcgtggtggtgtgtgcctgggatcccagatactctgtgaggctgaggtgggaggattgcctgaacccaggaaacagaagctgccatgagccgttatggtgccaccgcgctccagacctggcaacagagcaagaccctgtctcaaaaaaaaaaaaagtccaggatcaaaggactatggtctgggcctgcagcccttcatatgcccattcaataattccacaaatactcaataagcacctactatgggccatgtactggaatagtaaaactctgtcagtaaagatgggtggattctgacacaagagtgcatttacccccacagacccttctcaagcacctactgtgtgccaggcagcaccaccccaggcactgaagacaaagtagcacagggcctcagtgcctcagtctgacccttaggagctgagttggtccagagctggggtgggcagaatgaaggctggccctcggtagtctgctctggccttctcctgcctcagtggagaagtttaggcaacagaggagccctttcccctatctccccaggagaggggaggctagtcaaggggacagggaccccgggcggaacgggctctaaaccagggtctgctcctgcattcaagatctccacatgcaaacttactgctccagcttgacaatgtccatttgtaaacttacaagatttttcataaattaagctgaaagttactcaatacctggtatacaaatgcttgtcaataatagtgaaagaatgtttaaaaacaggagctacatttattgaaccccttccacaacgccacgtgtagcaaaatggtctgcgggggatgggctggattcacccaaaaagccccaagggtgtcagggtttctacttagcccttctccacaccggcactgttctaaaggtttcatgctaattaattcattttattattccccaaaactcatcgaaggagaggtacaattgctcccgtcctatagatgagaaaacgaaggtatggggacttcccagctgtgtgaccttgtacaaaccactaagactgcgggcctctaatccaaagtcaggctccgaaacagtttccagaatgcaccgccgcatttggcgaatgaatgaacgaccgaaccagtaatcactcctaagaccaagaaggccacatccttccccgtggggcctccttttccgaggccaaaccttcagcccaggcccgagctccggcctctaccgcctaagtcgactctcggccggcgcgttccgctctagaaggctctggcacaggcgggcggtgccgggcgccagcttctgcgggcgtgggccggccagggcgcgtgggcctggggactcggggccacggtcgtcacgtgagctcatccccgaggcggcagcgtggccggcacccgcccgctggcctggtccggcgagcgtgggcggcgaacgggtccccgccggatgcacgctggtgggatccagggccagagggcgccgccggggaaggtcacctagacgcgcggcccgccgggcctccacgcggccgcccttgcacttccgcccgcaagcccgggccgcctctcgccgccagccgcaggcgtctctggaccctcggcctcgcgctccccagcccagacctgttcggcacccgcctgtgcggccttctctgcccgcccgctcaccagccaggcccgcgccggccgctcgcgatccctccccgcggccgggctgccggggcccctcgcccgctcctccctcagcgcctccctctcagctccccaggggcctggcccccgccgtccagggcgcaaggaagccggggtccttttccgctgcgcctacctcagaggatgtggcggcgggctcggaggcggctacggcgggggctgcgacgcggaggcagggagccgagccagggagcggagccgagcgagcggctgggccaagggcggggcggcgcggacggcggcggcgcggacccgcctcccctcctgcgcgcccggcccggcgcgctccgcccccaggccccgcccgggacagcgtccaggccgggccagggtccccatcccgctagcgagccgcgttcttacccttccgggccccgctgccccggcagcagacacaggagcctgcgggcgtgttgcgggcgcgcgggaggacctgcgtgagtcggggcacggggaggcgccggactgacgtgtgcaccgtgtgtgcgtgcgcagggacacgcgggttcttgctggaaacctcggccccagtggcagcgctcgggaagggggaggaggccttccgattctctgagctgtggcccggaggtccctgcgctaat

SEQ ID NO: 2151 - DNA, 33092 bp, Homo sapiens
  source 1..33092: mol_type = genomic DNA
gtttatttatattttattaataaagacaacagaagaaggatgaggtttcaatattttattcaagttttttaagtgttgttaattacagcatttgaaggggaggatctaattccaacaaaatggaagactctaaaatgtacccattaaactgctaaaaaacaaattgagtggtgagaatacaacagaagtccaatttagattctgagtgttgtcaccatgtgattacaatcacacagacacttccaagcttatagctggagctcctggaagctatttcatactctggtgcaagggccaaaaaaaaacacaacacaagaaggaataagtcctgaattattggcttcatcacatccaccttctccaccccaaaatggcacaaaagaaacagttaccacaccctgcagaccttttggtgtaaaagagatgatgatgaactggggtgggaacaggtcatgaagatctgtctaaaaaagtcccattcaggtgagtttgtacacaccatcaagcagcgagcctctcatcaattagggttagggaaccaaggttcgattctcaggaaatcacaatttcattcatttactcaatatgaatttacaaagtgcctacatattatccgcttccacttgcagccatttctagataaaaaagaaacctggcatctcaaaggggccaccaagttctccccgagtctaccactgaaaggaccttttttggaaataggtttcttctgtacctctggaagggtaacatcttaaagctgaatcaactttaacctggagggctaacatatttagcaatacttgcatcccagacatacaacattaaaagatacactaaattctgaaggtagctatgctgcaaaatagtttaaaattaaacaattgtacagtattcatttatgcttgaaattccagtcctagaccaagcttgtggccaccagcattgacgttcttgccatccagaagagctgacagtgtcagtttaatacctgcagggagaaaaatgagggagaggaaaggaggaggaatggaggaaagaaatgacaagaaagattaacaccaaattcagaacctgttccaggtattatcagcagggtccaaactacatggcccttcaatccttgttacttagcactatctgaccaacaggcatactacagtgggcttataaaacaactataattatcccaccgcccagagagcctacccaaatctacttctggaaccccactttcctttttcctctcactgttcccctggtacaattagtctatagcactggtagcatgcagtaagcttctttggcaatcatccctttaaatgaaacctcaatcctgaatccaacctaaggtcttacatgttcatgttcatagtgtacacacatgtgtagtgtgcatgtacatccacagatgcacacaacaaactgacattccctggaataacctgattcagggagtagctggtagtcttagatttccagggttcaaaagtggttatacactagaactataatacgccgtggactggcctagccaactgtgcagaggaaacctgcaaaccacttttcctatttctttgtctttttacagtggggctgatttataagttagttttgagaatctgccagaaataagtatcaagcattatgtccacactggaaaaaaggatggaagaaaatagcaaagaatatgtgttagcctcagcctttttcctcctgcttgctacatctcatattctccaaatgttttataatgaccccatactcctttataaacatttaattatactttacatatatccatttatatatacccactgtattatataaacattttataagcaatgacataaatcagcaaaccagcaccacaatttttttaagataaagaaccgatttcacacacaagcaacacatacctggctttagagtctgagtgtatcctaaacctatcaggctggagttgttcactttagcctaatcaaggaaatgacaaaacagagaaaacattaagtataatactttgcacttccatctccaaaattagagctttttagtcaaccaaccttggactttagaatcaaaatttttcatgaccaccttgttcatgagattcattaaattcaatacaaaatacatcaattttaggtgcatacctttctgttcaaagggtgtgctgagatctgacacccctcataagaacaaagcagagagaaggaaggcctcttaggggccagtgtccttttgctcatataaataatgaggctccttttctcttgtttttaagtgcttgctgttaagggagccaaattcggttctagtttaggagacttaaaaagggctgtccataaattacacaaaccagtacagacaccattctgcaacatgagattccctcatttcaccccaaagagatacagccgccagtgccctgtgacaacagaaatgagcccaataggatttactgcaaaaactgtgtagtagttcgagggcctgtgagcaatgccagagactctgcaagatgccaactgactattgatttcttaatatgcaatgcaggagctgaaaaggagaatgaaaagtgaggcggggcggggggaattatcaattagaaccctagatttcagagtgccccttttaacagtccgcatgatagaacaggaactggtattaatggaagaggcttaacagtaagccagtctggttcaaatccagctcccagcactttcctgctgtgtacctttgagcaagttactcacctaagtttctagttcctcatttgtaaaaacagagatgattggccaggggccatggctcatgcctgtaattccagcattttgggaggccgaggcaggcagatcacctgaggtcaggagttcgagaccagcctgaccaacatggtgaaaccccgtctatactaaaaacacaaaaattatccaggtgtggtggtgggtgcctgtgttcccagctacatgggagggtgaggcagtagaatcacttgaacctgggggacggaggttgcgcagtgagctgagatcgtgccattgcactccagcctgggcaacaaagggagactccgtctcaaaaaaaaaaacaaacaaacagagatgattggccaggcatggtggctcatgccttgtaatcccaacatttgggaggttgaggtgggaggacagcttgagcccaggagtttgagaccagcccaggcaacagagtgagacattgtctctactaaaaatttttttttaattagccaggcatgctggtgtgcctatagtcccagctacttgggaggctgaggtggcaggattacttgagcacaggaggatgaggctgcagtgagctgcaattacaccactgcatccaacctgggccttgtctcaaaaaaacaaaaaataaaaaaaacccagagatgattaaaaaaccaaagcacctatttcaaatgggattaaacacagtaatctacacaaaaggctctgcacagtgcctggtacccataagaagtactagtagtatgatcactgtactcatttggcactcttttcaaagtgagaacatctctcactttgtttttgtttttttgagacggagtcttttttttttttttgagatagaatctcactctgtcacccaggctggagtgcagtgacacgatctcagctcactgcaacctccgcctccccggttcaagcaattctcctgcctcagcctctcgagtagctgggattacaggcacacgccaccatgcccggctaatttttgtacttttagtagacagggtttcaccgtgttggcgaggctggtgtcagactcctgacctcaagtgatctgcctgccttggcctcccaaagtgcagggattacaggcgtgagtcacggcgcccagcagcatctctcactttgagtaagctgaagcacagcactccagcaaacctgaaggattccaacataaagagcagatgggcctgcctgtgagatgcgtgattccacagatacccaccgagaagcaggcgtcagggtcaatctgatacttggctgctattccgaagcgcgtgttactgtttcctgctgtccaggcaagattgacagcggtctccaacttcttgttcactttctggtaaatggagccgccaaactctgtcccgtcattcctgcaaacaagcacaggacagatgctgagcttcccagggaggtgagctgcagcccagacagatccacccaagtctcccagaagacagggatgacagaaatggactgaaccaatactggtattaagggaagtcagaagttcaccaaatttcacaaaacaggtactaaattacaggaagtctgataagtatggaacaggcacctagccaggcacagtggctcacacctgtaatcccagcactttgggaggccgagatgggcagatcacttgaggtcaggggtttgagaccagcctggccaacatggtgaaaccctgtttctactaaaaatacaaaaattgaccgggctggtgccatacgcctgtaatcccagctactcaagaggctgaggcaggagaatcgcttgaacctgggaggcagaggttgcagtaagccgagatcgcgccactgcactccagcctgggcaacagagcaagacattgtctcaaacaaaaaaagaaaaagccaggggagagggggtacgtggtgactcacgcctgtaatcctagcattttgggaggccgaggcagcaggactgcttgagcccaggatatagcttgggcaacagagcgagatcctgtctctataaggaaaaaaaaaaaaaagaagcagcaagtagagcactgagattctgagtgatttatttttactgctactgatgttattacttttataaacgattctaccagaaaaatggcatggaagtccgggtgcagtggttcatgcctataatcccagcactttgggaggccaaggcgggcagatcatttgaggtcaggagtttgagaccagcctggctaacatgatgaaaccctgtctctactaaaaacataaaaattagctgggcatggtggcaggtgcctgtaatcccagcaacctgggggggtgaggcaggagaatcgtctgaacccaggaggcagaggttgcagtgagctgagatctcaccactgcactccagtctgggtgacagagtgagactctggctcaaaaaataaaagtaaaaataaaaaatgttatggaaagagaagaaaatgagaagagaacacagccagaaatggcaagaaaggtggggctgcacatatgcctcagaaggcaagttagagcccttggcacaacctgctgcagccactgctggggagatacagttggcactgacccagcctcttggaggagcagcacttcaaaagagcttaatccacaattcatctcgtccacctatgcatactcctcacccatgctgcaacatctaagcctggcaggatttgaaagggagctttttgctacatcataaaatgtctccctctttcaaaaacattcagaatgaaaccccagctggccaagctccctcctctcttacaaacacactgaatgactccagttgctgggaatatccctttcccttcttcagtcattcaaattctcctcttcctcttttggggccctgcttaagctctcagaatttgaaagtctgccccacccagctgaacagcctatacaaactctgcagtcactgccacccctaaaaaggcatacgaagagctcagagtctacactttgtcctctgtcgggctggggtcggcacagatcatagactgtctctcattactgctttcagattgttgtttatacacacagtgcatactggtgcctggtcagaagcaaccttctccatggagggaaccacagaaaacaaaaacagttaaagtggctgccactgcggagctgggatgagcaggctgaggcaggctggaatcactgcttttcataggcccatctgtactgtttgattttacaaccatgggttcagactcctttgattaaaaaaattaagaaaaattttaatgctgcaattttttaaaaaggaatgaccatcctccttgcatcagatggtcttcaagcctgcctagaccctctcaaacatctttaacataaaatcagtgtctgagttctgcctcatcattgtgggcatttccagtggaaatggcattggttaactgtgagtcagagcccacgtactttggaatccagcaaagggcttcaggacctaagaacaaaaactctagtcttcacaagacactctccctaaatcagagaatacattctaaattttcttttttttttttccccaagatgggatcttgctctgtttcccaggctggagagcagtggcaaaatcatagctcactgtaacctcaaactcctgggctcaagtgatcacaggcatgttgccaccatgcccagctaatttttaaaaaatttcttagagacagagtatttctatgttccccaggctggtcccaaactcctggcctcaagtgatcctcccgcctcagcctcccaagtagctaggattacacgtatgagccacacattgtaaattttcgtttccccatgaaattcagcgagacagacattatgcttctagaaagtacagggagacccaggcactgcctgattcacagagaatcctgtcttctgtagacagcccaagtatgctacaataaaacagcagcctgtcaaaaataagatttttgaatgactttagtaatatattcaaatggggaagtttcttgggcttacatgtttttaaaaaaggccagacttttcagaatatcctaaaaccaggaacacaatactgccttcctgtacagagctttcaaaaccataaacagaaggcagatgcagtggctcacacctgtaatcccagcactttgggaggccaaggcgggcagatcgcttgagctcacaagttcaagaacaacctgggcaacatggcgaaatcctgcctccacaaaaaatacaaaaattagccaggtgtggtggcatgcacctgtagtcccagctacttgcaaggctgaggtgggagtatcacttaatcccgggaggtggaggctgcagagatcgtgccactgaactccagcctgggtgagagagtgagaccctgtcaccaaaaaataataataataaataaataaatacacaggtggaactgttcaaattcatctatatgaagcacaaagaatttctgttatgcatttgggcccctgcaagcaccagggcaacccagatgagttgtgtcagctgccttcacgctggttccaaaaataaaccatacccacttgttgcttatttaaaatgctgaagctcagatatgtgggggaaatggctaacagccattgttcctcctagaattggtactgaagaattggtgccaatgcccaatttcaaaccaaggaaaacacttcccatgccaatcagaattctacgttcaaaaacatttctatgcatgtggtatgtttcctatagctttttagtatgtttcacctcttcttaattaaacatataataaaattgatattttctttgctttttttttttttttttttttttgagacggagtcttgctctgttgctcaggctagagcgcagtggcgtgatctcggctcattgcaaactccacctcccaggttcaagcgattctcctgcttcagcctcccaagtagctgggattacaggcacccgccaccacgcccagctaatttttgtatttttagtagagatggggtttcaccttcttgaccaggctggtcttgaacttctgacctcgtgatccacccgcctcggcctcccaaagtgctgggattacaggcgtgagccacgacgcccggccaaaatggatattttcttggtatacatttttacgaattttaacacacgtacacagattaatgtaaccatgacgacagtcagaatatagaacagttccctccccgaaactccctcagtcactgctttgtagtcataccctccccgccccctgccaaccactagattgtccatctctatagttttcctgtgactttttagctgtaacagattccaaattaatgataaaaattcctcaaaaaatttattaatggaaatattagtttacacattaatatcactgatttgccttaagtttaagaagttacttctttagtgacctctagtggaaagaaataaacatggtaactctgcacccagcttgtgcctgtcacaggttaattcctcatgaaactaaataaaacaaggtttatggataaaacaagattcatgaatgaaatgtgtttcccttaacttaaatcatcaatctacttcaattctcaaggggctctctcctaacctataatcactgtttcccttcaccatactgtccaatagttacttttacatgcttcactgtacagagaagatagtttgtaactgagataatcagctcctaaatttgtctaccatgtctacatgtcatcaagcccagcaggctaatcctcaggcattagacagagaaagagagctgttttgttaactaaaacaaaaactgcagggaatggacacgctctggactgacaccatgtccctgctgtaattaatcagccactttgtgtacctgtggcaatatatactgttcacagagtggaaaggatctaagacactccaggaaatgggtaggtgggaaacaaaagatagcagcaggccatgtggctcatctaatgccaacaaactcactttacagtggttaaaaactgggctttcttaaaaaaaaaaaaaaaaaaacagtgaaaagcaatccccttaccacacatgctccaaccccacccctcccaccctgctgcccccatgtacacttacacattagtgtgaagctggaattcatcagtcttgtagccaactgcaaagttgctctgggtcactcgggattttgcagtctcaaaattcatctggtagccggccagccagccctcgtaacctagcaccagagcaccccggatggaaggcccagcaatgtcgaaatccatgtcgcagcccaggttaatgtgctcccgcttgtaccctgtcttgattttagcattttttttcctgaaggaaaataagttatattaagatcagaagctaactcaccttgaaatgcaagttgtcttttttttttttttaatcccaggtcaaataaagggagtggggtgggggtgaagtcagggctccagttctcccttaagccactgctgtaccacaatgagcaggacacaacctctcttccacagggactcagtctgcagaaaccccacaataacgaagtgagaacacagacaggaaaagcctgaaaaataaatacgaagtaactttcttctcctatcctctttgtatgcttaacgtagcagcctacacaggcattcattaggtagaaagccaccatgtaattatgaaacagatgcatctttgatattttccaaacctgtggaaaagatttatctgccatgaaggcagctacctaaatagcagcttttaaagagacggttttcttcttactctgtggctcacatggttaagtaaggaaacaaaggctatgttccctctaagtgagtacaacagtaaaatggatttcaattccatattcatgagaccccaatgagtacatatttcagagaaccgggtactgatgtagaacctggaactctgcagtcatgggggccaggaagtgttagttagccagacagtatcccaggtccaacctgatgataccagatgtgagtctataagcagttcagtgtctctactgccggttcctcaagacccagcatcccttaggaagagcaggtgaatagtgtcacctgcagacctattattaccatgtcttttaccaaaagtacacactggagaacaagatcacatccaacaaatacaacatggatcatttttatctgattgtctctatcattcagttacaagatcgacatctcccacaggaagctgcattctcagcagagaccacaggaggaaccagatccactcagagcctcaaggactacacagcactgttcacttctagctttattcacattgagattaatgcttcatcctcagcacctagaccatttcctcctaaatggaaccagtgctccttggagaaatggccaactacagatcttaggcaggaaatgtacacagtaacctaaaacatctatcaaagctattgaagactactggggtggaggcaaaaggacttacaaggtaacctgaagaggctcccaagggcttcgacaatggagcaatgtgagcctcaataagaaaaatattagcaataggctgaaacatattaaacagtatgtttattctaggcattataatgacactcggggccaggcgcagtggctcatgccagtaattccagcactttgggaggctgaggcaggtggatcacaaggtcagaagttcgagaccagcctggccaacatggtgaaacaccgtctctactaaaaacacaaaaattagctgggcgcggtggtgggcgtgtgtaatcccagctactcaggaggctgaggcaggagaaacgcttgaacccgggaggcagaggttgcagtgagccgagatcgcgccactgcactccagcctgggcgacagagtaagactccgtctcaaaaaaaaaaaaaaaagaattataataacgctcaaatcacatagctgtcatctttaaagactaaagaaccaacctgttattttaaaaacagcaaaaggccaggtgcggtggcttacgcctataatcccaacacttcgggaggccgaggtgggtggatcacctgaggtcaggagttcaaggccagcctggccaacatggcaaaaccccatctctactaaaaatgcaaaaattagctgggtgtggtggcacatgcctgtaatctcatctacttgggaggctgaggcaggagaatcacttgaacccaggaggtggaggttgcagtgagccaagaccgcgccactgcactccagcctgggtagcaagaataaaactcagtctcaaaaaaaaaaaaaaaaatcatgaaacaatcatgtaaatttgaacagactagagatttgacaatattaagaaatgatccactgggcgcagtggctcatgcctgtaatctcagcactttgggaggctggggcaggcggatcacctgaggtcgggagttcgagcccagcctgaccaacacggagaaatcccgtctctactaaaaacacaaaattagccgggtgtggtggcccatgcctgtaatcccagctactcaggaggctgaggcaggacaatcacttgaacccgggaggcggaggctgcgtgagctgagatcgcaccattgcactccagcctgggcaacaagagtgaaactccatctttaaaaaaaaaaaaaaagaaaaagaaatgatcaacttttttcaatataataataatatcatggttatgctcctttaaaatggattattgccatttaaagatacataataaaatatttacagctgaaattaagtgttgttatttacttaaaatagtatgtgcgtggaggagtgttatatttatggctgtataaataaaacatgattggccacaggttggtaactatcaaagctgtgtgataggaatagaatgagggttaaacatatttttctgtatatttttgtatgtttcagatttctcattaaaaaaaaataaaggttaaaaattccaaattctcaatgagacaagaattttagaggtcacagctgaaaataaagccagcacccctcccaagtgatgtaggaaaatagcctgttccatggcaagagtgacaccgtcttgaaacaaaatcaccactgatacagtttcgatgctgtatcttctgaatctcatgttgaaatgcagtccccagtgttggacctgctgggtggtggttagaccatgggggtggatccctcatggattggtgctgtcctcccaataatgagttatgagatctggttgtttgcgtgtggcacctccccaccactctctctctcttgctcctgctcttgccatgtgatgtgcctgctcctgcttcatcaatcaccatgactaaaagcttcctgacgccttcccagaagccgagcagatgcctgtgctctgcttgtacagactgcagaaccatgagccaattgaacctcttttcttcataaattagctatcctcaggtatttttttctttttttcagacaaggtctcactctgttgtccaggcaggagtgcagtggtgcgatcatggctcactacagcccctacctcctgagctcaggtgatcctcccacctcagcctcccaggtagctagaactgactataggtgcgcaccaccaggcccagctagtgtgtgtgtgcatgtgggtagacggggtttaaccatgttgcctaggctggtctccaactcctgggctcaagcaatctgcctgccttagcctcccaaaatgctgggattacaggtgtgagccacctcgcctggccaggtatttctttagagcaatgcaaggacaagactataggcgctcaccacaatgaccagcgtgtgtgtgtgtgtgtgtgtgtgtgtgtgtgtgtgtgtgtgtgtgtgtgtagatggggtttcaccatgttacctaggctggtctccaactcctgggctcaagcaatctgcctgcctcagcctccaaaaatgctaggattacaggcgtgagccaccttgcctggcaagaatagcctaatacagccatgacgaccaaggaatgcatcatagacaatcccataaaagaaacaatgccagccgggcacagtgcctcacacctgtaattccaacacttttagaggccaaggcaggtagatcacttgagcttaggagttcaagaccagcctggccaacatggcaaaattccatctctactaaaaatacaaaaattagctgggtgtggtggtgcacacctgtagtcccagacactcaggaggctgaggcagaagaatcgctggaacccgggaggcagaggttgcaatgagccaagatcacgcctctgcagtccagcccgggtgacagagtgagactgtctcaaaaaaataaataaataaaaatttaaaaagtaaagatgcttatctaacctccctttggtcacaagttttgcaagagttttctgcaagatggtctaagacatgcacatgtctttactctaaaagcttgctatataaagaatactttctggaggatgaatgcagggatccactgtctcttggctgcttgagacatcgcttctatttgtaagtctctattaaatgtttctttctgagaaactggatttgtcagtctctttctttggctgctcagctccctcagcagttgggagtaggtgtgcacagacctgctcaccaacagaacaagtgacaatgaaacttatgccttggaacctcaattttgttcaagttacttctgtacattttggcaaggtttgaaggaaaggagtaacaaccaaattatctctcaataagaaaaatccaaaactggtcaggcgtagtggctcacacctgtaatcccagcactccaaggagggcagatcacttgaggtcaggagttggagaccagcctggccaacacggaaaaaccctgtctctactaaaaatacaaaaattagcaggacgtggtggcatgtgcctgtaatcccagctattcaggaggctgaggcacgagaattgcttgaacctgggaggtggaggttgcagtgagctgaaatcacatcactgcactccagcctgagcgacagagcaagatgtctcaagaaaaaagaaaaagaaacctatcttcatctgcctgctctttggggaaagaagtctgggtttcagccaagtatgtgattggcaccaggctggttgagatgactgatgattagacagctgttgagaggctgacatttacaaagggaaaaggaaatataaaatcaggcatcttctaaccatctcctttttcaatttttaataaaaagctgctgatgatcacaaactatgatgcctatggcagggcctctgaccagtggtgtgcaccacctgcaccagttgacatggcacccccacccactgtctcactggattctggccagggcccacaatccccaagagaaagggcagtgctggggagtggctcaggcttctctccaggtctctttctaacactgcacaccatgtctgtggagtcttcctctttcagatattattgggatttatttttaagctatttcaacagtagtgctaatttgacaagcacccgagagaggcctgactgatttgtggttaacaagcaagctttatttgtgatggatactcagcgtgggtgctggtccttattgaggtctgtggcctcatccagatgtggtctacactccgctcctcctgggagccaggtgttttcccaggctgtaccctcagtcactttggaaagccagctttcgtttctaatctccatgatgcaccaccagaactttcctcaaatacccagtagcattatgtacatctagcacccagaattttagttttgttttttttttgagatggagtcttgctctgtcgcccacattggagtgcagtggtaccatctcggctcgctgcaacctccacctcctgggttcaagcaattctcctgcctcagcctcctgagtagctgggattacaggtgtgcgccaccacacccagctaatttttgtatttttagtaaagacagggttttgccaggctggtctcaaacacctgacctcgtgatccacctgcctcagcattccaaagtgctgggattgcaggcatgagcccccgcgccaggcctacaatcttagtttctaaatatcattctccaacataaagaaccaaggctccttggagaaatggcagatagcaggactggggaaaaacaagtactagatgagcgtggtacactttctaaaaccagaaataaagacatgctctgaaaaacgacagaggtttgtcaaaaagcacacagagtgtattctcccaaagcccatatctgggacaacttgagcgacaaaataaatgacactgtgcattatagcccatagagtaaatgtccatgcatctatactaatataaataaataattgattaaataaatacatggggaagaaggaatagctcttccttacggtagaataccaattaacaagtgaaggaaggatggcaatagaaaattaccatttgaggccaggtgtggtggctcacacctgtaatcccagaattttgggaggccaaggtgggaggcagatcacttgagtcaggagtttgagaccagactgagcaacatggtgaaacactgtctctaccaaaaatataaaaatcaaccaggggtggcagcaggcacctgtagtcccagctactggggaggccgaggagggaggatcccttgagccagggaggcagaggttgcaatgagccgagatcataccactgcactccagcctaggtgacagagtgagaccccatctcataaaaacaaaaaagaaaagaaaatcaccatttgtagccaggcgtggtggctcacacctgtaatcccaacaatttgggaggctgagacgggtggatcgcttgagctgagaagttctagaccagcctggccaacctggtgaaacctcatctctactaaaaatacaaaaattagctgggcttggtggcacacgcctgtggtcccagctacttgggaggctgaggaaggaggattgctggatcccaggaggcagaggttgcagtgagccaggatcacaccactgcactccagtcaccatttgccaagcgtaactgttgcaggcaagaatcaccaatggatgttactatttttgagcaaaagtatgatgagaaatagaatatctgcataatctcaaagtgtctacccacaagatacttactaattacaaagagaaaaatagtagctttacaatgaagagagttggcagacaccacttcaaaactgatcaccaaaaatgaggcctactgatatattcttcctaacatcaggtgcagagaagaatataacacaacaactacagttgccaaaaatgcataacctaaatttaatcataaggaagcatcagacaaatccaaactgagggacatcttaacaaaataattggccactctttttcaaaagtgtcagagtcagaaaatattccagattagagaagacttaacaattagatgcaatttaggaacctgaactggatcacagatcagaaaaaagacgtcattgtgacaacagattaattaactatatgatatcaacattaacttgctgattctgatcattatagttacgtaaaccattaacattaggagctgggtgaagaacacaggagaactctgcatactatttttgccacatttttttctaagtataaaattattttgaaataaaaagtaaattaaaaaaaaaaggggggcaggtgcagtggctcacgcctgtaaacccggcactttgggaggctgaggtgggcagatcacccaaggtcaggagttcaagaccagcctgaccaacatggagagaccctgtctctattaaaaatacaaaattagctgggtgtggtggtgcattcctgtaatcccggctactcgggaggctgaggcaggagaaacacatgaatctgcccagcactttgggaggccgaggcaggtggatcacgaggtcagaagttcaagaccagcctggccaatacggtgaaacccccgtctccactaaaaatacaaaaattagccaggcatggtggcccgtgtctgtagtcccagctacttgggaggctgaggcaaaaggatcacttgaacccgggaggaggaggttgcagtgagctgagatcacaccactgcactccagcctgggcgacagagcaagactccgtccccctcaacccaaaaaaaaaaaaaaccaaaaaactttcctttgtgttttatactgcatggcctggagacctctgcaaagctccctaaggtcatgggaaggaaatcacctacaaattccaaagtgtgctatcccagggcagcaggcaaagtcccaggcagcaaattcaagcatgtgggcacatcctccagcctctcatcctatcccaggatctttccagataaccgctccctgataccatggcagagttcctggggggagagtgcacagcactgcaaaaaggcagtgctcttgcaggagaaactacagcagcgaagaggaatgagagtaaatcagccccgtaacaatggtctcttcagatcatctatagccaagctataagacgacatctccagaggataggaaccatgtgtgcccagtcacttgtgtgcactgcacacccagcacaggtctgcacttggtagatcctccctctaataaatatctgttggaaaggaaaaaaggaagaaagaaaaaaaatgaatggcaaaactgaaaaattcatagtgccatttaactacacacttaaagatgttaagttttatatgtatatcttaccacaatttttttttttttttggagacagagtctctctctgtagcccaggctggagtgcagtggtgcgatctcagctcactgcaacctctgtctcctgggttcaagcgattctcatgcctcagcatcccaagtatctgggactacaggcacgcaccatcatgcctggctaatttttgtatttttattagagatggggttttgccatgttgcccaggctggtctcaaactcctgacctcaagcaatccacccacctcagcctcccaaagtgctgggatcacaggcatgagtcactgcatccgactcttttttttttttttcttttgagatggagtttcgctcttcttgcccagggtgcagtgcaatggcaccaccttggctcaccacaacctctgcctcccaggttcaagcgattctcctgcctcagcctcccaagtagctgggattacaggcatgcgcccaccaggcgcagctaatttttatgtttagtagagacagggtttctccacgttggtcaggctggtctcaaacttccgacctcaggtgatttgcctgcctcagcctcccaaagtgttgggattacaggcgtgagccaccacgcccggcccacaatttttaaaaactgaaattcagtacatgcccttgaccctaacatcactatataaaacatcttccccaggtttggaagacccaccaatatgagtggaaaaaaacaagggtgtattctaaaagggaataattccttctaggcactttgaaaagcacccaggaattgaggcagactaccatgctatcatgccaagtgatggtcaagaactaacaagcctattacatctgtggccagaaggcctggggaaagtgcagcctcaggagccaccttgcagttacacccacagggtctcagtgtccctaagcagcaggaagctgggagaaggacttccatgcctgaagaaatgaggctggcaacagtgaccagttaggccctgcttccaaatgtcacccactcccgtttggtcatagccacttacatcaccagcagcctaactcacatgaaatggctattactgaacagaaatcctgcaacctccatggcagaaactaggagaacactaacaaaatgcagaatcttattacaaaacacggctaaacactggtctgaatcctctattagaaagtgagctccttggcgggtaacaatcatggcctgggcacccttagatctccagatgggcacagggccaagcacaggtggcacttagaaatcgtttgttgggtaaacaccagtcctgaattaggaagtgctcattatagcatagtctgttagtgcatagatgtggatacgacccctgggaccaaatcaaaaccagaggacttaaatcgccaggtctcggagaccatattttaggtgctgtcagcccccaaaacattttgtcacaaagggcttccaccacctgcaacatcagagaacatccttgtggagaaaacagatgaaactcttacccagtgttaggtgagaaggatgaatcgaaggtcagcttcagtccacgtgcaagctgaacagaaaagaaatttgccactagatttagtcacaaggcaggctggcagatgcgaattaataaatccacatcttttcacagcagccattacctgatcttccacagtaatctcggtgcctagtgtattgtcggtattccatttctctgtaaacgtcaggccgtactcagtccatctgtacttggtttccagactgcccgtcactttggtggtctcagtgttggctgagcctgagcttgtaaattccttcaaaggagagagaagagtcacagcctgcaccatagcactcacttggcttcacttcactcctaaacactatacttgcctttctgcaagaggcaagaccctgaatgtgggggggccaaggctaactctacaattcaaatagatatttaaagtacagatgggagtaaaggagcctgctatgtaaagaaatcttatggggaatttgttgtcagcagacagcttccttcctccctgtaactcttcagtctggacaggaaagcatctcccttccatcctggctccagggcagtacagagaaaaagcactgagctaaagctgacacagcggtaattcaaacccaaaacttctttcttccaacaattactgcacacataatttcaaagggactactaagattactttaaaaacacttatgtggttgaatgcaggtgaatttgaaaataagaagcacaaggaaaactaaaactgagacctgacccattctcctctattacccgctgctgaactgggggcctactggcatggttcccctggaccacccatcatgcagaaaatggaatgaatgtgaaaaccacaaaaactgccagaataaaaaaaaaaaagtaccttcttttggctttgcgggccaggtcacgacagttatttgttgatctacaacaaattcccacgttccatacaatggtcactatttgggtaatgggtacactagaagcccaaacctcaccattacacaatacatccatgtaacaaacctgcacatgtacaccctgaatctaaaatcttttttaaaaataaaaataagccaggcgcagtggctcatgcctataattccagcactttgggaggccaaggtgggcggatcacctgaagtcgggagttcaagaccagcctgaccaacatggaaaaaccccgtctctattaaaaatacaaaattagccgagcatggtggcgggtgcctgtaatcccagctactcggtaggctgaggtaggagaatcgcttgaacccaagaagtggaggttgtggtgagctgagatcacgccattgtactccagcctgggcgacaagagcaaaactccatctcaaaaataaataaataaaataaaataaaaataaataaatactcatgttccatgtgggttggacaacttaccaatccattctcagattttgttttcaaatcaagctttattaagccaaatcctaaagaaagaagaagacaactgtcaataggttaaataactagagaacagcacctctgcctccctcatggttgcttcaggatgcttttttaaaaagaagcacactcctgccacaggggctgagggcacccagtctctgctgctgctcgtggggggagctctcagctgccatggaacagcagcagacagaatgggcacccccacctgggtcccacctgcactcccagcagggtctgataagaagacacctgacagctggcaaagacacagttactgggcctcgtgggcatgtgcctaagcacaggctaaatatagaagccgcgctccactgcagcagcttccacagggctgctccacacttggaaaagaaaacaagaatacccacttgacagcaccaatgcaggagcctgtccaactgggtgcacaaccaaagttgctacaattgccacacaaatgaaagcttcttttttccctcacgtgaaagttcagaacagctgacctacccaggtctcctaaacagttatcggtaaagtctcaaacatgccaactcagtctgtgagctgaaaggcaccccctctctgcaacactcaccatagcccttggtgaagacatccctggcagatttgccaagatcggcatacgtgggtggcacagccatcttctgctatgataaaagaatcaccagaataaatgcattgataattagggaaattagctttccatcaataacaattattagatgtaattagcaaccaataaaaatcacctagcactaagactaccaggtagcttatcctcccagatgggccaagaagcccttgctgtcttgtccttcattttgtggccagagcttgagacactcaatgagtctttgttgacagatgatcaacaatttagacctctcctcctcagcatccccaggactgagcccaggcccagaacagagtaggagtcaggaaatatttgcttaatgaataaactgtcaaagacacattcccatgagccagtgactttactgaattgtaggactgttgccaataaaacatatcatcttacaaaatgtcagctactaggacattaaatgtaccgaatagaaatcagagcttttcatgggaacatcattttccatgtggctctgatttcattcattcaacaaatatttatggagtacctactatatgccaggatgggcccaacttttcacaaaacttttggactttatgggaacccacttcatatttctcatagagaatacagtaaaaccaaaccagtttggcagctcttcacatggaaaaaacccaaatacatcctccaaatacattaaacaaatatttattgagctccagtgtaactttatttttaaaaccaaccatcaaaggactacttgggattgctgcatatcactaagtcaatcaacaaacatttattaagcacctcggtgttcaaggaaggagagtaactcaaatagtctttgccctaaggaccacactgcattcctggaaggctttgctttggcatgctgtatatgctgtgtacacaggattaatatcctaatctgggactgtacatggtgtgctctgcccaggaggagagggggtcatgcatgagaaagcctcatctcctgcaccttctccatccccagaatcattagtctcaaccagaaggaccattccattcgttttaaaatacagtatacctaaattatcaaaattcatctgcatatataccatctgaagttacatgtatatatattcacacaaataaacacatatatgacatgctcctggcatgtcatatgacatgatatgcttccatatcatcaatggaagttgcattcttggccaaagctttaacttcaaaggcattgcaggaggccacagactcactgagtatgttgtaaaagaaacagtataaacttctacaattttaaattgtgaagttgtgatccaggtcctactttactttttccagatgctttgttaattttatcccagctcacttttgtgtcagagcacagacagaagagcagcgagctgtttactctgtcctatttttgtcgctgctgtgttatttcttgcacatgatcaggctgaaaccatggacaggtcagcccacattagtatcagggtagagagatgaggggggaagatccattttacactgcccgccactggctctttccagtctgggggctcccctctccccacttgttcctccctcccaaactaaccctgtaggtgcatccccccgggatagaccaggaaaccacccaccagaacctcaagaaataccctttacctgacaccttcctaggagaacaactctggattgaaagctgaggcaatgtaaccccaggcagacacagaacataacagtaacgggcccagaacattctccacccgacagggttaacaaaccatcagtgaaccaagtacccctcttcagtgctatgcctcccaggggggccacaaactcagccggggtgggggctggggaagcagaaggagaagcagtccagtggtaatatctgtgggtcacctaagacctccctggaccttaggagccagagccttccccacgactctcccctgaccccacagaagagacgcctcccagacacagcagccttcacatctggactggtccccgctcaggataaaggcagagcactcatccattaaatgttccccaaatgccctctctcatcgctaatccccaaaatccaacaagcacagccacctgtcaaaaaacaccccacccacagcaaacatcagcctgaagtacaaggccactaaagagattaccacccaaggacaaggcactcagagagcagagctcagaagagcagaccggacccctcctggggcctctaggagctccgacacggccaagctcttttggggctgtggggttccacaacacaaccatgtagttggtaccagcagcacgcaagtgaacttgctggttcactaaaacatatccctatccaatgcctcactgtaaacatactggatgctggctttctcatctgtgtcttgctctcttccccatctccttgaacaccgacaatgaagcataatctcccccgttctgggcccccaagtaagcattctccccagcatagcacctggcaaggaagactcacagaaaccactggctgaatggagtcaagtccactcctgggcctgaagtgacaccaccgaggacagcaaaaggatgactcaccctttcactaaaggcccccaactgccaggtagtggtagcttcccctcctttttgtgcacttcggcccatcccctgctgcactgatctgacggaactaaggaaggcccgagacagctctgccgctccgagaagttcagctttcttacagctacagacagcacccccaaaatgcccatttttacacagctctcgaacccatttcagagacaattttatgatagaaataataatctgcattaattttctaaggcgaggactggaggaaagaaaagtcggcaacaaagcctgctttcacttaacaccctgccagggtgctgacttgaaggctgaaccctggcccccacccctcccagtcactccttccacccagatctgctccaaatcggagcctgtacagttagctactgatacacagctgtctctgcagcatccaccccccaggggccttcacaagctgagcctctagaggctgcgcatgaagcagggcagtctggcatcggcaaagcagctagccctggacagacagaagtcagagggcgtcctgggggagtcagaaccacaggcctctctgcctgagtgatggcttcagggcagagcctgggggctttgttcccactggttggtaggaaacagagggatgggcagggccaggctgagcagacctgcctgcagtcactgaagactttgagaaggaccagcaagtcacaccaggatacaggagtccctggttcccctccacagcctgccagtctacctacccaacctttccttggctgaccttgaacaaattatgcaagccccattccagctgaggaatgaaaatccggcccatactggaagcacagaggggaaggatagtgtatctatcacccagcacagtctgcataatacttacgtaacctctgtcttgggggtacacatccttcttggctcatcagctgaatggcaatgacagctgctgtgctcaccgtgcccccaccccaccctaccccatacacctacccccaaaatcacctctttgaattcaaagcaccccagagcctgtcatgcataaatttatccaaaatatggaaaaagttacgtatataaagatgctaagccctggcacataataggcattcaatataaatgtgtttgatgagtgaatgagcaatgagcatcaaagtattatttagcaatggggaaaaaagtagaaacttggaatctgacaataggaactcattacaatgcaaccaggaagtaagagctccctctgcaggctcactgttgcagcatcaccaagagtgggggagttggggagaccctcaactagcaatgacctccactccctgcctgctcccacctcggcctaaggagagctgatctcaggctgaggagaccaagtgccatcagaagcactggttgcttctgacctcaataccatgcatggattttattctaagggccaccaagagccactgttgagtgactaccacatctgtgtttcagaagctcacttaaccagcagtctggcaaaaacgtaaataatatccagtgtcagtgagggtgtggaaaacagtcactcttgttcacgccaagggggagtactacaggtacactctttttggagagcaattaacccagcattaaccctagtggcaattccacttctaggaacctgccccactgtagcaaccaaggcactactcaaagatgtgtatatgaggatgctcactgcagcagtatttgtaacacaaaacccagaagcaacctaaaagtccatcaaaaggaaaatgaatgaataaaaattaaggtactatacttgcaaactaaggagtaccatatggtaatcaaaaagaataaggtgggtggctcatgcctgtaatcccagcactttgggaggctgaggtgggcggatcacttcaggccaggacttccagatcaacctggccaacatggcaaaaccccgtctctactaaaaataaaaaaaaaataaaaaaaaaaaatcacccaggtgtgatggtgcacgcctgtaatgccagctacttgagaggctgaggcacaagcttaaaccaggaggcagaggttgcagtgagccaagatcatgccactgcactccagcctggatgacagagcgagactgtctcacaaaaaaaaaaaaaaaaaaaaaagaataaggtggatgtatgtggtggcatagaaagctagctatgaagctacgatagccgtgcgcagtggctcatgcctgtaatcccagcactttgggaggccgaggtgggcgggtcacctgaggtcaggagttcgagaccaccctgaccaacatggagaaaccctgtctctattaaaaatacaaaataaattagccaggcgtggtggcgcatgcctgtaatcccagctactcgggaggctggggcagaagaattgcctcaacctgggaggtggaggttgtggtgagctgagatcgcgccattgtaatccagcctgggcaacaagagtaaaactccgtctcgaaacaaaaaaaaaaaaaagaaagaaagctagctagctatgatacagttaaatgaaaaaagtcagaaaatttgtaattccatgtaattggaggaaaacctttttacacatctttctatgttcatgaatggatgggaaagcatgtggaaggatacaagccaatctgcaaattggggctggcttagatacgcttctggagaaggaggtttagggaaggaatgcacttcaaatcgaattttcattttttgttctgcttcattatttaagctgtttgtgtatactaataatttgtttaaggataaagaatttcaatacaaaaattagccgggcgtggtggtaagtgcctgtaatcccagctacttgggaggctgaggcatgagaatcacttgaacccaaaggcaaaggctgcagtgagccaagatcgtgccactgcactccagcctgggtgacagagcgagagactccctctccaaaaaaacagcactttaaaagccaaccactgtgcctgaaattgagctgtgttgtgtcccaaatcacgttccaaggctgctgcagtagcaatgccagaaggctacctagagtgtccatacagattgcaagaacagatttaaactacactgagatggaagagttatcaggcaaggtccgtcggggcacatttcactcccaggtgaccactagtggcttggccaccctgccagaaatcatgagcaggaaagagctccctaacttcagggtgcacaagaatcaccggaggcgcttgttcaagaagagcctgccagaagagatggaactcctcctgccctacctctcagcctgtgcctaacaggcagggctgcccccaggtgccactgagaagcagcagctcagggcggttcctgcactaagcacctaccaggcccccgcctggtagaaatatgctctcttctctgcagaggctccctcaaaaggattcaggcatgtgccaggcatggtggctcacgcctctaatcccagcactttgggaggctgaggcaggaggatcgcctgaatgcaggagttcgagaccagcctgggcaatacagtgagaccctgtctcttttaaataaaaaataaaaagaaataaatagtaataatagaaggattcaggcagatgagctttgcacccctagagagccaacaactactgcaatggttgatacagggagcagggtggccatgggtctccaagactcagctaaaaacagctgggaggaaaggccttaggcctaaggaagttgttacaaggaatgagtgaaacaggcagaacagcagaagtatctggcatggagtaagtgttcaacaaatggcagtaataaccataatccactacactggatactctgtctgcccctccagatccattctcctcccttccaccctgctctgtgcccccagaactgatcattatggactgctgtccatgggcttatgattgggcttagcctttcaacgtgaggtacttgcagaagacgggagtttagggaagaatgaagtcggggtactcaccccgagtctccctccctgctaggcttcagatgggcaatgactaccttcctctacccaaggccacagctcctgccaagaagctccctctcttgtaggcctcagggtgttaacagaccagacctgacaccccatccacagctttgcaaatgatgtcttcattaaactctcctggattaccaagtgtaagtgtgcaccagatccctgcaaagacgctaaccaacagagcaatcacaaccatcatcatcatcattgccatcatcttatgattctgccaaggaagagagtactatggaaaagtctctggccccgctgtttcaccaacaccattctaggtggtttgtcagggcagaactaggccagcctataggaggggtatcagaccagccagtgatcacagaaacagcacctcttcctagccctgaggaccaggaaaagcaacttccccagcagaaggcaaccctagctctaaaagccaacatgggggcgaacacaatcagcagctcgctcacacacatgcacgcatgcacacacacacactccagcactttctctttcttgccaggaagaaacaacccaggggaacagttcctggttcaagctccaggatgctggcaaaggctgatggccctgtgttctggtagcaggtctgcgtacccaatgcagctgttctctccctccattcttccacaacagtctcgcagtgggcagtagagctttccaggggtagcttctattttgaaacaccctggcagctgggccaccaccagcacagctgagttccatgctgagctcctgggctcaagaggttgctgactcagggcagcctgcccacccacctatcaaggggagatggcctgcgctggcagccagtacactatggtctggatcccaggcatacctggggctcctacctgacctaaggcacctcaagttccctggagcctcactgcttggcttgaccaggtagggttgagacagacagtgcttgggcaggaagcctcgggaatcaaatagacctgagttctaacccaccccaccactttctaggtatgtgactttgggcaagtcgcaacctctctactcctttttcttcagctctaatatggagaaagagagcctggatggcgtcactgtgaggactgaattagctcgttaatatacaacacttggtacagtggctggcgcttggtaagcagggaatacacacagtattttatcacaagttttcattttgtatatttattataataatggctgctaagcatgttcaaaaggtcaccctgaaccacagggtccagagtccttcatgtccacaatgaggcattgtttagctgaacaggtcctgaaagaatgcctcccaccagatcccagggaaaacggacccttataatagacactcagcaccactgtccttgcaagaaatagaggtgactccattgtccactgccagttggcccgcacacagccatgcacaagttcactctgactggtgtggaaaaataatgtctcccatctgaacaccaattttgactttccaaaaggcattcacatctgttagcaccttgcaagggtcccttggagtgcaactgcaatgtgagagcaccaccattcagaccaggccttgaatcccaactccactcctgccaggctgtgttacctcacctctctgtgctcgagtctgctgacctgtgaaatggaaacacactatctctctcccagggtatagggtggtgaactcaacatcacagaacattcgttgagcccccagaaaggtgctgagcaagccctcaatcagcaatcactgtaatgacgacaatcatacttttatagcagacaaactcggccgggctcagtggctcacacctgcaatccccgcactttaggaggccgaggcgggtggatcaggaggtcaggagttcaagaccaacctggccaagatggtgaaaccccatctctactaaaaaatacaaaaaaattagccaggcatggtggcaggcgcctgtaatcccggctactcgagagggtgaggcagagacttgcttgaacccgagaggtagagattgcagggagccgagattgcaccactgcactccagcctgggcaacagagtgagactccatctaaaaaaaaaaaaaaaaaaaagagagagagaaactgaggcacaagacagtgacttgacctgtatgagaccgaccctatggctcaccagacctgtgttatgggcctaagctactctccagtgctctttccagcacagttctgagtaaagaacttaaagtcccactcatcccaaaccccctgagtacgtggtaaaatggagaaatgcgcccagacccagctgaggagcccactggtcaacttttctcagtggctaccacaggactccatggaaaacccaaagccgcagactacagaatctctgagcaccaggaggggctgcctccaagcttcggctggtcctcaaccacacatgcgcctcttccagtcactaccaccgaagacactacaccacgggaaattccatcaaaggcgaagtggacttcagtgcttcaggagcatcttcctggtaagggtagaggttggatgcccttcacctccccagcatggagttcactgtccacacctgcctagtgttcagcaaggccaggggcccacaggcacctcatccctgtatggtcccccactttctgagctacgaataacccctgcctatagccccactctagaatagcaaaaataaaactaaataatcaacaaggagtagtccccactacccacaggcaggcaccctactcaggacaaccccagcacaagctgtccatccacccaccatgagggaaggggtaacaggcccaacaccttctgtagaatcccagtcacccatgtcaccctccctgcaagcccagaaacaccagttcaacaagtttccctcgggacttggaaaaccagagaatgaagacgatgtgtttaaagcacttatttcaagagactatacatactgttacagttctttaaatatttgtgactctctgctaggtgaggctgttttccacaagtgagatgtctgtgtccctcaaaaggatgtccaggaccgggcatggtggctcacgcgtgtaatcccagcactttgggaggcggaggcgggtggattgcttgaggccaggagtttgagatcagcctggcaaacatggtgaaaccccgactctactaaaaatacaaaaattagccaggcgtggtggtgtgtgcctgggatcccagatactctgtgaggctgaggtgggaggattgcctgaacccaggaaacagaagctgccatgagccgttatggtgccaccgcgctccagacctggcaacagagcaagaccctgtctcaaaaaaaaaaaaagtccaggatcaaaggactatggtctgggcctgcagcccttcatatgcccattcaataattccacaaatactcaataagcacctactatgggccatgtactggaatagtaaaactctgtcagtaaagatgggtggattctgacacaagagtgcatttacccccacagacccttctcaagcacctactgtgtgccaggcagcaccaccccaggcactgaagacaaagtagcacagggcctcagtgcctcagtctgacccttaggagctgagttggtccagagctggggtgggcagaatgaaggctggccctcggtagtctgctctggccttctcctgcctcagtggagaagtttaggcaacagaggagccctttcccctatctccccaggagaggggaggctagtcaaggggacagggaccccgggcggaacgggctctaaaccagggtctgctcctgcattcaagatctccacatgcaaacttactgctccagcttgacaatgtccatttgtaaacttacaagatttttcataaattaagctgaaagttactcaatacctggtatacaaatgcttgtcaataatagtgaaagaatgtttaaaaacaggagctacatttattgaaccccttccacaacgccacgtgtagcaaaatggtctgcgggggatgggctggattcacccaaaaagccccaagggtgtcagggtttctacttagcccttctccacaccggcactgttctaaaggtttcatgctaattaattcattttattattccccaaaactcatcgaaggagaggtacaattgctcccgtcctatagatgagaaaacgaaggtatggggacttcccagctgtgtgaccttgtacaaaccactaagactgcgggcctctaatccaaagtcaggctccgaaacagtttccagaatgcaccgccgcatttggcgaatgaatgaacgaccgaaccagtaatcactcctaagaccaagaaggccacatccttccccgtggggcctccttttccgaggccaaaccttcagcccaggcccgagctccggcctctaccgcctaagtcgactctcggccggcgcgttccgctctagaaggctctggcacaggcgggcggtgccgggcgccagcttctgcgggcgtgggccggccagggcgcgtgggcctggggactcggggccacggtcgtcacgtgagctcatccccgaggcggcagcgtggccggcacccgcccgctggcctggtccggcgagcgtgggcggcgaacgggtccccgccggatgcacgctggtgggatccagggccagagggcgccgccggggaaggtcacctagacgcgcggcccgccgggcctccacgcggccgcccttgcacttccgcccgcaagcccgggccgcctctcgccgccagccgcaggcgtctctggaccctcggcctcgcgctccccagcccagacctgttcggcacccgcctgtgcggccttctctgcccgcccgctcaccagccaggcccgcgccggccgctcgcgatccctccccgcggccgggctgccggggcccctcgcccgctcctccctcagcgcctccctctcagctccccaggggcctggcccccgccgtccagggcgcaaggaagccggggtccttttccgctgcgcctacctcagaggatgtggcggcgggctcggaggcggctacggcgggggctgcgacgcggaggcagggagccgagccagggagcggagccgagcgagcggctgggccaagggcggggcggcgcggacggcggcggcgcggacccgcctcccctcctgcgcgcccggcccggcgcgctccgcccccaggccccgcccgggacagcgtccaggccgggccagggtccccatcccgctagcgagccgcgttcttacccttccgggccccgctgccccggcagcagacacaggagcctgcgggcgtgttgcgggcgcgcgggaggacct

SEQ ID NO: 2152 - DNA, 33092 bp, Homo sapiens; identical to SEQ ID NO: 2151
  source 1..33092: mol_type = genomic DNA

SEQ ID NO: 2153 - DNA, 864321 bp, Homo sapiens
  source 1..864321: mol_type = genomic DNA
ggcgcggtacaggagcagcactgccggcgggggcgggtgccagggacttggaggtggaggggacgcggcggtactctggcgtgtgagccgagggtggagtgcagagggagcgggagcgggacgggaggtcttctagctttggttctatggtggcagatccggctgggttccgggaagcgagggcctcgcggggtggctgggttggtgaagggctactgcggccgaaggggagcccgcctcacttcattcttccactctgagggacccgctctcttctggtcactacgtcttcctccctcacttcgcttggcgaagggtgttgtacttgtgaggaagtcgcagctggagctgggagtccgctggagtttttctctgtttctaagaggaggcgaacggccgctttggtggggacttactgctttcggcctgagataacgaacgctctttccttcactctaccgccgacttctaacgtttctgtctactcctttcagcttccgacttcgactccttaccttaaaagatgctggagtcatatgtaactccaattttaatgagctatgtgaatcgctacatcaagaacttaaagccgtcggatctacagctttcactatggggtggagacgtggtactcagcaagctcgagttaaagttggatgtgctggaacaggtaagctatttagctgtcattaactggaaacagttttcagcttgtttagacggtaatctattgtttcctaagctttgactttatgctgtaaaaacgtaacttttctactgatgtattttgagctaccctgaaacaagggggctttattttacactattttctttttctttctttctttttttttttttttttttttttttgagatggagtctcgctttgtcgcccaagctggagtgcagctgcgtgatctcggctcactgcaacctccgcctccgggactcaggcagttctcctgccgtagcctccctaatagctgggattacaggcgcgcaccaccacgcctggctaatttttgtatttttagtagagacggggtttcaccatgttggccaggctggtctcgaactcctgagcttaggtgatccgcccgcctcagtcttccgaagtgctgggattataggcgtgagccaccgcgcccggcctgcataatttttaaaaatagtttgttcccagttttggtatattagaatgggattacttaaagttgctttgacagaaagacgatttcattgttcatgtcagaattgttcggtctacttactcaattttcaagcattatgaatgtgctaatttatgttgtcaaaattctgtatgagcctggaaaacatcacattctcattctcctttttgggcaatggaagggtttgaaagccagcaggaagggtggctggcttgtgggggtcgaggaaaaaaagacaaaaaaaaaaaaaaaaaagagcagattcagatcatgaggaaagatgacatttcccacggcatcctcagagtgttgagtagatacattgagaatggcagtaaaattggaaacttctttattaatcgttttagtttcttttaacatgagatttgtctgatgcaaaagaaccgtaacttcaaagatcacatattcattaattcatttattacatttattagtaacatgccaagaaattctgttaggcttgaggatctgtgcaagctcagaagagtcagagaccaactgctttttaggagataagggaagacttaatctgacagtgatggttatttataatttttagttatagtccacagcctcttttattactcttttattaagtcaatctagacttagcactaagaaataatactcctggctgcttctttttcctcttcccaaggttagttgagtggcttaatatttaatattttcattttattttattttttaatgagcacaaatcccaagtgtaacagctcaatttttttttttttttttttgagacggagtcttgctctgttgcccaggctggagtgcagtggcacgatctcggctcactgcaagctccatctcccgggttcatgccattctcctgactcagcctcctgagtagttgggattacaggcgcccgccaccacgcctggctaattttttgtatttttagtagagatggggtttcaccgtgttagccaggatggtctcgatctcctgacctcatgatccgcccgcctcagcctcccaaagtgctgggattacaggcatgagccaccgcgcctggccaacagctcaattttaaaatgttttacacctgtgcaactactgtccaataaaaaaatggaatgtttccagcaccccaaaaggctcacctgtttttgtaagtactccaggccgggcacggtggttcacgcctgtaaccccagcactttgggaggccaaagcaggcagatcatgaggtcaggagttcgagaccagcctagccaacatggtgaaaccctgtctctactaaaaatacaaaaaattagctgggcttggtggcatgtgcctgtaatcccagttatttgggagactgaggcaggagaattgcttgaacccgggaggtggaggttgcagtgagccgagatcatgccactgcactccagcctgggtgacagagtgagactccatctggggcaggggaacgtactccccactcctaaaagaggcgactggtaatctgacttctgtcaacatagataagttttacctggttttgaacctcaaaaaaattggaatcatttatgtttggcttttttctttcaacctttctaagattaacccatgttgttagaagagtttgtttttcgtattgtcagtactattccattgcataaagattccacaatttacttactcattctcctgttgatggacacttgggtttttaatatttttggctggtgaagaaagcttccataaacattccagtacatctatcttggtaacgtaagtattaatttctcttaggtgtatacctagaaggtaggcctgtgtttagcctgtgttttcattttatattgccaaatagtcttccaaagtggttatatcaattccagtcttaccaacaacttataagcattccaggtatttcacatttttgctactacttgttatgtttgttattttaatgttagcctttctagtgggtgtgtagtgataacctcattgtaattttaacttgtattttcctaatgactaattatgtttttatattcttattggccatttagctatctttttttttttttgtgaagtctaagtcttttttccttttttaaaaattgagttttctgtcttattgatatataggaattctttttttttttttttttttttttgagacggagtctcgctctgttgcccaggctggagtgcagtggtgcgatctcggctcactgcaagcttcacctcccaggttcacaccattctcctgcctcagcctcccgagtaactggactgcaggcgcccgccaccatgcccggctaattttttgtatttttaatggagacagggtttcaccatgttagccaggatggtctcgattccctgaccttgtgatcctcctgtctcggcctcccaaagtgatgggttacaggcatgagccactgcgcccggccaggaattctttatatattttggaaatgagtcctttgccagatagatgttttgcagtatttactctcagtttgtggcttgtctctttactcataaaggtgtcttgatgaataaaagttaataatcttactgaggtccaatttatcaatcttttcccttgtggttagggtttttctagtcttgtttaagaaatcttagcttacaccaacatcgtgaaaatattcttttatatttcttttaggagctttattgaattccatgattcatctcaaattttttttctgcatatgagtaatagaggttaaggttaatttttttccattgatagtcagttgatctataccatttgttgaactcttctttccctactcaattacagtaagcctttgctgtaaatcaggttgccatatgtgtgtggatttgtttctgaactctttattctattgagtggtctatttgtctattcttgtgtcactccatatggttactgtagcttttataataagacttggttggtatctcagtgtaattagtacaactttgttcttttctccttcaagattgtcataactattttaggtcctttgtatttccatatacattttatttttttatttttattttttgagacagagtcttgctctgtagcccaggctggagtgcagtagtgtgatctcggctcactgcaacctccacctccctgtggagcaattctcctgctgcagcctccgtagtagctgggattacaggtgtgcaccaccacgcctggctaacttttgtatttttagtagagacggggtttcaccatgttggccaggctggtctcgaactcctgagctcaggtgatccacccgccttggcctcccaaagtgctggattacaggcatgagccaccacgcccagcctatcatatacattttaatttcaacttataacttttagaattaatttctaaaaaggaaagctgttagtgttttttgctgagattacattgaatctatcgatcaattttggatgaattaacatattaacattgagctgacatagttttgagtttttcaattcatgtacagagcattgcttttcatatttttaggcctttaatttctctcagcaatgttttgaactttttagagaaattttgcatgtatttcattaaattttacctctttttatggatgtttaagtagcattttaaaaacctctattttctggttaggtgtggtggctcttgcctgtaatcagtcacagcactttgggaggccaaggtgggtggatcacttgaggtcaggagttcgagatcagcctagccaatatggcaaaacctcgtctctactaaaaatacaaaaattagccaggtgtggtggctcacgcctgtaatcccagctacttgggacgctggggcacaagaatcacttgaactgggaaggtggaggttgcagtaagctgagattgtgccactggactccagcctgggcgacagagtgagactctgtctcaaaaagcaaacacaaaaaaacctctatttttaaataatttgttaccagtacaggaaataaaatcaattttagtatgtcgacctatccagtggcccaacttgtctaacagtttttggtaggttcttttggattgtccatgttcaatcatgtcacctgcaaataatgacagttttacatctttctatccaatacttgtatcttttatttcatttcatttcattattgcagtgggctaggaccttttatataatgtggagtagaggtcatgagaatagacatccttttttgtttctaatttcagtgggaaagtattcaatgttttactattaagtatgttgttagctataaataacctttactgagttgagattcttttctattaatgattttccaatgagttttaaaaaatcataaatgaatgctgaatttgatcaaatattacacttaatgagttgatatatgatttttctcttttattttgttaatgtggtaaattacattgttttcaaatctaaaccttgcattcctggaataaacctgattatatattatcttttttacatattgttggattcaatttgttaaattttgattgattttgttgtgtctttgcttataagtgatactagcctatgattttcctttctcgtaatgtgattacctggttttgaatgtcatatatatatattggccttattgatttatttgtgaggtattccctctttttataatctctaacagtttatgtaagatcaatgttagtggtttttttaaaattgtgatagaatatgtataatacaacatttatcatcttaaacatttttttttttttttttttgagatagagtttcactcttgttgcccaggctggagtgcagtggtgcgatcttggctcactgcaacctctacttcctgggttcaaatgattttcctgcctcagcctctcaagcagctggcattacaggtgcccacgacaacacccggctaatttttctgtatttttagtagcgattgggtttcaccatgttggccaggctgatctcaaactcctgacctcacccaccttggcctcccaaagtgctgggcttacaagcatgagccatcgtgcctggcccattttaatcatttttaaatgtacgattctgtggtattacgtatgtttacattgttgtgcaaccatcactactactcatctctagaatattttcgtcttcccaaactgaaattctgtatccattagacaccaactccctattttcccctgttcccagccccttggcaaccaccattctactttatgactgtatgaatttgactattttaagtacttcatataagtggaatcattcagtgtttgttctttcgttattggcatatttcacttagcacaatgtctcaaaaagcttatctatgttgtagcatatgccactatgtcctttgtttttatgtctaaataatctattatatgtacatgccacattttgttcattcatttattcgttgatggatagttgggttgctttcatcttttggctataatgctgatatgaaggtaggtgtacaaatatacctgagactgtgcttttaatttatttgggtatatacccagaagtggaattgctagatcacgtgataattctgtgtttaattttttgaggaatcaccatactgttttccacaatgattgcattgttttacattcctaccagcaatgtgcaaaggttcgaagtgctccgtatcgtcactaacacttgttgttttacgtgttttttttttttaaatatagctatcctaatgggtatgaaatgatatctcaatgtggttttaatttgcatttctcaaatgattagtgatgttgagcctcttctcatgtacttattagctatgtttgtcttctttggagaaatgcctatttgagtcctttgcccaattttgaatcgggttctttgttttttgttgttgttgagttataggagttctttatgtattgtggatatcaatcccttagcagatacatgatttgcagatattttctcacatgctgtcagtggcatcttactctataatagtgtcctttgatgcaccaaagtttttaattttgatgaagtccaacttagctatttctctcattcattgtctggatttttgctgtcatatccaagaaatcattgtcaaatctaatgtcatgaaggttttctcctatgttttcttctaatttttttgttcttacatagtataaggtagtgttgcaacctttctctctttttttaaaatgtggatattcagttttcctaacaccatttgttgacatctgtactttcacattgaatggtcttggttcctttgtcaaaaatcatttgaccatagatgtgagagtttatttctgggctctcaatcctattccattgagtaatatgtctgcctttatgatactatcacactgtttggattattgtagcatcgtagtgagtttcagaatcaggaagtgtgagatcaccaacttctcagttttttaagtgttaggaagaattaaacatgaagtcatctgggtaatgatgtaaagttataaactgctgatttaatttaagacatataggatcatttagacttttatttctggtgttgtcagttttggtgagttgtatctttcaaggaatttccctatttcttgaaaattagggatcagcaaactgtgtcctgggcctgcttttgtaaatacagttttattgaaacatagctattcattttgtttattgtctatggctgctttcgccctaaaacagaaggattaagtagctaggacagagattgagtggcttgcaaaagcctaaagtatttactgtctccctctgtactgaaaaagtttgctgtcctgctctaaatcgttatatgtaaggaataaagttggtttttttgttgtttactttttaattttttgagccaaagtctcactgtggctgggcacggtggctcatgcctgtaatcccggcactttgggaggccgaggcgggtggatcacgatgtcaggagttcgagaccagcctgaccaaactggtgaaaccctgtctctactaaaaatacaaaaattagctgggtgtggtggcgggcgcctgtaatcccagctactcaggaggctgaggcaggagaattgcttgaacccaggaggcggaggttgcagtgtgccgagatcatgccactgcactccagcctgggcaacaaagcaagactccatctcaaaaaaaaaacaaaaacacaaaaaaacaaagtctcactctgttgcacaggctggagtgcagtggcatgatcatagctcactgcagtcttgacctcccaggctcaagctatcttcccacctctgccccctctgagtgccagtgccaccatgcccgaataatttttatactttttgtagagacgaggtctcacgatgtttcccaggccagtctcaaactcctgggctcaaatgatcttccaacctcagcctcccaaagtgttgggattacaggcgtgagccccttatgcccaggctggtgtttattataaagctgcctgatttacaaaaatgtatctataggatctgctgtgatatcttcttttcatgtctgatgctcgtaatttgtatttttttcatcgatattgctagggtcttattaattttattaatattttcaaagaactaatttttctttttgttgattcttttttgaattgtacttgtgctttctttgtcatttatttttgttcttatttttataatttctttcactttttttggatttggtttacttttcttttttctagtttcctgagttggaaacttaagtcattgctttttttcagtctttttctactcaaatatatatatataatgctataatttttttctctaaccatatatttagcactgtcatgtgggatttcatgttgtcttttcattaagttaaaaaaattttataatttccattttgatttctttaattattgggttattatttggcttacttagaagtatattgcttaatttccaaacatttaggaatttattaattatctttctgttactgatttctaatttaattccactgtggtcagcagcacattgtctgtatgattttaatttattaaaatgtataaatatatagtctgtttttgtaagtgtttcatgtgcaattgataaaaagtgtgtattctgcacttgttgctgtagcattctgtaaatatcacttaccagaaattggtcattagagttcttcaaatcttgtaaatccatatggattttcattgtttgcttattctgtcagttactagatgatgaggtatgtctggagatatggagattgtgaatttgtgtatttctcatttttagttttgttagttttcactttatatatcttaaagttatgttattaagtgtatacaaatttagtatcatgaatctcattgtttaatatacttgaaaaaaatcattctgaaaagtgtccctcttttttttctttttggtattgtggtccctctttttccttgttttgggttgggtttgattttgtttttctactctcaaggtggacattttaggttattgatttgagatctctctcttttcttttctttttttttttcttttggacaaggcgttgccctgttgcccaggctagagtgcagtgttgatcattgctcactgcagcttcgaccacatgggctcaggtgattctcttgcctcagcctcccaagtagctaggaccacatacatatgccaccattaaccatctctcctgcttgcccctcccaccccttctacccttcccagcctgtggtccagctgtaattttgtatctgttaataaacatcttcctagtccccattttttctttaccttcctagtatctagtaaccactgttatactctctacttctatgatatcaactttttcagccctatgtatgagaatatgcaatatttgtctttctgtgcttgacttatttcacataacataatgaccttcatttccattcatgttgctgcaaaagacaagattttttttctggcataatagtattccgttgtgtgtacacaccacattttcttttctttctttcttttcttttttttttttgagatggagtcttctctgttgctcaggctggagtgcagtggcgcaatcttggctcactgcaacctctgcctcctgggttcaagcgattcttctgcctcagcctcccaagtagctgggactacaggtgcacgccaccacacctggctaatttttgtatttttagtagagacagggtttcaccatattggccaggctggtctcgaatgcctgacctcgtgatccgcctgccttggcctcccaaagtgctgggattacaggtgtgagccactgcacccagcttataccacattttctttatccatcattcctttgtagatggatagttaggttgattccatatccttgtattgtatatagagctgcaataaacatggaggtacaagatatctctgtcatactaattttatttgtatgtacacccagtagtgggattgctggattatatctagttctattttcagctttttaaggaacttttgtggtgttttttataatggctgtactaatatatgttcccaccaaaagtgtgtaagtgttctcttttctttatatcctcagcagtattttgtttgtttgtttgtttgtttgggtaatagctattctaactgatatgataccttattgtggtttttatttccattttccctgtgattagtgatgttgaacatttttcatatacctgttggccatttatgtgtcgccttttgagaaatgtctactcagagcaattgcctattttaaaattggagtctctttgtgcgtgtgtgtgagagcgtgtttgtgtgtgcatgcgcacatgtgtgctattgagttgtttgagttccttgtgtattatggatattaacctcttataaaatacaataaaatatttgtctagaccaaagtcccaaagcattttctcttatgttttcttctagtagttccatagttccaggaattacatttaagtctttagtccatcttgagttgatttttgtatatggtgagagatcgggatctagtgtcactcttttgcttatggatatccagttttcatggcaccattgattggagagactgtcctttccctaatgtgtgttcttcatgcctttgttaaaaatccattggccataaatatgtgggtttgtttttggttttgttgttctgttctcctggtctgtatgtctgttcttatgcaagtaccatgctgttttgattactatagctttgtagtttattttgaagtcagaaattgtgatgcttgcagatttgttcttttgctcagaattgctttggttattcagagtctagtagccaaatacaaattttatctttgcttgttatgtatctgtaaagaatagcattgataatttaataggaattgcattgaatctgtagatctttttgggtcattttaacaacagtttttccaattcatgaacatgagatgtctttctaatttctttgtgtcttcctcaatttctttcaccagtgtcctgtcatttttttttgtagagatcttttacctccttgattaaatttattctaaggtattttattttttgtagctattcgaaatgggatcactttcttgatttctttttcagctagtttgttatcgttgtatggaaacactactgatttttgtagattttgtatcctgcaactttactgaatttatcagttctaagagtttttttgatagagtctttaggtatttctgcatatgagatcttgtcttctgcaaatagggacagtttgactttttcttttccaattttgatccctgtttcaaaaaatttttttcccttgcttaattactctggctgggacttcagtactatgttgaataagggtggtgaaaatgggcattttgtctttttccagttcttagaggaaaagctttttggcccattcttgcattcctgggataaatcccatttaattatggtgtataatcattttgctgtgctattagatttggtttgctagtattttgttgaggattttgcatctatgttcatcaggcatattgtcttgttttctttttctgttgtttccttgtttggttttgttattagggtaatactggccttgtagaatgagttaggaaggattttctatccttcagttttttggaatagtttgagaagaattggtattctttttcaaaagtttagtggaattcagtagtgaagccattcagtcccaggcttttctttgttgagtgattttattactgattcaatctcattactcggtattggactgttcaggttttctgtttcttcttggttcaattttggtagattatatgtgtccgggaatttatttgtgttctctaggtatactaatttattggtgaatacttgttcataatggtcactaacgatcctttgtatttctgtggtttggtctctttttttcttagtctgtgtaatagtttgctgattttgtttatcttttcaaaaaaccagcttttcattttgttgatcctttgtattgtttggtctctatttcatttattttgttctgatcctcataatatctttccttctactaattttgtgtttgttttgttcttgcttttctaggtccttgacatgcattgttaggttgtttatttgaaatctttcaacttcttgatacaactgtttaatgctaaaaactgtttgtactgtttttgctatattccgtaggatttgctatgttgtatttctattttcatttgtttcaagaaattttaaaatttcttgtttaattttttattgatccattggttgttcaagaacatgctgtttaattttcgtgtatttgtacagtttccaaagtgtacttgttactgatttttagttttattctattgtggttagaaaagaaacttgatatgacttggacttttaaaatttttggagaatttttttgtgtgctaatggcaagaatgtatcccgcagctgttgttctgtaaatatctgttaggtctatttggtctaaagtgcaattgaaatttgatatttttggctgattttctgccagcgatctgttcaatgctatgagtggggtgttcaagtccccaactattattgtaatggagtctatctctctctttagatctaataatatttgctttatctatctgagtgttctagtagtgagtgtgtatatatttatagttgttatagatgcttgccaaattgacttcattattattatatgatgaccttctttgtctccttatatagtttgtgacttaaagtgtattttttctgatataaggataactactcctattcatttttggtggaacttttttcattttttcattttaagtttatgtgtatgtttacagaagtgagtttcttataggcagcatatagttgggtcttgttttatttattttttttttcccccgctccgagacggagtctcactctgtcacccaggctggagtgcagcggtgcaatcttggctcactgcaaactctgcctcccaggttcaagtgattctcccgcctcagcctcctaaattgctgggattacaggcacccaacatcatgcccagctaatttttgtatttttatggagatggggtttcaccacgttggccaggctggtcttaaaactcctgatctcaggtgatctacctgcctcggcctcccaaaatgctgggagtacatgtgtgagccactgtggccagccaggtcttggttttggtaatccattcatccagtttatagcttttaattgaggattatagtttttaatttggggtttttatttgtttacattcaaggttattattgataggtgaggaatttctgttgtcattttgctaattgcctttttttttttaaatatatatccattcttccttccttactttcctattgtttatctttgcagtttggtggtttctgtggtgataagttttacttctctttctcatttgtgaatctgcttcatcagtgagattgacacttcttcatgttttcatgatggtagttatagtctgttcgctttcagttctaggattcccttaatcatttcttctacatctagtctagtggtgataaattacctcattttttgcttctctgggagattttagttttccttcatttctgaagggtagttttactagatatggtaatcttggctcacagtttgttttctttcatcattttgaatatggcatcccattgtctcttggcctatgtttctgctgagaaatctgctgttagttttttttatttttttatttttttattttttatttttatttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttaagattagggagtggtgatgactcttaacaaagcacatcttgcaccgcccttaatccatttaaccctgagtggacacagcacatgtttcagagagcacagggttgggggtaagatcacagatcaacaggatcccaaggcagaagaatttttcttagtacagaacaaaatgaaaagtctcccatgtctacttctctccacacagacccggcaaccatccgatttctcaatcttttccccacccttcccgcctttctattccacaaaaccgccattgtcatcatgacccatccccaatgagccgctgggcacacctcccagacggggtcgtggccgggcagaggggctcctcacttcccagtaggggcagccgggcagaggtgcccctcacctcccggacggggcggctggccgggcagggggctgacccccccacctccctcccggatggggcggctggccgggcggggggctgaccccccccacctccctcccggacggggcggctggcggggcagaggggctcctcacttcccagtaggggcggctgggcagaggagcccctcacctcctggatggggcggctggccgggcggggggctgacccccccccccacctccctcccggacggggcggctggccgggcagggggctgacccccctcccccctcccggacggggcagctggccgggcggggggctgaccccccccacctccctcccggacggggtggctggccaggtggggggctgacccccccacctccctcccggacggggcggctggccgggtggggggctgacccccccacctccctcctggacggggcaactggccgggcagaggggctcctcacttcccagtaggggcggccgggcagaggagcccctcacctcccagatggggcggctggccgggcggggggctgaccccttaagttagcgcttatgggggctgaccccccccacctccctcccggacggggtggctgccgggcggagacgctcctcacttcccagacggggtggctgccggacggaggggctcctcacttctcagacggggcggctgccgggcggaggggctcctcacttctcagacggggtggttgccaggcagagggtttcctcacttctcagacggggcggccgggcagagacgctcctcacctcccagacagggttgcggccgggcagaggcgctcctcacatcccagacagggcggcggggcagaggtgctccccacatctcagacgatgggcggccgggcagaaacgctcctcacttcctagatgggatggcggcggggaagaggcgctcctcgcttcctagatgggatggcggccgggcagagacgctcctcactttccagactgggcagccaggcagagggctcctcacatcccagacgatgggcggccaggcagagacgctcctcacttcccagacggggtggcggccgggcagaggctgcaatctcggctctttgggaggccaaggcaggcggctgggaggtggttgtagcgagccgagatcacgccactgcactccagcctgggcaccattgagcactgagtgaacgagactccgtctgcaatcccggcaccttgggaggccgaggctggtggatcactcgcggttaggagctggagaccagcccggccaacacagcaaaaccctgtctccaccaaaaaaaaaaacgaaaaccagtcaggtgtggcggcgcgcgcctgcaatcgcaggcactcggcaggctgaggcaggagaatcaggcagggattttgcagtgagccgagatggcagcagtacagtccagctttggctcggcatcagagggagaccgtggaaggagaccgtggaaagagggagagggagagggagagggagacggagagggagagggagagggagagggagagggctgttagttttatggagagtccctggtatgttacttcacacttttcctatttttaaaattctctttgtgtttgaattttgacagtttcactataatgttcatcttttctcagtttgactataatgtatcctgagaggacctttttgggttgagtctatttgggaaactttgagcttcctggacctggatgtttatatttcttccgtgacttgagatgttttcagcaattatttatttaaataggttttatatgctttgtctgttctcttcttctggatctccaaaaatacatgcttttttttttttttttttttacttaatagtatcccataggccctgtaggcgttcttctcattctttttaattatctgttttttttgtttttttttttcggctaacctgggtacagcaggacctcaaaataatgttcagcgttgtttagttataatgttgctgagacaaaaatgatttctggttaggacctctgtctttatggagtttgcttgttctccccatgtctgcatgggttttctccggatactctggtttccttctgcttcccaaagatgtgaatgtttggttaactggtatgtctaaattgtcccagtatgagtgagtgagtgtgtgtgtgtgtgtgtgtgtgtgtgtgtaccatgatgtaatggtgtcctgtccagaactggtttccactttttaccctgagtgtctggataggcttcagccacctgtgacactgaactggaataagcaggttggaaaatgaatgatcacgttactataaaataaaaatgcgtaaagtatatgataatcatacaaatgcacaatatattatgcgttcagaaagcactcagtgatctcaccatattcattgtttttttaactgtgtggcattagaggatgctcgttttcactttgcaaacatttatttcatgatttcattcataaccattgtgacttctgtcattcgccaattcataaatttggtaaatatttattaatcttaattttattaatttagtagtgtactaatttgatactaatttaataatttcattaatctttcttaaatgtacatataacctacatctatttcagtatttgatattagaagtggtttgactctttacaatattggtgatgtttttgtgactagacgtaggctgtaggaacttttgtttatatcagttagcctaggtaaaattagttttgttacatgttgtttcatttaaatcacagtttccaagaacccactgatgatgtcaggtgaagatttcctgtatttcaaaagacttatgttcaagttcacaaattcttctgcttgatctagtgtattgccgaagctttcaattgtattttttaattttattcactgacttcttcaatgccaagatttctgtttggttcttttttatggcatatatctgttcgttgaatttctcattcagatcatgaattgtttttctgattttgttgaattaactatctgtattcttttgtatttcactgagtttccttaagaaattactgtgaattcttttcaggtattttataggtttgtcttccttggggtatgttattagagaattactgtattcctttgaggtgtcatgtttccatgccttttcgtgtttcttgtgtccctagcttgatatctgtttatctagaggaacaaccacctcttccaattttatgaagtagttttcgtaggaaaaaactttttcctgtagatttgacttacagtactggttgagtagggtgtttaggcttttttcctcattgggtgcagtagtgtaatttctatgtgatttcttcacccgtcatcaatatcagcattttctgtgagtgcctcagtgggctagattgtgggtgtttgtggaggcagtggtgtggctttgcttggggtgaggaatgctaggcaggctggtccttagtccctgagaaatggctgctatttctcagctgccattttctgattacagtgtccaagggatgtagagatgccagggctattgagccccaaggcagaatgcactccagcagttgcttcattctccaaatgatatagtactgcagcaacttggatcctgaggaattcagtggatcaaatgcgaattctctctttggagcaatccagccttatggacctcaggtagctccctatactggactcagggcttgtgaggactgtggaactgccctgtagcttggattgcaagtatccacagtggtcatggggactgctgaggatgtcttgcttaacttttctcgtcaatagggagtcccttctggctccaggctgatcttggccaggtgctctcctttcccctttatgctgacatgtggagtttctgtacctcagaagatcttcattacttcctgatgagttccattgttctcccatagacactaaactcaaactgctctatttgttgttttggtttttctttgtggaggagatgaacattgggtaccattttgattgaagtttttaatctgttcacttctaatttttattcatatgattggatttacatttatcattttgctattattttctgtgtgcctcatgtcttttttgttcctctgatatttattaatttcttttgtaataaattgatatttttgatgttctattttaattcctttattgattttcaaattgcttttgaattactttctttctttcttttctttttttttttttttgagacagagtctcgctctgttacccaggctggagtgcagtggcgcgatctcaactcactgtaagctccgcctcccgggttcacgccattctcctgcctcagcctcccgagtagctggaactataggtgctcaccaccatgtcgggctatttttgttttttttttttgtatttttagtggagacagggttttacgatgttagccaggatggtctcgatctcctgacctcgtgatccacctgcctcagcctcccaaagtgctgagattacaggtgtgagccactgcgcctggcccgaattattttctttgtgattgcttgggggattataatatgcatctgatttactgcaaactagttgagattattgataactttattccattaaaatagagaacatttctctactatagctccattttcttctgctgcttgtgctgttattgtcacatatattgcatcttgttaaaagttcaactatacaattttatcattattgttttatgcaatttccttttaaaccagaagaacaaaggagaaaaaagcatttatactgtcctttactagtcaccaacataattacctgtatcgttttgttgtgtgaatttgttgtgtgaagtagctgttgctacttcctttcagcctaatgaacttcctttaatattctgctaggaatcaattatcttattctttatttgagtatattttaatttgcttgcattattgaaggataattttgctggatatagaattcttggagaaattaggtgttaatctactaaaagtttccttgtacctgaaaaattatttttgtctttctgctctcaatatctatatattttttgtccctggctttctgcagtttgactatgatatatttggatttgaattcactgattcttttgccaattcaaatctgctgctgagcccttctagtgaattttttattttgttgattgtactttcaactccaaaattttcattttttttgtaatttgtttttattgacattttctaattgatgaatcactgttgtcatatgtttctttaattatttgaatatgaggctgggtgcggtggctcacacctgtctgtaatcccagcactttgggaggctgaggtgggtggatcacttgaggtcaggagttcaagaccagcctgaccatcatggtgaaaccgcatctctactaaaaatacaaaaattagctgggtgtggtggtgggtgcctgtaatctcagctattcgggaggctgaggcaggaaaatcatttgaacccgggaggcagaggttgcagtgagccaagatcatgccattgcactccagcctgggtgacagggtgagactccatctcaaaaaaaaaaattatttgtatatggtttcccttatttctttgaacatatttggaattgatgttttgaagtctttgtgtaccaagtcctgtatttgatctccttcacagatagtttgtttctattgactatttttatttctgtacactttgcatgtgtcatagttgtttgttgtaaattggacattttgtgtaatatattgcagcagctttggattttgatttcttctcccccaggagatggttgttgtttcaggattatttgtttattgacttgcctcgactaattttgtgatgtctgtttcgtgtgccttctgatttctctgctcattaaaacaaattctcttttctatttttaagcctggcattctaggaatttcgctgggttactataacttagtcatcagccagtgattgtttggaggttgtttaaacctttgagctagttaggtatttactctttggcatgggatatatacatttattgggtaatactttcaaagtcaggagattataagtctgttttttttttttttaaattctctatgttcatgaggcctcatggttaactcgaaatgagtagcttgctagttactgccctctctttgtggttgcttaggggattatatctgtgtatctggtggaacaacagatatacagtcttctgagtaagtactatcttgcacatgcatacaactttctagactaccagtaatatatatgtgagaccctggcaagaccctgttgggctatatcattttccagatttctctgttaatttttgggctggtttgctgttttgttgcctgacccaaattgtattgtgaccctatgctagccttactcttattgctgctgagctgtctgttgtttttgacaactttgtcctgttttgtcattgctttttggggagaggatttgccgagctcctcattcagcactcttgaagtcttgtcgcatgcgcgcgcgtgtgtgtgtgttcctgtagtaacaaacatgtgacataaaatttgtcattgagactgggcatggtagctcgtgcctgcaatcccagcactttgagaggctgagatgggaggctagcttgaagcccaggagttgaagacaagactgggcaacatagtgagactcatctgtgccaaaaattaaaaaaattggttgggcgtggtgacgtgcatataatcctagctacttggcatgctgaggtgggagagcccaggagtttgaggtttcagtgagctgattgtgccactgcactccagcctgggtgacagagttagaccttgtttcttaaagagaaatgaccatcttaagcacttttaagtgtatactatattactattaattatatgcacatccttgtgtagcagatcttcagaacttttttgtcttgtaaaactgaaactctctatctattgaaccaatgactccctttttacctttcccctgccccagcccttgacaaccaccagtctactttctaagagtctgacaatgttagataccttatatatgtggaatcatacagtatttatcttttcgtaactggcttattttatttaccataatgtcctcatgtttcatccatgttgtggtatattatgggattggcttatttttttaaggctgaataatatcccattgtatgtgtgtattacattttgcttatccattcatcctaaaatgagtattagagttgcttttactttacagctattgtgattaatgctgctttgaacatgggtgtgtgaatatctccttaagattttcttttaaattattttgggtatatacccagaattggggtttctggatcattgtaattctgtttttgatttgttgaggaacctccatattatgttctgtagcagttgtaccattttatgtttccactaagagtgtataagtattccattttctcaacacttactatgtttttgataatggccattgttatggctgagagatatctcattgtggtttttttatttgtatttccctaatgagtagttatgctgagcttcttttcatatacttattggccatttgtatatcttttttgtggacatggcttcaattcctttgtccattttaaaatagaattattgttattttgttgttgattagtcataggacttgtttatatattctagatattagtaccttatcagatagatggtttgcaaatatttttgtccatttcataggttgtcttttttactctttttcctttgttgtgcagaagttttaaaatttgatgtctcatttttctatttttgcttttgttgcctgttatgttcattttaaaagtatcccttttctctgttattttataataccttacctagaattagatttttgagatatattcaactctgttctgaaattctttgctactaatatcctttgcattatcatagatgttctgattttagggatgcattttacatgatgtattaactaaaagttatacataaataaagtatttttaagttgtagacatatatttcaagaagggaaaagaatgaaaagaaaattccttttttggttatcttaaggaagatccatttgttataacaatcatcatttgtgtttcaccttttactatatatgtatgttgtttatttttccttcctctgtgattttgaaattgaaactatcttgcttatagtcagatcatatggctcaaaattccatgttctaatccagaaagccacctcttgtgttactgtttggttagtagcattctgatgatactaagttcttgagtttgattcaggtgtctttaaacatttgtactctgagaactctgagacaatctgatttatgcccttagactgcaactttggtagccattttgcaaatatatcattgttacacaaggcgtagggtggtagaggtggaattgtaatgtgctcattgtccagttagatagataaatagccagtggaaacattttcagtgctgataatggaagtatagaggcagtattatagtggttaattgccatggctgtggaataatatttcttaattttgagtccaggctctcctagatgactcgttttgggaagattcctgacccttcatgtctcagattcttcattgtaaaatggggataatgctatttacattttgtgattcttaggaggagtaaatgattgtatacgagtaaggtgcttagaatagcgcctggtacatactcagtgcttattgcttttgttacaggcactgatcaatatataatcttgtgctagctgaacaatgcttgaagaaattaatgcattttaaaaatactgtgataatgacaaatatctaaaaattgtaacattccattagcatagagtactaacaatagacttaatagctgacctttaaaaaaaaaccctctggttgaagaaacaaattaggcccacacttttgtaataataataataataataagcacctttataatgatttctctgtgaggaaggtagtattctaagctttatatagattaatataatattcaaaatgtagtctttttatacaaattttacagataatgaaactgaggcacagatacaataaactgtctgctggctgcagagttattggtcttaatcactttgctatactgtctgtatttaggcatattgttactgtgttgctgaaccaactaggtagactaaaatgtgaatgaataagcttaatatttttattaactttcacaaatagagttacaataactaaaaatgtgatagaaatacatttttttcttcctcctttgttgatttgtaaacaaattatatctagaagtgagacaaatgagcataaagcaattttggtgacatttttcatgcctaaccttttatctaatgataatgaaaagcagtcagaaaacatttaaaatttatgaccaagtagtatccagttcaattttacattaggtgaagtggaatactttttttttttttttttaagttgatcagttttcattttgtcaggttattttcaaatctccaattgagctcccctttcaacttgacttagaatactgttctattagtttaaaatatattttgaagacatatttttagatggagacttaaaaaattacatcatttcagttatttgaagtactgctgctatatactgttgcactatcatatatcagccttcatcatgtactgagtattatatattatttccattcagcaaagtaggagacaggcctagagtgcttaaggaacttattaaatgtaacttgtaccataaattattgttatttatcattaactatggcctaacaaggtatttgatgctactttttgataaacagtaattctgaaaatatttttgtgttggacattttatttctcttttaagaaaggaatttgtatattagaatgaaaaatattaagcactaaacaataagtctctgaatattcttgtgttggaaattttattttttaaaaaagaaatttgcatattataataaaaaatattaagcacttactaatttttatgtaatgttttgtgttttaaggaactgaaattaccattcacttttttaagtggacatattcatgaattgaggattcatgtaccatggacaaaactgggttcagaaccagtggtaattaccatcaatactatggaatgcattttgaaacttaaggatgggatacaggtaagaaattattgaaccaagttgtttatgttaactaattttagtagtatttgacatttctttaccttttcaaatatgccaactgttacataaacatatcttagcttatatacttttttttttttttttttttttttttgagatagagtcttgctctgttgccaggctggagtgcagtggtgcgatctcggctcactgcaacctcctcctcctgggttcaagtgattttcctgcctcagcctcctgagtagctgggactacaggtgtgcgccaccacgcccagctaatttttatatttttagtagagaaggggtttcactatgttggccaggatggtcttgatctcttgacctcgtgatctgcccaccttggcctcccaaagtactgggattataggcatgagccactgtgcctggcctttaatttgtatatgcctgtttaagtgacatgactatttgcaaagtcatttttaaatttgaataaagtatgtaaaggttgttttcatacagattttactttgtcatagctctactagggaccatgcagattgcttattacttacatctacaatgaaagtgcagcctaattgtgtccgatttttacattaacatttttagatttttgcaaaggacctgtatgtattttttctttacataatttttctaaatctgaagggaatttctcaggttattttttgggaagatgaaaatatatttacaccaaattttataattgtttttgaagttttggtataagaaactgattttttcttttttcagatttatttatttcttctctgacccatcttacatttcttgctagtgtttttttgcagatgtaatattggttttaaagagtttctaccaaaaattttccaatctaggaaagcaaaataggtcaggaccatagcttattgtggagaatgtttccactttcaccttgcagaagagtagtgtgtctgtcattcatttttattaggtttttttttttttttagcacccacttaatatttaacttttagttttaaggaagattggctataatcaagtaaattgataagtattattaaaatgacttcatatgaatctgtaagtttaacgtattctaaatgtaactttaatctttgtgaagttagggttatgtatgaactgttaaaattatttcctattttaagtggatgctttgagtgccatatcaacccagtggactcagatcttttttccatttatgaaatctttgattccaaacacgtattatccaatttaacttaatatagtttctagaagttaatagaccaatgttatattctcatgaaaatgaaaagttactttgtgaacttctaatatttgagagattaatttagaaatctgtggatagttacattacaacaaagttttactttccatttatagttggtaatacttaaatgttaagtggttcttaattattatcttttcttggaatttattttttttcaaagtctggacttggttataccacccatgcagtgttccatattaaaagagaaaaaaaaaatccagacacttaagtacttttttcattgagaaggtagaagtttcaaggccagatgtcccttaagaaacatgttttaacagaggcaaattacaactaattatagaggctgcagaaaaagacttgtaacacatgacttagtgcaacctagaactaatacttgatattggactatgcagatggctactgcaggaatgatcagatttcctgcttgcatggtatttgggacttgaattttgtggtttgtacagcaaaaggttaaatgtcatgaatgtaaaccactctcaaaacaagtattttttacagatgtttaaaattttgggttagaaaggatttttgaaaattgcagttgacatttggacaaattatttagcagtgtacacctctggagagtaatgcttgggtttatgctagtgattggaattaaattttgcgtaaaaacattgtagatgaaacagattttaaaatagtttattttcctgttttaagctttgattagtatagtatgtaattaagcaggtactagtaaaactgaattagtttatattcaaagtatttcaagttattacattgtagaatcaccacgaagaaaagacgtattttctaaataaaattgtggttggaatggtaggttcagtgaaggggccttttagagttacaggtactcaaagatatgaatctgttaaaaaaaactattatgcataggaatgtattgaagtatgattaaaaggtaggaatatgaggcttaaatcagataagatcattccaaaaataagattttgttaaatgccttgataagaaggcatgtcttgtttgtgaaggtcaatttaattctaccaacatttgttggttgtctactctgtactgcactgaaaagcattgctaaaatatttatataatctcagcaaaagacacttagaaaaagagattcataatgattgtgattctagtggtcatggttttaatatactgccttaacatatccttacaatcagttttacttatagagatttttaggatgacagggtgaccgaattgttgtgttaggtaaaataaagtccatcttgatgtttactctgaattttaaaaaatatattgaaacttcactcatgaaatagttgttaatgatttcctattcactctgagagatgtatctatgtcagtcattgccctcacttttaaatcttgcagagttactacttgtaaactgtttatcctgtttttgatttcagatacacagtttttgattcatgacacatcatgtccatgctaatctaataaatacttgttaacataactcaagagctaaaacattatcagtaacttccatttaactatgtgctcctctcctttttcatattcttttttgttcagcctctaggggcctcatctgtaaaacaggacaagacttgctatacaatttaaaaaattatatgattgatgtgctttctttgatcattgaattaagtcttggctgggcatggtggctcacgcctgtaatcccagcactttgggaggccgaggcgggtggatcacgaggtcaggagatagagaccaccctggctaacagggtgaaaacccgtccttactaaaaatacaaaaaattagctgggcgtggtggccggcgcctgtagtcccagctactcgggaggctgaggcaggagaatggcatgaacccgcgaggtggagtttgcagtgatccgagattgtgccactgcactccagcctgggcgacagagcgagactctgtctccaaaaaaaaaaaaaaaacttcttcaacctaaagagagtaataaatctgtttctaaaccacctattctggtttttgtaccacctggaacataaatgttaaatcttttcatctaataaatgtaactatttgtaaggctgtttatagaagtaatacttatttttcttaaaaaatttgaaaagtgggaggctgaggcaggagaattgcttgaacccaggaggcggaggttgtggtgtgcagaggccgcgccattgcactccagcctgggcaacaagagtgaaactccatctcaaaaaaaaaaaaaatttgaaaatcatcttttgaacctaaaaatctgagattatcttctaataggagaaatacttgtagtttcactccagattaaacttatttttatgtatatattcttaccatctttctcctttttagcttaacttcttttaaaatcatttttgcaagtttcattttatttctttactgtcattaaccttttaccacctttctcctttttagcttaattttctttaaaatcatttttgcaagtttaattttatttctttactgtcataaccttctaattgttgatatggctctttaagattacaaaaatattctgtttgaaaacctaaggtgattttatccttttatctcatgtacctacaggtttagctagattttaaacaagaaagtgaaaatatttgtatatgtagtattttaaattcagagatagttttctgtttcccataagcacggattcctttcttaaacattttaagtcagataccagtaagccactttttgtttgttttgtttctgtttttgatactgcgtcttgctgtgttgcccaggctggtctcgaactcctggcctcaagtgaccctcctgccttggcctcccaaattgctggaattacaatcaagagccactgatttccagtattaataagaaaaaaattttggtcctgacagcccatagatttaggtgacctgatcaaaaagtgatatgttattactcttgactgtggcattttatgtcaactctttttatagtttcatcttgtactttatttttgtttttctacaaagtctgtgtcagtgtaattagacttaaagatctgaggcagctgttttgatttgaatgtctaattctgatgaagggcttcagaattattttttccactgtagagcagggaaataaagctttctttgattggacaccagcacctatctgctctatctagcagaacttttctgggatctagagaatttccatactttcacaggacgaagtttttttttgttttttgttttttttaattttgtttacatttagataggattttttatttactggatggtcatttgatctggccatcaatgtgctctgtttaccatcagggatttgatggatttacttgtagaaattttacatgtgatcattggaattttaagtgtggattattatgaattagtacagttgttttggtagactattaataatcagtctctattaattgattttaaaaatcaattagttagaatttgagattaggaggcctacaagagaggtatcacctctctcttagcttggctgaagtctgtgtttatcgtcactgttattggtgaggtcattgcttgaatgttataataaatggccttctaattggactgactctagaccattactcttctacacacactcacaaatatctcttatttttttgaagctcatgtgacctgactatataatcatttgtggtcctctgatagctatcatccattgattttgtggtccctcccccactgtgactgaaaattttgttacctggttcacagacttttttttttccaattgaagttcatccatcttgggtcatttcagtgtccatatggattcttacataactctctagcaacacaattccttgatttttaactctgtcatccttatttctgttccatttcagccaatccctttatggttatgttgtggagtttgctgttccttgaagcattctctttattgtggatcctgtctctgtatcttaagtatctcactttaacagtattccttcacttcaatctctcatttgatttattggcactttgctatcatttaaagtgcttatttctctgctacattttggggaaatactttcctgcaaccatgtttccctctctagcttcttttcttttctttataaccacatcatttctttttttttttctttctttcttttttttttttttttttgagacggagtctgctctgttgcccaggctggagtgcaggggcgcgatctcggctcactgcaagctctgcctcccgggttcacgccattctcctgcctcagcctctggggtagctggggctacaggcgcccaccacctcaaccagctaattttttgtatttttagtagagacggggtttcaccatgttagccaggatggtctctatctcctgaccttgtgatccgcccacctcagcctccgaaagtgctgagattacaggcttgagccaccgcgcccggcctctttttttcttttttaaaataagtcaatgtttgtgtgtgtgtgtgtgtttttttaattgaaacgaaattcacataacatacaatcaaccattttatttttgtttatttatcttttaaatttttttatttctataggttattggggaacaggtggtgtttggttacatgagtaaattctctagtggtaattcgttagattttggtgctcccatcacacaagcagtatacgctgtaccgaatttgtgtcttttatcccttacctctttcccccaagtccccaaagtccattgtgtcattcttattcctttgcatcctcatagcttagcttccacatatcagtgaggacatatgatatttggttttctattcctgagttacttcacttagaatgatagtctccaatctcctccaggtcactacaaatgccattaattcattcttttttattgctgagtagtattccattttatacacacacacacacacacacacacacacacacacacacacacacaccaccccccgcccccacggtttctttatccgctcgtcgattgacaggcatttaggttggttccacatttttgcaattgtgaattgttttgctataaacatgtgtgtgctttaaacccatgtgtgcaagtatcttttttgtataatgacttcttttccactgcgtagatacccagtagtgggattgctggatcaaacggtagttctgtttagttctttaaggaatctccacaccattttctatagtggttgtactagtttacattcccaccagcagtgtagaagtgttcctggtttactggagccatgccaatatctattattttttgatgttttgattatggctattcttgcaggagtaagttggtatcacattgtagttttgatttgcgtttccctgattattagtgatgtgaacattttttcatatgtttgttggccatttgtgtatcttcttctgagaattgtctgttcatgtccttagcccactttctgatgggattgttttttttttcttgctaatttgcttgtgttcgttgtagattctggatattagtccgttgtcagatgtatagattgtgaagattttctccgactctgtggattgtctgtttactctgctgactgttccttttgccgtgcaaaagctctttagtttaattaagtcccagctatttgtttttattgcatttgcttttggggtcttggtcataaaatcctcgcctaagccaatgtctagagggcttttctggtgttatcttctagaatttttatagtttcaggtcttagatttaagtccttgatccatcttgagttgatttttgtataaggtgagagataaggatccagtttcattctcctacatgtggcttgccaattatcccagcaccatttgttggatagggtgtcctttccccactttatgtgtttgtttgctttgtcaaagatcagttggctgtaagtatttgggcttatttctgggttctctattctgtttcattggtctatgtgcctatttttataccagtaccatgctgttttggtgactatggccttatcatattgcttgaaatcaggtaatgtgatacctccagattttttctttttgcttagtcttgctttggctaggcagactcattttttggtttcctacgaattttaggatttttttctagttctgtgaaggatgatggtggcatttttatgggaattgtattgaatttgtagattgcttttggcagtatggtcattttcacaatattgattctacccatccatgagcatgagatgtgtttccatttgtgtcatctatgatttcttccagcagtgtttgtagttttccttgtagaggtctttcacctccttggttaggtatattcctaagtattttattttatttttgcagctaatgtaaaaggggttgagttcttgatttgattctcagcttggttgctgttggtatatagaagagctactgatttgtgtacattaattttgtatccataaactttgttgaatttttttttttatcagttctaggaggtttttggaggagtcttgatagggttttctaggtaaacaatgatatcatcaacaaacagtgacagtttgacttcctcttggccgatttggatgccctttatttctttctcttatctgattgctctgggtaggacttccagtactgtttaagaggagtggtaagagtgggcctccttgtcttgtcttccctaaaagaatgctttcaacttttccccatttagtattacgttggctgtgggtttgtcatagatggcatttattacattgaggtatgttacttgtatgccaattttcctgagagttttaatcataaaaggatgccatattttttttgaatgctttttctgtgtctaatttttgtttaaattctgtttatgtggtttagcacatttattgactcgtgtgtgttaaaccatccctgcatctctggtatgaaacccacttgatcatgggtggattatctttttgatatattgttggattcagttagctagtattttgttaaggattttagcatctatgttcatcagggatattggcatgtagttttcttttttgttatgtcctttcctggttttggtattagggtgatatcggtttcatagaatgatttagggaggattccctctttctctatcatgtggaatactgtcaataggattggtaccaatccccctttgaatgtctggtagaatttagctgtgaatgcatatggtcctggacttttttttgttggtaattttttttattactatttcagtcttgctgcttgttactggtctgtccagggtatcaaattcttcctgatttaagctaggaaggttttatcttttcagggatttatccatctcctctaggttttctagtttgtgcatgtaaaggtgttcacagtagctttcaatgatcctttgtatttctgtcttgtccgttgtaatatttcccgtttcgtttctaattgagcttatttggattttctctcttcttttttggttaatgttgctaatggtctatctgttttacctacctttttaaagaaccagctttttgtttcatttatcttttgtattgttttttgtttcagtttaatttatttctgcactgatcttggttatttcctttcttctgctggctttgggtttggtttgttctcgttctctagctccttgaggtgtgactttagatcatctggttgtgttctttcagactttttgaggtaggcatttagggctatgaactttctttctttccttttcttttttttatttttgagatgaagtcttgctttgtcacccaggttggagtgcagtggtgcgatcttggctcactgcaacctgctcctgtggggttcaagcagtttttgtgcctcaccctcccaagtagctgggactacaggcacctgccaccatgcatgactaatttttgtatttttagtagagacgtggtttcatcatttttgccaggctggtcttgaactcctgacctcagtgtatccacccaccttggcatcccaaagtgctgggattacaggtgtgagccactgtgctctgctctatgaactttcctcttagcaccacctgagctgtatcccagaggttttgataggtcgtgtcacaattgtcattcagttcgaagaaatttttaatttccatattgatattattgttgacccaatgatcactcagaaacagtttacttaatttgcatgtatttgcatggttttgaaggttccttttggagttgatttccagttttattccactgtggtctgagagagtgcttgatataatttcaattttcttaaatttattgaggcttgttctgtggcctctcatatggactatcttggagaaagtttcatgcactgaggaatagaatgaatattctgcagttgttggatagaatgttctgtaaatatctgttaagtccatttgctccagggtatagtttaaatccattgtttctttgttgactttctgtcgtgataacctgtctagtgctgtcagtggagtattgaagtcccccactgttattgtgttgctgtctatcttgtttcttagatctggtagtaattgttttataaatttgggagctctaggctgggtgaggttgctcatgcctgtaatcccagcactttgggaggccgagacgggcggattaccagtggtcgggagtttgagaccagcctggccaacatggtgaaaccccttctctgctaaaaatacaaaaattagctgggtgtggtagcgagcgcctgtaatcccagccactcagggggctgaggcaggagaatcagttgaacctgggaggcggaggttgctgtgagccaagatcaagccactgcactccaggttgggtgacagagcaaaactctgtctcaaaaaaaaaaaagaaaatttgggagctccagtgttaagtgcatatgtatttaggattctgatattttactgttggacatagccttttatcattatataatgtccctctttgtcttttttaactgctgttgcttcaaagtttattttgtctgatataaggatagatactgccttttgcttttggtgtacatttgcatagaatgtctttccacccctttaccttaagtttatgtgagtccttatgtggtaggtgagtctcttgaaggcagctgatggttggtgaattctatccattctgcaattctttatcttttaagtggtgcttttaggccatttacattcaacattagtattgagatgtgagataccattccatttatagtgctatttgttgcctgtatacctttttttttttcaaattgtatttttgttttataggtcctgtgagatttatgctttaaagaggctctgttttgatatgtttccaggatttgtttcaagagtcagctccccttttagcagttcttgtagtgctggcttggtagtggcaaattatctcagtatttatttgtctgaaaaagactctatctttccttcatttatgaagcttagttttgctggatacaaaattcttggcagataattgctttgtttaaggaggctgaagatagggccccaatcccttctagcttgtagggtttctgctgagaaatcagctgttaattcaataggttttttttttttctttaataggttaccttgtgcttttgcctcacagctcttaagattcttttctttgtcttaactgtagataacctgatgacagtgtgcctaggcgatgatctttttgtgatgaatttcacaggtgttctttgagcttcttgtctttggatgtctaggtttctagccaggctgggcaagttttccttgattattccccctaacatgttttccaacttttagatttctcttcttcctcaggaatgccaattattcttaggtttggtcatttaacataatcccagacttcttggaggctttgttcatattttcttattctttttcctttgtctttgttggattgggttaatttgaacaccttgtctttgagctctgaagttctttcttctgcttgtttgattctgttgctgagactttctggagcattttgcctttccttcttttatttttttttaacttttgtatttttatttttttatttatcttttttaaattatactttgagttttagggtacacgtgcacaacgtgcaggttagttacgtatgtatacacgggccatgttggtgtgctgcacccattaactcgtaatttaacattaggtatatctcctaatgctatcgctcccccctccccccaccacacaacaggccctgctgtgtgatgttccccttcctgtgtctatgtgtgctcattgttcaattcccacctataagtgagaacatgcagtgtttggttttttgtccttgagatagtttgctgagaatgatggtttccagcttcatccatgtccctacaaaggacatgaactcatccttttttatgggagcatagtattcaatcgtgtatatgtgccacattttcttaatccagtctatcattgttggacatgtgggttggttccaagtctttgatattgtgaatagtgcctcaataaacatacgtgtgcatgtgtctttatagcagcatgatttataatactttgggcatataccaagtaatggatggctgggtcaaatggtatttctagttctagatccctgaggaatcgccacactgacttctacagtggttgaactagtttacagtcccaccaacagtgtaaaagtgttcctgtttctccacatcctctccagcacctgttgtttcctgactttttaatgagtgccattctaactggtgtgagatggtatctcactgtggttttgatttgcatttctctgatggccagtgatgatgagcaagttttcatgtgtcttttggctgcattaatgtcttcttttgagaagtgtctgttcatatgctttgcccactttttgatggggttgtttttttcttgtatatttgtttgagttcattgtagattctggatattagccctttgtcagatgagtagattgcaaaatttttttcccattctgtaggttgtctgttcactctgatggtagtttcttttgctgtgcagaagctctttagtttaattagatcccatttgtccattttggcttttgttgccattgcttttggtgttttagacatgaagtccgtgcccatgcctatgtcctgaatggtattgcctaggttttcttctagggtttttatggttttaggtctaacatttaagtctttaatcatcttgaattaatttttgtataaggtgtaaggaagggatccagtttcagctttctacatatggctagccagttttcccagcaccatttattaaatagggaatcgtttccccatttctggtttttgtcaggtctgtcaaaggtcagatgattgtagatatgcggcattatttctgagggctctgttctgttccattggtctgtatctctgttttggtaccagtaccatgctgttttggttactgtagccttgtagtatagtttgaagtcaggtagcatgatgcctccagctttgttcttttggcttaggattgacttggcagtgcaggctcttttttggttccatatgaactttaaagtagttttttccaattctgtgaagaaagtcatcagtagcttgatgggaatggcattgaatctataaattaccttgggcaatatggccattttcacgatattggttcttcctacccatgagcatgcaatgttcttccatttgtttgtatcctcttttatttcattgagcagtggtttatagttctccttgaagaggtccttcacatcccttgtaagttggattcctaggtatttcattctctttgaagcaattgtgaatgggagttcactcattatttgtctttctgtttgtctgttactggtgtataagaatgcttgtgatttttgcacattgattttgtatcctgagactttgctgaagtcgcctatcagcttaaggagattttgggatgagatgatggggttttctcgatatacaatcatgtcatccacaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcaatatgatgttggctgtgggtttgtcatagatagctcttattattttgagatatgtcccatcgatacataatttattgagagtttttagcatgaagcgttgttgaattttgtcaaaggccttttctgcatctattgagataatcatatggtttttgtcgttggttctgtttacgtgatggattacgtttattgatttgcgtatgttgaaccagccttgcatcccagggatgaagccaacttcatcttggtggataagctttttgatgtgctgctggattcggtttgccagtattttattgaggatttttgcatagatgttcatcagggatattggtctaaaattgtctttttgtattgtgtctctgccagactttggtatcaggatgatgctggcctcataaaatgagttagggagggttccctctttttctattgattgaaataattttggaaggaatggtaccaactcctccttgtacctctggtagaattcggccgtgaatccatctggtcctggactttttttggttggtaagctattaattattgcctcaatttcagagcctgttattggtctattcagagattcaacttcttcctggattagtcttgggagggtgtatgtgtcgaagaatttatccatttcttctagattttctagtttatttgcatagagatgtttgtagtattctctgatggtagtttgtatttctgtgggattggtggtgatatcccctttatcatattttattgcgtctatttgattcttctctcttttcttctttattactcttgctagcggtctatcaattttgttgatcttttcaaaacaccagctgctggattcattgattttttgaagggttttttgtgtctcttatttccttcagttgtgctctgatcttagttatttcttgccttctgctagcttttgaatgtgtttgctcttgcttctctagttctttaattttttaattatttaattatttatttattttttatttttagtatactttaagttttagggtacatgtgcacaacatgcaggtttgttacatatgtatacatgtgccatgtttgtgtgctgcacccattaactcgtcattaagcattaggtatatctcctaatgctatccctccccgctccccgcaccccacaacagtccccattgtgtgatgttccccttcctgtgtccatgtgttctcattgttcaattcccacctatgagtgagaacatgcggtttttttggttttttgtccttgcgatagtttgctgagaatgatggtttcctggttcatccaggcccctacaaaggacatgaactcatcattttttatggctgcatggaatactatgcagccatcattctattatactttctgtttctatgattttgagtattctaagtacctcaagtaagtggaatcatacagtttttgtcattttgtgtctggcttatttcacttagcacagtgtcctcaaggttcatccatgttgtggcatatgacaaggttcctttttttttcctttttttttttttttcttgcttacaactcttttttttttggttttgatacagaatctcacttggccacccaggctggagtgcagcggtacagttccagttcacttcaacctctccctcctgggttcaagtgattctcctgcctcagcctcctgagtagctgggattacaggcgactaccaccacccccggctaatttttatattttttagtagagactgggtttcaccctgttggccaggctgatctcaaactcctggcctcaggtgatcctcctgcctcggcctcccaaagtgctgggattacgggcgtgagccaccacgcccagcccagggtttccttttttctagggctgaataatatttttttgtgtgtatttaccccatttggtttattcattcaccgatggacacttgggttgctttcatcttttggttattgagtataatgctacaatgaacatgggtgtgcaaatctctctttgagaccctgctttcagttcttttgcatatatactgagaagtagaattgctggatcatatagtaattctgtgttcacttttttcaggaatttccatactgttttctacagtggctgtaccattgtattctcaccaccagtgtacaaaggtttcagttttgccacatcttcaccgacacttattttctgttctttggatagtgtctatcttaatgggtttgcaatctttgaccattttaaaattcaattgtttgtctttttgtttgagttttaagagttccttttgtattcaaggtagtagagtaggtccttagcagattatgattttcaaatattttcatccattctgtaggttgtgttgtcacattcttgagaatgtattttgatgcacaacgtatttaatttggataaagtccaatttgcctatttttaacttttattgctagtgctttcggtgttatatctaagagttcattgctttatctaaggtcttgaagatttccccctatgttttcttctaagagttttaaagttttagctcttatatttaggttgttgatccatattgaattaaattttgtatatggaatgattaattttatatatgatatgttgtatatgggttcaacttcattctatggttatttggtggtccaagcactatttgttgaagagtcttttctttgcccactgaatggtcttgtcactcttgttgaaaataaaccctataggcctatgctggccatagggtttatttctggactcagcattttattccattggtttgtgtgtgtgttcttaagcctgaacaacactattttgattattgtgctttgtagtaagttttgaaataaataagcttcctattttgtatttctgttttttttttgtttttttttttgttacagggtctcactctgttccacaggctggcatgcagtggcatgatctcagctcgctatataacctctgctttcgtgcttaagtgattctccagccttaacttcctgagtagctgggactataaacatgagccagcatgtttgtctaacttttgtatttttggtagagacaaggttgtgccatgtcgcctaggctgatctcgaattcctgagcttaaagcaatctgcctgcctcagcctcccaaagtgctgtgattacaggcgtgagccaccatgcctggccctattttatatttctttttcaaaattgttttggctctttgcagttgtatatgaatttgaagattagctttttcagtttggttcaaaaggccattggaattataatagggattgtactgaatctgtcaattgcttggtagtattagcatcttaacgatgttaagtatagtgatccatgaacatgggatgcctttctatttatttaagtaatctttaattgtgtcagcagtgtattataattttcattgtgtctttcaccttcttagttgaatttattcctaggtatattattattttgggtgctattgtatgtagaattgttttcttaatttccattttggatcatttgttgctagtgtacagatacaccaccaattttggtgagttgatcttttatttatttatttttgagatgaggtcttactttgtcacccaagctgcagtgcagtgatgtgatcatggctcactgcagccttgaccacctgggctcaagcaatgctcccacctcatcttccctagtagctgggaccacgggcacatgccacagtgcctggctaattaatttttttttttttttttttttttagagagagggtcttggtatgttgatcaggctgatctcgaacttctgggctcaagtgatcttcccaccttgtcctcccaaggtgctgggattacgggtatgagccaccatgcttagctgtgagttgatcttttttgtttgtttgttttttttgagacaggattttgctctgttgctgagggtggagtgcagtggtgtgatctcagctcactggaacctccatctcccaggcttaagtgatcctcccaccccagcctcccaagtagcagggactacaggtgtgcgccactatgcccggctaattttttttgtgtgtttttgtagacatgggttttcatcatgttgcccaggctcgtcttgaactcctgggctcaagcgatctgcctgcctcagcctccaaaaatgctgggattgcaggcgtgagccatcatgcccagcctgtgggttgatcttttatcctgcacatttgccagattcgtttgttagctgtagtagtttttggtggattctgtgggattttctatatatagagtcatgttatctgaaaatatatagagatagttttacttttctgtctccaatttggatgccttttcttccttgtcaaatttctttgtctaggacttctagtacagtgtttaatagcagtggtgaaaatgggcatccttgtcttgttatttatctttgacggaatgctttcagcctttaactattggatatgatgttaggtgtgtgtttttcatagaagtttccttctattcctcatcctcattcctccatccagtggaggtggcagggggtgaaatggactctgtgagggtcatccttagttttggttgtttaatgctctatctttgtgctggttggccttaaacatgtagatgaatttcacaggaatatttttactgtgttgagtcttacaatccatctacacagtacgcttctctaattatttagattcctttgtatttctttcatcagcattttcttttttcagcatgtaagtcctatatatgttttgttagatttatacctaaatattttatttcctttggggcatttttaatattatcatatgtttaattttttattttgattgttcattgttaagttatagaaatgcaatttatttttctgcattgatcttgtgtcctgtgaccttgcttaactgtttaattttaggagttttttgggtggattcctttagatttcctccataaataataataccacctacatagacaataatatcacccacaaaaagtatttttttttttgtttccagtctgtatgcctttctaccctttttaaacttataagttaatatttatacctcatggattctgcctccatgatgccgttgtaagcactttggcagagctcattagtaacatcaagcttaaaaaatccagtgtattcttttcatttattttttgattctcatttacctttgccatttaatacttgtcatctctttccaaaaacttcactttcttggctcctctgattctttccctacatctttggcaccctgtctctggctcctgttgttacttttctgctacctatcccacatttaaataggagttttgtaggttttcgttattttagtgctcactctccttggataattttattcccaatggatttagttatcattatatattttttactcacaaaatgctattttaggggtcagtcttttttttcctgaactccagcataagagctaaatgggccttcacctatatgtcccatagaatgttccaaactgaaatcatcttaaacctcaaatcctttcctctttatgtattttctgtgtcagtgaacaattccactgtgtgctttcaatccaaaccaggaaccctgaggtcgtccttaactttacccatcccttatatcaattattcatcagtctgttttctactgctttcctatctcttgagtgtatctattagctttcattggtacttcgaatcatttttcacactgtctctagacatgatattcttaaatgtgggtcatttcctcaaaacttcttttctagttcagtgattttctcagatcataaacttatgtgcaactcataagaaagagactgaaattttttgtaatctagttgttttcgaagtgtgatctgaagacctccaggtgttcccaagttttttctttttatatacaaaatcaacattatttttctaatactaagacatgattcatgatttacttttttcaccctcattttctcatgaatgtagtgtggaattttccagaggttatgtatggcactggaacagactgacggcagaagcaaatatgagaatgtagctgtcttctcttaagtcagatttaaaaaaaaatataatgccccctttttttatttttgttttagaaaatatagctatttttcataaaatatgaaaaccctaaaatctatcatttattttaaattatccataatataattataattaacaaataatggatttatttaaaaataagtcataaaatatataaacatatatattagaatttttttcttttgtatttctactatggtaaatatgtgattctcagtaatttttaacacattaagaggtcctgagattaaaatatatcaggattgctggtctcatgcatattaatacatagcaatcaaaattgaattattttaaattggcaagcaacttgactgaatttataattttggaagttgacttttttcacagtggaggggaagggattggaggaaataatttcagagaattagttagattctttttgccatattttagaagaaaagttatggagcccagatggaactaagtcattgtctgtggcattggagaggtggtgataggttgtgaaggaggatatacagaggaagttctgggatgacttatggaattttactttaggatgattggtgtggattttggtgctgttgatttagattcttttcagacttgtctgtctagctcatcatatgctaacattactagtaattagatctcactgaaggataatacagaaagtaggcatagtacattgtgtgtaaaccacatagaaaattaccattttagtacttatttcctttctttgaaggaaaagttgaaaagttctttattcaacacatgcttactgagttttataacactgtactgaatgctatggatatagtagttagtgatacagacaaaaactttctcttcttttggagtttatgtctttttgagagaaggtctcactctgttgcccagcctggagtgcagtggcttgatcttggctcattgcaacttctgcttcctgggttcaagtgattctccagccttagtgtcccaagtagctggtactacaggcggaagccaccaatgcccggctaatttttgtattttttgtagtgatggggttttgccctaatttttgtatttttggtagagacggggtttcgccatgttggccaggctggtctcaaactcctgagctcttagctattttcccaccttggcctcccaaactgctgggattacaggcatgagccaccatacccagcctctttttggagttttaagaagactgtatcaattgatacagtctgccctctgtaccacggatgtgaagcccatggatgcagaaggctgactgtaaggtatttgagcatccacaggggtcctagaaacaatctcctacagatactgaagtatgactatctatcatgagtggtttatgattttaattttaacatgaagtattgtttgtaatcttagaatcattggatactaaacttttgttttaggtttagcttctgcttttttttttttttttttttgagacagggttttgctctgtcacccaggctgcagtgcagtggtgtgatcttggctcaccacaacctccacctcccaggttcaagcaattctcctgcctcagcctcccaagtagctgagattacaggtgtgcgccattatgcccagctaatttttgtattttttttcgtagagacggggtttcagcacattggccaggatggtcttgaactcctgacctcaggtgatccgcccacctcggcctcccaaagtgctgggattataggcgtgagccactctgcaggccaaggtttagcttctttttgaggtgaaataattggggtcatttgagaacattattgaaaaagaagtaaaaaaactacaaaccacacactgatacttgtagatggatgacagtgtaggtaaatttttttcaaattgtattgtgttccctgagagtttgggaacacaagaaatcatggtttcttgaacttcagcttgtgtctagatcctagaagtaatagaggattctttttagttagctatttgggagatatagtgtgttataaatgtttgattctttaaaaatacataaattgggctaggcgtggtggttcacccatgtaattccagcactttgggaggctgaggcaggtggatcacttgaggttaggagttcgagaccagcctggtcaacatggcaaaaccccatctctactaaaaatacaaaaattagccgggtgtggtggcaggcacctgtaatcccagccactcaggaggctgaggtgggggaatcacttgaacctaggaggcggattttgcagtgagccgagatcacactactgcactccagcttgggtgatagagcgcgacttcatctcaaaaacaaaaaaaaaaattgatttaaataatataatcttttattatatgatgtataatcctgaaatttatggcatatgaaaatgaaacttggcataaagtggattttttagttcaataatacttttttttaacttattgaggatgttttagttcttgtttgccataagtgaaactttttggaattctgtatttgtttcacaattgggaagatttttttttctttttgagctgaaaaaggtatattttatttttagtctgtcaactattttaagtaagaagaaaacatttagatcaagacaaggaaggctttagtttcatcagggactttctaagaatgttatgaatgagtgaaaatatggggttgtaacagaagtgcaaatataaccttaattgtagtgttcagtgcttttgacactataatttatgtctaaatgctgcaaactgaaagaaccttagtttgaaactttgaagttgatggtggttgcaggttttctttttcccttcagttttatgccatctcaatgtgttatctggcattaaagacataaggaacacagattgcagcttccatttttttggcatgtttttgatttctatttgattcatatgctctggaggttccttttgaatctataaaatgcaacagttctctgattttgttttgatgattagatgctgctaattttcttttttttttttttttttgaacttgttcattttgccatgactattttttgaaacttgagatgtctggtatttagaaactgtactgagactttagtttttctatctgacctgagttttctatggacagattatagtggggtcttactagtctgacaattcctgactattcattggagtgtttacttttatttagttctaaatgtggttaggtttaagtttaatgtcttcatattttactggtcccatctgatttttgttcctttttttcttttcctgccttctttgggattgagtatattttagcattctattttctcttcattattaattaaccatactttattttttagtaattgctctagggttgacagtatgcatgtttaacttatcaatgtctactttgaaataatattataaaataccactttataagtaacgtaagtattatcccttacctagaatgtttatgacagtatgctcctcttcatgtcctgtcatgatttgtgctaatgttgtcataactcttacttctgtatgttacacactcacaatggtcaataataataactattactgctttgaataatttttaagaaattaaaacaagagtgtttgttgtgtttacccacactggattttaaggagtgaatcttgtttggtgttcgttgttattttgtgcttctgtgtacacaaaggtgcctatgatgtttcaccttagttgttaaatacttccttaagtcgaagctcatgtctcaacagtatactgttcagccctcctgggatatgtttttgcttccttcaacttgtctaaatccacatattcccccgaagttagatcgattctcaacttcagtatcttatttagtaaaaccattatttgcttctgattccctatgcgttttatagggaagataggacatgccatttcctgtaaataagattagtctaacatttataatacaaatgccaatgctacaaaagggaaaactgttcttatttagggttctgtttatgtagcagttcatacagagaattttcatgtgcgtcaaaaccaataagagattagatatgcctttacaaaacacaataaattatcattattcttttcttttattcaaataagacaacctttcaactgttgaagagcatgggccctgaaaaataactttattatatgtttattttttttgaggcagagtttcgcttttgttgcccaggctggagtgcatgggcgtcatctcggctcactgcaacctccgcctcccaggttcaagcgattcttctgcctcagcctcccgagtagctgggattacaggcatgcgccaccacgcctggctaattttgtatttttagtagagatggggtgtctccatgttggtcaggctggtctcgaactttcgacctcagatgatccacccgccttgtggatcccaaagtgctgggattataggtgtaagccaccacgcctggcctatgtgtttaatttttaattccttaatacataagaatacattattctcttataatagtttaaggtattcagatattttcttaaccattactgaaagtatctgtggatatagatgggcactcaagtatagaatagatgttagaggattgcaactacaaaataaagtatttcttaattattttaaaaatgaatatagtaaacattatggccttttttcctttatttacttatttttaaagcaggatgcatttttttaggagccagagtctcttttatagcaatagtgaaatgaattattgtaatctgaacacttaacaatccataaattgactcttccaagatggcccagtaggaacagctccagtctgcagctcccagcgtgattgacacagaagacgggtgatttctgcatttccaactgaggtacctggttcctctcattgggactggttggacagtgggtgcagcccacagagggcaagccgaagcagggcggggcgtcgcctcacccgggaagtgcaaggggtcgggggatttccctttcctagacaagggaagctgtgacagacggtacctggaaaaacaggacactcctgcccaaatactgtacttttccaatagtcttagcaaacggcataccaggagattatatcccatgcctggcttggtgggtcccatgcccacagagccttgctcactgctagtgcagcagtctgagatcgacctgcaaggcagcagcctggcagggggaggggtgtctgccattgctgaggcttgagtaggtaaacaaagcagccagggaagcttgaactgggtggagccaaccacagctcagcaaggcctgctgcctcatagactccacctctggggacagggcatagctgaacaaaaggcagcagaaacttcttcagacttaaacgtctctgtctgacagctctgaagagaggagtggttttcccagcatggtgtttgagctcagagaacagacagactgcctcctcaagtgggtccctgacccctgtgtagcctaactgggagacacctcccagtaggggccaactgacacctcatacaggcaggtgcccctctgggacggagcttccagaggaaggatcaggcagcaatatttactgttgagcaatattttctgttctgcagcccttcgctggtgatacccaggtgaacagggtctggagtgaacctccagcaaactccaacagacttgcagctgagggaccagactgttagaaggaaaaagaaggaaaactaacaaacagaaaggcatagcatcaacatcaacaaaaaggacatccacaccaaaaccccatctgtaggtcaccaacatcaaagaccaaaggtagataaaaccacaaagatggggagaaaccagagcagaaagctgaaaattctaaaaaccagagtgcctcttctcccccaaaggatcgtagctcctcgccagcaacagaacaaagctggatggggaatgactttgaggagctgacagaataaggcttcagaaggtgggtaataacaaaattctctgagctaaaggaggatggtcgaatccattgcaaggaagctaaaaaccttgaaaaaagattagacgaatggctaactagaataaacagtatagagaagaccttaaatgacctgatggagctcaaaaccatggcatgagaactatgtgaaatatgcacaagcttcaatagctgattcgatcaagttgaagaaagggtagcagtgattgaagatcgaattaatgaaataaaatgagaagagaagtttagagaaacaagagtaaaaagaaatgaacaaagccttcatgaaatatgggactatgtgaaaaaaccaaatctgcttttgattagtgtacctgaaagtgatggggagaatggaaccaagttggaaaacactatgcaggttattatacaagagaacttccccaacctagcaaggcaggccaacattcaaattcaggaaatatagagaacaccacaaagatactcttcgagaagagcaactccaagacacataattgtcagattcaccaaggttgaaatgaaggaaaaaatgttaagggcagccagagagaaaggtcgggttacccacaaagtgaagcccatcagactaacagctgatctctcagcagaaactctacaagccagaagagagtgggggccaatattcaacattcttaaagaaaagaattttcaacccagaatttcatatccagccaaactaagcttgataagtgaaggagaaataaaatactttacagacaagcaaatgctgagagattttgtcaccaccaggcctgccctaaaagagctcctgaaggaagcaataaacatggaaaggaacaaccggtaccagccactgcaaaaacatgccaaattgtaaagaccatgaatgctaggaagaaactgtatcaacacaacaaaaaaagagaatttcaggttgatatccctgaatgaacattgatgcgaaaatcctcagtaaaatactggcaaaccaaatccagcagcacatcaaaaagcttatccaccacgatcaagtcggcttcatccctggcatgcaaggctggttcagcatacgtaaatcaataaacataatccatcacataaacagaactaaagacaaaagccacatgatcgtctcaatggatgcagaaaaggccttcgacaaaatttaacagcgcttcatactaaaaactctcaataaactaggtattgatggaacgtatctcaagagctatttatgacaaacccacagccaatatcatactgaatgggcaaaaactggaagcattccctttgaaaaccggcacaacacagggatgccctctctcaccactattgtgcaacatagtgttggaagttctggccagagcaatcaggcaagagaaagaaaggaagttgtattcagttaggaaaagaggaagtcaaattgtccctgtttgcagatgacatgattgtatatttagaaaaccccattgtctcagcccaaaatctccttaagctgataagcaacttcagcaaagtctcaggatacaaaatcaatgtgcaaaaatcacaagcattcctatacactaataacagacagagagccaaatcatgagtgaactcccattcacaattgcttcaaagagaataaatacctaggaatccaacttacaagggatgtgaaggacctcttcaaggagaactacaaaccactgctcaatgaaataaaagaggacacaaacaaatggaagaacattccatgctcatggataggaagaatcaatatcgtgaaaatggccatactgctcaaggtaatttatagattcaatgccatccccatgaagctaccaatgactttcttcacagaattggaaaaaactactttaaagttcatatggaaccaaaaaagagcctgcataggcaatacaatcctaagccaaaagaacaaagctggaggtatcacgctacctgacttccaactatcctacaaggctacagtaaccaaaacagcatggtactggtaccaaaacagatatatagaccaatggaacagaatggaggcctcagaaataacaccacacatctacaaccatctgatctttgacaaacctgagaaaaacaagcaatggggaaaggattccctatttaataaatggtggtgggaaaactggctagccatatgtagaaagctgaaactggatcccttccttacaccttatacaaaaattaattcaagatggattaaagactttaatgttagacctaaaaccacaaaaaccctagaagaaaacctaggcaataccattcaggacataggcatgggcaaggacttcatgtctaaaacaccaaaagtaatggcaacaaaggccaaaatagagaaatgggatctaattaaactaaagagcttctgcacagcaaaagaaactaccatcagagtgaacaggcaacctacagaataggagaaaatttttgcaatctacccatctgacaaaggtctagtatccagaatctgcaaagaacttaaacaaatttacaagaaaaaaacaatcccatcaaaaagtgggcaaaggacagacacttctcaaaagaagacatctatgcagccaacagacacatgacaaaatgctcatcattactggtcatcagagaaattcaaatgaaaaccacagtgagataccatctcacaccagttagaatggcaatcattagaaagtcaggaaacaacagatgctggagaggatgtgtagaaataggaacgcttttacagtgttggtgggagtgtaaattagttcaaccattgtggaagacagtgtggctattcatgaaggatctagaactggaaataccatttgacccagccatcccgttactaggtatatacccaaaagaatataaatcatgctgctataaagacacatgcacaggtatgtttattggggcactattcacaatagtaaagacttggagccaacccaaatgtctgtcaatgatagactggattaagaaaatgtggcacatatacaccatggaatactatgcagccataaaaaaggatgagttcatgtcctttgtagggacatggatgcagctggaaacaatcattctgagcaaaccgtcacaaggatagaaaaccaaacaccgcatgatctcactcataggtgggaactgaacaatgagaacacttggacacagggcggggaacatcacaccctgggtcctatcatgatgtggggggcagggggagggatagcattaggagaaatacctaatgtaaatgatcagttaatgggtgcagcaaaacaacatggcacatgtatacctacgtaacaaaactgcacgttgtgcacatgtaccctagaacttaaagtataacttaagaaatccataaattttggaatgccttggacacaacagcaacaagaatctataaatattatgcttgctaatagtataatgtataatttaacccttttaacctttacttcaattccttaaagtctttaaaatctcagttggcatcaaaagtattactgagaaaattcttttgtgctttaccgcaaatttatctgaaatgcattcttttcttcttatacattgaatactctcggagttcgttgttttggaattatatgtgattataagatatttcctgttttttcctcccatgctcccattgttttcccatgacacttttagatatttatcatgttggctagatttcgccttttacttttgcatatgtttggaatatgctattttatattatgtagctcttacgtgtattatttattttccgaaatatttgtatttttcttctcccttgagcctctttatcttcttcagcccattttcttacagatacttcctttcctttcctttcttttcttaaccctttagtctttcattagaactgttaaggaataacagaagaaataccttgtcttctttccagtacttttgccaagcataaattttgtgcttttttcttccctagctgttttatagattttcttataattcagacatatttgtggtctgaactttttgccttttataatgaaatcactaggttacaaagcatttataagttgtgtagtttattctgtaaatttttaataaagacagatgatttagagtaggggtaatcaaactatgccccatgggctcactgcctgtttttgtaaatacaagttttttggaacacatccactcttacttgtataaatattgtgtttggttgctttcatgctccaatggcagaattgagaagttgcacatattaggccgttttcacactgctatagagaactacctcagactgggtaatttataaagaaaaggtttaattgactcacagttctgcattgctggggaggcctcagaaaacttacaattatggcagaaggcgaagggaaagcagggcacatcttaggtggcagcaggggtggggggaatgccacactttaaaggccattaaatctcatgagaactcactcactatcacgagaacagcatgggggaaaccatccctgtgatccagtcacctcccaccaggtccctcatttgatttgtgggaactacaattctagatgaaatttgggttggtacacagagccaaaccatattattttgataaagcctaaatggcttgcaagcctaaaatatttattgtctggccctttacagaaagtttgcctactcttattttaaagtatatgatcatttaaaagtgacatttaattctattaaaagtaaaagcataaaataatttaaaaattatatatatttttctagattgttataggaatttgcatgttggtaattgctaaaatttgataacataatacctacataatttgagcccttaaataaatggagtcaggctgggtatggtggctcactcctgtaatccctgcacattgggagcctgaggtgggcggattgcctgagcccaggagttagaaacctgctggggcaacatggtcaaaccccatctctacaaaacagtacaaaaattagctggacttggtggcacaagcctttagtcctagctactctgaaggctgaggcaggcagatggattgagccaggaaggttgatactgctgtgagctgtgatcacaccactgccagcctgggtgacagaacaagagcatgtctcaaaagaaaaggagtcattttgtgattgagagacaaaagaacaagttaataatgacgtttgtcaattattagagtatgtagttatctaataagttattagggtgtgtgtatatatatgtgcacatacattttctaataatttgtgtatgtatgcatctgtatacacagatatttacatgtctagatttcacagtaggttgatctgagaatgacagcatgatctactattactgagtaaattatcattaccattcagggttatgattcttggaaattatattcagaatggcctaagagaggttgttatattcagtgtgttgaacttgagaaggaaattggaagagtattggcagaaaactttagagcgcatatagtttacttttaaaaattctaaatacatttgaaaaaaattctcttgctcctttttccatgaatttttaattgttttaattaaatttttgaaaaaagttttaaagtttttaaaaacaattttagacaagatcttgctctgtccactcaggcaggagtgtggtggcacagtcacagatctctgcagcctcaaactgctgggctcaagtgattccccccgccacggcatcccaagtagctagggctatagacatgcaccaccatgcccagctgatttttttaatttttaattttttggtagagactaattctcattgggttccctaggcttgtcttgaaatcctgggcttaagcagtcctcctgccttagcctcccaaagtgctgggattacagacgtcagccaaagcacctggccccatgaaattttttttagttcttcgattatcttaaaatatgtgatctgttatatcctgttagtaggttattaacatcctaaagtactaagaaattttctatccagtcagttaaatattttgaagtgttttggaatggatgcatgaaatttttctgtgaaaactttaattctttctttgtattatagtacatactttgggaattatatcctgagttttctagaacagttccaatttcatacttattgaaattaactacaactgcttgagattaagtatttgactgcttatggctgccatgaaagtaatgcttgttgcaaaataattcaaatggtacagaagtaaataagtagtaaaagttaatttttttctctttgttttttgtttttctgatactccccttcagagacatatattatctataggtttcctctccactgtctacattaccttcttttctcgaattttatttcttagttttctcattctgcatactgtatttattgttcaaactgttacgtcattgagtattatttcgagatcttgtggctgtgcttcagtcttccattattcttttttcttttgtctcctgtatgtattttcaaatagcctgttttcagtctcactaattctttcttctgcttgattaattttgccattgagaggttctgatgcattcttcagtatgtcaattgaatttttcagctccagaatttctgcttgatttccaaaaattattttaatctttgttaaatttatctgataggattctgacttccttctctctgttatcttgaagttcgttgagcttaaaaataagtattttaggttctctgtctgaaaggtctcatatctctgtctcttcaggattggtcattggtgcttcatttggtttgtttggtgaggtcatgttttgctgtatggccttgatgcctgtggatgtttgttggtttttgggcattgaagagttaggtgtttattgtagttttcacagtctgggcttgtttgtatccgtccttcttgggaagactttccaagtgtctaaagggaagtgagtgttgtgatctaagtctttggttgctgcagctgtatcgcactgggggcacctgaagcctagtaatgctgtgactcttatagacttgcagaagtattgcctttgtggtcttcagtaaggtccaagagaatttcctggattaccaggcagagaataccctggattactgagctccatgctgaactgcttcaggcggggaaaaaggtgacacaagcatccatgtggccaccaccactatgactcgttgggtcagacctgaagccagcatatcactgggtcttgtctaaggcctacagtgaccactgtgtggctactgttgttgttcatttaaggcacaggctcttttggcagcaagtggaaaatccagccatgcttgtgtctttcccttcagagtggcaagttctcctgtagcccagggtgggtctagaaatgtcatctaggagccagagcctagagtctgggaatcttagaaatctgcttggtgttctgttctactgcagctgagctggcacccaagccacaagacaaagttcttcccactgtttcctctccttttcagaagcaggagactctcattgtggccatcatcaccccaggtctgcagtgaatactgcatggctaccagtgatgttcattcaggggccaaaggtttgtcagtcagcttgtggtgattgcttccaggcctgggtctgtccctttagggcagtgggctcccctctggcccaggacagacccagaaatgccatccagaagccagggtctggaactggggaccctagcagccttcttggtgctctgcgattttgtggttgagctggtgtacccaggcagcaagacaaagtcccctttatccttcctctccttccatcaagcaggaggagcctctccttgtggccaccacagctgggaatacgctgggtcacacctgatgccagcacagcactgggtctcacccctagacccacggtgagtactacctgattactgctggtgtttatccactgcccaagggctccttagtcagcgcgttatgaatcctgccaagactggttccttcccttaaaggtagtgggttttcttctggcccaggatggtctagcaatgttatctggcagctagggcctggaatggaggcctcgaactcttcctgatgccctatgctactgtggttgagggcatccaagttgcatgacaaagagctctttagttttccctctcctctcccactcctcaagcttaaggcaggaatgtctcctgggagcttgtttggcaggtggagccaggggtgcggggccgaggtggtataggcactcccctggctgggtggtttaacataataccattcgtgtatttctgtttttattgtttggggttttgaggtcataaccgtaaaatctttgcctagatgagtgttctgaggtgtttctcctgttttcttttagttttaatagttttatagtttcaggtcttaaggttaagtctttaatccattttgagttgatttttgtatgagttgggagatagggttccagtttcattgttgtgcatgtggatattcagtttcactgcaccatttattttagaagatgtcctttccccagtgtgtgttcttggttcctttgtcaaaaatcaggtggctgtaaatacatggatttatttctgggttctcttttctgtttcattggcctgtatgtctgtttttataccaatattgtgctattttggtaatgatagctttgtagtatatttcaaagacagtgtgatgcctgtaggtttgttctttttgctcagggtacccaggcagcaagacaaagtcctctttacccttcctctccttctgtcaagcaggaggagcctctccctgtggccatcacagctgggaatgctctgggtcacacctgatgctagcacagcactgggtctcacccagtgctttggctattcagagtcttttgtagttccagattaattttagggctgtcttttctatttcaatgaagaatgtcactggtatttcaatagggattgcattgaacctgtagattgctttgggcagtatggccatttttaacaatattaattcctctaatctatgaacataggatgtcttttcatttgtatccttttctgtttctttaatgagtgtttcgtagtttttattgtagagttattttttaccttttctgttaaatttattcttagatatttaatttttttgtagctattgtaaatggcattgctttcttgagttctttttctgaccatttttggtgtgtggagatactgctgatttttctatgttgattttgtatcctgcactgaatttatcagatttaagagctttctggcagtctaggtttttctgtatataagatcatgttgtctgcaaagcagagcagtttaacttcctcctttccatttggattttctttccttttttttttttttttttttggtgtggaaacccaggactttcttttctttcttttattttttgtttctttctttcttctttttttttggtcataaagtttcactctgtttccccatgctggagtgcagtggtgcgatcagggcccactgcagcctcaacctccctgactcaagtgatcctccgttctgaggctcccaagtagctgggaccacaggtgtgtgccaccaggcctggctaatttttttattttttgtagagatagagtctccctatattgcccaggctggcctcaaactactgggctcaagtcctcccaccttggcctcccaaagtactgggattacaggtgtgaaccaccatgcccagctgtctttattttgcctgatagctctggctgggaccttctgtactgtgttgagtaagaatggtgaaaatgggcatccttgaaagcctttcagtttttctcatttcagtatgatagtagctgtgggtttgtcatatatggcctttattatgttgaggtgtgttccttctatccctaatatgttgggaggttttatcatgaaggtatgttggattttatcaaatgcatttttagcaccaattagatgatcatatggtttttgtcttgattctgttaatgtgttgtatcacgtttattgatttgtgtatgttgaatcgtcctttcatcccttaagtaaatcctacctgattaggagaatggcgtgaaaccgggaggcagagcttgcagtgagccgagatcgcaccactgcactccagcctgggtgagacagtgagactccgtctcaaaaaaaaaaaaaaattctacctgattatagtatattatgatgcttatttgttgttgggttcagttggtttgtattttgttgagaattttaaatctatgttcatcatggataatggcttgcaggtattttgttgttattgtttgtttgtttttgagacaatcttgttgctcaggctggagtgcagtggtgcaatctcagctcactgcaacatctgcctcccaggttcacacaattctcctgcctcaatctcctgagtagctgggactacaggtgtgtgccaccacacctggctaatttttgtattttttggtagaaacagggtttcaccatgttggtcaggctggtctcgaactcctgacctcaaatgatcagcctgcctctgcttcccaaagtgctgggattataggtgtgagccaccactcctggcctgcagttttttaattgttgttgtgtccttgtctgtttttggtgttagagtaatcctggccttgtagaacgagttagtaagcttcccttctcatcatttttttggaatagtttaagaattggttcttccttgtaagcttgataaatttagcagtaaagccatttcatcctgggcttttctttttagggagagtttttactactcattgaatcttgttacacattattgatgtgctatactattcttgcgatgttataaaggaatacctgagactaggtaatttataatgaaaagagatttaatttgctcacagttctgcaggctgtatagtcatgtagccggcatctgcctagcttctggggaggtctcagggagcttttactcatagcagaaggtgaagcaggaacaggcatgtcacatggtgagagcaggagcaagagagagtgctggggaggtaccacacacttttaaaaactcagatcttgcaagaactcactattgtaaggataattccaagggtacagttccaaaccattaatgggcagtttttccccatgatccagtcacctctcaccaggcctcacctccaacactgggggttacattgaggggccaaattcccaagctatatcaattggtctgttcaggttttctgtttctttctggttcagtcttaataggttgtatgtgttcaggaatttcatttcctttaggtttttaagtttgttagtatacggttgtttattatagtctctagtgaccctttgtcattttgtagtatcagttgtaatgtcgccattttgtttgtgattttgttcatttgggtctttgctccttttaacatggttagtctagctaaaagtttgttgattttatcttttcaaaaagctaactttttgtttcattgatcatgtatattgtttagtctctagttatttctgctctgatctttattgtttccttgtgctagctttgtgttggtttttcctcttctggtttcttgagagtcatcattaggtggtttttttgaaatctttctacttttttgttgtaggcatttattgctataaactttcctcttagtatcgcttttcttgtatctcatgagttttcgtatgttgtatttctatttttgtttaatgaaattttttaatgttttaaattactttattaatggagtcattgatcattcaggagcatgttgtttgatttgtctctatttgtacagtttccaatgttcctcttgttactgatttccagttttattcttgtggtctgagaacatatttgacatgattttgatttttaaaaatttgctgagacttactttgtggcctaatatatgatttacactggagaatgttttatgtgctgatgagtcgaatgtgtattttacagctgttggatgaaatgttctgtaaatatctgttaagtctgtttggcttatagtgcagtttacatctgatttttttggttgattttccatgtggatgatatgtcccatgctgagagtggggtattcaaatgccccactattattgtattggagctatctctccctttagatctaataatatctgctttgtatatctgagcattctggtattaggtgcatatatatttagaattgttatatcttcttgctgaattgatccttttataattaatgactttgtctttttttttttttttacagtttttcatttaaagtctgttttatctcatctaggtgtagctacttctgtttgcttttgttttttgtttatatgcaatatctttttccattcctgtacttctagtctatgtgtatttacagttaaagtgagttatttataggcagcatacagtttggtctttttctttttaaaaattcattaagccagtctatatcttttatcaggggaatttaatctatttacattcaaggttattatttataggtgaggacttatttctgtcattttattgttttctggttgttttatatatcctttgttcctttttcattgtttatttttgtggtttcgtgtttttctgtatttgtaatgtttggttcctttctctttctcttttgtgtatctgctctaccagtgagttttatactttcatgtgttttcatgatggtggatattattctttcacttctagatgtaggactcccctaagcttttcttttagggtggtttagtggtaatgaattccctcagtttttccttctcttagaaagatgttactgttctttcatttttttttttaaaaggagtttcacgctggttgcccaggttggagtgcaatggcgcgatctcagctcactgcaacctccgcctcccaggttcaagtgattctcttgcctcagcctcccgagtaactgggattacaggaacgtgccaccacacctggctttttgtacttttagtagagacaggttttctccctgttggtcaggctggtctcgaactcccgacttcatgtgatctgcctgcctcggcctcccaaagtgctgagattacaagcttgggtccccgtgcctggcctgctctttcatttttgaatagcactttgctggaaatagttttcttggtgggcagtttttttcttttaatattttgaatatattatctcattctctcctggtcttaaggtttctgcttagaattgtgattttagtctagtggggatttctttatatgtgtgttgacacttttctctcgctatttttagaattctctctgtgtcgttgattttgatagcttgagtataatgtaccttggaggactttttctggtagaatccgtttggggttcttgagcttcctgtattgaaatttgtatggctcttgcaggagttggaagtttttagctattatttcattaattaggttttctatgcctttacccatctcatttccttctggattttctaaaattttctgaattttctaaaatctagttagatatttaaaaaagaaaaaagttatcttaaaagacttgtcttcaagtttagaaattctttctgttgcttgatctattgttgaagtgctcagttgtattttttattttattcattgagtttttcagttatgggattttgtttggttgtttttttaatgacatctatctcttttgaatttctgattcatgaatttttttttataaccttgtattatttatgtgttttctcctgtttctcactgaggctcttcgttatcatttcaaattctttttcctttttctttggatctgttactagagaattagtgtgttgctttggaggtgtcatgtttccttgcttttttatgtttcttgtgtctttatgttgatatttgtgcatctagtgtaccgttcacttcttctagttttgcggattgtcttttgttgggaaagactttttttcttatagatgcatctattatgttgcttttgtagggtgctttgtctttgattcttggtgggtgaagtagtatagtctgcatgatttctttggctggaatcaggattagtcttgtctgtgatttccccagtggcttaggctgtggttcttaggtaaaggctttggtgtggctttttcttgggaggaggaagacaggcagactagttctcaggcaccactggtggcagtgatgggctgcgcatgacagtccttggtgccctgtgtggcatatgcaggtgattgtggtgatgggtctagatgggccaaactttggttgtccaggcagcttttctgggtgccagaggtagaagtggtatggtgagtctggtgggtcctcagagtcttgggtagtgtgatggcattggtggtagcaatagcggtggcaggccaaccattgggtctccagtggcaggccagcagtggtgttgggctgggtgtgccggtccccagtcccctaggtggtatgcataggtgagtgctggtgatagtggcaaactgagcaagttggtatataggcccctgggagatgcatgctggtgccagcagtggccatggtgggtgtctgtctaggcccgcagatagtgcacatggtaaaggtggctgtctgggcagattcatcctcaggctgctggaaggtgtgtatgggttctggcagtggcaggccggtaggatcaatctccaggctcccagatatcaggtgccagatgtggtgagtcagtctccagggctctggagaatgggcgtaggcaatgttggtgggcacggctggtctgtccccacaggttggatgggttgatccccaggccccagatggtgtgttttgatggcagtagcggtgggttgggtgtgcctgtcctttgattcctggatggtgtgtgcaagtggtggtggcaggtggggtggtcttgttgtcaggcccccatcatggtgtgtctgattatcaatgacagcaggttggggcagatcaattcccaggcctccagatgacacctgtggctgtggtggcagtttgggtgggctagtcctgtccttactcccacctccccaaaattgaatgtggttgtggtggatgtggacagagcaggttgatacctaggccctggttggcatgctatccatgttgatattttactctagtttataaatgttaactgctgtatagtatagtgtttaatgaatattaaataatgatcctactatgaattttttttatttctccttgtgtatagattttagagttctaaagtggattgttgagttgaagtttatgtacattgattttccccttaatataaaattgtttttttaggttacactgtaagagaatttctgtttgtctatagtgaaatcaatacttgatagtttcatacttgaattttgccagttgagtggttttgaaatgttagctcatcatcatttttacttacatttttatcataaaaagtggttttccgggaggctgaggcaggagaatcgcttgaacccgggaggtggaggttgtggtgagccgagatggcgcccctgtgctccatcctgggcaacaagagcgaaactccatctcaaaaaaaaaaaaaagtagttttcattttaaaaaaattgcctgttcaagtttttttagttttcttaataatgtatcatattataattaataatgtgtaaatatatacttgtgtattatattgtatattatctatatcatataaattatatataacattaatgtttcttttattttgtctttttcttactgcaggggtcattattcagaatacttaattttgttgcatgttaggtgtattgcaaatatattctgtcactctttggattttcctttaactttctttagtgtgtcttttgtgtagaatagcttatttttgtcttaatgaagttgggtttttctggtttttgtatttttcttgcttttgtattttttgcttttttgtttcatgtgaaattttcaactgacctgtggtcataataaaatttcctatggtttcttgtagtaattttaaacctttattttttaatttatatcttttaatcagtggggtttgttttcctgtatagtgtaaggtatggcactttatatgtctaactggttcttcctgtaccatttgaattgtttctcttcccctctgatttataatgctacctgtgtcatattccatgtatccatatatatcacgatctgtttctgggctctcctctgttccattggcttgtttaaattattatggttctaaaataaatcataatgtggggtggaggtaatttccccacttactttatattttgtgtttgtttgcatagatattattcaagtatctctgagaatcctaaacacaattgttgtaagattgtttaaggctgttctagaagattaattttattgtgacttaattttgttgatttccttagctgtcttagcattagatttcttcgtgtgctttagaatggtggtttgtaaggttatttttaacagaaaggtcattatctctctatttcaccatcttcttcttgtcttactcaagcccttcctctgctcattgttagtgttatagttacttcctctggtctatggtctagaatccagttttaccttgacagttcaaggctcttgcattgctgtattgggtgatagcaaagcattgcttatttcgtttttcatgaggtttgtttacttctgacaccctttatacataacttcatgttaaattctaggcagtggttggcagtaagttttttctgcctccttcaaaattggggattcactctgttactggttttaagcgttgagcttggtaacagtctcccatccttacatgacaattttcagttctctttattcttcatctgcctctgccaggttttacatcttttgcatggccacctgtctttctcaatctgactaaatgctttgagtctggttaaaatttttctcttttttatgttattgctagtatttcttgtcctcccccatcctcaatgtttttatctagtcagcctttatcagaagtataaatccttttttctttttattggaaatctaaaagcttcaaagattactttttttattatactttaagttttagggtacacgtgcacaacgtgcaggtttgttacatatgtatacatgtgccatgttggtgtgctgcacccattaactcgtcatttaacattaggtatatctccaaatgctatccctcccccctcccccaaccccacaacaggcccccaccccacaacaggcccccaccccacaacaggccccggtgtgtgatgttccgcgtcgtatgtccatgtgttctcattgttcaattcccacctatgagtgagaacatgcagtgtttggttttttgtccttgcgatagtttgctgagtatgatggtttccaacttcatccatgtccctacaaaggacattaactcatcattttttatggctgcatagtattccatcgtgtatatgtgccacattttcttaatccagtctataattgttggacatttgggttggttccaagtctttgctgttgtgaatagtgcctcaataaacatacatgggcatgtgtctttatagcagcatgatttataatcctttgagtatatacccagtaatgggatggctgggtcaaatggtatttctagttctagatccctgaggaatcgccacactgacttctacagtggttgaactagtttatagtcccaccaacagtgtaaaagtgttcctgtttctccacatcctctccagcacctgttgtttcctgactttttaatgagtgccattctaactggtatgagatggtatctcattgtggttttgatttgcatttctctgatggccagtgatgatgagtatgttttcatgtgtcttttggctgcataaatgtcttcttttgataagtgtctgttcatatcctttgcccactttttgatggagttgtttgttattttcttgtaaatttgtctgagttcattgtagattctggatattagccctttgtccgatgagtaaattgcaaaaattttctcccattctgtaggatgcctgttcactctgatggtggtttcttttgctgtgcagaagctctttagtttaattacatcccatttgtccattttggcttttgttgccattgcttttggtgttttagacgtgaagtccttgcccatgcctgtgtcctgaatggtattgcctaggttttcttctagggtttttatggttttaggtctaacatttaagtctttaatcatcttgaattaatttttgtataaggtgtaaggaagggatccagtttcagctttctacatatggctagccagttttctcagcaccatttattaaatagggaatcgtttccccatttcttgtttttgtcaggtttgtcaaagatcagatgattgtagatatgtggcattatttctgagggctctgttctgttccattgatctacatctctgttttggtaccagtaccatgctgttttgcttactgtagccttgtagtatactttgaagtcaggtagcctgatgcctccagctttgttctttttgcttaggattgacttggcaatgcgggctcttttttggttccatatgaactttaaagtagttttttccaattctgtgaagaaagtcatcagtagcttgatgggaatggcattgaatctataaattaccttgggcagtatggccattttcatgatattgattcttcctacccatgagcatggaatgttcttccatttgtttgtatcctcttttatttcactgagcagtggtttgtagttctccttgaagagctccttcacatcccttgtaagttggattcctaggtattttattcctttgaagcaattgtgaatgggagttcactcatgatttggctctctgtttgttattggtgtataggaatgcttgtgatttttgcacattgattttgtatcctgagactttgctgaagttgcctatcagcttaaggagattttgggtgagacgatggggttttctagatatacaatcatgtcatctgcaaacagggacaatttgacttccccttttcctaattgaataccctttatttccttctcctgcctgattgccctggccagaacttccaacactatgttgaataggagtggtgagagagggcatccctgtcttgtgccagttttcaaagggaatgcttccagtttttgcccattcaatatgatgttggctgtgggtttgtcatagatagctcttattattttgagatatgtcccatcgatacataatttattgagagtttttagcatgaagcgttgttgaattttgtcaaaggccttttctgcatctattgagataatcatatggtttttgtcgttggttctgtttacgtgatggattacgtttattgatttgcgtatgttgaaccagccttgcatcccagggatgaagccaacttcatcttggtggataagctttttgatgtgctgctggattcggtttgccagtattttattgaggatttttgcatagatgttcatcagggatattggtctaaaattgtctttttgtattgtgtctctgccagactttggtatcaggatgatgctggcctcataaaatgagttagggagggttccctctttttctattgattggaatagtttcagaaggaatggtaccaactcctccttgtacctctggtagaattcggccgtgaatccatctggtcctggactttttttggttggtaagctattaattattgcctcaatttcagagcctgttattggtctattcagagattcaacttcttcctgggttagtcttgggagggtgtgtcgaggaatttatccatttcttctagattttctagtttatttgcgcagaggtgtttgtagtattctctgatgatagtttgtatttctgtgggattggtggtgatatcccctttatcatattttattgcgtctatttgattcttctctcttttcttctttattactcttgctagcagtctatcaattttgttgatcttttcaaaacaccagctcctggattctttaattttttgaagggttttttgtgtctctgtttccttcagttctgctctgattttagttatttcttgccttctgctagcttttgaatgtgtttgctcttgcttctctagttcttttaattgtgatgttagggtgtcaattttagatctttcctgctttctcttgtgggcatttagcgctataattttccctctacacactgctttgaatgtgtcccagagattctggtatgttgtgtctttgttctcattggtttcaaagaacatctttatttctgccttcattttgttatgtagccagtagtcattcaggagcaggttgttcagtttccatgtagttgagtggctttgagtgagtttctgaatcctgagttctagtttgactgcactgtggtctgagagacagtttgttataattactgttcttttacatttgctgaggagtgctttacttccgactatgtgatcaattttggaataagtgcggcgtggtgctgagaagaatgtatattctgttgatttggggtggagagttctgtagatgtctattaggtctgcttggtgcagagttgagttcaattcctggatatccttgttaatttctgtctcgttgatctgtgtgatgttgacagtggggtgttaacatctcccattattattgtatgggagtctaagtctctttgtaggtctctaaggacttgctttatgaatctgggtgctcctttattgggtgcatatatatttaggatagttagctcttgtcgttgaattgatccctttaccattatgtaatggccttctttgtctcttttgatctttgttggtttaaggtctgttttatcagagactaggattgcaacccctgcctttttttgttttccatttgcttggtagatcttcctccatccctttattttgagcctatgtgtgtctctgcacatgagatgggtttcctgaatacagcacacttaatggttcttgactctttatccgatttgccagtctgtgtcttttaagtggagcatttagcccatttacatttaaggttaatattgttatgtgtgaatttgatcctgtcagtatgatgttagctgattattttgttagttgatggattttcttcctagcatcgatggtgtttacagtctggcatgtttttgcagtgtgtagtactggtttttcctttccatgtttagtgcttccttcaggagctcttttagggcaggcctggtggtgacaaaatctctcagcatttgcttgtctgtaaaggattttattctccttcacttgtcaagcttaatttggctggatatgaaattctgggttgaaaattattttctttaagaacgttgaatattggccccactttcttctggcttgttgatttctgccgagagatcagctgttagtctgatgggcttcactttgtgggtaacccgacctttctttctggctgcccttaacattttttccttcatttcaactttggtgaatgtgacaattatgtgtcttggagcaacaattatgttgctcttctcgaggagtatctttgttgcgttttctgtatttcctgaatttgaatgttggcctgccttgctagattggggaagttctcctgtataatatcctgcagagtgttttccaacttgtttccattctccctgtcactttcagatacaccagtgagacatagatttggttttttcacatagtcccatatttcttggaggctttgttcatttctttttattcttttttctctaaacttctcttctggcttcatttcattcatttgatctcccatcactgataccctttcttccaattgattgaatcggctactgaggcttgtgcattcatgatgtagttcttgtgccttggttttcagctccatcagatcctttaaggacttctttgcattgattattctagttagtcattcgtctaattttttttcaaggtttgtaacttctgtgccattggttcgaacttcctcctttagctcagagtagtttgatcgtctgaagccttcttctctcaaatcgtcaaagtcattgtccgtccagctttgttccattgctggtgaggagctgcgttcctttggaggaggagaggtgctctgatttttagagtttccagtttttctgttgtgttttatccccatctttgtggttttatctacctttggtctttgatgatggtgatgtacagatggggttttggtgtggatgttctttctgtttgttagttttccttctaacagtcaggaccctcagctgcaggtctgttggtttgctggaggtccactccagaccctgtttgcctgggtatcagcagcggaggctgcagaacagtggatattggtgaacagcaaatgttgctgcctgattgttcctctggaagctttgtctcagaggagtaccgggctgtgtgaggtgtcagtctgcccctgctggggggtgcctcccagttaggctactcgggggtcagggatccacttgaggaggcagtctgtcggttctcagatctgcagctgtgtgctgggagaaccactactctcttcaaagctgtcagacagggacatttaagtctgcagaggattctgctacctttgtttggctatgccctgcccgcagaggtggagtctacagaggcaggcaggcctccttgagctgtggtgggctccacccagtttgagcttccaggccgctttgtttacctactcatgcctcagcaatggcgggcgccccctcccccagcctcgctgcccccttgcagtttgatctcagactgctgtgctagcaatcagcgaggctctgtgggcgtaggacccacccagccatgtgcgggatttaatctcctggtgtgccgtttgctaagaccgttggaaaagcacagtattagggtgggagtgacctgattttccaggtgccgtctgtcacccctttctttgactaggaaagggaattccctgaccccttgcacttccagggtgaggcagtgcctcaccctgcttcggcccacgcttggtacgctgcacccactgtcctgcatctactttctgacactccccagtgagatgaacccggtacctcagttggaaatgcagaaatcacctgtcttctgcatcgctcatgttgggagctgtagactggcgttgttcctattcagccatcttggctccacccactgtttttttgtttttttttttttttatagactgggtctgtttatgtagcccagcctggctgccaattctttggttcaagcagttctccaccctcagcctcctgagtagctgggattataggaatatgctacaaagccctgtttcaagtataacttgtattttaaatgagtcctaagtctttatataactgatctctttcagtctcttctagtacacattcagctttcctgtgcacatatataattgtatgtcatgcctttactagaaataccacctatcaaaaattgaatttattaggctgggcgcagtggctcatgtcggtaaacccagcactttgggaggccgaagcaggtagatcagttaaggtcaggagttcgagaccagcctggccaatatggtgaaaccccatctctactgaaaatacaaaaattagctgggcgtggtggcatgcacgtgtaatcccagctactcgggaggttgaggcaggagaattgcttgaacccccgaggcagaggttgcagtgagccgagattgcgccactgtactccagactgagtgacagagtgagaccctgtctcaaaaaaaaaaaaaaaaaaaattgaatttaccatttaaccttaaatatcagatcttaaaaaaaaaatcaattggtaatttcctgggtagtgtagagcttagagattagtgttgtcttatatgactcatggtcaggcatctgtttttctgttctgaaatttgcagatctcattagcatcattttgcaatgttagagcagacataaaagttagattatattcttctttcttaggagactgagaagataatagtgtcattaactgaattagggaataaaggacagaggattttgggggaaacaatgggagaaggggaaaaaggagctgaatcagttgcagagttatgagttttgttttagacgtgttcaatttgaggtgctcacataaaaaaattttttctcagtgctacttccctcattatttaatttctaaacttttataataatctattgctaatgtttctgcttttgctcttggccaaatactcagaagagtcttcttcctaaatgaaatacttcatctttttattctcccattcataagtttaattggcttgtttaatatatagaataaagtttaaatttcttggactaataggccctctgccatttgccctagtttctttttacagcttgatatttcactgctctctatttaacctaaattgggctatccattatcatttcagtaaggcatgttaccttgccttgttcaacttttcctttttcattcctgcaggtacagtcttttcaaatctcttgttctttgtgatgttttcctgactactcaatctcactctgatttttcttttctcaggataaggaaaggttaggttggataggttaggaaaggataggttgttaatttagtattatatttttcagttccctttttctcatagggaggcagtagggcaaagtggttagtattgggcatttaatagctgtgtgattttgaagcatttaatctctttatgccttcgtttcttcatctataaaatgaggatattcttgcattcatagagtcgattaggaggattgagatatgaacataatgtctttagcagtatgtgacatattgaaagtgttacaatgttttttctgtttgtctctttttcatccatccctgccttccttccttctgtttgtaaaccaaaaagcatttgagacaagtctcaatttagaagtttattttgccaaggttaaggacaagcctcaggacgtcctgatgacgtgtgcccaaggtggtcaggctacaccttggttttgtgcattttatggagacataagacatcaatcaatatatatcaaatgtacattggtttggtctggaaaagcaggacaacgttaggaggaaggggcttccaagtaataggtggaatcaaagatttgcagttggttgaaagaatttatctaaagacctggaatccatagaagggagtgtctgagttcagataagggattgtggagaacaaagttcttattatgcagatgaagtttccaggtagcaggcttcagaaagaatagattgtaaatgtttcttaatcacacttaaaaaggtgccagactcttagttaattctctcctgtatcagagaaaagaccaccaggaaagggaaagggattctctacagaatatagattttccccacaagagacagctttatagggccatttcaaaatatgtataagggttatactttgatttctttcagggcctgtgatctgtcatgtgatgcaatactagagtcagggtagaatttggtgtcttattgctacaaaaagtcttaagatttctgttttaatgttaatactggtcagttgtgcctgaatttcaaggagaggcgggtataatgaggcatgtctgacctcccactcccatcatagcctgaagtagtttttcaggttaagtttggaatgcctatggcttgagcggaggggtccattcagatagttttgggggctaaggattttatttttagtttatgcctactctccacttttcttaagagaagctctacttttcttatccttgaaatacttgctgcctagtaactgctatttctttgtgacatgtataatcataaacttttttttttttttttttcacacagagtctctctctgtcacccaggcaggagtgcagtggtgcgatcttggctcactgcaacctctacttccctggttcaagtgattcccctgcctcagcctcctgagtagctgggattacaggtgcaaagcaccacgcccagctaatttttttgaagttttagaagggacagggttacaccatgttggccacactggtctcgaactcctaacctcaggcaatccacctgcttcccaaagtgctgggattataggtgtgagccaccatgcctggcctgattaactcttaaattactaactttttagtgtttacataggttttgttatttgagtaaataggtaaaatacttagataaaggtatcaattttactactttttttaaatttttttttcctgaaggtgcctaacacatacttttctttgctcagacatcttttgctgagggaagttatatacaagaaaacaaagtgcagttaaattaatctgttcaataacccagttccccccagtgaatttggtaaaaattagatggtagaatgtggtttagaccagagtagttctgtatttactttttttttcttcctccctgaatttctgcctatttcaccttctaaatcttagagtggatctcacagtttcaattctgtggtttaaaaaaagtgggagagggaggtggcaatcggatacacacccacatacccaccaatatgaaggaaaggaatgtcataggtagcaataaagaacaaatttttcataacatgttttgcaatttctctgatatatgttctggcatagtttaatagtttgattattctgtggctggggcagtatcatgggtcgggggctatgtgggtgaaaagaaggcagaggagagatggctaatggttgagtcatctgggaaaatgactctggtccttttactgagtagcatgggtctcagagattagaagagcagagattagaaaagcacatagaagtgttcacagtgaatatggtgatctcttttattgttaaaatgtggcccaatgaatgttcagcttttggtcattaaggttagttatatcttcctttgagatgatcaaatgaaaagaatacaagggagggtcatttctttttcctttttccagcctgtcataaccccttttttccacccttgatagaagatggaaacagcctcccttgtggactaaagttgatgtgtgaagagattggtgctatatattcctctttatttaagcatgcttgatatatatattttttatgactaaagttaaggttttaaatattgctgttaaggtagagttgagtcagatttctatttttaccatgaaagttagtgaatgtgttttccctggctctctcttgtgctctccaagtgtacctctgagtaaatgactttatttagctttctgtctttgaagtgtgcagtattactctcagagattctttattgcatctggctgttgtcattgtacttgctactggagaggatagaggtgaatgttcctaaaagccttgtagcagttcatttctaagcccctttggtgaccagagctgacaggtgagtcttagttcttttctgcttgcgaagtttggtgccacagggttgaagagcataaagtacatcacctcttagtttcactgtccactttctccttcttcagctctttcctgcatcttaacctcttgctctgtagttttagacaaggacttcaatgatgtagtcacttgttttcagttttattctaaatgttattcacactattgtgaatctgggagttgatggttttctagttttagttgacaaaccctgtgagggacagggagaaaagtgagtaacatgaactcatgatctgtcagtatgaaagtaatggatctgtttacgtgcagtgtttgccacacatttttcctctgttaggaacttttgtaaggaaatgacattcttgcttgtttcatgaggagcaaatggcagtattttcagaaatagctatgtggtccccaagagaaaacattctttggccatgaaatatacttaccagacattttggaaaattgcaacctaaataagatatgactgtaatgcttttggtgttaaagattatcttaaaatattttagctggtatttttgagaacagagtttcttttattagtaattaagggctttcaatgaacgaaaactgtgtaatggtccacagtgatgcctactggttaaaagcagatgatgaattcaaaactaatggaagtaatttcagtcttaatagtaaatattataattattcttattttgctttatttttatttatttaatttgattggggcatgatttgaatggaaactcacttttatttgatacaactaaaatgtaattgaaatgaaagcaagttcaaatcattgaaaggattaatttctaattatagtatatacattgtcaaagtttcctaaccataattaagaaagaagtgtttacatgtttggtaatgtttggtttatagtatatattcctatgagtaccatgattaatgctcattttttaagcacaccaaaatttcaagtttttaaaataaattttgtttaggcaaataaagttatttagtttgtttttcttttgaataataaatacatgtagtttgcagggaagctttactcactttttttttttcagtgctatcattatttaattgctatgtattatatacattttgtatactttggtatattttatattggtaaaatcaatggcaccacaaattaaatatgtcaagcacttatttttaaaattacactgaatgactcctaaagatgtctatacaaataatattataaattttatgatgtagagagataattaaatcaatcaaatacagtatctttaattaagacaacaggaaaaccccaaagaggatttggttactggaaagaacagcacttgaaaaagaacagcctcattaagaaatgtgaaagttatgaagagttaaatacaaaagtggacaaacatatctcacttagagttctttacactgcatactctgggagtctatgctattcaaagcacctcaaatttggaaatttttttttttaaattttttttatttatttattattattatactttaagttttagggtacatgtgcacaatgtgcagtttagttacatatgtatacatgtgccatgctggtgcgctgcacccactaacttgtcatctagcattaggtatatttcccagtgctatacctcccccctccccccacctcacaacagtccccagagtgcgatgttccccttcctgtgtccatgtgttctcattgttcaattcccacctatgagtgagaatatgcggtgtttggttttctggtcttgtgatagtttactgagaatgatgatttccaatttcatccatgtccctacaaaggacatgaactcatcgttttttatggctgcatagtattccatggtgtatatgtgccacattttcttaatccagtctatcattgttggacatttgggttgagagaatactacaaacacctctacacaaataaactagaaaatctagaagaaatggataaattcctcgacacagacactctcccaagactaaaccaggaagaagtcgaatctctgaatagacctttactcacttttttttaacaaaaatttgaaaactcatcgttttcatttaatcccattttgctgctaataatttttaaaaaatagagtaaaaataacttgttctttcttttgctttaaaatgtttgtcatctcacatatgccagatttattggactgcagtagttttagtgcattttggctggaatgtttattatgacatcaccataatctatatacagtatgtgatttcagatggtttcagtgttaaatattttcataattatgctagttttggcagttcacttggaactttttcacatctttttaatgaacatgttttacttctgggcttctgagacaaccatatgtttcaaaaattaataatgtgcttttaatgttaatgttgtgcagaagtgtatgactatggacatttttaaggatttaagttgaactaaaagtaattacagtgaggctttattcacagtagtagtcttttagtatttaagactgtaacatcccccaaataacagaagatgtctttatgaatattgaatagtgaagttattttgtggaatgaaacctgtgatgtttgtttttcattaacttaaaatgaacataagttcatgagaaaattttcagtgttgtttatggttgcaagtctttttgcttgtatgaagtttcaaacaaatttttttctaacgtatcactaccatctgaagccatgctgttttgtaaaacaccttttattgtatatttctcttagtgtgatagtgaataaaagttttcttaaagaggtcttattgtcgttcttatttgcctctagtaccctgttagtttggtaaactagtgatgattattcttttatatgctcttgaaattttcccttcaaatatataaagtagaaaaactaaatttaataccattcttgtaagtattataaaatagtgttattattgattaatgaattcatggtgcgcaatgcactctcagctaccctttgtgttggtatctttgatctctcactccacatgtgcatctttacttcaagcaaaaatgtattcttttatccttaaaaaaggaacaagaagttagttgccagctgatcttccctcatgttactactctacctattttctcttcgtaatgcctatcttcgtgaaagagcaatttattttaattgactccatggtaacttctcattcactctgagctactcatttactgctcccacttctctccctctgtgggaactgctaaatcacctttctaataggttagtggcagcctcctcctaattaccaaatcctgaaacaggtcaactagaatgaggactaagaatatctctatagttgttaacattaccccatttttattgaaaggtctgtgcctttaacttcttccatcttagacactgtatactctggccttatttgactaatcatcattctttgtacgtgctacatacgttgatactgttttgcttttgcttatggttcctcccaccacccctcatttagccccagtctaaacctaaaacatttctacatttgattttgaatggcctgatctttctagttcttccaaacagaatgactctttttatactccttattacttaaaaacaaacaaacaaacaaaaagtattgcttttgtagaattagttatacatgtgttcgatagattctgaagtccctaaggacaggatacaaagataaatatatctaatttatccttgtaaatccagcaatttggcatgtaagagtattatatacatgttgaatcaggacaggaaaaaagtactcatttgcagttataaatacagggataaatttcaaaaatatgtataatttatttgtttctgttactcatattgaaacccagttaaaacttatacctaacatgaatgataatttagtatacattgtttagtatacattgtttaggagaggattataaggattattaagattaatcattaaagatgaccaagatagcttggattgaaaatagtgttttaacatataaacaacaaatggggaaaaattaagaacctttttatttattttgcacttacatagagatggatgttgtttaaaggctttcattaagtcattttttcttttgctagagccataaataagaattctttggagattgtcaagtagtttgttttgatatcagctaaagaaagaagaatttatagttttaaactatgagttattaatattttttaaatgctgtttgagaatgcaaattatgaaaattggttatgtagtttttagagctaaaaaataaaattatgttgatcttatctcctgtagctaccataaactgcatatattaaaaaattttttttcttaattcttgagtatgatcgatggttttctttttctttctttaaaataaaaataggatgaccatgaaagctgtggttctaattctaccaaccgtagtactgctgagagcacaaaatcatcaatcaaaccgcggagaatgcagcaggctgctcctacagatcctgacttaccaccaggtaacttctaatgggatcaataaaaccaaatttcaatttttggccgggcatggtggctcatgcctgtaatcccagtgctttggggggctgaggcgggtggattacttgaggtcaggagtttgagaccagcctggccaacatggtgaagccatgtctctgctaaaaatacaaaaattagccgggtgtggtggtgtgcacctgtaatctcagctactcgggaggctgaggcaggagaatcacttgaacctgggaggtgggggttacagtgagccaagatcatgctactgcattccagcctgggtgacagagtgatactctgtctcaaaaaaaaaaaaaaaaaattgatcattgttttagtactttgtagaatatatatttttagtatcataaaacttttaagctatatgtgcatatgtacttgctacatgacttcagaacaaattgggtcctgggattacaggtgtaaaccactgtaccaagcccaaggtacttttatcttgagactctggtatcttttaggccagactttggattctgctgctttcagccttttcaagaggaaagagtctggagaagacctatctgcttcttaatatccccaggctggaagtgatacatattcctctgatcaaatttcattgaggagaactatttgcagggatattacttatgacttagaagttaaatctcagtagcaattccacattcctgaagtgggagcacaaattattgatggatagctagcttctctgccatacaggtgttctttcttattaatgtatcaatccattcttaaatggattatgcttcaaagtattattttgttaataaccttcaagatagctgatgtttatattttattacagaaaacgtgatcattagagagcctttatttcattttaatttgactgaatttcaaattattgtttagtggagacaggctgtttatttccctaaatgtgtatcactatttgaataatatgctagagcagctcattgagggctatttttgccctcaaagagttaactgtttaggataggagccttttaaactatcaatcacagtacaaagccaaaggaagatgagctctaatgaaccacaagtaatatcttttgggcactaaaaggagggagttgtcatgtccaggtgtgtgtggcttctgaacacacacatgaaacagaggcaagacagatcaaaaatgaaagtatgggagataatataagagacaaatagtagccaaaaataaatctgtatctttcatataaaaatgaggcaaaaataagaaaactaaagacaaaaaacattaatggagataggtaataaagatactaaattataataaaatatatagttctccagaagatacacattgactttgtatggacctaacaatgtgactttgaaatgtcataaatcaagcagggaaaaaaaatctccagattagttcactggatatcaaaattttgttttagtagatacatgtaaactctgcactaggcacataagacagtatacatttcttttgatgcacacattgagtatctacagatattaacaaagacttggttgaaaaggaagtcttgagaaatttcaaagcatcactatcatgtatctttctctctgaccacaatgtgattaaattagattataattattgatgtggttgtatttacttctgccatttcatttgttgtttttctttgttcactctgttttttgttcctgtttcccatctcatgcctactatttactttttaagagccctgaagtagctgctccatacattctctccaggttttatggcttcagtcactgggaaagacagggtggagtgtttactttatcttatccagaactgaaaccggttaacattgtggtgtacaaccttttagagagtcttttcttcctttacacacacacactcacacatatgcacacaaaaacaatttgttataacctaaatttttcatttaatgttatgccaaaaacatgtttccaggccattcacattttttacgttgttatttcaatcagtggcatacaatcctgttgtataactcttctacagtttatttaaccagtcctttttttggtttgatatttaggttatttgttatttttagttttgtaaaatgctttagcaaacatatgtaggtaagtctttgcatacacctctgcttatatctttaggaaaactcctttccaatttatagagtcaaaatttgtgagcacttttaaggtttttggcataaaatggctaaattactctgtggaaagtttgtaacaatactttattccaatcacatttttagtgtaatgctgttttttattattaaaaaaatctcttaaaacttttataggtggaaaatgctatcatacattttattgctaattgggatttccatctttaccattttctttttatacttttttgttaggaaagctaatttttatattttgttagctgaccagtattcagtattttttagtcgcttcttttggagtttctatataaaaagtactgtcatctttgtgaaatgacttttttccctcctttgcaatacttatacactaatttctcttttttccctttatttcattgtctagaacttctgtgaccatcttaaataatatagtatcaccaactcacatcggtttttttagctcctacagtaattgcccaaaattattatctagttattaaatctgatgtttttaattcatattttattgggcctgtctataacattgacagtaaagattttttattcttgcccttttaacaaagtttttattttgaaacaatttcagcatttcataaaagacaagaacattctaaagaacttattttccctttaaccatttgagcataaatttcctatctgatgctacataatgctcaaataaattttacaccaaaaacttgactacgatgtttttatgtactgtaaccaagtcatcaaccgtggcatttctgattatgagcagcttggcttcccagtgaccacatcaagatgaatcaattgcagatggtgtctctttgtaaccaaaattttttgatacatgccatttaagactatcagagaaataaataagatacagtcttttttctctaggacttcacagtttatcagagaagataagcatacatatacataaaaaatgactaatagtaacataagcccaagaaaagtggtagagacatttctctttaatgttgaggtgtaggatggaggacattggagaagacaatataaggcagaggaaaattatactgcacctgaacaagaagtgcgaatggacaaaaagtattgtaaaaaggaggaagaacacgagtaaagttagtgaaaattagtgttttcatctgggcctgtggatatagatgtatgtttggaagaaggggttatatgaggtatggggagaggtagataataagaatttctggagaaaggttgactagtagcaggctgttttagagccatctaatattacatcttgtaggttctcatccttagtgtgactttctattttcagatgcgtgtggagtagacccggatgatgaacaaatatactcccagggagtctctaagtatggagtgatgagagctattagatctacttgacactatcttgtaccttgcttagaactaagttactgtgagggattatagagacggtttgtcatttattccactgataagtttctgttacttattttgacattgcatttttagtaaggaaacagtgatagtcttctacagaagtagttctttcgatatttgattcttttactttggtgaagtggcttattcatctcaatttgtatgtcagttttataatacaaaatggaaagaaaaaaaaatatatatattttgagacacggtttcactcctgtcacccaggctggagtgtgatggtgcaactttggctcactgcaacctccgcctctggtgctcaagcgattctcttgccttagcctcctgagtagctgggactaaaggcacatgccacgacacccagttaatttttgtatttttgtagagacggggttttaccatgttgcccaggctgatctcgaacccctgagctcaaatgatctgtctgcttcggcctcccaaagtgctgggattataggtgtaagccaccatgcccagccagaaaatatttttaaaaagatgaacaatccatcagtagtgttctatcagttaaaatacatattgtgttttgtttctattactttgcattatacttctatgctatttttgatactgttttaaagataataaaaactcatgaatgcttacgtggtttttaagagtactgtattggccaggcatggtggctcatgcctgtaatcccagtactttgggaggccaaggagggcggatcacgaggtcaggagttcgagaccagcctgaccaacatggtgaaaccccatctctactaaaaaaaatacaaaaattagcctgacgtggtggcacgtgcctgtaatcctagctactcaggaggttgaggcaggagaatcacttgaacccgggaggcggaggttgtcgtgagttgagatcatgccattgcactctagcctggacgatagagagagactagtctcaaaaaaaaaaaaagttccctgttcatgacaggtttttgagaaatagggaaaccaatattagtcatgctcacttgacttcttggaaacatttttatttatttattttttagatggagtcttgctctgtcgcccaggctggagtgcagtggcacgatcccggctcactgcaagctccgcctcctgggttcacaccatcctcctgcttcagcctcctgagtagctgggactacaggtgcctgccaccacgcccggctaatttttttgtatttttagtagagacagggtttcaccgtgtcagccaggatggtctccatcttttgaccttgtgatctgcctgccttggcctcccaaagtgctgggattacaggcgtgagccaccgtgcttggccccatttttgtttttaaaatctgcattgagtagtaataatatggggttatgtacattctaaggttaaaatgttgatacttacaatttcttttggaggtctcatttattaagaattattttagcatctactcatggaagagtaattgttactttaaatctattaatattttgaatgttaattttatagcatgtgataattggcactctaaaagctgctaatagtttctatataggagaaaacctcgaatctaagttgtattacatttctttcctatttgcatcattgggaatgaatgaaggagttgggttttgcacacgttatggttgaatagatttaagtaagtcttctctcagcaggctttagtgtaggtgttaacaatgtcagatgctgacagaagttgattatgttttgtccagtaaaattctgggttaaagaatacaaccatatggttatttcatgaaatagctaaaattttaattaccttttaaatagttttctttaatagtggaaatgcattaccttttagttagctttttacagtggaaaagattaatttttttttctcctggcttttaaaatgctttttataaagtgttatttatatttttaactaaattactcaataatgtatccatgtacacacttacatgagaaacataagtgagattatggagtattcctcagtagcatgaaattaaaagaaaaattttggagattctaagcaagccatggagaaatagaatgttcattaattacttttagtgtttggagttaacctgtatttctgtttctttttcctatttccctgtgttcttattctacttttatacattctccttccttccatacttttgttttttcatttttctgtcttcttcatggtagtattttaaaaatatttctttaactcttcctgtctacattttcttcttcattcatattttcccctctactctattttaacattaaatattagtaagtgagtagagttgaatccattatgatggtcatgtttcttctatccgaggcataacttttaaatatttttatggctaaactaggaagagatgaaggtagctggtttaaaaagaggcttaagcttaaagaagaccatcttctaatatactgtataatcagcatatagtaacattgcttcattttggaaaatgtttatataatacaataagcaaaaatcaaacaaagtacttgtagaataggataatcattgtatgggatctaatattatgttatcaaaaatatatatggtctttgtggtttctcttagtatatgaatacttcactatagaacttcttgataatgacgtttgttggggtcgatctgctacttattacctgtgtcactttggcaagccttttaacctatctgaacttcagtttctctttgggaaatatgctaaataataaccacctttctcatacattaagttcaataacactttaagaaataattatttactgagagatttgtggctaattaaattctttttttctattttataggttatgtgcagagtctgattagacgagttgtaaataatgtaaacattgtgataaataatctcatactaaaatatgttgaagatgatatcgtcctttccgtcaatatcacttctgcagaatgttatacagtaggtgaattatgggatcgtgcattcatggatatttctggtgagtaaatatggagaataccgtatatttttccataattgaaacaattaccttaactcttaacccttctttgggccaactgagttgctggtaaatgttatcaaatcttcatgcctccagtgtgggaaaaaaatgcacatatacaaaatgttgcatataattacaggaggttagtagacactccaaattcagaaatctatacttgtggtttttgtttgtttgtttttgagacagggtctggctctgttgcccaggctggagtgcagtggtgtgatctcagctcactgcaacctctgcctcccgggctcaaacaatcctctcacctcagactcttgagtagctgagactacaggcacatgctgctatgcccggctttttttttttttttttttttttgagatggagtcttgctctgtcgcccaggctggagtgcagtggctcaatctcggctcactgcaagttccacctccccgggttcacaccattcttctgcctcagcctcccgagtagctgggactacaggcacctgccaccatgcccggctaattttttgtatttttagtagagatggggtttcaccatgttagccaggatggtctccatcttttgaccttgtgatccacccgcctccgccttccaaagtgctgggattacagatgtgagccactgcgcctggccaaatttttgtgtttttttgtagagacaaggttttgccacattgcccaggttggtcttgaactcctgagctctagcgatttgcctgccttggcccctcaaagtgctgagattacaggaatgagccaccatacctggcctatacttgttttttaatacttttaattttcattctttcttacttgccacatgcttgtttcaaatgtgatgtataatacagtcatgcattgcttaacaacagggacatattctgagaaatgcatcttaggcgattttgttgttatgcaaacatcatagagtgtacttacacaaacctagatggtatagccagtacacaacctcaggtatatggtattggctattattgctcctaggctgcaaacctgtacagcatgttactgtgctgagtattgtagatagttgtaacacagtggtatttgtgtatctaaaaacagaaaaggtatagtaaaaatatagtattataatcttatgggacagccatcatagatatatagtctgttgttgacttaggtattgttatgcagtgcatgactatattttatagtgccatgggttgtagcaataaaagttaaatgatatttagtttgaattgtttatgtttttgaaaggtgaaaggcatcatgtttcatttacaaagcttggtgaaggcaaggcaatatatctgattgatttatgttttaggcttgtgtgttccaaagcacatttggaatttcttccttcttttcctcccctctccccaccgtcccccctcccctctccctttcatcctcccttccctttccttgcttctcccctgcccctttccctcttccccctttcctttttgagaaagggtctcattctgttgcccaggctggagtgcagtggtgctaccttggctcactgcagcctcgacttcctgggctcaggtgatcctcccatcttagcctcccaagtagctgggaccacaggcgtgcactaccatgcctggctaatttttgtatttttttgtagagatggggttttgccctgttgcccaggctggtctcaaactccttggcttaagtgatccacccaccttggcctcccaaagtgttgggattacaggtgtgagccaccatgatagccctggaatttcttgattatcctgaagcctgtttttatctctttttaatgtttagtcatatattcctttattcatcataaatcccagttaaagggttaaagcaaagtgaaattgagtctcaagagtatttaacttgcctgattaaggcatacaactaggaagtagcagaactggaatagagttttattattatgtgttttctaagctttagtcttcacatttaacaaaaggagagtagtcctgattttacaactttgttgtgagcataaaagtgtaggtaaggcccaagcatcatttcttatatatcgttaatgcctcctttgcatcttctgtggaaagaaatatttgattaaaaggctggaagaagcagctatggaaaatagaaaacaaatagaactggacaatgtaggattgtattaatgagttgacatttgtggtgaagaaattttattttaattaattaattaatttttttgagacagagtctcgctctgtcacccaggctgaagtgcagtgacgcaatcttggctcactgcaacttctgcctcccgggttcaagcgattctcctgcctcagcctcccaagtagctgggactctaggcgcctgccagcatgcctggctaatttttatatttttggtagagacggggtttcaccatgttggccagtctggtcttgaattcctgacctcaagtgatctgcctgcctcagcttcctagaatgctgggattacaggcatgagccactgtgcccacccagaaatttaattttagtatagaagcaatttagtatggtatagaaatttaatttagtatagaagcaatgccagttttactttgggaaattatttatagtgaattagaattctggatcaggagttggaagatcttagtttgaatcttctctccactgctaatttacagtgcaaacttgggtgagtcatttataaaatgactgcttctaacttgccagtgtactcttcagaagcaaatataccatatgaaagctcatgatgatggtggtgataaagacagtgaaaatagtatcttctgtttatttagtaccagggctagtgttacatattttatattaattatcttgtttaaccctttaactctctgaggaagaaactattattttcccttttattagtttttttttaaataattttttttaattgaagcataacatgcaagaaagaaagagcattaagcaaaaacacatagctggccgggtgtggtggctcacgcctgtaatcccagcattttgggaggctgaggcgggcggatcccctgaggtcaggagtttgagaccagcctggccaacatggtgaaacaccatctctactaaaaatacaaaaaaaattagctgggcacggtggcaggtgcctgtaatcctagctacttgggaggctgaggcaggagaatcacttgaacccaggaggcggaggctgcagtgagtcgaaattgtgccactgcactctagccttggcgatagagtgagactccacctcaaaaaaaaaaaaaaaaaaaacccaaaacaaacaaacaaacaaaaaacccatatagctaaacgacataccacaaaatgaacatactcttgtaaccaccaccaagctcaagaaattgaacaatatcagcacccagaagtgcttgttgtacatatactcacttactactgccccttctttccccaaagcaaccactttactgacatctgacaccatagtagggtttggactctttttaaatttttgtatgaatggaaccatatgtattttgggcctagattattttgctcaatattatgtaaatgaaatttattcaggttttcgtctgtaacaatagttcagttctgcgtgtatatatctattccctctccctgcacaatcaggtgagcaagggttggggttctgcctgcactggtctttcctggatatatgtgggatggcgagtttgcaggtctggtctgtgttgtgaataaaacatttttttgctcagtgtaccattgatatagatttaattatgtccagttttggctataatgaataatgctatagcgaacattttcatacatgtcctttggtggacatatacatacatttctgttgggtatatgcctaggagtgaaattactgggtcatagtgtaggcctatgttaagcttcagagatactgacaaatagttttttcataatagtaatgccatttttttactaacaagtaatgcacgaggctgtattaaaatattgcagttaaaataagaattgtaatatctttgtgagggtaaaaaggcaagccacagatggaagtgtatattcttgatacttaaaatttgcaacatacttatatccacaatatataacttctataaatcaataagaaaagaatagacaactcagtagaaaaatggacaagagacttgaacaaacacgtaaaaaagagtataccccaaagaccaataaacataagatgttcaattaacaccaaatcagattgcactaaatacttgccataatggattaaaaaataaaataattgggccatctatctattccttctcctttaactcattccttccccttacgtattttttttttataatttccaagacttttatttcagtataaaggtcttcagaatatctaatcttttctactattagaggcagaatcctatcatctcccatgtggttgacattcaagttgttctaaaatattgacattgcccatagtgctggaatgtacatccttttttatgtttccttgttacgtgtttgaattctgtaaattatgatcaggaaaagaataactgcatatgtaaacattcagttatgttttatattgctgaattgttctctaaaatgattaaatcaatttattaccatccatactatctgtgagaattaatatttctttttattcctttccaagttgtattttaggttgagagggtacatgtgcaggtctgttacttgggtaaattgcatgttgcatgcatttggtgtacagattattctgtcactcaagtaatgagcatagtacctaatggttagtcttttgattcttaccttgctcccaccctccaccctcaagtaggccttggtatttattgttgccttctttgtgtccatgtatactcagtgcttagctcccacttataattgagaacatgcagtgtttggttttctgttcctgcataatttgcctaggataatgccctccagctctatccatattgctgcaaaggacatgatttcatccttttttatggctatgtagtattcgatggtggatacgtcttgtattttctttatctacttcactgttgttgggcatctaggttgattccatgtctttgctattgtgtatagtgctgcaatgaacatacacatgtgcgtgtctttatggtagaaagatttatattcataagcgtgttgcctatgcttttgaggtcttagtcataaattctttgcctagaccaatgtcaggtcttacatttaagtctttaatctatctcgagttgatttttttaaatagtgagagataagggtctaggtttgttcttctgcatatagatatccagttttcccagcaccatttattgaagagactgttcttttcctcagtgtgttttcttggcccctatatagaaaatcagttggctgtaaatgcatggattcatttctgggtttttgattttattccattgggctatgtgtctttttttatgccagtaccgtactgttttggttattattgcttttagtatattttaaagtcagggagtatgatgcctctagctgtgttctttttgcttggggttgctttgagtatttagggtctttgtggttccataaaaattttaggattgttttttcttatgtctgtgaaaaaatgtcattggtattttgatagggattgcattgatttcgtagattgctttggatagtatggaaatgattttggaagaattccctccacttcaattttttggaacagtttgtgaatattggtattagttctttaaatgtttggtagaatatgacagtgaatccaaaggtcttaggcttttctttgattgctttttccaggttttggaagttttctctatttctttgaataagcttcctaacctctttttaaaaatagtattcttatatgttgtattttgggtttgttgttttcaatcaatactatgcttttaatatttctatatattggtgtatatagttgtagagccctaatttcagtgatgaataatattttactgattaaattgtagcacatttctaaagtaagtaccagaaactagaattcattttctaagtttttgaaatatagttgctgttatattttgtgtttaagaaaaaatacctttaaaacagtaatgtcctctttcactgaataataattgtctagggtctagggtatccttgaaatttgaatacttcactttttctttctttcttttttttttttaagagagagtcttaactctgttgttcaggctggagtgcagtggtgtgatcttggctcactgcaagctccacccctgggttcaagccattcttgtgcctcagtcacctgagtagctgtgattttctgcatttgccaccacacccagctaattgttgtatttgtagtagagatggtgtttcaccactttgcccaggctggttttgaactcctggcctcaagcaatccgcctaggcctcccaaagtgctgggattataggcatgaaccaccatgcctggcctgaatagcttacattcttatagcaaagtagataagaacatgcactctgcagtaaggttgccagagtttgaattacagctctgatctttataaactgtataacaatagacagactattaccactgtgcctcagttttcacattttttaacaggaccgtgtaaatattgtcagataagagatgtaaaagacttagtgtagtatctgagtaatagcaaatactcagaaaatgataattgttatcataaagagagggaaggaaacatctacaggatatctttttttttctcatttctggtcctactattgtaatttcttaatttgtgtacatatataatattagtaactaaatcattattcatataatatgtaaatttgaaatatggtagtcatatgtctttttcaactaacagacaactttgaaatttatctgcaaataatactgtttagacacatcttctttaatttctactttttaaaaacttataaaataaaatgttgaattaattagaagttgccaggatatactcagaaatagtgttataacctgaactaaaacacattttattgttttttaaattcccatggctaacttaaaatcactgggcaagtagatttgggcctgatatttacctaggaattgcttatcagttaagaaataagaaatattgatttgctaaaggcttcatttcatacttttatactttaccatcaattgttttatttttattcctttgaaaatatactctagagtgttattggtgatttctttattaattaatgtggtggtgtccactagacctttctgtgataatacaagtgttttatatcttctctctccaatatggtagccactagccacatgtggctgttgagcacttgaaatatagctagtgcaaccaaggaccttaatttttatttttatataattttaattaatttaaatagccacatatggctggtggctaccatattggatagtgcaagtttagagtagcagtgagttttttttaatataaaatgaatgttaaatgaatgacttcttcaaaaaattatctttaatgtggattcttaagaattttattgttatctcattgtgtaagagaactgtagtgaaatttttcataattaaaaaaaatttgtagttaatgtgccatgcagattggggcaaactaattaggtctctgattcttcatatataaaatggggagaattgtgcctatttcataaagttgttggaagatttaaattgtataataaaatgaaaagttcattgcatatggtctggcattatgtattaaatgctccatgaatcttattttctgttattattaattttattactatttatactaataaataatagttgcctttcccctgctaattttcctttttacttaaaatgtttttttttctttttagcaactgatttggtgctgagaaaggttatcaatttttctgactgtacagtttgtcttgataaacggaatgccagtggtaaaatagaattttaccaggatcctttattatacaaatgttccttcagaactcgtcttcattttacatatgaaaacctaaattccaagatgccatctgttattaaagtaggtatctcttttttttgcagttaagttgcatgtctttattttgtttattgactcttgtggatgctaatcattattaacaaatgaagaaattaaccttgtaaatatgtatgccatttgtttttataaaaattttatttatgtttatgatttttatgttgtatttatacatttctgtataacgtattctactagagtttagagacaacttttttctgtaattgtttttttttagtttttccagctgtttattagtgtttctctcttcaagtagatagaggaaataatattaaaaggtatatttatacccacagtggactgcatatcagtattctgtatttcagttcttataatctgttcagcatgatctgctatctatactttttcttctctttactaggtgacttcgtaaagcttgatatactaacctaatagtttattggttcaagaagttttagcttttgatttatgatttttaaaatgtaattaaaatcttagggagttattcaggacatgtctttttattttttatctgcattttcatttaagattaagggatttgttacaagggtatattgtgtgatgcttaggtttgggctcccactgataccatcatccagatagtgaacatagtacccaaaaggaagtttttcagcccttttttcctctccctccttccctccttttagaatccacactgtctgttgttcccatctttatgtccatgtgtacccaagatttagcttccacttctaagtgagaacaggacatgtcttttgatacatgtgaaaattttctgtccaatgtagtgtatgttttcaatgtatgtgattagtatctaagcataaatattgttgtcttatttaacagttttctgaacattgtttgtctgcctatcattgtatcttggaaaaagaattcagtgacttctgatcccattaagtaggttttaatgtggagtaaatgtttattgttgaactacttgcctctgactgtcaaagttctgtagatggaagggctggacttaggtgtctgaacactggtattaactactgttcctgtttgagtatggctgtataaaaattagttttgtttttgttaccttatattttattaaaaatatagtattttctattttacgtagccttactgtacttaatatgtaaaatctacatgtttttttcttggtagtgcttagtcacctgtgttttacttttttccacacggtgtataatgcatattggtttgtttatattctgttactttttccttctatatttgaattagcttctttggcaaagataaacatggaaaagaattaactcagtaatagtgatggctctgtctcagggaaatacgcttattttctatagccttgggttttctagtaaatttggggaatgtgaaggtaaattgaagatacattgaaagcaagtaatggatatatggaagcttactatataaaatactctttttgatcattagtgcaaatgtaatggtctattctaggatgtggttatattagaggaaggtaaaaatagatgaggaaaaacttagtgttggcatataagtaagtttgtgttctcaaaactgattagtcattacatttcactgaaaaagtcccttatcataaataaacttgtataatagttgccaaatatgtgatatcaatgtgttatactcaactgaaatcaattttggaggttttatttctttcttcttttcttttctctctttcttttttctcccctcctctccctctccccacccttcccctcccctctgtttccctcccctctcctccgctttctctccttttttctttctccttttttctttaccttcgaggctccctgtcacccaggctggagtgcagtggcacaatcatacttcactgtaaccttgaactcctggggtcaagcgatccttctgtctcaggctcttaagtagctaggactacaggcgcatgtctccatccctggctcattttaaattgtttttttgtagagacggagtctcactgtgcagcccaggctgatactgaacctcctagcttcaagtaattctcttgtctaggcctcccaaagtgctgggattcctggcatgagccaccatgcctgcctgagttttttgttaatactattgtaatgttaagatttgccattttgggttagacccatcattcttccaagtcctaatcctagggaatatgtattaaacagatatggtcgacctcattaattacttcacagaggtttctcaaaatgttccagatactatatttcttttcttctttttttttgagacggagtcttgctcttgttgaccaggctggagtgcaatggcatgatctcggctcactgcaacctctgcctcccgggttcaagtgattctcctgcctcagcttcccgagtagctgggattacaggcgccggccaccaggcctggctaatttttgtatttttagtagagacagggttttgcccttttggccaggctggtctcaaactcctgacctcatgatccgcctggctcagcctcccaaagtgctgggattacaggcatgagtcactgcgcctggcccctctatttcttttcaaatctttcatgtatgtttattttgaatgtatttatatgttgggttggctttttataattttccattttttttgtgtgagatacatacgttctggtgattatgatgtttatgagatacagatcctatgggtacgtaatttatttaacatttctcctgtttttagaaatttactttgcagtttctcagagcagtgaaattctgtgcatagaactttgaccacatttcctgagtaattccttaggaaagatttgtataattgcaaatatcttttttttttttttaagacctgtgatctgtattgccagattgtttccagaaagatttaaccaggttatactcacatgaacattaaggggagtgcctatgtcatactcttattatccttaaatatgatcatattttaaaaattgccaacttgttgaacaacaaatgatatgtaatttaattgccgtttattagtgaagttagatttttgaaaacacattcactggtcatttgttctttgtattatcagttcaggttctttatccatttttctactgagtattaatcttactcattttaaggagcttttaaaaagatacttatgacagattctttgttattggttttgctgactgcttattaccagtgctattggtgcaatacaagatttaaaagaatgtgacagaggaatttcaaattaaggaaaccttagcagacatgcatactcctttcctgctcacctcccacactcattccccgctttcttacctcttcattgtttattcagtgtatgattattaggtcagtttttaaaagcttgtgctcatatttgaaatatggtatttcacagtccccccatatagttttctcccccttcacatacatttttttatgtgctttgcaccctaaaaatacgatgattaccattactattacttcatctttcatagacactgaaatacattagtcaaaataaaccttctaagagacttgactttatggcataattggttttactccgtgtttagataacagcaggaaaccattacactgaagttgtgtttatattccactgatgtctctttctttaaggagagctttgattgctgtatatcctatttgctagtagttaatcttatttctttgttataatggtttcattttatcagttgaataagttttatgtcatttaaatcttatctacaatttggaaaacttttgttatttaaatcttacttaaaatttgtctgaaaaacttttttcaacatatatttcacttgtttttccatatttgacaaaaatttttattatttacatactttcatagttgtaatactagtcttttccccagttaacatatggttttaggatgtatatgtattctttatggttaataaacctggaaagaatgattagagtttcactaaaatgacataaaatttttattattcttggttttgacagattgttctgttttttgaggataatactgttattctcttaatgttatagagtagctatttggttatataactaactttgtttctggaatagtaatctggaaatctagtgtgattataccttctcactattaattccatttgtatgtacatcatttggtttaatatcgtttctatctaacgtgtattgatcatcatagcaaaatttacttaattcctaagatcttagagtaagtattgttttgatttaagtattaaaatgtttggagcatttcttttatgttatgccatttaaagactttaaaacatttctttatgtaaaaaatactctttttaaacatgcgtttgttggtgttatgtctttttcaaaatgcagattcatactttagtggaaagtttgaaactttctatcacagatcaacaactgcctatgtttattcgtataatgcaacttggaattgctctttactatggagaaataggcaattttaaagaaggcgaaatagaggaccttacttgtcataataaagatatgctaggaaacattacaggtaatgtaaaactttattaaacaaaaactttattttaagactattcttacgttttaccattgggaaactttaaaaaatgtattagcttgagttttacagtattctaatgagatgggctgattgttttttggttgttttacactattttaatttttttgtttgttttgttttgagatggagactagctctgttgcctgggctggagtgctgtggtgcaatcatggctcactgcaacctctgcctctcaggttcaggcagttctcttgcctcagcctcccaagtagctgggattacagacatgcatcaccacgcctgtgtaattttgtattttttttttttagtagagatgggttttcaccatgttggccaggctggtctcaaactcctgaccttgtgatctgcccgcctcagcctcccaaagtgctgggattacaggcatgagccactgtgcccagcctacactactttaattttatctacatgctggataacattctgattttctcctatatgctaaaaataacttctatatttataatagatataagtgttcagaatgtactacttatttatttatgaatgagggttttgctctgtcacccaggctggagtgcagtggcatgatcatgggtcactgcagccgcgacctcccaggctcaggtgatccttctaccccagccttccaaatagttagggctacaggtacatgccaccatgcctgggtaatttttgcattttttgtagagacagggttttgctatgttgcccaggctggtctcaaactcctaggcataagctatctgcccgcctcagcatcacaaagtgctgggattacaggcatgagccaccatgcctgacccaggatatacatttgataaaagttgaagtagtatacctcaagatttcctagtaaataatagtattggtaatttttctgcaaaagttcacttaagttgaattgagttattttagtgctgttaattaatgaaatgtatacttcattgaaggatatgtaatgtgggaaaatacagaaatcattttgatgtatttctttcccttagaattttaagataaaatgggacagatagacatgtcagtagttagttaagtatgatgaatggtagaatggcagaaagtttgataaatatcatgaatgatctgatgtagaaagatgaaaggatgactgatttcaacttggtattgggcctgagactcagaaagttttcaggtgattaatttccatagataaagccctaagagaagggcatttaaaacttaggggcaaataacccaattaaaaatgggcaaagagacatttctccaaagaaggtaaacaaatagcaaacaagcaaatcaaaacctcagtgagataccacttcacaggtactagatgactataataaaaaaaaatacaaaataacaggtattggtgaggatgtggagaaactggaactcatataagttgttgggagtgtaaaatggtatagttgctttggaaaacaatatggcagttcttcaaaacgtgaaacatagagttaccatgttgacccagcaattccattcctacgtgtatatcaagagaactgataacatatgtccatgtaaaaacttatatatgaaatgttcatggtaacatattcatagtagccaaaaactggacacaattgaaatgtctgtcaactgatgaatggattatcaaattatggcatattcatacattggagtattatttagctgtacaaaaaaatgaaatactgatataggctacagcatggatgaaccttgaaagcattatcttaagtgaaagcagccagtcaaaagataatacatatgatatgattccattagaaatgttcataataggcagttctgtagaggcaggaagtagattagtaaccaggagttgcggggaggagagaatgactgcaaataaataggtttctttttggaatgatgaaaatgttctaaaattagatagtggtgataggagcaaaacttgtgactattaaaaaaatcccactgaattgtacacctttaaatgttgaattttatgctatttaaactttatctcattaaaaaaatcttactaccttaaaataaagcatagagaacaacattaatcagagtatgtagatataaaacatacctttatttcacactagagggtaaatttttgttagacaatgcattgctgagacagaaacagtgtcttatacctggaacaaacataacatgtagaagatacttgatttatttttttccaacttgacaaatttcaaatatatggaaaagctgtaagagttattataaggtgaacactcacagacttatcatctggagtcttctattgatattctgttacaattgcttcatcacatattggttcatctaacatccctttccctatttatcaatacaattgtttttgatgcctttcaaattaagttacatacattgctacacttcacccctaaccctcagctgcctgttgttatctagagtttctactaagtggtgggtctttttattttttttggaggttaaatctccaaagtaaaattcaatgagtttgagaaatacatacacctgtgtgatgcaaaacactcatcaagatataggtcattaacatctgagatagtttcttatgcccctttctagtcattcccctttcacctgcctgcctccccgcgagaaaacactgttctgaagttccttaaaactgtagatttagttttgctgattctagaatttcatataaatggaaacactcaatatgtataaaaggcttctttcattaagcatagtgtgtttggtatttatctatgttgttgcatgtagcagtcgttctttccttttcattgctacatacactgtatgaatataccatgtgaatatactatagtttattttaccattcactgtttgatggacacttgggctgtttttcgtttttggctattataaataaagctttcatagatatttttgtacaaatttcacgtagacatgtgctattctttctcttgggtaaatacttaagagtggaattatatgtttagttttcaaagaaacttccataacttttttcaatgtggttgtaccattttatattcctatcaacaatgtgtgagagttgcagttggcctacatccttgctaacattcaatggtgtattttttcacttttttgccattgggatgagtgtgttgtggtatctcatggttttttaatttgcattttttgatggctaattattttgaatttttaatgtgattatcggcctttatctgcctttgtgaagtatgtgttaaatatttgtccatttaaagcttttttgtgtcttttaaaaattttattttactttatgtatttattatttatttattgacatagtctcactctgttgcctaggctggagtatgatggcatgatcatagctcactgcagccttgaactcctgggctcaagcaatcctccagcctcagcctcccgagtggctgggtgggactacaggtgcacgacactgagtgtggctgataaattttgttttgttttgtttttggttgaggtgggggtctcactttgttgcagtaggctgttcttgaactcctggcttcatgtgattctcccatctcgggctcccaaagtgctgggattataggaatgagccagtgggcccaacagggtttgcaccttatataaaacttattctgaactacaatggcttaagtgtcttggtactgttattttagttactctagttaattcttattaagccttttccttctcaggtgaaagaaggtaaacattcataacctataaatgtagaatgttccaagagtctcctgtcataagagtttaaaaagttataaagctttttgagtaagaaaacctgtaaggatgttatttaaagatttaaaggagtatgtgtatttatagatttatcaatggagagtagatatgagtgaatatgctggagactaatttttccatggtgttttttttttgtttgttttttgtttttagacagggtccagggtcttgctctgtcacccaggctgcagtgcagtggtatgaaacatggctcactgcaacgcctgcctcctggattcaagtgattctcccacctcagcctgccaagttgctgggaccataatgggtgcacaccaccacacccagacaatttttttgtatttttagtagggacagggtttcaccatgttgcccaggctggtctcgaactcctgagcttaggtaatctgcccaccttggcctcccaaagtgctgggattacaggtttaagtcaccgatcctggcccctatgaattttacacccggacagtttttttgtatttttagtagggacagggtttcatcatgttgctcaggctggtctcgaactcctgagctcaggtgatctgcccaccttggcctcccaaagtgctgggattacaggtgtgagtcactgctcctggcccctatgaaatttttaaaaagtaatttttttttctaaatttcatgatgcctcttttgtttatattgctataattatattaaaggactttgatggagtttgtctttacaaaggtggcataaattaaagagtagttggaatctaaatctttggtctgccagtttgtaaccaaataaaatttcttggctataattttttcagctgtacaacaggaaaggtataacatatcttacttgctagtaagaaagaggccccaacattattatttttcttaactacatataaaagttgttttattctaatatttgctttcatttttgggataattcttgtttgggcaggggagcattttgcctagaagcacttgccattttttttttcctccatgggtgctgatcaggaaatgaagaatgtttcttgggtctttgtggtattatgtttctgagaaaagtcagtttttcaatatatcagccttatttttgagaggtaggttttttgttgttggtttaaaacattcatgagcgatgttaaagaattaatttattatttgtctttatcaaatacagttaaaagttatgtgcagttgataaactactttccacatcacattaaccataacctactaaaggagaaagatacggtacaacatacagaaagttgagagtcataatgctaaattattggtttcaaatagtaataatcactgtatcatttgtttataccttatattagaaggatatgggaggaaaaattttaaaggatgtctatttctattctcttagttaaatccttttgacttatttaaaatgacttaattttaattgataggttctgaagatgaaacaagaatagatatgcaatatcctgctcagcataaaggtcaagagttatattcacagcaagatgaggagcagccacagggatgggtgtcatgggcctggtcctttgtgcctgcaattgtgagttatgacgatggcgaggaagactttgttgggaacgatcctgcatcaaccatgcatcaacaaaaagcacagactttgaaggatcctattgtttctataggattttattgcacaaaggcaacggtgactttcaaagtaggtcttttctcttgctgtttatatctctatcaactttaatgcttaaatttggattgttagtacaattctagctttattcaagtttgctttgcattcagtagatgtgagatagagtctaacagttcttacttcataaaattacatggctcctccacttgaaatctttgaattctgatcccttcctgtcttcttagggcattctccacatttcttttttattagcttcatggatagttttttgccctattgaatcattcagttggtgtacaaacatgccttaatattgtcattaaaaaagaaaggaacagcaaaaattttcccgtgaattcttttacctgtcaggtacggtttcctttctgtgctctccttcgtaacaatcataacaatctctctctctctttttttttttttttttttttttgagacagggtctgactctgttgcctaggctggagtgcagtggtgcaatcacagctcagtgcaacctctgcctcccgggctcaagacatcctctcacttcagcctcccgagcagctgggactacaggcacgtgccactgtgcccagctaatttttttttttttttaatattttgtagagttggggttttgccatgttgcccaggctggtctcgctcctaggctcaagcgtttttccccctttggcctcccaatgtgctaggattacaggtgttagctatcacgcccagcctcataacaaatttttttttaaaggattgtttacatataattatctctttcctcatctctttcgcttttcaagacaaaattgttaactaggtcctcttctagctatttttccagcagtatttaacataacttgacgacttcctccattaacataatgcatgtaaaatacctgttcttatctatacaaaaatatatatgatatatacaaatatgtgtatgtctaggttaaagaataataaagtaaatacccctttacttgaagaaatataaaattatgccaggcatggtggctcacatctgtaatcccagtacccctgcacttcagccaaaataaatataaaattcctagtagctttgatcccccatgtgttcttctttgatcatattttaccttctcttcctctcacatataacccaaacttaatttttgagttatttgtttcctggacttttataatgctattaccatacatgtaatattcctgaataatatcttaattcattcaacaaatattttcaatgccagctgtgtctaagcattgttttgtctccagagataccagagtgaacagatataaattcctgctttttcaagcttaaattgatattataaacaaataacatatatattgtgttcattgaatataaaggttaggtagaaaaatcaagtgggggccagacgtggtggctcacgcctgtaatcccagcattttgggaggccgaggcggccagatcacctgagatctggaattcgagaccagcctgaccaatatggagaaaccccatctctactaaaaaaaaaaaaattacccaattagctgggcgtggtgacgcatgcctgtaatcccagctactcgggaggctaaggcaggagaattgcttgaacccgggaggtggaggttgtggtgagctgagattgtgccattgcactccagcctgggcaacaagagcgaaactctgtctccaaaaaaaaaaaaaaaaaaaaaaagaaagaaagaaaaatcaagtgggaagaggaatagtgagtgctttcaccagaggggatattatgcagtttaaaatgggatgatcagggaaggccttattatgaagggaatattaaagcaaagacctgtgaaagaggaagccttattgatatttgagaatgaacattccagtaataacaaatgtaaaggcaccagagttcaagaaacagcaaggaagccagtggggcagtagtgtcatgagatatcatgaatgaatgtggtatgaaagataagaggggtgatgaggtttggagtggttcacaagttgtaaactgtgtagatcatttttaggactttgtcttttattctgagtgagataaacaatatttggccagtttttagaagaattatatgatctgggttatattttaatctggatcactgtggctgctgtgttgaaagcaaaagtaaggaaaagaaatagataggaatgcaattttcaagcaagagatggtaatgacttggactagggtgatagcaagtggaggtgatgaaaagtgattgtgttttggatgtgttttgaaggtcaaataggcagaatttcctgatagattttattatgagacatgaatgaaaaaaaaaagatgatccaaggatggctcttaaacaactagaagagttgagctgtgacattttgagatgactgggattgggagaagactagatttgagatgaagatgaggaatttagttttggataggtttaagatgcctgctgtatatttaagtagagtaacttagtggagagttggatatatggatctagaattcagattagaagtttgcctaggtgcatatatttgatagtcatgatcatattaagactgaaattagtgtagaatagaaaaaagaggttctagagccaagctctgaggcactgtgatgataagaaattggaaagatgaggaagaaatagcaagggaagctgagaataagtgatcaatattgtaggcagaaaaccaagagactggaaggtaagtaccataaaggttttaaagaggagggaatagattatttgtaagaatggatccttggatttgacaatgtggaaattactggtgattttgagcagagcagtgatatgacactgttagaatctttgctggagttgattaaaagcaaatgggaagactggtagaaatgtaaaatagtgcgtctgctgtggaatatagtttggtggttccacaaaaaattaaacgtagaattaccatataatctagctattttatttctaggtatgtactcaaaagaataaaaaactggtattcaaacaaattggtgaacataaatgttcacagtagcactattcagtgatctcccaaaatggaaacaatccatatgttcatcagtggatgaatgaataaacaaattgtggtatatacatacagtggaataatattcagccataaaaaaatgaaattttggccaggtgtggtggctcatgcgtataatcccagcactttgggaggctgaggtgggtggatcacaaggtcaggagtttgagaccagcctggccaacatgttgaaaccctgtctctactaaaaatacaaaaagctgggtgtggtggtgggtacctgtaatcccagctactcgggaggctgaggcaggagactcgcttgaacctgggaggcggaggttgcagtgagctgagatcacgccattgcactccagcctgggcaacaagagcaagactccgtctcaaaaaaaaaaaaaaaaaaaaggaatgaagttctgatgcatgctaaacatgaatgaacctggaaatctctatgctgaatgaaataagccagacacaaaaggacaaatattttatgattccacttagatgatgttctctagagggacagaactaataggctatatgtatgtatgaaagggagtttattaaggagagttgactcacacgatcacaaggtaaagtcccatgataggccgtctgcaagttgaggagcaagtaagccagtgatggatcagtcggagtcccaaaacctcaaaagcagggaagctgacggtgcagctttcagtgtgggccaaaggcctgagagcccctggcaaaccacaggtgtaagtcccaaagtctaaaagctgaagaacttggagtctgatgttcaagggcaggaagcatccagcacaggcgaaagatgaaggccggaagactcagcaagtctagtccttccacattcttctgcctgctttatcctagctgtgctagcagctgattagatggtgcccacccagattgaggatgggtctgcatctcccagttcactgactcaattgttaaactccttcggcagcaccctcatagacacacccaagaacaatactttgcagccttcagtccaatcaagttgacagtcagtattaaccatcacagatgaggtatttagaatatgcaaaatcacagaaacaggagtagaatagacatgctagaggctgtaggatacaggggagttgagttagtgcttaataggttcagagtttctgcctagtatgatgtaaaagctctgcaaaaatatagtggggataattatgtaatattttgtactaaatgccactgaattgtatattgacaagtggttaaaactataaattatattatgtatattttatgcaaaaggacagataaaaatgcaaatggtagttgagtaattgttgaagagtacagaaaactctttcaagacagttttgttataaagagcacagaaatggggaaatagctggttggggttgtggagctaaagacttttttttttttaaagatgcaggtaattacagcatgtttgtttggtgatatgagtgatctaatagagaggaaaaaatcgatataggcaagagggggagaattggctggagtaatattcttgagtggataagagggcttggcacctcttgtagagatggaaagtctgatgatctctaatgggacaataggtcattaattcatgatagcaggaaagaaagcaatgtgatcttgcacccacataagtggtttggtagaaaaggtgatagcggtttttgaaagttctctttggattatttttttctttaaatagttctcttaactcagagtaagcatggggaaggaggagaagctttgaggaaagggaagaaggtataaaattgtcatcttggggaggatgaggagtaatggcctttgaatatgtatgttcactagggacactaaggacctactacacaaaagtgatcatgaatttgaagatataccagtcattgtggttgtatgtatttttctggtcatattctgctgctttagttagggtgatggtgaaaataatctggaggacaagatcaatgcagaagaggtggtcaaaaaactgagaaatcagacttttggaatgatcatctctctggatattgaaatcaccaaggattatgacagtggtagtgtgggactgaatccaaaattaaatcttcagacaactagtagaatgatgtgggattgatttatgagtctaagaaagagggataatgggtcttacagtctgttccatatattttgctatattttgaacaatgctgatgtaaatgttctggtacagatcttctgacatatatatgtggaagagtttctttgggatatgcttctttttctttaaaaatgttatcgctgggcacagtggctcatgcctataatcccagcactttaggaggccaaagcaggcggatcacttgagcccaggaattccagaccagccatgcaaatatggtgaaactctgtctctacagaaaaatacaaaaattagctaagcaggatggcgtgtgcctgtagtaccagatacttagcaggttgaggtgggaggattgcttgagctggaggggtggaggttgaattgagctgagatcatgccactgccactgcagcctgggtgacagagcgagaccttgtctcaaaaaaaagaaaaaaaaaaaagaaagaaaagaaaattatatctgggttaccagggacttttttgtagtcgtttttggtgcttctcctcttctgtatgacctttaaatgttggcatatagggcttggtctttgaccctctcttcttttctatctacaaactcccaaggtgatataactccatcatgatatagatgctgatagactaccaaatttgtgtctccacttttcacttttccctgagctctagaattcaactgccaattttatatttccactttcatatctgattgatacttaacacatacaaacagaactcttgatttttctttgcagttgtgcacccccacccccactattttacctttcattaaattgcaacattatctactaatttgctcaggcttaacatttatcagtatcttttcttctcccaccacatctaatcagtcagcatgttctgtcagctgtacctctaggatgcagtcatttctcatcagctttattgcaacttatagaccagtagttttcaaactttttgatctcaaggctccaggaaacctttgcattcttaaaaattattgagaactctgaggagttttgtttattcagattacatctactcatatttattgtattagaagttaaaacaaatcttaagaatatgtatatattaatttattttaaaatgaatttattatatgttgatgtgaatatcattttataataaaagtaaaattactgtattttaaaaggtaagaagggacatgcattggttttatttttgtaagtatcttgaatgtctggcttagtagaagatagctgaatttttgtgtctgcttcagtattcagtctgttaggacatgttttaattaatgtatatgaagaacatctagcctcacatagatatttatttggaaaggaaggggtattttaatagccttttgaaaaattatggatattccttttgatattacactaaagctcattaagtggtaattttaaaaggtttgttgggctgggcatgatggctcacacctgtaatcccagcactttgggaggctgaggtgggcggatcatgaggtcaggagttcgagaccagcctggccaacatggaaaccccgtctttactaaaaatagagaaattagcctggtgtggtggcaggcgcctgtaatcccagctacttgggaggctgaagcaggagaattgcttgaacctgggaggtggaggttgcagtgagccaatatcgtgccattgcactccagcctgggtgacagagcaagatactgtcccaaaaaaaaaaaaaaaaaaaaaaaaaaaaaaaaaaaaaaaaatttgttgtttcttcagcacttagaaattgcctggtatgttttctacaaatatttattttttgaataagtatgtgcatccatccattatccatacatctgcccaccttttcatctgcttttcagtttacaaaaatttatggactcatttttcaggttttgtttcctctccaatttcattttttgtgggtttattatttcatgtctgcatttttgtaaaggagataaacccatgtgaaatgagctaaacttttgaaatagtggtataggtattattccaggcaacttgttacattgtggggttgcagcagtggaaaaaaaaaaagtttctgttcccatggttttaaatttagcatagattttctttgtattagtactaaagctacacaatttataactacaacagatggcaagttataaaatactttaagatagctggactcagtggctcacgcctgtaatcccagcactttgggaggctgaggcgggcggatcatgaggtcaggagttcaagaccagcctggccaatatggtgaaaccctgtctttactaaaaaaaaaaatttacaaataaatattaaagacttttctacttaagataattcaatgttttctaatatgacaaaagttgaaaaatatagagaataaatttcaactaaagtttgtgtcatagcttgattgatttaattttttaaagtttgggcaaaaattataatgcatatattagctgtactattttaacatcattattctcagttctactgaaaaaaattatttttgtgattgaaattcactgatttagcattgattaaagggataaggattcatcttcaaaattaaaatataataaaataagatattaaaaaatataataaaaaggcaactgttgataaatattgttggatatgttgtcagtttttttaatatcaaaagtcctgacatatagcctgggcaacatagtgagaccctgtctgtacaaaaaataaataaataaattagcagggcatggtggcgcttgcctgtaatcctagcaatttaggaggctgaagtgggagtattgcttgagtcctggagtttgagctgcaatgagccatgttttcaccactgtactctagcctgggtgaccaagcaagactgtgtctccttaaaaaaaaaaaaaaaaaaaaagtctgacattttgtaaaaagaaaaaaaagatatattgtcagttttagattggaataaagcacttatttttgtggaagattgtgagggaagtcaaggattacaagttaagtaccgtcctttctggtgattttttcctgtttagttttaaatttgaaattattctgatatatttctgttaacttgattgttgagaggaattatattcaacggaatcagtcaaaataggcatttatccaacctgggcaacatggtgagaccccatctttataaaaaaaaatagccaggtgtggtagtgtgcacctgtagtcctaactactccggaagctgaagtgggaggattgcttgagccctggaggttttaggctgcagtgacccatgatcgtgctactgcactgcagcctgggtgacagaggaagaccctgtgtcaaaaacacaaacaaaggcaaacaacaacaaaacaaaatagtcatttgtgtataaaatttttatagacttcttgggcagtatttgtcaatagttaatatatctttttataattttagaacatttatgtttcttaaagtttgctcttagggaaataccttgatattaaggaggaaagcattagaattcattgctcagcttagatttgaagaatgtttggaattaatttctggttcatatttttgttaagaaaacaagatcatgtttctacattagcattttgagcagttgatatcagtccagcaaaaatcatgccaaattaaatctagcatttttctaagaatgtttaaaattattcttgtaatgttcgggtcctttttttttttttttttgaggcagagtctcacactgttgcccaggctggagtgcagtggcgcagtctcggctcactgcaagctctgcctcccgggttcacgccattctcctgcctcagcctccccagtagctgggactacaggtgcccgccaccatgcccggctaattttttgtattttttttagtagagacagggtttcaccgtgttagccaggatggtctcgatctcctgacctcgtgatccgcccacctcggcctcccaaagtgctgggattacaggcgtgagccaccgcatgagtccttttaatcaattaattgctttttctctataataattgtagacagctgaagagggatcaatttaaaaaaattcaagtttacttcagtaatcattctagattacagaattgtgctttaaaatagctacattgtatatatcagtactagaaacatccaagaaataggagtctacattacataaaaatataaaatataaaaagctttattataaagaatgagaataattagttgatactcaatatagagaagtcactgtgcttaaaattgtaactttctagttcaagaactttcattaggcctaagttaaatattggtttttttaaaaatgtgagctttgactttgcatttaaaagtgatgaatatatctatgtcgtaagaatgaggggaagtaaataattggcaaacacatgctgaataccttttttaaaaaagtaaccttttctttttggaataattttagagttacagacaggttgcaaagatagtacagagagttcctttatgttctttacccagtttcccttattgttatgttatcacagtatatttgtcaaaactaagaaggcttcattgatgcattactgttacattttgaacattaattgaatttcatgatatgttttttctgtaccgtgattcaaaccaggataccatgttgcatttagaatagtacttttgtaaaataatttatgtaatttttgaaacatataaataatatgttataagcatctggggagttaagaattttttgttttgttaatatctagattagtacaggtgtacctcagagatattgtggacttggttccataccaccacaataaagcgaatatagcaataaagcgagtcacagaaattttttgttttgcctaatgcataaaaaattatgtttgcacaatattgtagtttgttaagtgtccaacagtatgtctaaaaccactatatataccttaattaaaaatactttattgttaaaaaatgctaacaatcatctacactttcagcaagtcataactttttgctggtggagggtcttgactcagtattgatgattgctgtctgatcagggtggtggttgctaaaggttggagtggcagaggcaatttctcaaaataagacagcaatgaagtgtgccacgttaattgactcttcctttcatggaagatttctctgtagcatgggatgctgtttgactgaattttactcagagtaggactattttttttgagacagagcctctctctgtcacccaggctggagtgtagtggtatgattttggctcactgcaacctccgcctcccaggttcaagcaattcttgcacctctgcctcctgagtagctgggactgcaggcatgcaccaccacgcttggctaatttttgtatttttggtagagatggggtttcaccactttggccaggctggtctcaaactcctggcctcaagtgatccacctgacttggcctcccaaagtgctggcattacaggcgtgagccactgtgtccggcttcagagtagaacctctgtcgaaattgaagtcagtccttttcaaacactactgctgctttatcgactaaatatacagaacattctaaattcatcgtcatttcaacaatgttcccagcatcttcaccaggagtagattccatcttcagaaatcactttctttctttatccataagaagccagtcctcttcaggttccacttctaaatctaattctttagtagttacttcctccacctaagtcttgaatacctcaaagtcatccaggagggttaaaatcaacttctttcaagctcttgttaatgtggatagtttgacctctttctatgaatcacaaatgttcttaatggaatctggaatagtaaaccctttcaggaaagtttttgatttactttgcctagatccatcagaggaatcactatctatggtggctatagccttacgaaatgtattccttaaataataagacttgaacatcaacattactcctaatccatgggctgcagaatggatgtcattttagcaggcatgaaaaacaatattcatctccttgtatgtctccatcagaggtgtagggtgaccagatgcattgtcagtgagcagtaatattttaagaggagtccttttttttgagaagtaggtttccataggcttaaagtatttagtaaaccatgccataaacagatgtactgtcattcagtcattttttttccattcatagagcacaagcaaagtagatttagcatgattcttaagggccctaggattttcagaatggtaaatgaacactatcttcaacttaaagttaccagatatgttagcccctaacaagagcatccgcctgtattttgaagctttgaagccaagcactgacttttcctctctagctcagatgacatcttcttccaggagaaggctgtttggtctgtgttgaaaatctgttgattagtgtagccactttcgttaattatcttagctaggtcttctgggtaactgcgtgcagcttctacgtcaacccttgcgcttttatggtatggagacgtcttcgttccataaggctcatgaacagacctctgctactgtcggacttttctcctgcagctttcttacgtctattagcctacatagaatttaagggttagggctttactctggattcagccttggcttaagggagtgttgtggctagttcgattgtctatccagaccactcaaaattcctccatatcaacaggctgttttacttccttatcacttgtgtgtacaattttaatttccttcaagactttttcttttgcattaatgactgggccaactgtttggctcaagatgcctatgttttggcctgtcttggcttttacatcccttcttcactaagcttaatcatttctagcttttgatttaaagtgagagacagggactcttcctttcacttaaatacttagaccattgtaatattactaattagcctaatttcaatattgttctgtctcaggaaataggcccaaggagaagggagagaggggagtggctagacagtggaacagtcagaacacacacatgtatcaattaagttctcagtcttaaatgggcatgttcatggtgccccaaaatagttccaatagtactatcaaagataactgattacagatcaccataacagataataataatgaaaaattttgaactattgggagaattaccaaaatgtgacacagaaacacaaagtaagcatgtgctattgggaaaatggtgctgatagacttgattcatgtggggttgctacagacttccaatttgtaaaaagtgcaatatctgcgaagtgaaataaagcagagtgcaatacaatgaggttcgcccctacttcttatctagctggctttcaataagtatttgttgcatgattgaatgagtctatgagatttagtaggaaacatcttttgaaaagaaatatgcttgattctatttccttcataggaactagaaagagcctgttttatctttttgcatttcatcaccactttcttttttatttcaaatagtgagaagtcttggaaatgactgaaactacacgttgttgaatgttttgttgaatataaaatgaactgaggttatactatatgtaaatttttggcagaatacataaatgattttgtgagtatgggactgttattgcacacagctttcactttttaaaacaatattaagaaggagtttaaaaagtatttaaattctctatatacgttgagactagcatattcaacctttataccatggataatctgttacagctgtttttgttgcacctgctttcctgcttaatatttaaatttcctgaatcttaaaattggccttgttttaatcaattaatcatcataatgacaatttattgctctttaatactaaatttgatttacttaatattcttatatttcttagctcacagaaatgcaagttgagagtagttattacagtccacagaaagtaaaatctaaagaagtattgtgttgggaacaagaaggaactacagttgaggtaatctttcaatattgaacctgtatttttaaatattttgttctttaatattttataaatacctgtttttatcagatgtagtgtatttaaaaatacaagtaagatgtttgtttcttattttaatagagtttactatctcatggatagtataaataaatagtatagaataaatttaaaaatgacataattctaaagatgtttaactaatttagagattctacaaggaaagcctctaacatttttattaaattcaattcttagttctaatgtttcctttcgtcttataggcccttatgatgggagaacctttctttgattgccagattgggtttgttggttgcagagccatgtgccttaaaggaattatgggtgttaaagattttgaagagaatatgaatagaagtgaaactgtaagtccgtttcctccatccttttttggataggatataggaataattaagtgcttactgaagtgtttaaccatataatatctgttagactatatatatctcaggcttgagagaggagctttactatttctccctgtgtttcacctgccagaaattatagatctcagggaagtttagaaagttggtagcgcctaacacctggacagtagttccaactactttcttattcatgaatctttcttcttttttgttcatggcagttatttggagtttccttttggtttgtaaaaatgatctttggcaaaatagtcaatgaaggtggagcagcagcattccttatctttctgttttagtgatttcttttgactagtaaatgggcatcataaaatcaaggttttattttgtttaacaggctaatggtttttcttcccatttataaattttgcatttgttttcaggaagcctgtttcttcatttgtggtgacaatttgagtacgaaaggtttcacataccttacaaattcattgtttgattaccgaagcccagaaaataatggtactcgcgcagaatttatcttggattcaactcatcataaggttagagaatatatatttgaaccaaattctaggctgtgtttgggtggacacattgtatgaatacttgtgatttctagctttcttttcaaataatgccttctgaatgctaattgtttattaaaacatttagaatgcatttatacagtatacatgtagaaatgtttgaggagtgcacagagatcttttattgaatatgtaaacatattttgcttatttatgccctgcttcaaaaataatcgtggaggaaacatgttgaattacctctgttaatttttgttacttttaatgtgtgggattgatgtaaagaaatgaggaatttacctttttactatctatacttcttagtgttttttaaatgtaagaatatattaatatgtttatggaatattaatacatttatgaaatcagttaaaaattcagataattacctgaagattaatgcaataggataatttacattttactctttttttatcaagatttacttccattgttaaaatatttaatgttgacttgcataattaacatacatttagaatatttcagtatatctttagtgtttgaattgtttcatgatatgaagtatttaaggattaattctatttgagagtatacattattagacagttttgtgatagtgataaaggtcaggagtgtactatctcctccattgtaggtatttattaactagacatgattaataaagtggtcaaaatgtctcataaaagtatggatgtcttttttgtgtggtctgtaatagatggaatattacctttcttagaagtaaattcttggaataacctctgttcttttggtcatcctttgtgttgttatacattctatataaagatatgtgtctaacctatcaagctttaaactcaaaagtttcttttatacaatgtttattctgtttgcattgctttgttggcaggagacatacactgagatagctggaatgcaacggtttggggctttttatatggattacctgtatacaatggagaacactagtggcaaaggtattggcttctttcctttatgtgtgccatttcttgaacaactgaaacaaagccttcctcagaatcaattggtccttgactggttgtactctgctacataagatttatcttctagtactttggggagtggtttaattttaacatcatgttagaattgtcttagattcttgtcatttcaaatccattctttatacagctgactgaagacattttgtataacctgttagaattagttctcatgtgtaccatatattatgattctgatatatcaaattttatattacattaaatttttaaaaagaataaaccttttctattctaaatacactttgaaggtgatactaatttttaattaaaaagaatgtgttgtatcaatcagaaaaatagaaaatcttccagagactttagatgtatatattgtattattttattatgtaccttattattgtattattttctattttttggaaataaatgacgtttaaaacatttcaacacttttttttttacttctatatcaatatatgatgtacttactatttcagtcttttttatgttgaaaagttagcgaaaataggttcacagttttttttggtgaatttttcatgttttataaaaatgatttcagtgtattaggtgatatgttaggtacagatgaatgcaatgaaaaccaaagcatttcccaaagagccaataggtggtgttgaactaggcatttaagtaaatgattataacgtagcatgttaagaagagtagtatagagaactagaagtgtgggtaaaaaaaaaaaaaaatgacaacttttgcttgtgagattgaaacttcgcagagttgatcttgaagtaaatttgtttttgatgaagaaagaaggaaagagcagtaaatttctggcttctgcttttggaatggtttctaaatgttgatgttttcattggtcaatccttaatttctttccctaaactttctcccaagttaatttcattcttttccatggatttaagtactttccatatgttgttgatactcaaatttgcattttatagtccaaagttctctaagattcagaattaaatatccaatgcatacttgacgtttttgcctctgtgtctttcagatatctcaaaactgattttgtccaaaattgagttattaataaatattcctatgaccacttactacctctgcttctttatttttaggcttctcttctttgaaaatcgtactatcctcttcttgttgctcaagccagaagcctgggagtcatcatgacacaccttttccctcgctcctagccatctggtccacagatgataacagtggtatcactgttaccatatggactagcatttagttcatatgtaccatcatctctagattctaatatatatatattttttgagacagagttttgctctgttgctcagagtgcagcgtcatgatctcggctcactgcaacttctgcctccctggttcaagcgattctcatgcctcagcctcctaagtggctgggactacaggcatgcgctgccatgcctggctaatttttgtatttttagtagagatggggtttggccatgttggccaggctggacttgaactcctaatctcaagtgatccatccaccttggcttcccaaagtgctgggattataggcgtgagccaccgcactcagccaggttctaaagctttcttactggtcttcctgctttcattgtagtcctatagtttctactgcaatcacagggatttaattctctgctgttaattttcatgggcctgacattggtttgtttaaaaacaaaatttaaatagtttactagattctggtcttgagttacttggtggatagtgataactattaagaaagctaaataagaggaaaatttttggaggaaaagatgagttttgagataactgtggacattgaagtgtaaatattccttagccagttatatatatgaaagtgcaactcagaagtcttgtgttctaatagcattgcaaattattgtagtgttgtagttgccacttgtaaactggtaggtttcctcttgttcaatataatgtcttatgcatgtgctgtggattccatgtcttgtgaggaggtgaagtatgtagtagttaccttttaagcaaaggaaacctagcacagaacatctttatttgtatatatgcctctcctgcagtttttaaaagatagaaacatgatttatgtttgttagattgtttatatattacttctgagaagccagtagtttgttaacttttgggtttttcatatttttcacttccatgaatactatacagtgttacagatattatagtccttaacttttaaaacaaaatattgaatattgcacatgtacagaacagcaaataatttaaaactgaacacctgtgtattctccacgcacaccaagaaataggacattgttagcatccagtaagcctcctatgtgtttcttttctaccacactctgcctcctttactggaggagattgctgttttgagattcatgagaaccactgtcttgcttttggtttatccccattttacagatgaggaaacagcaaacccaatacaggtaaagtaacaagaaccaagatcacacacagtatgtgggatttgaacccaacctatccagctctagagcctacatttataactattctgttgatatttcctttttttttttttttttgtttgagaccgagtcttcctctgtcgcccaggctggagtacagtgttgcaatctcgactcactgcaagctccgcctcccgggttcatgccattctcctgcctcagcctccccagtagctgggactacaggcgcccgccaccacgcctggctaactttttgtatttttaatagagacagggtttcaccatgttagccaggatggtctcgatctcctgacctcgtgatccacccgcttcagcctcccaaagtgctgggattacaggtgtgagccactgcgcccggccctctgttgatatttctttctttcttggtttacctgaaacaagaaatttgtagaattttaagtattaatgagctaggaaaagtaatgagttcctataagaggatacttgtaaatacttaaaaaaaaaaagctttatctaaaactcttgtttttttgtgacaactttttttttgtttctatagtctacattatcaaaaagtgccctaaattttattaagtaaatatctaaacacgtattgagccaatatttttacagagtttgtagtgaatcctgatagtttgaaggcggatttgattttgtgtgttttaagtaagttcatggcagtattctaattaatgtaagaaactaggctgagcgtggtggctcatgcctgtaatcccagcactttggaaggctgaggtgggcagaccatgaggtcaggagttcgagaccagcctggccaacatggtgaaaccccttctctactaaaaatacaaaaattagccgggggtggtggcaggcgcctgtaatcccagctacttgggaggctgaggcaggagaatcacttgaaaccggaaggtggaggttgcagtgagctgagatcataccactgcactccagcagcctgggcaataagagtgaagctctgtctcaaaaaaaaaaaaaaaaaaaaaaggaagtaaatacagtaataaaggaagcttctattatttatttttcttgtaataaatgataaaatagtatcttgtccacattatactatggcatataaataaaaattaagtttcctctgctactatttggtattgatgataagctgctgcttctcttcttctcctccttctcctcctttcttcttgctgctgctgctgcttcctccctctcctccccttctcttctcctcctctccttcctcctcctccccctccttgccttcctccccctcctccccgtccttctccccttcctcaccctcctcctcctcctccttctccttctttgtgagtatactttagtcatttttgtttacaactgaaactctggaaaaattaacatcttttgcccaggagcttcttacagacaccagtaaaagtttgaaccttgtgttccacaagataagcatcttctgacaattattttacttttttttatggtacttgaaagcaagtgatgttttaaaaactaaatggaaatatttattattaatataattgtgtaaatatttgttaatgttgtaatgactacctttctagtcttttctgtttaagggggttattacaaatgttatggaccctaaagtagatagctgaaattgtaatgtacaacaggaagattttagagataaccaattttagagatacaataggagataaatctgaaacaattaagttattgaattgaagggcaagaattgagaaagagtcttgactcttaataagggcagccaaacattcagggagctggagtggccagatgcatgaaaggtgggcacaagtaaatagctgaaaatatatagctaaaagccagttgtgtttttacatttcagacaagccatggtatctaaatttaaactgcattatattcagttttcattatggggggcattggcctgtattattttagagacaattttgtgtctaaaagaagagtcttgttatacagtgacatcatttagggagtctattatcccctaaaggacgcatagcagggcatttttattgctttttgagtattttgatttgtaaccgaagttctatctttaagttacctcattctgtcttacatgtaattctagaaatgtaatggttttagctatgaaaagtaatggttttgatgtgaatggtatgttatttatacctaattcctaatgtgagtcagtattaatcatacatcttacaaaatatgtataagattaattttgtatgttttatttgatgtgacattgggcttatagatttttacttgtattatatagttaactttaaaataatctttgcactaagtcgtctggttaaaaatatgtgagtaataaatctaattaatttttggccaggcgtggtggctcactcctgtaatctcagcactttgggaggccgaggtgggcggatcatgagggcaggagattgagaccatcctggctaacatggtgaaaccctgtctctactaaaaaaaaaaaaaaaaaacaaaattagccgggcgtggtggtgggcgcctgtagtaccagctactcgggaggctgaggcaggagaatggcatgaacccaggaggcggagctttcagtgagccgagatcacgccactgcacttgagcctgggtgactgagactctgtctcaaaaataaataaataaaaatcaatcaatcaattaatctaattcatttttgttcatatgatgaagactaaagattgagctgtactcctttgcatgaaataatggaaatatatttttgtataaaagtattagaaggtatagatataaaagttttgtgtaagtaggcttttctagtttctaaggttattaaatcctggaaaattctttcttctttttgtctgaataaacaaaatgcattataaattaaaaatcatttttatcacaataatggattcatgtatacaaaaaacctctcatttaagagatgtacatattagataatgacacatgcctatacctggggccaatatcttatttagaaaacagtgtatgaggagatgaggagtctaggaagtaggattctgtaccatggaacatcgctataatgaatctattctagaaaaagttcaaagcaggtaatacctactgttcatttccatggtcattataaaactctcaaggcaccctgtgatcatgttacttaaataacccaattttcaatagactaagataatttactaagataaattagtaaaatggagtttcctccaaagtaccccctctcagtcaatgcatattgtgtatagaattactagatataagccaattaggttttgcagaataattttctaagaatgacaattttgattttatattgcttgttataatattaaataacaggaataaattttaatgaattgctttttatcagtaatttattatatgcacagagaaatacaaatcagcagggctctctgtatgcagctgattgggaatttgttttaaggcattaagctacaagctataaaaatgagagaagagcgattttaaaatatttacttggtatatccaattgatgcttaaaatataaaatttgacttcttttaggttccacaaatcaacaagacttttcttcagggaaaagtgaagatttgggaacagttcaggagaagtccaccaaaagccttgttataggtcctcttgattttcgtttggatagcagtgcggtgcataggattttgaaaatgattgtgtgtgccttggaacatgaatatgaaccatatagcaggctaaaatcaggtttgtttctggattaattttgaatcttttgccatttgttttgagaataattatataatccaatttgtgttgtcttgctaactttacgtttttagtgtaatttgcctgtttgcaaggactttgatatatgtagctgtttatttaaagaataaacttgtgtgtagaagttggagagatcaagatttgaaaattattgcacaagtactttatttgccagtatttgtcagtattttattgttatacctttttgatactttttctagtggatacttgtgaatatgatttttttttttcacattaatggattctaaggagccagatacaaaattgggctctaaacacacaaatttaacattgaagaaaacttaggcactgctggtttagaaaaagttgctgtacaactaattttttctacatggtagatagctatagttgtcatagtttcataaaatacgaattcctttttaaagcagtaaagcaactctagagtagagcataatagtgtaatgaggaagtataagataatgaagaactcaccctgtggagtcagactgtggtttaaaatttgaccctcacttcttagtatccttaagaaatttaattaacatctttgatgtttcatttctctgtctctacaatacgtttagttactgtgacagagatggctaattgtctcctcaatatccatcctttttcatagtaatagaaatttctataacagaagtaaagactatacatttaagggatagtcatatgactaggttctgtctactgggatgggagcagaactttatgtgatgttttgggccatgactttaaaaggaaaagagcatgccttccttcttttcttctcttctttcttctggctggaaaataaatacaatggtatgggctggacctgccatttcagatcctgagattaaagctgcatgctgaggatgacagagtagcaagataaaaagcacctaggtcctcagtactgtgatggcaccatgtccgccctggatcctttagactcagattgtttcatgaaaaagaaataaggactgagcatggtcactcatacctgtaatcccagtagttagggaggccaaggcaggaggattgcttgagcccaggagtttgagaccaacttgggcaacatggcaagacccagtctctacaaaagattaaaaaaaaaaaaattagttgggtgtggtggtacatggctgtggtctccgggctgagcagggagaattgcttgagcctgaatggttgaggttgcagtgagctgtgattgtgccactgtgctccagcctggccaacacaacaagaccctgtttcaaaaaaaaaaaaaaaaaagctgctgtttttgttgaaatttctattactttacttttgtcccagcaactttactgttaccttaaatgatacactgataggacctacttccaatgattgttctgagcactaaatgagatagtgcacataaaagcacttaacccagtgtacagtaagtgcttgacacattcatgcattcatttattataccttacttgaatgcctaccctgtgccagacattctttatgtgctaggatagtatagcaaacaagacatacaaagcctttggtctcatggagcttatatcctcatggggtagacaaatagtaaacaagttaaaatatttcagtcattgataaatactagagaagaaaaataaaaggaagtgtgagcaagagtgccagaaacagaaggaggggagagctgttttagtagggactttaggaaagttttctctgaagtttatatgtgagctaacttgtgaatgatgtaacggagtgaatcatgcatgtatttgtgaaaagagggttttatgtagacaagtgcaagagccttgaggtaggaacagtttggcaatatacagggatacaaacaggctagaatagctgaagcacaataaatgtttgtaagtcatagaggtagacatcaatcaccttgttgggttttagggaccatgtagtctggattttattctaaatgtgatgggaaatcatcagtaagttttgaataggaagttattaacttattattttaatagtaaatagtatggttggcatatgttttcattttaaaaaatttagattttcctagttttacttgcactcatttgtgtgcatgtgtattaagttctatacaatttcatcacctttgtaggtttgtgtgttcactaccatggtcaagaaaatgaacagttccaataccacaaggatctggcatgttgctctcttacaaccacacccacttccctaccatgttcctttctcctccctcttttccaggggctagggataacccctggaaacttttgtcttccatttctaaaattttgtcatttcaacagtgttaaataagtgaaatcatacagtatgtaagcttttgaggttgacttattttgctgagcataattctctggagactcattcaagttgttgcatgtatcagtagtttgtttcttttcctgctgagtagtattccattgtatacatatactatagtttgttaattccctcacttatggaagaatatttgggattattctagttttgggctattacaaataatgctgctctgaacagttgtgtactggtttttgtgtaaacatttcttcaggataaattgctgggtcatatggtagttgcatgtttattattttttttaaagaaactaccaagctgttttcaggagtggccataccattttacattaccatccaacgatgactgtgtgatccagcttctttacatcttcccagcattttgttttgtcactgctttttattttagccattctgatagatgtgtagttttaatgagcaatctgccatctcattgtggttttaaagttgtgtttccttattggctaatgatgttgaacatctttttatgtgcttatttgccatttttatttcttcagtgaactgcatatgtcttttgctcagattaattgggttaatctgaaagttttaatgtttttcattttatactcaagtatgtcatcattttgaattaattttttacataaggagtgaggtttagataggggtttatttatgtgtctttgaattttcaattgcactagcaccatcctttctttattgaactggttttttacctttgtaaaaaatcaattgagcatatttgtgtgggtctgtttctgagtcctctagtttgttttcagttagtagacctgtggtatttcccactgtcagtaccatgctgacttaattactgtaactctatggtaaacctttatattggagggagaagttattcattttggttttgagggaacatttgcttaggttagaaataacctcattataactttcatttacatatatctctaatggaatattgggttggctgtttcgttttgtttttgtttggagatggggtctcactttgtcacctaggctgaaatacagtggtgtgatcatggttcactgtagccttgatatcctaaaatcaagtgagtctcctgcctgagcctcctgagttgccaggaccataggtgtgcaccaccaagcccagctaatctttgttttttttgtagagatgaagtcttactatgttgcccaggcttatcttgaactcctgggctcaaacaatcctgccttggcctcccaaagtcctgggattataggcatgaaccactgtgctggcacttgactcttttaatatagatctattggtgttatttatttttctcatggaaaagtccaagttggtcagtattccagggaaactgttttatgaggttgtcttagacccagattccttctattttattgttctgccaaccccagagatatgccatatatacatggtcagaattgggtcaccattatagtgtgtaattttaatcaggaggaagggggaacaagactataaaggaaggtatgtagtcttatttatttatttatttaagatgtagtctcgctttgttgcccaggctggagtacagtggcgtgatctcggctcactgcaacctctgtctcccgggttcaagagattctcctgcttcagcctcccgagtagctgggattacaggcacctgccaccatgcccagctaatttttgcatttttagtacagatggggttttaccatgttggccaggctggtttcgaactcctgacctcagatgatctacctgcctcagcctcccaaagtgctgggattacaggtgtgagactatttcttaacaatttttaggagtttttaaaatttttgtttttaatatgctgtggatacaagtccctcatggagctggatcttccccctccccatctatctgtagcaaatattttctgtcagtctgtgtcttgcctttacattatctcaatggtattttactgaccaaaagctgttactcttttaaagaaagaaattggggatttcttaaagatatattaaaatgaaaaactggtaaatttttatataacaaagatacatttacattcgagaatagtgcaacttatatttgttaaaggtaacttattattttatacctgcttcattgttgaaaagaaaaacaggatttgaccttatagtttggagaactaattcatttttcagttgtttaagaatattatttaaaaatattctttattaattttttatcattttaattttagatattaaggatgaaaatgaaacaatactgaatcctgaagaggtggctcttctggaggaatatattcctactcgacatacaagtgttactctcctcaaatgtacctgcacaatttccatggctgaattcaacttgctggaccatttactacctgtcattatgggagaaaaggtatattttgtgatttgctatattttttttccctcatatatggatttttttttttttttttgtcatttactgaaagaatatctgcagccgggcacagtggcttgagtgtgtaatcctggcaattcaggaggctggggcaggatgcacacttgaggccaagagtttgagaccagcctaggcaacagcaataccttgtctctaaaaaaaatttggcacggtggcacatgcctgtattcccagctcttcaggaggctgaggtgggaggattgcttgagcccagaagtttgaggctgcagtgaactatgatcacgccactacacttcagcctgggtgtcacagtgtgaccctgtctcaaaaaaaaaaaaaagaaaaagataaaagtatctgcttatatagttatccatgatgaagtaaaagcaatgtaactatgaactaaaaattaactgttaatttttaaaatgtaattttaaatttatatttttaataaaataaacttaatcttgagagtgtataaagaaatgttgaagaatatgggcctagaagtcagaccatatgccagctataatgccatagacaattactttatatctctaagccctgattttctcttctcaaaaagaaaacaattgtattttttcaagcagcctgactattttagttttagccagtaaaactgtcagcctgcctagattcagacagtttattacttacatagacagcagaagcaaagtcagtaatggtgccagctcccctgtcccttgttctataggacaacctgtaaacaaagggccaaatgacttctattggtacatggtggggcaccctgttggcaacaattcagtttcacactgcagctaagcagtggtgtagcttagcgcatatgtggaaagcccataactcagctgaatgaggaatgctgatgagaaaatgtttcatggccgcctctctcaagatgggaaggtgaatgagaaatgctcttttagcagctcctcacaagaccacatatgatcctttgtttttagaggatcacaggatattctaccaaggtctgctgtggttgagtattgccttcatggcatggatttgtgtaacattatcaggatgctggtacagactagacccaccatagtacttagctcctaggattattttaaattttcattgaaataatgcatgtaaactattttgcatgtattaggaactgagtgatgtctgctgtaattgttgagaatgcttaatatttgtttatggtccatatacaatgtattgctttctgagtttgacttatacatacaaggccttatttgttcgtttgtttgctttttgagacagagtctcgctctgttgcctaggctagagagcagtggtgaaatctcagttcactgcaacctatgcctcctgggttcatgcaactttcctgtctcaggcttctgagtagctgggactatgggcgcatgccaccacgcccgactaatttttgtatttttagtagagacaggatttcaccatattggtcaggcaggtcttgaactcctgacctcaggtgatccacctgcctcagccttccaaagtgctgggattacaggtgtgagccaccacacctggcctatgtgtttttttttttttttgatatatttcttttgatgttcatataatgatcaggggtccccaactcctgggatgcggaccagtactggtcagttgccttttaggaactgggttgcagagaaagaggtgaatggcaggtgagtgagcgttaccacctgagctccgcctcctgtgagatcagcgatggcattagattctcataggagcacaaactctattgtgaactgtgcatgcaagggatctaggttggcactccttatgagaatctaatacctaatgacctgaagtggaacaatttcattctgaaaccataccccttctcctgtctgtggaaagattgtcttcaatgaaattaatctccgatgccagaaaggttggtgtccgctgacagtgataatcatagaaataaaaagtgtcctaactttaaagaagttatgtaagggaattaactatatgcattaactttatttttgctccctactggccactcatcattaagtatggtagtgtattacgattaagagatcatgtagagaaaatttcactggagacaattaaaatatgtctgcattttgtcatctctgtttttgctatcatctaatttttaaaatagatactattttttagagcagttttagattcacaaagcagagtgaaaggtacagagatttttcataaactgactccccccacgtacatagcttccctctttgtcaacatccctcaacagagtagtatgtttgttacaattgatgaacctgtattgacacatcagtatcacccaaagtccacagtttacattagggttcactcttggtgttttatgttctatgagtgttgaaaaatatataattatctgctataacaatatcacatagagtagtttcaattcccaaaaaatcctttgtgctctgcctattcatcccttcctctccctaaccactggcaaccactgatctttttactgtcctcacagttttgccttttctagactgtcatatagttggaatcatatagtatgtagccttttcacattggcttcttttacttagtgatatggatttaagtttcctctttggcttttcatggcttgatagctgatttcttctttgcacttactaatattccattacagatgtaccacaatttacttatccattcacctactgaaggacatcttggttgctttcaagttttgagagttgtgagtaaaacaggcatatacatccacgtgcacgttttggtgtgggcatgttttcaactcctttgggtaaataccaaggagtgtgattgatggattgtatgctaaaagtatgtttagttttgtaagaagctgccaaattgtcttccaaagtggctgtatgattttgcatccctgccagcagtgaataagagttcctgtttctccacatccctaccaacatttgatgttgtcagtgcttcggttctttgccattctaagacatgtgtaatggtgtcttattgttttgattttttatttccttgatgacatatggaaacatcatttcatatgcttatttgccatctgtatatcttctttggtgaggtatctcttcagatctattgcccattttttaagagttgtttgttttcttaatattgaattttaaggattccttgtatattttgggtaacagtcctttatcagataggtcttttgcaaatattttcccccaatctgtggcttgtcttttaattttcctgtattttgcagagcagaaattttgaatttttagtgaagtcctgcttatcaattctttgttttatagattgtgccttttgtgttatatctgaaggtcatcattatacccaaggtcatcagcttgtatcctttacgaattggtccatttcatctaggttatcaaatttgtaggtatagagttgtttatagtacttctttgttttttttttgagatggagtttcacttttgttgcccaggctggagtgcaatggcatgatcttggctcacagcaacctccacctcccgggttcaagcgattctccttcctcagcctcctgagtatctgggattacaagcatgtgccaccatgcctggctaattttgtatttttagtagagaaggggtttctccatgtcagtcaggctggtcttggacttctgacctcaggtgatctgcccaccttggcctcccgaagtactgggtttataggcgtgagctaccaccgcacctggccttttttagtattttaaaaattatcattttagtgtccttgggatttgtaacaatgttcctctttcatttctgacattaggaatttgtattctcttacactttttcttagcctggctagagaggcttactgatttttattgagctagcttttggttttgtttattttctctattgattttctgttttcaatttcattgatttctgttttgattttaattcttttcttcttattttggatttatttaatttcctgaagtgtaagcttaggtgattgattttagattttccttttttgtaatatatgaactcaatactataaacttacctctaagcattgctttcactgcatgctacaaatttcgataagttggatttttgttttcatttaattcaaagtattttgtatttctcttgagatttatttctttgacttgtgttctttagaagtattttatttaatgtccaagtattttgacattttttagttatgttactgatttttagtttaattccattatggtctcatagcagacattgtatgatttcttttaaatttgtttaggtgtgttttgtggcttagaatgtgtctgtgttggtgaatgttctatgtaagctttagaagaatgtgtactctgttgttgctgtatgaagcagtccattgatgtctattatatctggttgattataagttcaattatgtccttattgattttctgtctgctggaactgattatatctgatagagggatattgaagtctccaaccaaaacagtgggtttgttggattttttccttgaaattttatcacattttgctttatttttttggcactgtgtctttaggcacatccatgttagggactgttatgtctttttacggaattgacacctttatcattatgtaatcccttctttatatctgatagctttccctggtctgatttttcttctgtctgaaattaatatagccactcctactttcttttgattagttttagtaaggtatgtatttctctattttcttttaatctacaagtgtctacatatttaaagtgagttttggctgggtgtggtggctcatgcttgtaatcccagtgctttgggaggtagaagtggactgatcacttgagcccaggagtttgagaccagcttgggtaaaaccctgtctctacaaaaaaatacaaaagttagccaggcatgctggtgtgtgcctgtagttccagctacttgggaggctgaggtgagcggatcacctgagccctggaggttgaggctgcagtgagcaatgatcacaccacttgcactccagcctgggtgacagagtgagaccttgtctcaaataaatacataagaaaaatttttttaaaaagtaggtttttttgtagacaatatatagttgggtcttgtatcttcagctgccttgacaatctgtcttttaattgatgcatttagaccattgatatgaagttattattgatataattggactaacatcaaccatacttcttgctattttctattttttgcccttgttatttgttcctgattttttttcccgctcttttttggccttttgtggttttagttgagcattttatattattcgattttctctcctctattaacctacctgttatacttctttttagtgtttgtcctagaatttgcattatatttttacaactaattcaagtccactttcaaataacaccataccactttacaggtagtcagagtttcttataataaaagaaatactaattctgccatcctgcttcttgtatcattgctgtaattcattttatttttatataagcattcataagcctgccacacacaatcatacgtaattacttattactattattattttgacaaaatttatgtattagatcaattaagaataacaaaaattaaaagtctttttttaccttatgccttttctgatgctgtttttttttatgtagatgtgaaattctgacctttatcatttttcttctctctgaagaatttaacacatctagtaaggcagatatactggaaacaaattctctgaatttttttttttgtctgagaaagtctttttttctccttttgaaggataatttcgtggggtatggaattctaggtttgtgggttttttcctcttaaaatactttgttttactctcttcttgcttacattgtttttgagtggaggtcaggtataattcatatcattgctcctctataagtaacatgtatttttttctgtggatttttttgggcgactttatctttgatttctatgatttgaaaatgatgtgtctgtatgtaggttttttttgtttttttttttggcatttatcctgcttggtgttctctgagtttcctgggtttctaatttggtgtctgacattaatttgaggaaactcacagtcattattgtttcagatgtttcttctgtttctttctgtcttttcttctcttgtggaattcgtattacatgtatgttacatcttttatagttgttccacagttctgaaatattccgggtttttttttggtttgcttttcagttttggcagtttctactgagataacttcaagcttagagattcttttgttagccatgtctggtcttccagtatgcctgtcaaagggaaaaatgctaacaaggaggtcttactcagaaggcagcccaaaaatttgtataaaatttcctttagattgttggctaattcctaagctgcccatgtgtaatgcaagacttcaggaaacccagcagaaagcaaagtataaatttgactatttgcatggtgctgtgtatctacaattagagttcaggccctgccacattagcacctggggccttcctttgagaccttataagggccacaccctaggaataagtacagattgaaatagattagtctgagcaatcctaattccagtcctggataggaccatgatgatgtacttgtattctgtctgcttgccaaagaatggttaacttactttaggggaagatagcattatcaaagcctctataattttttacccatgatgtcatctgcttgatacaaaattatgaggtatactaaaaatagaagcaattgaattaaatataataaaaaatcaataatataaatagacttagagatgattaaggtattagagttgttagacatggagtttatgattaattgcttaaggaaaaagacaaaaaggtggaagatttccaaagagacctcaatccattaaaaaaaagcaccaaattaaattgtgaaactggaaaatgtaaggatacaggtttgaaggaaaaggatggaaaaaatataccatttgaacactaaccaaaagaaagatagcatggctattttactaagagataaagtagattttaagctaagaaatattactgaaataaagaaagccacttcataatgataaaagtgtgaactgaaagaaagaacaacacagataattctcacaggtgtaatattgagtaaaaaattatatactatatgatttcatttatatgaagttccagaagagagaaaactaatctatggcaattgaagtgattggctacgtctgttgaggatttagtattgccttgaaagggacatgggacagtctcatagggtgcttcagatgggtggtggttacagatgtaaaaattcattcagctctacccttcagatttgtgtgctttattctgtgttattttttagtaatcccaaagaaagtcacttaaaaaagcaacataattcctaaataaatggtggttttaaaattattagtaatgagtaaaaaatcagcattgtattttcgacttagttttaagcacagtgattctcagtaatggcacttttggttttttggattggagaattattatgtagcatttaccatctttggccaatacccgctaaaggccaatattattgtgacaatgaaagacagacaaagcaatgaaactgctcttcttgcattttgtcatattcttctggatgggaagtcatggcattcctcattgagaaccacaggtagagcattttaagggagtgagtgagtgagttctaggacagggatcatttgccactcagggtacatacgctggacatcttgaaacttacctgtatttatttgaaagctcagaaagattctgtaaaactgagaatactgtgccgtcctcaagattcttaggactttatgagcccttaacatgtgtattgttagtagatacgatacagataaggaatttttcttacctgcaaacattgcttattgtgaatgtttttgacattgtgtggtgtagtccatttagttctttagtcagctaaatgtgaataaaagagattaaaataaaagatgctgactcttggatatctaggaaacattttggaataattaagcttaataaaatatcttcatcatactgaggcatgtcgtgatactattccagttgattgaaaaagaaaaaaagcttgagctgaaagggcaatgataattttgcaaaaaatatgcattctttgaagtctgggacatatttaaaatacatggaaagacatttgttatttggttatggcaagagagttctgtagaaaggcatcatttctagattgatttgatatcactgcaaatgtgcagatctgaagcttgcatagagggaactgcaactcagtcactgctccacttttaaaatataaagcgaacactattattttctagaactcaagtaacttcatgaatactacaaacttccagtctcttcggcctttgccatccattcgaatattggtggataaaattaatctggaacattcagtgccaatgtatgctgaacagttggtgcatgtggtcagcagccttactcaaccttctgataacctgcttcattattgttatgtacactgctatcttaaggtatgaaaagtgaattttcttgtttgttagcatgggtttggctttgggatcatcagataagtttcttttttcttgatgttgtaatttcagagaaatagtactctaaaaggtaagatttaaataagaaataagatgtatttattccaataaattaaagtaagtaataaaaatatacttattttaaagatttttcaattatgtgagattagtagcttgatatttataaatgaatggttaatcataacttttgaataattttatttatcattgatggtaatttttataagcaatgtgaaagagcacttagtttaatatggatgctttgaagactcatgtttttttgaagggagcatttgtgtgaggcataatgaggcataaagagggcctaaaacttttttatgtcacctttatttaattcatgtcaatttattgatgcaagggaaatttattttaaatacaggcatatgccattttatcatgcattactttattgtacttcatagtaattgtgtgtgtgtatgtgtgtgtgtgttttttttttttaacaaattgaaggtttgtggcaatcttgcattaagcaaggctttggtgccattttttcaatagtatttgctcacttcgtgtctctgtgtcatattttggtaattatccaaatatttcacaagttttcattattattttagcattgtgatctgtcatcactgttctttgatgttgctattgtaactgtttttcgggcaccaagaagtgcacctatttaagatggtgaacttggtaaatgttgtgtgtgttctgggtcctccactgaccagttcccccttctctctcccttatcctaatccttgagacacaacaatattgaagttaggccaattaatagccctacaatggcctgtaaatcttcaagtgaaaggaagagtcccataactctactttaaatcaaaagctagaagtaattaaccttaatgaagaaggcatgtcaaaagccaagatgaggccagaaagctaggcctcttttgcaaaacagccaagttgtgaattcaaaggaaaagtctccaggaaattaaaagtgctactccagtgaacacaggaatgacaagaaagtgaaacagccatattgttgatataaagtttgagtggtccagatagcagatcaaaccagctacaatattcccttaaatgaaaagcaaggccctaactctcttcaattctgtaaatgctgagagacttgagaaagctgcagaagaaaaattagaagctggcagaggttggttcatgaagtgtaagagaagccatctccataacataaaagtgcaaggtgaaacagcaagtgctgacatagaaactagagcaggttatccatatctagctcagttaattgatgaaggtggctacactaaacagattttcaatgtagacgaaatagccttctcttggaagaagataccatctaggacttacatagctagggaggagaagtcaatgccttgcttcaaaacttcaaaaggcggccgggcacggtggctcatgcctgtaatcccagctcttttggaggctgaggcgggtggatcacaaggtcaggagatcgaccagcctggccaacatggtgaaaccccatctctactaaagatacaaaaaaattagccgggtgtggtggtgtgtgcctgtaatctcagctactcaggaggctgaggcaggagaatcgcctgaacccgggaggcagaggttgcaatgagccaagatcaggctgttgcactccagcctgggcgacagggcaagacgctgactctcttgttaggggctaatgtacctggtgacttcttaagttgaagataatgctcatctaccattctgaaaatccaaagtgctttaagaattaggctaaatcttcactgctcatgctctataaatggaacaacaaagcctcaatgacagtacatctgtttatggcatggtttactaaacattttaagcctgtggagacctactgcccagaaaagactcctctcaaaatattagcgctcacggacaatgctcctggtcaccctacacctgtgatgaagatgtacagggagatgcacattgttttcatgcctgttaacatgacattcattctgcagcctgtggatcaagagtaattttgactctggggtcttattatttaagaaatatattttgtaaggcttatagctaccatagatagccattcttctgatagacctgggcaaagcaaattgaaaaccttttggaaaagattcatcaatctagatgctattaagaatatttatgattcacagaaggaggtcaatctatttacattaacaagagtttggaagaagttgatttcagtcctcatggattactttgaggggttcaaggcttccatggaggaagtaactgcagatgtgatggaaatagcaagagaactagaattggtgtctgaagatatgactgaattgctacaatctcatgataaaacttgaatggaggaggagttgcttcttatggatgagcaaagaaagtgatttctggagatggcaattactcctggggaagatgctgggaacattgttaaatgattacagagaatttaaaaagttctataaacttggttgataaagcaatggcatggtttgagaggattgactccaattttgatagaagttttactactgttaaaatgccatcaaacctcaaatcaatcatcaatgcctgctgtggagaaatctttcatgaaaggaagagttaatcaatatggcaaacttcattgttgtcttatttttagaaattgctgcagctagccccaccacttttagcaaccaccatcctgattagtaaggagccatgaacatcaaggcaaaaaggttattacttgctgaaggttgagatggtcattagcattttttagcaataaagtactttttgtaaggggtgagggcagagtcttactctgtcacccaggccgtagtgcagtggcatgatcttggctcactgcaacctccacctcctgggctcaagtgattctcccatctcagtctcccaagtactgggaccacaggtacacatgcccatgctcagctaattttttgtatttttggtaagatggggttttgccatgttgcccaggctggtctcgaattcctgagctcaagctatctgcctaccttgcttcccaaagtgctgtgattacaggtgtgaaccactgtgcccagccaataaagtgctttttatttaaggtatataagtttttttttttgacataatgttattgcacacttaatagactacagtataagtgtatacataacttttattatatgtactgggaaaccaaaaattattgtgatatttgttgtattgtggtgatgtggaacttgcagtatctcctgggtatgtccatctggttatgtaaagtgaattattggtagctttccccagctctttcaatttttaaaaaataagtaatacatccaatgcaggtatatacaaacaataacctcaaatgttgaacaatacatgttttagctaagcaagcagagatgtatagtttaaatagaaatagtgtgtacacaatcaacttctgttttatgaacaaaagaaaactataaaaagttgaatttaagaatcagtactggctgggtatcgtggctaacgcctgtaatctcagcactttgagagtctgaggtgggtggatcacttgagcccaggaggtcgagacccccctgagcaaagtggtgaaacctcatctctacaaaaaatacaaaaattagccaggcattgtggttgcgtgccagctacctgggaggctgaggtgagagatttgcttgagcccaggaggtcaaggttgcagtgagctgtgatggcgccactgcactccagcttaggcaacagagtgagaccctgtctcaaaaaaaaaaaaaaaaaaaaaaggtactaaaaaagcactaattttcatgtaatgtatcaaaagattagaggactccacaaataggctcttggcctaattagtttatttgaagttataaagtttttaagtatttgtatatctgtaacgcaaaaataaaccaatttcaagataccagttttagatcacctgcaggtgtatataaatgtaagatgttaacatttgactgttttcagaccattgcagactagaagaacatgttttcttggttgtttttgcaaagccttttttctcaaggatggctcctttggtggaagaacaacagatcacattgcaaaagggtgtggacacagggaagtgtgactcattggggccattattttagtgatctaccataatgttttatgttatatggagagtagcagaaatattttcaaaacctagatataaagattataaatgtactttatactttacaatgctttatactctataattttcagattcaatgctttatacttaagctttatttattgtcacaattaatacatagaagtgtacaattttaaaaaatattggtacaaatttaatatcagattacagtgttaagaatatttgctttgttttttcatgtcaataatatattttatttaacccaatatatgcaaatattggttaacatgcagtcaacataaaacattgacattcagcttatagataaatgaagtgagtctctatactcaagaaggatgttcaccaaaaccattggtcatcaatatagtcaccatccatactgacataaaatttattggaatacttcttcacgatttctacttgtcaatatgttaaaactcacatttccagtgtaatgtaaaagttatttacagtgtactaccgatatagttatattttggaaaaagggcctttgctacacatgctgtctagttttcttttatattttggcttgtttgaatacagtcataatggatacgtttaatgtctcaggaagtaaggtgttaggcagagtgggaatagcattaatatgcgtgggaaaaccattccctggtgttaagtgtactaaatccttttttttttttttttttgagacagagtctcattctgtcacccaggctggagtgcagtggcacaatctaggctcattgcaatctccacttcccaggttcaagcgattctcctgcctcagcctcccgagtagctaggattacaggtgtgcaccaccacacccagctaatttttgtatttttagtagagacagggtctcaccatgttgaccaggctggtctcgaactcttggcctcaaattgatcctcccacctcgacctcccaaagtgctgggattacaggtgtgagccactgcgtccggccaagaatactaaatacttttgaaaataaagccttgaatcttgtcttgaatatttcatttcattttcatacttctactgtgacataggacttttgaatactttcaggatgtggtagagagtttttttttatacggctattgtgatgtgactccatttaccagtttgctataaagtttatagcagttcatattacttgggttgattttagtagcctttgaggaagtttttaaagttttagttttatcatattacagtagtacagtagaggattcgtgtgtttggcattttagtccatatataattttcaattaagtacttaaacaaatccttgagttttaattttgtatactgaaccttggctgtattggctatatgatgaaattgtgtccggagttggtgggttcttggtctcactgacttcaagaatgaagccgcggaccctcgcggtgagtgttacagctcttaaggtggcgcgtctggagtctgtcccttctgatgttcagatgtatttggagtttcttccttctggtgggttcgtggtctcgctggctcaggaatgaagctgcagacgtttgcagtgagtgttacagctcttaaggcagcgcgtctggagttgttcgttcctcccggtgggctcatggtctcgctgggctcaggagcgaagctgcagatcttcgcggtgagtgttacagctcataaaagcagcgtggacccaaagagtgagcaatagcaagatttattgcaaagagcgaaagaacaaagcttccacagtgtggaagggaacccgagcgggttgccaatgctggctcgggcagcctgcttttattcttttatctggccccacccacatcttgctgattggtagagctgagtggcctgttttgtcagggcgctgattggtgcgtttacaatccctgagctagatacaaaggttctccacgtccccatcagattagttagatacagagtttggacacacaggttctccaaggccccaccagagcggctagatacagagtgtcaattggtgcattcacaaaccttgagctaaacacagggtgctgactggtgtgtttacaaaccttgagctagatacagagtgccgattggtgtatttacaatccctgagctagacataaaggttctccaaggccccaccagagcagctagatacagagtgacgattggtgcattcacaaaccttgagctaaacacagggtgctgattggtgtatttacaatccctgagctagatataaagactctccacatccccaccagactcaggagcccagctggcttcacctagtggatcccgcaccggggctgcaggtggagctgcctgccagtcctgcaccgtgcactcgcattcctcagcccttgggtggtcgatgggactgggcgccgtggaatagggggtggtgctcgttggggaggctcgggctgcacaggagcccatggagtgggtgggaggctcaggcatggcaggctgcaggtcccgagccctgccccgtgggaaggcagctaaggcccggcgagaaatcgagcacagcgccggtgggccagcactgttgggggacccagtacaccctcggcagccactggccggggtgctaagtccctcattgcccggggccagcagggctggctggctgctctgagtgcggagcccaccaagcccatgtccacacagaactccagctggcctgcaagcgccgcacacagccccggttcccgctcgcgcctctccctccacacctccctgcaagctgagggagtgggctccagccttggccagcccagaaaggggctcccacagtgcagtgggggctgaagggctcctcaaatgcaaccaaagtgggagcccaggcaggggaggtgctgagagcaagcgagggctctgaggactgccagcatgctgtcacctctcaatcccccctctaaacaggacaccccaattgctgttgggaatttggccgttgactgctctagctacttcctgctggataggggcgaagaaggggccctgcagttgtggtgtccttcagaggggaactctccaggccaggggaagtgccagtgggtcggtccaggggtcccgggtagaagttgttagttgaactcatttggggttccatttgtaagaccatctgttgcttgatggtctcgattctagaggaaacaaaattgacaagaaggttagaaatacagggcccaaaggtgagtaacagcaagatggctgccacaggacctagaaaggggagaagccatgttgcccaactccagaggttggtataagtatttgaaaggcattgtctgatttcagaagccttttcctgtaaacgccgggcagcatctcgtactatccctgactggttagtgtaaaaacaacactcttcccctaaaaaggtgcagagtcctcctttctcagcagtgaggaggtctaggcctcagcagttttggagagtcactgctgccaaagagtctatttgggattgtaaagtaaggatagatttcgttatttcttgcaaactgtctgagaagcaaatatgggttgaagacccacataagtagaatatgccttggctgggtagatagaaatttaccctggcttttaaaggaataggatacactgttttttctttactacttccatctctctctttctctcttcgacttcttctttgtctcttcttctctttttaactctctctttaactttctgtgtctgtccctctttctctctgactccttttctttgtctctgtttctgactccctctttgattttctgtctctctgtctcttcctctctctgtctttttgactttctctttctctcttcgactttttctttcctttctgctgcctctgccagctgcttatgctgctgttctcccctctccttcccgttttgatggctttgtcagtgtaagaaaatgattcataattcccacttcatgtaataaaatttaccaattgggagagttggcatggatctgtatggaaaatatgcagatgaaagattccttttatttgtaattgacaaaattgtatatattattgtttataacatgttttgaaatatgtatacattttgaaatagctcaatttagctaacatatattatgtcacatactatcatttttgtggtgagaactgtttaaatctgctgtcattgattttttaatagaatacattgttatttactatagtcttcatgttgtacaatagatcttttaaatttatttctcctatctaattgaaattttgtatgctttgcctaacatctcttcaacctcctctccccgagagatgacacttgcttatggcttaccaattcctctttatgtatctggcaaacccatcgtttgaatatgtatggtattgagtagctaagagtttcaaggcatctgatatttgaaacatatgtagaaaatttggtaatgtgactgcgttgtgtaatttgtagaatagtatataactttaaggccttattcatatggatcagctgcaatacatacttcagacagaacaaggagttagagtaggatggaaaccctttggattctttggatctgttaattttttacctcaagaaaatcccaggggatttggaggaaataatgttttcatacacattttacggttacataaattggcatatttattttggaagtagcagcatgtaatacatttgaaagcacatctaccttaccacccatttgttccaattttcagtgtataccctccagcaggggtcagcaaaattttgcctacaggctcagtatatattttaggctttgtggaccaagtggcaaaattgaggatattatgtaggaacttaaataacaagagagagaacaaattttacaaatgttgagtttataatattcaaaatgtaataattgagtacagtttttgggtaatacacagttttatttttcttttatttatttatttttttgagatctagttttgcactgttgccctggctggagtgcaatggcacgatcttggctcactgcaacgtccgcctcccgggttcaagtgattctcctgcctcagcctcctgagtagctgggattacaggcacgtgccaccactcctggctaattttttgtatttttagtggagacgggacttcactatgttggccaggctgttcttgaactcctgagctcgtgatccacccacctctgcctctgtctcccaaagtgctgggattataggcatgagccaccgtgcctggccaggtaatacagttttattaatgagaagaatggaactctttttggagggacaacatttcacctaattgggatttcaacttattgttcccaccatgttgattataaatgtttatgtgtaaaaattattctttgcttgtaggctatcccggaacaagcagtgtgtgggatttggcctgtaggctgtagttggtttttgttctgttttcttagaggtttattgtttaggaattaacttaaccaaggaagtgaaagacttttgcaataagaaccacaaaacagagctgaaagaaacgaagatatacataaatggaaacgcatctcatcttcttgaattggaagacttaatattgtccatgctatcctttctacacattttcagtgcagactctattacaattccaatgtcttttttcagaagtagaaaaactcatcctaaaattcatatggactctcaagggaccccaaataaccaaaaagatcttgaaaaagaacaaagctgaaggacttactcttactgattccagaagctactacagagctatagtaatcaaaacagtgtggtactgttgtaaacacagacatatagacccgtagaaaagaatgcagtgcccagcaataaaccattgtgagaaagattgtttatttttctttaagaataaacagagaatcagccattcctttttaggtgaagagaaggaggaaatagaggaaggaaggaagatcgggtgaaattttgagttaatagatgagctacatcaaatgaagtatcatatccttgttacatcaatatataatttcaaagatgtccctaatccttttggacttcatttttcctgcatgtgaaatgagatgattgagttaaataatctctaagcagtttgagctctaaaattctttggttgattttgatttcattcttttcccctgaagagtttttcttcacaaggtgttcattattatgctgtacaaccctagttattattattctttcttcagtttttatgtgtttcagtgtattattgcatacataccaacttttaaaatgaaagaaatgcttatttgttcctttagtgaagggacaaatctttatgatgctgattatactattatgtgttttatactattatgtgttttatttaatggtataaaactaccatgtgttttataatggcagtaacaaaaattatttattgtatatcataattataatgtttttattgtcatttacaattagcatgtgctttttatacttttgtctttttaaaatagcaaattctaatttatgataatttttggcaaaatcttacagaagtaagttgccatataatgtttctaaatccattacaatttcttctatttgagatattaattcaagaacatttgttgtaaaatgttaaaatcttgatgatgtattcatttttgttatttactaattgggatttttaaaaacaggtggcaatacatgtttaactttttatttaatgagatgtgtaagttctcttattcaactttacagtttcctttagctaaaatttctactggtagttatacttactgtttcatacatttttattgctccagattattagtttgcaacatttaccaaaccagtttttgaatatgtgagctatccttcatgaaagcaacttcagtttacactgctggttctgctttttccagattaagtatttatagtcttggtcaagggatgttgacaaattattagcttatataggttttgtaaatctatgtatctgattgctgtaatttaaaagagagagtttaaaaatttatttttaaatagttctttttgatttggtggataatagaggaagcaaaaatatgactcataataatttggcaatatttagaaggtaacttctttgtccagtaggtcctgttttattgtaattttcacctggttgaatgttttcttagaagcatctctaggcaacacaaaagtataataaagacttttaaaaaaatgacagaatagtatgtagtttccccaaagccctttgcaattctgcagacaaccagcaggggatctcgtctacacccaatttccttctgagtacagttggtagatagtgtctgtgattatactgttggggcatttaatggaaaatttgacagtggctttgagagagttcttagttgagcataggtaatatgatgtgataaaatattatctttattcataactcgaaatatttggcagttggatattgttttaaaaatgttttgtattgttataataataactgtaaattccagaatcctttgaatatttggcctttatgaggaaataagaaatcctgaaattgtacagaaaccaacgcagtactttgcatacattattgctcagaacaggtcttcaaaaagaatgaatgtgaaatatcttaattttaagttatgattttaagtaatcatttcagtattagaaagatatctttttctcaattctgtacttcttatctattggttaatagcaggttataggtgctgatgggtgcatcacttttgttttccttgatagtaattacataagtaggttctttgaaatgcagttttccttgaaaatgtaattttaaaaaatgttttatttctaaaacattgttttgttcactcaaaactgagtgtataagaaataatttgacattgtcgatttgatgaatgttaggagtataatagctttttgaaactatttggaagtagcttaatacttttaaagaaattgataattattttatgctcattaaatagtattttgaaatcagttatgaagaaattctaaacatattttattatagaacttcacagttgatattaattctagagatatggaagtcagtgctttataaacccaagggataaaaaacagtaactaaagataaatgttgagattaagctacttttacatttactggaaaacagtaactctttgttttgtatccatgtgtgtatttccactctgaggtgtttatcttttgttgttttacaaataattgaagcagaaatatcatcagttctctacagtatttcatgtaacgtgatgttatgttgtttctttctattatgacaaatatagtatccaggaatttcagggattgcttataaaattttgtagtatggtctgcttgctttaagcatagacatgcttgtacatatgaagagtaatttatgccatgtaccaagttttctggggtttaaaacctcaatcccacaattattttcacaaaagaaaatagaaataacattttaggatatttttcgatatcctttttgtatgtacattatacaaggtgaagacaaaatacatttttaaacagtttttcttgtagttaatgttattttagtcataaaatattaacattaatttataaaatttgtagtttactgtgtagaaaatgcagtcagcggtttatatttatggaaaaatgtatattttagcagataataaaacactacctgaggagtatgtatagaaataaaatgtgaaacttaaaaaaatttgtcaaaagagcagtgatctttcagggatgtgaaataaatactgtatatttaagtttcttaattttgacctactgtcaaattgtatagaagaaaatgttgatcgtttgggaagtggaaaaagactttggaacatatttagtgtgcagctgttgtaaagcaagttgaaactgacgtatttcatcctgtgcttattaaaactttgtctgtgtgaacacttgcatcttttctttttgttttagatatttggtttccaggcaggactgacgtctttggattgcagtggatcttactgcttacctgtaccagttattccctctttcagcactgctctttatgggaaacttctgaaactccccacatgctggtaagtcttacatgttaaaatgtgatttatgttaatttccatttattaggagggaaaaaacccccaaatgtatctgtcttatgcccatgctagttttatacaaaactttagaaaaaaaatctaaacttgtacttttactgagacactaaaagtcttttttaagtttctgaaatctgttagttcatcatgtcttttgtgatagcaataactgttattagggtaataactgttaattcatgttggatgtgtgtaaaatactacttgagattataataggaactgtaagaggaagtgcctttttttcaagagtgggtataaagattttaaaaagttataaattaatattcaagaccaaagtatttatctattaaataataatttcgtatatattcatacccactgacaaaagtatacacattatgtagagttagaatgtatttacatgtctagtagctatattttataagaaattgattgtagccctcaccattttcattccgaattgaatgctatatttggaggtcacatttccttaaattcggagagatttacagaaagaaagccagtagttaccagttataaatttttagtttaaaggaatgcttttaatatattgtttaaatatataaaataatgtttaaatatatgaaattaatttttagtgaaccatttttccaatttaaaatgtgatttagaatatgtcttttgtattctcattctaattagtaagcttatttttgcaggatagtttttctattagttttttactaaaaatgacataacctttagaaaattagcattaatttcttatctaaaatacttcagttgctaaaaatttgtttctttaataatatataacttttaaaatgaaattataaaataatcgctcatattttcaagaaactttgcctgctgatacagaaaatttttttaaaagtcgtagttaagtcttagtaccaattcctctataaagtgaaaccattattaaatgataattcttaatttctagtgataaatttcattttgtccttactcctccatacctctcacatgtcatttattatgttatatagagatagatttaactttttattagcatacatggtatgttgcatttgagtcaagttttatattctgatctattaagaaataaactgggatatgtcacagttgatatggtgatatcaattttaataggtatttgtgaaaactattttctccgttatgtgctgattaatttatcatttctaggaccaaaatagttttattgcaaacagtgcaatttactatagaaaattcttaatttctttaaaaaagtccatatttttcaaaatgattatagcctttatataaaatcaatattgaaataagtaagacttatttgaaggatacaaagagggtattatgaatactgtcaaatgttacttaaaatatgcctacagacatctagaaataatattccaattaaatactgaaagcatgagatcacagaatgccaatattttttggatgtgttttgcttttttgtagttaagactacttctgtgttatttcagtgatatttttgctatgctttatagaagtatattgatttgaaatatttcttgaaattttcttaataaatgtaaaaaaaaactttagtaactgtaacttgaaaataaagagaaaacttaataaattgagatattggttggttttagtgcagtttgaattcaataaaatactgcttaagcagtatgtcctataagtttaaagaaagcagacagtttccctgggacgtcagagatagctgatgagatgaggtcctgttagaattggacattagtggatgagacagatatccatgtatctatcactgcatacagtgggcgaagaatttggacagttactctaccttagacttgtccatgagcaatgatatctaaatgttttaatatgaacacttaaagatagttaaaccagttaatcaaatattcattagtcccatttcttcatgttcatgtttgttaaagcctaactaaaatatagtctcaaattcactttgtcctataattgagggttcaaatgtgtgattctatttgtagagaaatatatgcaacatattttggaagtttggagtatagaaatagtatattggcttagaaagtcatggaaaacatggaggggtaatttttaagcaggatattgaggaatggatataatctgaaagagcatactatattgttttatacagtcttaggtacctagttaaagttcatgacggtcctgtgagataagatgatattgtctcttataaactctttctaattttcagagaggttaaataagttgtccaaagtcacacactggcctcacaagattttcgtagaggattgtctgatttgaacatctttgattgttttattacttgaaggagcgaaggggacatatataatcttctgttaatcagttttgaaggccctgttaatcagttttgaaggcccagtatgctttttgcctatagttaaagtaaatttccatggagtgaaaggctagctaataaatctgaactctgctagtattagttaatagtatgtagatattattgtaattctgatcttaaaatgatggatattaacattaggtggaatcttagacattatcccagttactgagtctttatgacgtacttttggtttatagccatctgtgtactgcttgaacattttattcaaggatgttagctactttctgggccaaccattattgggcagctctaaatttctttcttttatttaatcaaagtttgcttttatgagaagtttatacttggatttctgcctaagaataatgtttcttctctgatataattattacttatatatatcatgaggcattttcattctcagagaaatgtgtgaaaacacatatttctttttaaggttgagggacttctaagttcccattttttacttagcacagtgccaattgttgattttaactagcaaagttattgaacagatcatttgcaggggaaaaatgcttctgtgaaatctttgagttcagtgttaattagaagttacacgacttggtgctggtaggctggtggtattgatgtggtgtgtgaagggcaggtgaggcagatactgatccttttgcctccctggaagtgaaactgaaggcatcatttgccccagctcagagtgacaccagggtaaattcttttagttttaatggatactgggaccttcaagtctaaaaaaaattgccagtaatacttattatcaacacaataagtaaccttccagggcttaaaatgatgtttatacaactgccctgttcttcgtaataccacagttcgaggcctcaagaagctatacttgagtgtttttaatgaacctggagatagatcttccttccaaaactgtgttcatcagtctggttttgtgattaacattccctttaactaaatgccttaaaactactaagccttaaatgggatgttaattctcttatctccacctgataggtgttagactgatttttcagctttggttctgccatctaagatgtgcttttatggaatgttttgaacaaaaaagaaacattaacatctgttacaatcttctcatttcaaagatgggaaaactgagttccagagaggtcaaatttcttgcctaagaccacacagttaattaatatcagtgcctcaatttgatcctctccttcttgattcaaggctcgatcaactgtaccattttgcttaaaacaattgctattactatttcaaaaaataactatttttaaatgtaaaattcagtagcattaagtacattcacattgttgtgcagtagtgccaccattcaactttctgtctctataaatttgactattctaggtacctcactgaaatggaatcattccatatttgtcatttgtgtctggcttatttcacttagcataatgttttcaagattaatccgtgttgcagcatgtagcagaatttccttccttattcattcgtttgtaagactgaattttatgtattcattttatgtatatgccacattttgtttatccatttatccattgacaaatacctctcaccttttagctattgtgaatgatgctgctgtgaacatgcatgtacaaatatctgtttgagtctctgctttcagttattttgagtatatacctagaagtggaattgctgtatcatatggtaattctgtttttgagagctgccatactgattttcacaccacttgacacctgcaacagtgatggaaaaaggttccaatttctccatattttcatcaacacttattattttctgttttttgataatagctatcgtaacaaatatgaggtgatatctcattgtggttttaatttgcattttcctaatgattaggaatgttgaccatcttttcatgtcctatctattcaagtcctttgctcatttttaattagtttttttccttgagttgtagaagttctttatgtgttgtgtaaattaatcccttatcagatatatgatttgcaagtattttcttccactgtgtggaaccatattgcagggtcctggctggagatgcatcaataaacaaaataggcaagttatttcccctcatggcaatagagaataaacattctcttaattaagggaattttaaggagagaaaaattgctccatgtagattgtcttttaaaattgaatcataaaatcatcctttttgctgtactgagccttgaaaggaggtgtttaaatagttcttgatagcataacacttttggattacttaacatttttctatttattattttttatgtttcagtgaatgcagcatttttactttttcttaatgattcatgtttgaactgaaaaccatcgaattaggagtagagcaaacagtgataggaattgaaatatagattcttgcagataaatgaaaaaacccattggataaattaaatatattttttatttgccagctctgaaaacattcttcagttattgttgaatgatgttgtaggagggtgcatttgatgattcaggacttaatgcaagcttttctaaaaacttgatttctcatcaagtattttaacatgtacagcttgaacaacatgggcttgaactgtgtgagttcagtttctttcaataactatattggaaaatttttttgagatttgtaacaatttgaaaatttgcagatgaaccatttagcctagaaatatcaaaataatgaagaaaaagttaggtatgttatgaatgcatacaatttatgtggattttgtctattttatcatttactaccatgcaatatacaaaaatttattataaaaagttaaaatttggccaggaatggtggctcacgcctctaattccagcgctttgggaggccaaggtgtgaggattccttgagcccaagagttccagaccccatttctagaaaaataaaaaggtaaccaggcatggtggcatgtgcctatagtctcagctgtttaggaggctgaggtgggaggatcacttgcgctcgggagattgaggctgcagtgagccatgatcatgccactgctctccagcctgagtgacagcgagaccctgtctgtttcaaaccccaaaaccaaaaaggtaaaatttgttaaaacttatgcacacaaatgcttagggaccacacatggcaccattcagagctgatagaaatgtaaacaaacataaagatgcagtattaaatcataactgcataaagttaattgtagtactacatggtgtactactataataatttcgtagccaccttttgttgctactgcggtgagcttttgtgttgtatctgcttaaaatgctgtgtgatggtaagcatctccatgtgagcagtccctgagcagttcctctctacagtatgactgtgtattgcaatagaaagtgatctgtcacagttctcacatatttgtcattgggcttagtgcaatactgtaaaatactataaacttttgttttttttttttgagacgaagtcttggtctgttgcccaggctggaatacagtggcatgatcttggctcactagcctctgcctcctgggctgaagtgattctcgttcctcaacctcctgagtagctgggattacaggtgcttgtgccaccacacccagctaatttttgtatttttagtagggacgaggtttcatcttgttggctaggctggtcttgaactcctggcctcaagtgatctgcccaccttggcctcccaaagtgctgggattacaggcatgagccaccgcgcccagccctgtaaaccttgaataacaccacagggtccacacagagtgattctggaagtggttccaagaagcagaaaaaagccatgatgctataagacaaagttgagttgcttgatatgtaccacagattgaattctgcagcttcagttgcctgccctttcaagaaagataaattcagcataaggactattgtaaaaaaataaaaaataaaaggaaatctgtgaaaccattgcttcagttttgccagctagcacaaacacttttcactttttgtgaaatacctttttattttgtattgaaaatgcagcttttatgtgggtgcaggattgctataagaaaggaatactagagactctaataagatttgagaaaaagtgaagtcattatgtgacaacttaaagcaaagagaagatgaaggatctgaaggtgaagaatttaatgccagcagatgatggtttgacaattttagaaagaggtttggcttaaaaaatttcaagagaacaggagaagtactttctgctaccaagaaactcatattagtcagcagatgagtttcctaggtgccattaagaaaattattgaggagaaaggatatctacctgaacagattttaagtgcagatgaaagtgccctattctggaaaaaaatgccaccaaggacatttattagcaaggaagtgatgagtgctcacagacctgtgccagatgataagaagtaggagaagcagtgccagaaaacaaatggacattgtacagtctggcagaagggttccagttattcaagattgcctttgacttttttttatgacatggaccatcctatgataggggcactgcattatttgaaataaatttcttggaaagactgaccagtctttgtatatgttaatggtcttgccaatttctgtttttccttatatttttggttgtgatttgataatgtgtttagataaataacttgtcaaaaaatacatacatttatagtttttaaaacatggcctatgtgtatgaaattaaaaggatataaaaagcacaattataggtaaatagtatgtatctttatattagattttttccctttaatttttttagaaagggcacaaagagcatttgacttgacatatgttaacaagcaagagagtgttggtccaatgagaacagaaagtttcctttgattgtgattttggaaaatttgatattttccacatggaattttatggtcagttggggtgaagttgtataggcaaatatgatgcatttccaattccctagtttaatgttttaaacttagtaaaatagtttgtttagtggtgtccaaatgagcatttacaactcattcttagcttattgcctttaaatttgatttttggttattggagaatatttctacatgacctatatctatgtcagaataattatattgacttttcctcagtatttggctttgcctgtgcacagcagtgggaaaatattatcctgtgacaacattctattctagtgacagcattttaaaaaatgtatctttctttcattatttttgtgagggagagtgaaagtcagtagtattctttgagttcaaaagaactctacgttgttaatgtatttttttttaaagcgaaatggcttggttagtaattattaaatttagcctaggttttctttttatgactacctttaaatttttttcttaactgtgttttgatgatttaatttctttttattttttattttattttttttttattatactctaagttttagggtacatgtgcacattgtgcaggttagttacatatgtatacatgtgccatgctggtgcgctgcacccactaatgtgtcatctagcattaggtatatctcccaatgctatccctcccccctccccttgaaatgtaagaacaaataatcattggcggttcccatattcaaaagatcagatagtgcttaggttagtgacagaagaaaatttctaataatagcatcataatccccttgtatagcattttgtacttaactaagtttcactgcatacaggaagttttttgatactcacaaccaacctttgaaataaacaggttaggtatccttatttctattttatagatctggaaatggaggattagggaaggtgatatggtagacctagagagataaaatcgcttgcattggacatcttttatttattttattttattttatttttctatattttgagacagagtcttgttctgtcacccaggctggagtgtagtggcacgatctcgactcactgcaacctctatctcctgggttcaagcgattctcctgcctcagcctcccaagtagctgtaattacagatgtgtgccatgacacctggctaatttttgtatttttagtagagatggggtttccgcatgttggccaggctggtcttgaactcctgacctcaagtgagccacccgcctcggcctcccaaagtgcagggattacaggtgtgagccactgcgcccgccctagacatcttttgattaattgatgttggaactattaatagcatgttgattaatagctattaatagcaggttctagataagaactttgtattcttcattatgccttataacttaaaaaatactgccagcttcttagaagaatctgttaatacttaacattgttcagatttcaactgactaatgagtcatttattcattaaaaaaaaattttggtgcctatcatgttaaaactgttgtgttgtaggccttggagtgtgaataccacttggtctttgtgtttcctttcttgatactttaagaatttagacaggtgttcttaaatactgtctaactcatacatctgcagccaagtttgtttgtttgtttggcttgtttttggaagatctaattatgacctctttactagaatactttgcttcttacaatttatatggtaaagtttaaaagctttaaaatattctttgatgccctctatggtctggcccctgcttggctttctacactcatctgaaacgtcctcctctctgtcccctccttcttgcttttaaaaattttctctccttttaccaaattgttcactattattgttttactattctgtatcctaaataactgtaactgactccagatgctactccagttgatactttttctgacctggtcacttcccctctaaaatatgctttaaaatatgagataatgttcttgtttttcattgtacttttcatagaagtgattttacactgctttgtgtgattatttaatagcctttcccactcgttttattttaagctccataagaaacatctctttttctgtggggcacgtttatcgtgaaaacctcgcatctgttgtagacatgagtaaatatttattggcatgcgtctggctgtttctttaacaatttcaattttttttttggttttctgatttatgaggttttagattgtatacttttttgacaatcaagttctatctcctattagctcacattatacatgcaaaacttactcttggccaaagtgaaaatcagtgatgttaattacttaaattaaactaaaattttagtgacttttcctattcagagttctcaaggtaatatttgaaagttattaattacatatataaaatatattgtataaacacacttcatctcctttttttcctgagcagttacattcttattttaagtagatgaattgtctgttttaaattaacttgtctagaagatgagataatgtaaaggcatcttacttcttttgtattttgtttgtttgctaccacacatcagttaaccattatttaagctgttccatattccgtaatactagcaccactttttggctcatatcgagcaagtatagtatataggccattccctccagagacttacaactcatgctgcaactcatttataaatatttattgggtccatggtataattccagtcatcattctacatgctgggaatgcagtggtaaacaaaatagaccttgtctctgtttcatggagccaatattctgaagaggtagagccaacactgcattaagacaaatacatgcatttcagataatggtgagtaataagaaaaattatggccaatgggatagaaaatgaatgttttggggagtttatttgtctaaaatggtcagggaagttctcttacatggatgtgacttttgactccaacctaaatgaccagtcaatggcagccatacaaagattttgggaaattgtgttgcaagtgttgggaatagctggtgcaggtctcaaggtagaaatagatatagttcatatgaaggacagatagaagtcaagtgtgactgcaacatagtaaagggagatagataagagattaaattggagaggtggtctattcacaaataaaagcaacgtaagtaggtataacctgaacaatttttagccttaatagtagagaagtaaagatttaaacaatgtagaattaaccatcttttttgtgtactgttaaatgaatataatattcagaatgttaaggattgtgacaccagtggtggaaatttaatatgacagatccttacaacttttctgctgtacagcttgactatatccatcaaaatctgtaagcatgaatatcttttactcagcatgtccatttttaggagtttgtccttagatataattaagcgaatgaccaataattagttatgataaaatggaaaaatgtaaatagcaaataatgaaaaacaggttgtataaattatgttacactcataccagttagcaatatgtaggatagccattaaaattttgttgtagtatatgtttattggtatagaaatgttctcatgataaatatcgagtgaaaaaaggtcacagaacagagggatacagagttagtctattaatctgaacaaaaaatatgcttgcacaggtaaaaaggctgggctattgctaaactgtttgtgatggtgttatgtgagtggtaggtaatgtgtggtttatgtattatagtggttaggagcatggacctcagaactggattccttgcatttaaatataggctctgccacttcctagccttgtggctgagaaagtctttgtgtctgagtttcctcatttgtaaaaggggcaattcttaattcttaccttcgagttattttgaggcttaaatgagttaacaaatatgagctgctttgaatagtgcctgacacataacaagttctttatgcaagttagctgtgattattactattgcatatttacttttttctgacttttttcagtgaacatacatttataaaattgatgggtcacctttctctcaaagattgtataaagttttatttgacatgccaaaaaggaaaagtttgtttttaatcacatgtattaatataataggtataatctattaataaatttataaacttctataaagcagttaagaaaataaactgaggaacagactgagtaaaaagatgcacaaaacatctgaaaaaattattgtatacagaatatatgaaaatatcctacagttgaataagaaaaaatacaaccaattaaaaaatgggcaaaagacttgaacagacatttcacaaaggaagggtcaccaaacacataaaaaagaacccaacaactatacataagggaattgcagattaaaaccacgttgagaatgatcataacagctttattcaaaataatcccaaactgaaataaccctggagattaaataaattgtggtatatttaaacaacaaataccactcatcaataaaaaataatgaactactgatatatacagttgtgtttcctgagtgaaaagaactgggcacaacagaaacatggtatgattctatttatatgaatttctggaacaggcaaaattaatctgtagtggaaaaaagtctaaattgcctttgggaggatgaaggaggaaggattgattgggaagaacacagggaattttctggggagatggtgatttcagtatctttttggggtgagggttataacacagttatgagtatttgtcaagattcatgaaattctacagtttttagaatatataaaaagaatataaaattctttttatattttactgtttgtaaattttacctaaagaaaaaaggactgaaaacaaaattgaaatctgtttgcttttttgcagtggaatgagttagcaactaatgatatgagttaagcaattcttaaagcactttctgtgtattctaggcttgactaaataagtaggcttattcagagtaatggtatccaggtttttcacctgtggagaaggagttacaaatatgttaaagagaaagtctatatttatttatcgttttatttcttctttgagacggagtcttgctctgtcacacaggctgtagtgcagtggtgcagtctcagctcactgcaacctctttctcccaggttcaagagattcccgggcctcagccttctgagtagctgggattacaggaacccacccccatgtctggctaatttttgtatttttagtagagactgggtttcgggtttcattatgttggccagacttgaactcctgacctcaggtgatccgcctacctcggcctcccaaagtgctgggattgcaggcgtgagccaccgcacctggctgtggaagactatatttaatggtaggccgtcatggaaaaaaaagaggaggaagactataattcaccttggtattgtatttgaattggaggtatcagaatgaactcatggtttttaatacaaagatatgtcacatttacacctttttgttcatattgttgccgttttcttcttatttaacatcagtacttttgttgaatttagacactaggttgagacattatgccccgctgctgctctattgacggtatattgaagtttatataggttaatggggtttttgtttgtttttcttttttttgaagaattttttctttgcatgaaattttactctggagattaatatgtaaaaagttcaacatacatattgaaatgctcagatggaattggggagatatgcagcctagtagtttgcatttggtctctgcatggcagatgtttggataaacaatgaatatcttttggtatgttagatattaagttctcagtaagcacagagtggctttttaactgtattattgtgtagcatcgaatagtatctaatacttagtacttgcctaataaatgtggacttaaattgggtattttttcttttgaattgtagtgtttcagagtgttggaaaatcttagtaactaatatataaatatattttttcataaatgtagtattgaagtaataaaggtaatccttaagtaaactataagtattcatttttaaaaaatgactatattgaggtataatttacataccataaaattaatctgtttttaagcatacaattcaatgatttttagtaaatttaccaagttgagcattcatcaacataatcatgtcaccctaattagatcctctttgttacagttaatcctaattcttaccccaacttcaaggaactgtagatttactttctgtatctctagaaatagaaaatatctctagacatgttctgtccctggaatctataatatgttgtggtcttttgtttcagggttcatctaccttgtaacatgtattagtacttcacttctttttattgctaaatagtagtcaattggttggatagaccactttttatttatccattcaccagctgatagacatttgtgttgcttacacttttaaggctattatgaataatgctgccatgaacatgtagtctttgtgtggacttaatggtttcatttctcttgggtagatacctacaggggtatggttggattatatagtaaatttatgtttaactttttaagaaactgcaatctgttttgcaatatgatatcattttatattccttccaacaatgtatgaggttcttgttttttcacagccctgctgacatttgttattgtctgtctttttgattatgtccattccagtggggttgaaatagtatctcatggtagttttataagaattcatttttgtttgcttagttcattttaagattttggattttatgtatggtaataagacatttattacacttttattttagtggtaggcagcttttcttatattttcctatttttcatctaatattttaattcaaataaaactattccagaaatttgaaaaatgttaacatatttttatatctcgacaaacaggatataatttgtattttatttgcaaatgctaaaatcattgtaattaaaaatatatgacaaaagctggccaggcatggtggctcacacctgtaatcctagcactttgggaggcagatgctggtggatcacttcaggtcaggagtttgagaccagcctggccaacatggcgaaaccccgtctctaccaaaaatacaaaaattagccaggtgcagtggcacgctcctgtaatcccagctactctggaggctgaggcacgagagtctcttgaacctggaggcggaggctgcagtgagctgagatcgtgccactgcacttcagcctcagggacagagcgagactctgctttgaaaaaaagaaaaaaaatggcaaaagctaatggatgttgaaaaagatactccgatacactgctgacgaatgtgaaaattcagcgtgatatcatgtatgcattaaaaagaccactgtagaaggatttgtattcatgtaaagatcttagtgatctctaagatatgttgtttactcatatcaagtaggctgtagacatacacctatgtgtatattctcattaaaattataaatgtatatttgagtgcatgaaatgaatatacagaggtctgcagggatatatgataaactcataaaaagttgttacctgtagagtgtggagttgggagtaaatagtattagcttttcattttatctatttaattttttaaaactttaaaaactttttttcttttcattgagtattgatgtgtaagttaagtagtcactgtgtaaagaaatatacatcttagctttttaaactgttttcatttctaagttgagttagcaaagaactgtactcattttattttggaaaaagtgaactaatcttattttactgtacaggatatgagtaataacaaaaatacatttttggaaccagtttgtaggttcaaactttgcattttgggactctatataaatctttagatccagctgttgctgagaatattctttcaattgctatgaggtgtgttgattttaaaagaatggatggctgttcctcaagtgtacatatggcaaaaatttaatggtatcgctatgaacttgaatggattgtttaatttctttgcatcgagtagtaagaaccacacttccatcatttttatttaaaatttagaagaaggaatttttttttatagaaatgcccatttggtcctgaaatttcatcagctctctgttatagtttgtcaacaaatggtacaagcaaagtctttcaaagtatttgttaattaggccatattcatttttagtcttcgctactatacagtcaagacctacttgtttctatttcctttaatttatcctggagtttgtccaagttgagttttaatgagttgtttatcccactagttacactaggatttatttttccctagagagtaatgtttgaattgatagtttttaaacctattctgtaaaatgaacatatgttcagactaagacttctggatatgaggaataggcatgtgttaaagaaattattttatattcaacagcttaactgttaaaatggaaatttagtgatatttcaaaatattaggtaagtccagaagttagaaatttttggtatgaatttatattgaactattttgttttaagtaaagtttaataaatatgtagtagtctaaatcacaaggaaaaatacactttttattgtgcatttttattgacactttaatgactcccccaaatagtttaaataaagttgtaaaagctgttgatctttaaaaaattttttgaggtgaatatggtataatgttatgtcttgatgaattggtaatagatacattgagtatttgttattttctacatttgttaaccagttacaaatatttcaaaattgacaaaaacaaaagagaaaaacccctcttcattggtattgttacattaacagataattgtgtaagataccatctatacccaaatcattttaaatttatttatgtcagtttaaatactactggagtatctaacagaagtataaatagaatgtatttttatttgttgtgggttacagctgaaaaataaaccacaaagacatatcctgtgtgtataattggcgtgtttattattgaattctaacttttgtacaaagtaagcttctcctttgatattaaaataattaaggagagaatttttccctacccttgggcattactaaaatgtacaatatattaatctttctgaatttgcatgtgtttaagtttttattcaagtctatgttatccatttgggaacattttaggtgatataagctggcttgaaagggtaccatatacggtagctgaatttattatgaaatagtaaagacctgcttgtaaaaaaaatgaatcccatctataatattgccatacaaatacttactgctgtagttatatgaacatggctcttgctacacgataggacctcctaattgccacagagtgcctgaagatagattaattgtacattttcgtattataggagatattccaaatatctgtgttctttactacttatcactaataaaatgttgtgggttttttggtgcaggggcggggggcggttcaggaatttgaacagaaatttgagaacatagtggagagacctagttaactattttaaaatgcttatagaataaaaaggaaaatgagaaagaaaagaaaatgtctttaaaaatattctaaatgttggaaaagcgaaaggaaataataaggataattacattcagatttatgaattgagtcatatttgtttatccttctatttcttttgatctctactactttacctgtttggcataagggatcttttatttactgcatatttattttctggtccattcattccaatcctttggcttttatagccaaatatgatcagaattgtggattgagggacacaggtagtgtcacatgttgctattaaggatttgaaagttgttggatgggatagtggctttcttattgggcaactgtgtatttgattgatcttacatactaattaagagagatgggtaggccgggtgcagtgactcatgcctgtaatcccaacactttgggagggtgaggcaggatgattgcttgagcccaggagtttgagaccagcctgggcaactaagtgagatcctgtctctataaaaaaataaaaattagccgggcatgctggtatgcacccattgtcccagttactcgggtgactgaggtgggaggattgcttaagcctgggagatggaggctgcagtgaaccgtgatcatgctactgcattccaaccagggctagagtgagaccctgtcttaaaaagagagagagagagtgacggagacagagacagagacagacagaggcaggggtgaccctaggcttttgtttttgttgtttggacattttttttttttttttttttgtgagggaaggcattggtatttgaatcagttttgctaagaacagagttctaatactttagggacctagtttgttttcattgagctaaaatttacaacataaatttcatcattttaaagtgtacaattaagtggtttttactatattcacagttttgtgcagtcatcaccactatctaattccagaacattttcaaaacctcaaaaaagaaattctgtctctatgagtctagacattttataataacagaataatataatatgtgactttttggtctgacttctttcagttaatgtaatattttaaaggttcatccatgttatatagcatgtatcagtatttaattttttatcactgaataatattcctttgtatggatcgaatacattttgtttattcatcagttggggtacatttgtgttgttctcattttttggctaagaatagtgccgcaatgaacattcttgtgcaattttttggtatgaacatgttttcagtcctcttgggtatgtatatacctatgaatataattgctgggtcatatgataactcaatgttcatcttttttacaaattgccaaattgtgttttacatagtaactatacctctgtgcgtgatgttccaatttctacctattcaggccatacttgttattttctgcttatttttattttttaaaattacatcccttctgatgggtatgaagtggtatcttgtggttttgattttcatttccctgatgtctaataatgttgagcattttttcatgcgcttattggccatttgtatatcttctttgtcaagtgtcttttcaggtcctatgttcactttaaaaattgggctgtgtatcttgttcttgttgaattatgagagttatgaattatgagagcgatctcggctcactgcaagctccgcctcccgggttcacaccattctcctgcctcagcctccccagtaactgggaccacaggcacctgccaccacgcccggctaattttttgtatttttagtagagagggggtttcatcatgttagcccggctaattttttgcatttttagtagagagggggtttcaccgtgttagccaggatggtctcgatctcctgacctcgtgatccacctgcctcggcctcccagagtgctgggattacaggcgtgagccaccgcgcccggccaaagttcccttatattcttttaaggatgaattgtgcacataaattgactatgtatactaggctgttgtaaacagggtaggaaggataatagaaagtctgggaaattctggagaatttcattttacttcttcgtagctgcacattcctttatctatttgaatgcccatagaattttttccttatcatttttggagttcagtggctttactaggataatgatcattcagaatcagtattgtttgtgacacattgtgcacgttgtagtttaggtgtttattttagacaagatttttttttgataaatatttctgtatactatttcttttctatttgttttcctcttttctttaggaacactgattatgtatattttatattgccctttcctgttactgatatcagtgtccttttctaatattgttttataatttttcaaaattgttatttttgtatttctagattttatctaccacgttcctaatttgagttatattttatttgttgaacttctggctatttggagatttatacataactttatgatattagtttatagtttaaatccattgtgatcagcacatatattgtatatgatttcagcctttttcattctacttagacttgcttttatgttcttgtagtatgccttggtgaatgtgtactctgctgttgttgggtggggtgtcctacaaatgtcagttaggccaagttgattgatagtactgtttttgtttttaattctttacttacggtctatttgttttatcaattcctgagagaggagtgttgaaatgttcaggttttggatttgtctattcctgttttcagttctgtattttaaaaaatgtatgtatttcggagatgtgtagtgcctacaaacttaattaaccatgttatcattatgaaaaaaatctctctatatccatggtaatagtctttgttccagagtttactttgtctaatgttaatgtgtaactcttttttgattagaattatgtggtgtttgttttgctcgttcgtttactccttcatgcccctatccccttaatttttaacctatctactttattatttaaagtggatatatatgggtctttttttttttaatataatcgaagaatctcttccttgaattggtatgcttagacgtttgagacttaatactatattttggggtttagttctagtatcttgctgtttgttttctagttgtcccatctattgtttgttttcttttttcttttcataactttatttagattcattccgtttcatcctctctattccattcttattccactctgtctacactattgcctttattagttttaccttttagttttatggctttagttgttctagggtttacagtttacatcttttacttatcacagctaccttcaaataatgttatactgtgtcatacattgtgtaagaacctccatttccctcttcctgtccttggctattgacattgtgcattctacttttacatatgtcataaactctgaactatgttgttatgatttttgctttaaacagttaattcttaatcttattagaagataatgtttctttcttcttcttttttttttaaaaaattcacccatatatttaccattcccattctcttcacatttctttgtgtagagccacaaatatttccatctggtatcacattcatttagcccgaagaattttctttaacattttttgtagtacagatatgctggtgaggaattcttcccagcgtttagtcataaaaaagctcttttgctaacatttttgaaagttttttttttcctgaattttggattctaggctgacagttttcctttttctttcagcatttcagtcatggtattctgttgtcttctgttctgcatgatttctgatgaggagtctgctttcattttgtagctttgtttctttacatgtgatgtgtttttctccttaacactagttttcagcaatttgattataatatgccttggtatgtttttaattctcttctgcttggggtttgctgaatttcttggatatttgggtttatagttttcttcaaattgcttgatagtgtcccacgtcccattaaagctttgttcagttattttagtctctctctctctttttttttttttttttttttttttgagacggagtctgtctctgtcgcccaggctggaatgcagtagcgcgatctcggctcactgcaatttctgcctcctgagtttaagcaattctcctgcctcaggctcctgagtagctaggattacaggcacatgccaccacgcccagctaatttttgtatttttgctagagacggggtttcaccatgttggtcaggctggtctcgaactcctgaccttgtgatccgcccgcctcggcctcccagagtgctgggattacaggtgtgagccaccgcgctgggcctattttagtgttttatctttcctggtcctcgatttcctgggaactcctcagagactagtcagctagtgggagaagagagggaagcatttgttcctacatttccatcttctgcatatatgattgcaaagtagtttgctggtgtctcatgctgcatggtggctttaggcaatgcaaatgaaagtgtacattgaattggtctccatagcagcggccagaatatgaggtagggtgatatacaagagaagttctgtactctccatgtgtggttacagttgggaaaatgacaaatggtggagggtttgtggggttaaggaaagagcaggttacatacagtatactatagtagcatcctgattttttttaatctatttttgttttattgttcttctattttatcttgcatgtttattaaccttcagtataaacttgttgctcacagacatattgaaatgttttcttactttgaggctttgttatttagaaaatttaattacataattcactttattcatagacaaaaccaaatgaataagggatcaacaaattagatattccagggcagaaattttaaaaataattttccatgttactatcaagtagagtcctgcatgtaatgtaaatacttcataaatacttctgagagaaagtattaggatagagggctgtggatcaggttgcctggatttaaattctaatttttcctctttttagtagtatgacatttcataccttaatatatcggtgtgtgtcttggttttcccatttgaaaaactagtataatgatagtacctccctcatagagttattatggaaggattcaacgtgttaacagataaaagaaatctagaacaatgcaggtttgctagtaaatcctttctaagtgttaagaagcactatttttatttttactcaggatgattgccttgattatgtagtaattgcttgagcagtatatgtgtaggtgaatatgtgtgtatggacatcattctagtttgtatttttatattattcagagtttctgaaatagtggaacttaaagttagcagaattgcatatctattttgtttaagtagtatgtttgcatacatactttggatgtataccctttcttcccttgcaacctaagtcatttagtattttgttgtctgtaaatgctatttactgtattgcgattctttctgttttcttgtgcaggaccaaaagatctcagattgctataactgaaggtatatttgaacttccaaatctcacaattcaagctacaagagcacagacacttctcttgcaagcaatatatcaaagttggtctcatcttggaaatgtcagctcttccgcagtgattgaagctttgataaatgaaatcttcctaagtataggtaagagcacagtctttttgataactatatggaaaatttgtgttagaggcaactaatattttattatgaaaatccatatgtctagcatggtcaacttaaattgtaatatgtttctttgaatgtagatatttatagcttatgtttaaaatccagattatgagttaagccatccagttttatttcctcgtacctatttctgcatatgtttcataattgcaaaagattatttttcaccagcttcttgtataatttaccctttggataacttttgagggtatcaatgtatgtgtttgaaatgataaccaaattaagtataagtacagtatgtttgattatactggtaaaatgaaataaattcttactcataatatttggttagtttggtaaacaatttttgtgtgtgtgtgtgaaaagcattaatctggcacccttaaggagttaattaactactaaaaatacaaatttctgctttcatatcactataagagatatcttcatcttatcactcagtttgcatgtaaacaaaaaattatagaagctttttaaagttgtttcagttcaaaataataatgttatgtttgtcagtaacacaaaagtagtttttaaaggttataatttaagtgtaattatgcttaaagtaacattatttttaatttatctgttaaaataaagcgacttttgttcttatatgatgcttttgaaggttttaatttcagacctgacatcataattagagttttcttatttggcctagccattaactaatgtaaaatacaggttgattatcccttatccaaagtgcttggtaccagagtgattcaaatttcagatttttttcagatttggaatgtttgcacatacataatgagatatactggagatgtgactcaagtctaaatatgaaattcatttacatttcatatacaccttatacacatagtctgaaggtaattttatacgatatttttaataattttgtgtgacttaatcacatgaggtcaggcgtggaattttctacttgtatcatgtcagtgcccaaagagttttgaattttgaagcatttcagattttgggttttcagattagggatgttcaagttgtagtagttttggtgctggcttttagcattatataaagaataacaagataaatgttgcagtaggctagaggttcttcactcggagcttatgaaaagacttagagttttctgaaccccctgaagtagtatgcaaattttagtgtgtatataaacacacacagacatacatatttgtatcctctttttgaattgaacttactgctcctgtctaactgaaactttgtaccctctgaacaggatcttcctgttacatacccacccccactccattccgcctacgtttggtaaccaccgttctactctaactaccattctactctctacttctatgagtttgacttttttagataccacatttaagtgagatcctgcagtacctggcttatttcacttagtataatgtcctccaggttcaactgtgttgtcttaaacgacagaatttccttctttatttaaggcagaatagtaatctattgcggatatatgccatattttctttatccattcatcccttgatggatacttatactgatttcatatcttggctattgtacagtgaacatggctgtgcagatatctctctaacatgatttcattttctttggacatatacccagaagtgggattgcttatatttttagatttttgaggagcttcaataccgttttccataatggttgtattaattttcttttttcttttttttgtgagatggagccttgctctgttgccaggctggagtgcagtggcgcgatctcggctcactgcaacctccgcctcccaggtacaagcaattctcctgcctcagcctcccgagtagctgggactacaggtgtgcaccaccacacccagctaattttttgtatttttagtagagacggagtttcaccatgttgactaggatggtctctatctcttgacctcatgatctgcctgcctcaacctcccaaagtgctgggattataggcgtgaaggttgtattaattttcattcccaccaatggtattctctttttctccacatccttgctaacacttatctttcatcattttgagaatggccattctaacaggtatgtggttatatctcattgtgaatttaatttacatttctctagtaattaatgatgttgagtatgttttcatatacttgttggccatttgtatgaaccatttatatgttggccgtttgcattgttcaggaacccgttggccatttgtcatcttttgagaaatgtctgttcaggtcctgtgcccattttaaaattgagttatttgttttcttattattgagttgagttccttagatattttggataacaactctttatcagagggatggtttgtaaatttttctcccagtttctgtgttcttccttcattctgttaattgtttcttttgccgtgcagaagtttttgtttgatgcagtcccatttttctgttattgctttcatttcctgtgcttttagggttatagtcaatgcccagaccaatgaagctttgtccataagtttcttctagtagatttacgtttcagatcttatatttaagtctttaatcccttctgaattggtttttcctcatggtgttagataaagattcaatctcattgttctgcatgtagatatccagtgttcccagcagcatttattgaagaatctgttctttccccattgtatattcttggcatcttcatcaaagatcaattgtccataaatgtgtgggtttattttggattctgtcttgttttgtaggttgatgtgtctgtcttcatgccagtaccatgctgttttgattgctatagcctgttagtataaagtcagatagtgtgatttcttcagctttattcttttttgtttaatattgcttttgttctttgaggtcttttattccatatgaatttaaggatttttttactgtttttgtgaaaaatgacattggaattttgataggggtcgcattgaatttgtatattgctttgggtaatatggacattttaacattaattctccaagttcattagcacagaacatctttccatttatttgtgtttttttttagtttcttttatcagtgttttatactttttagtatacagacctttcatatccttggttaactttatatccacatatttttgtttttgctgttataaatgggattgttttcctaaattttttttggatagttttagttttggacatgttaatgcataaaaatggtactgatttttacatgttgattttgtatcccacacctttactgaattcacttatcagttctaaaagtttttggatggagtctttaggggttttttttttttttttttgagttggagtctccatttgtcacccaagctggagtgcagtggtgtgatcttggctcactgcaacctccacctcctgggtttgtaactgagattataggcacgtcaccacacctgggtaagttttttgtattttagtagagacggggtttcaccatgttggtcaggctggtcttgaactccttacctcaagtaattcacccacctcgtcctcctaaaatactgggattacacgtgtgagccactatgcctggctgggatttttacgtataagatcatattgtcaacaagtagaggcaatttaacttcttttttttctattacaatgccttttctttcttcctcttgcttagtttttctgaataggacttccagtactgtgtggaaaagaagtagtgagaatgaacattcttgtcaggtccctcatctttaaagatttcagcatttcactcttccatatgatgttagccatgggcttgttctgcatgtcctttattgtgtttaggtacattccttctatacctaatctattagtagttttgatcacgagaggctgttgaattttgtcaaatgccttttctgcatctattgagatgatgatatgacttttgtcctttattttgttaatgtggtgtatcatatttattgacttgtatttgttgaaccatccttgcatcccaaggataaataccactgtatcatggcaaaagattattttaatgtgttgttgaatttcatttaatattttgttgagaatttttacatctatgttcaccagagatattggtctgtaagtttgttttcttgtagtgcccttgtctggctttggtatgaggataatgctagccttctaaaatgagtttgaaagtattctctcttcagatttttggaagagtttgagaagtgatcaatattagttgttctggtagaattcatccagtccagaacttttctttgatggggactttttgttactgattcactcttcttactcattattggtctactcgtattttccattctttcatgattgagtcttgataggttaaatgtgtctgggaatttattaatttcttttagcttatccaatccattggtgtagcattgttcacagtagtcgattctgatgagtctctatatttctgttgtttctatcagctgtaatctctccacttttatttttaattttatttatttgagcatgctcctttttcttagtctattgaagggtttatcttgtcaaaaaaccaaatcttatacttcagctgcatttgataggttgtgtattttgtgtttccattttcatttgtctcaagatacattttgatttcatcttttacctgttggtaatttaggaacatgttgtttaattttcacatatttgtggttttccccaagatttctttttggggtggtgaaaatattctgtaattatatagttgtgatggattcacaaccttgcgttaggtaatcaccattaatttgaatggcaaaaaacacgattacatttgcaccaacctaatatatatggtaaaatccacttaattacacactttgaaaaaatgagggttatgttatatgaattttatcttcaaaaaacgttttaatttgatgattatttaagtagactgtgttattgccaatcttgtggccgttattttatatggatttactattcaaaatcttacctttttgatgccagcccatctataagttaactctacagtaacatcttccttggcattagcacttatcactgtgtgaaactgtctaattcatttatttgtttatttgctaaatttctatttcctgtgatattttcttcagagtattttttggtttattgtctcacaatattaatgttttttttaaattttaaacttttatttttattaattggcttagatagcctgaacatttgtgttagtaagctcatgaaattattatttgcttttataatttttctttttcctagccaaacctattccatttttacttttctgaatttataaaatggactgtgctatgaaaaagcattttatttgaaatttcctattctaaaaatattctgtgtttaaaagaatggtggcatatgtattgaaaaattgattaggtaagtgacaacagattgttatttgtaacctcaagttctgtcatttagaaacctaaaattagtggaactaatttttgcatattgaggagttgaagaaattagaatgatgttaagacatttctttgccaaataattttatttttatcaaatggaatgcctataaaatttataacagattaaagagaaaccatcagctaagacagttttaaaaagccagatttccaggtggtcagttttcttgtcttttttccccccgagaacaaaacctcattctgtgctttgtattcttatggagtgcttaaaggattgtgccttcaaatagttctatctaaagatccacgaaatgtgtatgtatttagggtgtaaagttttagcattttattattttgcgtctgaggactctcattacatagtactcagcactgttaagctttgtttaatatgttttgtgtaagtatgtgatcctttgctttacaactagttttcatttcccacattaataaagagattatacaagctgtgtacatttttggatctctcagacttaggttctgataatgtgtgaaagaagaaccattattattatcattatatatatttttttgagatggagtctcgctctgtcacccaggctagagtgcagtggcatgatctcggctcactgcaagctccgcctcctgggttcatgccattttcctcccgagtagctgggactacaggtgcctgccaccacacccggctaagattttgtatttttagtggagatggggtttcaccgtgttagccaggatggtctcgatctcctgacctcgtgatccgtctgcctcggcctcccaaagtgctgggattacaggcatgagccaccacacccggcccagaaccataatttttaaagtctacgtttgactgtacaccacctttcatcataatctcatgcctctagcctaccctcctacttgctgtcttaattcatattattgatagttacctaccaacaatatccagttttttcctgtgtatggctttttcttctatctggaacctaattctgtttgattacattctcctacagtttcctctcttctttgagcactagctttattttaacattagtctttttcctttaatttaacactatgctaattacagtctacttgtacttcagaaaaattacgttctcttacacattcctacctttttttcaggtattctcccctcttccatgtcagaaatattttattctttcttttcctttcccttccttctgttaagtttttaaaaacagttttatttatataaaatttttgtaccacactatttattccttttcaggtatgcagtttagtggcttttaatatattcacagagttgtatatccattaccataatcaattttagaacgtttccagcatccctgaatgaatccttgcattccctagctatcactcctggagcctcccattttcccagcaataggcaaatactaatctactttttgtctgtatggatgtgcctattgtggatgcttcatataaatgaattacataaaatgcagttctttgtgactgcatattagtgcatttttccacttagcatactatttcaaagtttgcccatattatagcatatgtcggtgctcattcctttttattgccaaatagtattccattttatccatataccatattttgttaattcattcatcagttgatggacctttgcattgtttctacttctgaatattgtgaataatgttgctttgaatattcaagtacaggtttttttttgtgaatgtatgcttttatttcttttgtgtatatatacctataaatataattgctgggtcatatggtaattttatttgtaaccttttgaggagctgccagactgttttccaaaccagctgtaccattgtactttccattggcaatgtgtgatggttctaatctctccacatcctcctcatattgttatctgtcttttgtgttccagccatcattgtaggtgtgaagtggcatcattatgattttcattttcatttccctcatggctaatgatattgagtatctttttgtgtatttattagctatttctatctcttctatggagaaattattcaaatcctttgcttattttaagatctgcctctttttcttttaaattgtgagatttctttatatattttagataaaagtttcttatcagatatgatttgcaaatgtttcctgtaattttgtgggttgtctttttacttttctgatggtgaccttttgtctaatttttttcattaccctcaagtacatcttctttacattggaccttgttatcatttagaaatggtttatccctttgatactgatattgattcttggtcatcatcattacttttagtccttttatttttttcattttttttaatatcacagaatccttcttggtcttattctttagcttcattcccattggccaacattttctatgacactataattttagactatttttctttcctttctctgtttatctttgttttctccatgcctgttctgtcattcctgtttgcaaataagaaatgtgtatatgtttcacttttactaccaccaaaataactgtatctgacctgaattaaactgttactgatttctgatattcttataaaatgcatgtatataattgagttccagttttaccatttctttcattataaattgtgatttattagcgagttttgaaatcaacttcattgattactactaagaatttgaaaagactagaatagaaactttgtgcctcagtcttctcattctaaatgttggactaatgtgccaccaaaagcaataacaaatttaacttcaagcatcaaaactgcaaagtgcttttagtaagaaaagtttttctttgataaatgctatatccaaaagtaagagataaattttgagtgttgaatcagtcactaatttctattttgtgaatgagtttaagaggctttaagagaatatctgtggatgttgaattatgttttatgatgctacaataatgaatccttcctcagctcttgcaaaaatcaaattaaaagtatattaaaataaaaaagaaaatgttatatgctagtgcttgctagggatttgattttgtgcattgaattatagtaatctttatgttacatataaatactggtttagtgaatgtcttactatttctgttgcgcattattttcacttttcaactattgacacttaggaaagatcactgaattggagtgtgaagattttctcaataactatatatgactaaataaaggtcagtttgtttcattaagttttagttaattttctcatctataaaataatgaaaatatgtttatagctgctcatagagttcttgcaaatgccaaatatattattgtttgtgggcttaatctgttgttcttgtcctagacatagaccttgctggaatcatccatctaaagatattacctatggaagttgttctaggatataaagttcttggagactgagataacaacagtcagaattgtagtctaggtgatccgttattttggttgcaaggatgatagagtgaaggtaaattcaaagagtaagccaagaaagaaaataggataatgaatagatattgatgagaaaagaataaaattcaagacattggttaggtctggttgtttgaacttagtgaagaaagtgtacatttgtgccctgttaatgtagctatttacaagaggcctcactaggctcacagaaatgtatgatgaataaatattttcagttctacagattcccaaggggagggagtcaatagacctgtgaatggatgtgacaatgcaatgggatatctagaagaaatgggtaaattcctggacacagcctcacaaaactaagccagaaagaagtcaaatccatgaatagacccaataacaatttctgaaattaaggcagtaattaacagcctaccaatcaaaaaaagcccaggaccagatggattcacagctgaattctaccagaggtacaaagaggagctggtaccattccttctgaaactattccaaacaacagaaaaagagggactcctccctatctcattttatgaggccagcatcatcctgataccaaaacctggcagagacacaacaaaaaaaaatgggcgtggtggctcatgcctgtaatcccagcactttgggaggctgaggcaggtggatcacgaggtcaggagatcgagaccatcctggctaacacggtgaaaccctgtctctactaaaaaaaaaatacaaaaaattaactgggcgtggtggtgggcacctgtagtcccagttactctggacgctgaggcaggagaatggcgcgaacccaggaggtggagcttgcagtggagcttgcagcttggagccgagatcacgccactgcactccagcctgggcgacggagcgagactgtctcaaaaaaaaaaaaaaaaggaaaatttcaggctgatatccctgatgaacatccatgtgaaaatcctcaataaaatactggcaaactgaatccagcagcacatcaaaaagcttatccacgacgatcaagtcggcttcatccctgggatgtaaggctggctcaacataatgcaagtcaataaacataatccatcacataaacagaaccattgacaaaaaccacgtgattatctcaatagatgcagaaaaggccttcaataaaattcaactccccttcatctaaaaactctcaataaactaggtattgatggaacgtatctcaaaataataagagttatttatggcaaactcacagccagtatcatactgaacaggcaaaagctggaagcattccctttgaaaactggcacaagacaagtatgccctctcttagcactcctattcaacatagtattggaagttctggccaggataatcaggcaagaataagaaataaagggtattcaaacaggaagagaggaagtcagattgtctctctttgcagatgacatgattgtatatttagaaaaccccatcgtctcagcccaaaatctccttaagctgataagcaacttcagcaaagtctcaggatacaaaatcaatgtggaaaaatcacaagcattcctatacaccaataatagacaaacagccaaatcatgagcaaactcccattcacaatttttacaaagagaataaaatacctaggaatccaacttacaagggatgtgaaggacctcttcaaggagaactatgaaccactgctcagggaaataagagagggcacatacaaatggaaaaacattccatgctcatggataggaagaatcaatatcgtgaaaatggccatactgcccaaaataatttatagattcagtatatccccatcaagctaccattgactttctcaacagaattggcaaaaactactttaaatttcatatagaaccaaaaaagggcctgtatagccaagacaatcctaaacaaaaggaccaaaactggaggcatcatggtacctgactttcaaatatgctacaaggttactgtaaccaaaacagcatggtattggtaccaaaacagatatatagaacaatggaacagaacagaggcctcagaaataacaccacacatctacaaccatctgatctttgacaaacccgacaaaaactagcaatggggaaaggattctctgcttaataaatggttttgggaaaactggctagccttatgcagaaaactgaaactggatccattccttacatcttatacaaaaattaactcaagatggattaaagacttaaatgtaagacctaaaaccacaaaaaccctagaagaaaacctaggcaataccattcaggacataggcacaggcaaagactttgtgacttaaacaccaaaaggaatggcaacaaaagccaaaattgacaaatggaatctcatcaaacgaaagagcttctgcacagccaaagaaactctcatcagcgtgaacaggcaatctacagaatgggagaaaatttttgtaatctgtttatttgacaaaggtctaatattcagaatctacaaggaacttaaacacatttacaagaaaaaaaaaccctatgaaaaagtgtgcaaaagatatgaacaaacatttctcaaaagaagacatttatgtggccaagaaacatatgaaaaaaagctcatcatcactagtcattagacaaatgcaaataaaaaccacagtgagataccatcttataccagttagaatggtgatcattaaaaagtcaggaaacaacagatgctggagaggatgtggagaaatagaaatgcttttacactgttggtgggagtctaaattagttcaaccattgtggaagatagtgtggcaattcctcaaggatctagaaccagaaataccatttgacccagccatcccattactgggtatatacccaaaggattataaatcattctacataaagacacatgcatttttatgtttattgcagcactattcggaatagcaaagacttggaaccaacccaaatgtccatcagtgatagactggataaagaaaatgtggcacatatacaccatggaatactatgcagccataaaaattgatgagttcatggtttttgcagggagatagatggagctagaaaccatcattctcagcaaactaacacatgaacagaaaaccaaacaccacgtgttctcactcataagttggagctgaacaatggaaacacatggacacagggaggggaacatcacacactggggcctgttgtggggtagggggataggggagggatagcattagaagaaatatctaatgtagatgacgggttgatgggtggctcgaaccaccatggtacgtgtatacctttgtaacaaacctgcatgttctacacatgtatcccagaacttaaagtataataataataaaaacacgaaacttatactttcatttacttttcacatactttacagctgtctgcttagcatttttcatctagtgagctgtataatgtaaggactggataccattaaagttacttggatagactgagttggctcacctattttagattgatatgtctcatttattaatttcattggcttcttaccaggaatattgttgttggcaggttatatatccttttttacagatgggaacatttatgcttagaacaatttagtgtttttcttaaatatcatcccgcagctattcactgactaagtcattttttgaagccaggcctttggaattttctgctaccattatgtctgcaataccaaactatctctggtaaatgagatcagaaatagagtaaagtgtgttacttcattagaaaatattaatgaaattatagcaaatattggaaatttaattaaaataataaattataaaggataaagcagagattaaaatttgagctaaatatgtattattaatcaggttattgaatatatatttttgttattcgtgtttctgatggctcttaaatcatagaaattctaaccctgtctttttgcgagaagattaaatataaagtcacacatggctttggttttgctctggaaaacaaggacttgctaccacttttccttgttcagaagttcattattttgttgacagtgtagtttcattaatctggtatttgcagggaaataacttacagactttaaaatctgtgctaaaggtgatcaaatggacattcgaatccctcatttaagttatgtcttaatgttaaaataaaaatctactttccagaaagtaactgttaaagtattttatgcaacatttcatgtgggataccttaatggttgaataataaattttacctcataaaaatgaaattcaataatacagtagctttctcagcgcagtagcatctggtctattctcatgagagccaatattttccaactcattaggatcatgtcgttctgtatgtcgtcaacattgacttagccaagcaacctttacttacataactgccaaactattaaataggtctcttgtggagtgaagtcaaatattcctcttactttacttctgccttagaagaggggaagaaaatgtacatactgtaacatttaaacatctggtctaaaaccacatcactgtaactgaataaagttatggaggtattcttcccaggtgtgcatataaaaaggattttggagttgttgaatagttctttaatcacttaggaaaaagattgaggtatattgatatgatttttctattcctctgttttcaaactacttcccccaacaccatcatgtctgctaaatacttctaatgtgttctaagatatatatttttgagatgttataaaattttcttgccagatacaggcattggctatacatttattcttgcgtaaaaaaaaatgaattgagttagatttgtattgagaactaccaattagacctcttgatatttaaattggagtaaaaagacattaatttttgtgaatcttgtgagttttaaggtgtccctatatgcacttttaataatatgaatatttattgaatttaaagtttccattttactacagcttatgtccaggtattgagagctcatttatagaatatgtggtcattattaagaagtgagtaattaatataggtttaacccatttatgctggaggttgcaattttgtgtgtgtgtgtgaaaaatcagatcttggcaatgactttgcacagtaggatataaataactcccacaagcttagcattctaataatgcaacactaggaataaaggggttaaagacacacttagaatgttaagttatgcctgacttaattttgttcctctattctgtctcagacattttgataatgtttgtaaatttttttctgatgatacttcatggcacaggaatgggaattttaggtgtcctttagtgaaagaaaatatataaagtgtaagtgtacagagtagatttgagaaaaatgcaattctttgaattattatttaagtatattttattggatatttgaaaagtaggcaatatgaatttagtgtgatttttcagtcttacagaaagtcttttatgaacatcataaaaatgtgtcaataaattactgttgataataaaatattaatagataaatgagttagatttctgcagaaaagatactttttttgccttatgtatttttttgctgtttatttgcctatgtattctttgctcatgtttatgtcttctatttgttcacaacctaaaatgtatttcttctggttgtattcacttatcagtcattttgaaaatatgtagtttgcaatctgttcagttctgggagcagatagctaacaagaaatagacatgattttagtaatgaatgtagaatcttctgtgtcacctattacaagatcaagtatggctttaaaaatggacaagagttaattacatacagtgaagaaagggactcttatttgtgagggctgtttacaaagtaccacaaactaggtgacttaaaacagcaaatttatttgttgaagccttgggctgcttaaaatcatgttggaaggcaaagcagtagctggcgtgtcacatcgccagagttggagcaaaagagagagttgggaggaggtgtcatgcactttaaaacaacatcttctgagaactcactatcacgcagcaccaagccatgagggatccatcctcatgacccaaacacctcctaccaggccccatctccatcactggggattacatttcagcatgtgatttgaggggatgacaaatatccaacccatatcacatatcattaagacttcttttctttctttttatttcctttttttattgattctacttggaggaaaattgtaatatttcataatttaaaatgaaattttggttgcaaaattccattaatcccaagtttctgattctatctttttatagtcacctttttaaatgaagtgtatatctcatatgataaacatcttcatattatatgtaagattaaatactatgttgattttactagatttttgtttgctctttaccacagagatttatttgaaatataaatattttgcataaagtgaatacttattttaattaatgattcatggaacatataggtcaaatcattgcaacaaatgaaatcatgataaaagtcttattatcatagattgacttcctaattcttaattttaaaacagtcctttactttcacaggaaagccaagtgacaatagtgaagtaattttgtaagttctttgtagtccatattttcattaatctcttgtacattctttgaagtagaaaatctgaacaatattttacaggtttaaaagctgttgaagatatttttacaaggctactgagtagtaaaaaataacagaatgagaagttgggttctagttttcagagaactacttgtgtttattttttaagaaataatgcgactgggcagggtggctcatgcctgtaatcccagcactttgggaggccgaggtgggcagatcacaaggttgagagatcgagaccatcctggccaacatgctaaaaccccatctctactaaaaatacaaaaattagctgagtgtggtgacatgtgcctgtagtcccagctacttgggaggctgaggcaggagaaccactttaacacgggaggcagaggttgcagtgagccaagatagtgccactgcactccatccagcctggtgacagactgaggctccatctcaaaaaaaaaacaaaacaaaaaacaaaaccgaaataatgctgtaatatactacacaattccaaatttttacttattatggcaaatagaatgttagagtataatttatattggactttgttggatttattaatgtgaatccttgaaaaatttcctactgattttaatataggtaagaccaagatctgtaaatattatttttattctgttttagtaggtaagtatatagcttctttacagtagatggacttattttttcactactattatgaattattttaataacaattttttttttttttttactttgtagagattgggtcttgctatgttgcccaggttgatcttgaactcctggcctcaaatgatcctcccacctcaacctcctgaagtgccgggattggaggcccaagccactgtgcctggccctttataaattatgttataatttcatgtaatacataattgtatagtcaaaatggctcacatattaaatattctttatacaaggaagtctcaaagagaaattacatttgaaatagtttattctaaaaagttttcaaatacttcagttacagaacttaaagtttataatgtatactaaatgttaatatttggttcgtactcaaaattttttttttaaggacaagagatgtaggttctgtgggtctaaaaataatacccatatgtgtcactatatattagttcttataataagcaattaaaaatgtataaccatatacataattactcatttttctttgatgatagtttaaataattaagaatgtgctaaatatattctgaagatgagcacaatttcaagtaataaattatgtagggctggttctaggtttaagtgaataaggagaagatagctgctgagtgctggaccagaatcccattttatttatttacttctacctgtattatgctctgggaatcagcatttcctacactataaaggaaatttccaaggcagagcagctaattttaccctggatattctcagcacctcatttctaatccttgtggcatacagttcttttattgacccctatattctcaaacacatctcccattgagctatgttcctttggggtgtacttctgtggcactctgcagtatcctcagtatctttctattatggccattggattccactggatcggatatcgggtcatttttgtagtgtttgtatgtgaatacatttatagtctcacatttggtgccattgtgttagacatagaacattctcgaaactatatttgaaagctgaatgtctggaagttgaacaataaacttacattataaggtcttgaaaaatatatatatatatatttttgagacagagttttatttccatctctcaggctggagtgcagtggtgcaatcttggctcactgcaacttcagcctcctgggctcaaaagatactcctaccttagcctcccaagtagctgggaccacaagtgcccaccagcatggccagctaattttttgtagagatggagttttgccatgttgcccaagctggtctccaactcctgagctcaagcaatccacctgcctcagcctcccaaagttctggtattaaggtgtgagtcactgtgcctggccaggtcttaaaaatatttaatgtttaactgtctttcctattggtatggcgttcttgggctaggaaattaaggatatatgtgagaactatctcaggtgacaaatgactgagacgcaggaggtggtgcttagttctgggagcctgccagccagacatcctcacttcccacaagcccattggatttttttcccttactctcatccttgttactaccatgattgtaagatgaagccgtccctaaatgtgaaattttcttataggaatgagaggctgaatgaagtaggcaaaaggcatctttgttttcttttgccatgagaggacaaggtaagggaggcttctggcagtcactctacttacacttgaggacaagcctgaagctgtctaccttttacttcttttaactcacacacacctctggctgaattcttgccgacttcttgcatatcttctaccaggcttccacccggtaatagtaagtacagcaacaaaagtggaggaaggggagaggacttggtttgctctctgccctgaaagacaatcatcttttatattaggaagctccaggcccctggcaggtcaggatttccaaggatccttcttggtagatttagacaagctagattttggaaaggagagttgttaggtatagctgtggttcagctggcagttaaaacttttgttctgttagagcctgttactactggaaaccccgtttctactaaaaatacaaaaattagctggacgtggtggtgtgtgcctgtagtcccagctaatcaggaggctgaggcaggagaatcacttgaatctgggaggcggtggttgcagtgagccaagatcgcgccactgcactccagcctggcgacagagagagaaaaaaattacttatgctttctgtaatagatgttgttggttcagtacttttgttctttcagtagtaccacgagtttcttttggagaactcttttgccaatcaaagcaattgtgcaattttatttttttaattttaatttttttttgagacagagtcttactctgtcacccaaactggagtacagtggtgtgatctcggctcactgcaacatctgcctcccgggttcatgcgattctcctgcctcagcctcctgagtagctgggattacaggcgtctgccaccacgcccggctaatttttgtatttttagtagagacggggtttcaccatgttggccaggctgctcttgaactcctgacctcaattgatccgcccgccttggcgtcccacagttctgaggttacaggcatgagccaccgcacctggcccagtcgtgcaattttgatggaagtgactgactaaatttcaggcacgggctgtgactggctttagccaatcgaaacattcccttcacctctctccttctatactgattggttgagaaacctaattgaggccaatggggttgaaaaacctaattgaaaccaatgagatgtcacagggtgttgctgggcaaattagaaatcatcttccttctgaaaccatcagacaaataggctcttttccttggaaagtgtgctgtgagcctatgagatctgcaactgttgcaatcattgtgttatcattacattacattatagccacaaagaagggaagtctgaggaagacaggtggaggaaggcagagctgagaaatctcagagaaatagagtcagagaactgataacattgtgaatctcagatctatctctgaactctgcattaccatatgatttaagctgatctaaggtggtctttttctcttcttcttccttagtgctgctcctacttttatttccatcatgaagaatcttaagtgatatagtttgtcaggataaaacccaaacttctgagcatgaaatcaaaaggtccttatgatatgattcttttctaccaatgtatgtagctccattttcagaactactactctcccctttgccttcacatctcttatatttttgatgttcttaaccatatcaaccccataaagtttctaggctaagtcacgctttcatatgcctgttttcatatacccccaaaatcttattctttctttaggattagtcttagtaagtatcctctgcaaatacttctctccctcatttaagcagatttgattattttctcctttgtgaaatcattgtgattaatatatcagcttagtttgacagatatttcttacctactaagtgctagacttggaccctgttttcaaagctctttaattctagctgggtaatatggcgtgtgttttttgtacacatcactctttattgtagttacttttgtactgagattttctgacaaaatctaatgtgctgtaatagttcatattgttaatacacatcttaagaagtttccatttgttattactacctaattctaataaaaattttattgcaaatattcattgaaaataaatataataattagttttaataatcaaatataacattttttccagatttccatgtcaaaaattatagatagtcctctgacaaaaattgggttaatattatttgtaacttggaaaacataatttttcagtaaaatggctaataattttttccctatctgacttgacctgctttttagatccttttatataagaagtagtaattcttttaaagtaaatatttctctaagagcctgctttgatagtccatacatacttttctcttctctgtagctagagcccctgtattttcagctatgccccagggttcaggactaatcctgtctatgaacctctgttggtataacttttgcacatttattcaatgttcatgtgattcaggagcatgtcctcaactttgcagtgtgttgccttgactgtgggcttagctttatgtattgaaagctcctacttgagctgactaagctttcatcttgaactgccatttcagttgctggatgcctttttttttttttttggctgggccacattccctgtttggtatcctagcccgtcagaggctaccgtcatgaatttccctttctagactcccataagttctgcaggcttttccttaattccaactctctggatgtggtactcccccataagtattaccagaccaatttggagacatctacttgcttactacccatttaattttttaaaaagttattattcattatattatatttgcctgctgggacacctactgtattgtttcttattggacaggtattagacctgaccacttgtctcaacttttgccttctatccaattcttgagatcaggatttggcaaataatctggctcactctttgcttttataaataaaattttattggaacacaatcatgctcactcctttaattattgtctgtgactacatttatcctacaatggtagggttgagtagttgccacaaacatattgtccacaaatttgaaaacatttatcttgccctttaccagaaaaaatttatccactgcataaagtatagcttatagccttgtacttttcatatggtgcctatttcaaacattgtactttttatctgtagagaacttaataaaaattaacatacttatcagatttttcatgtaattttaaaatttacttagtcaaatattgacagaagaagtcctggaatttaaactttattgctaatttttcttcattttttttaccagcattttgttaacgtgtctcatccacaatgtgtataggtttaactgattatattaattgatactttttacctatgtttaatcatgtacccatagtaccaaataccaggtgttgtccaatttattttctcaatactttaacaacatattcatttctctccatctttacttctgtcacactaaggcaattccataatttctttttccatccaatctattgtctattttgtaccagagtgagctttgaaaaactcagatgtgacaagtactaccagcccttcactgacttcatattaattgtaggataaaaacttaaatatggacctattccccagtaacctctgagcttctcaaaagaactatgcttctttctattttggagtttttttcaatatactccatatttctgcaatgcccatgtctctctatttaatctatttatatcaacttatcctttggagcccaccttaaatgtcagttcctcagaggagccttctttaagtagaaaataggttcctcaaaggcaggttgcatgtctgatttttttccctgctgtatcctcagtaactaatgtttactttgcagaatgtctaaagatgataagtgttgtatgtctgcttttttggtgaatgttcaaaatgtaaatagtttacaaattctactaattcttaaagatcacctcttattttgcctgcctgacaccatgtgttgtatagggtgtacaaactaggagattagtctctgttagtgagcaaagtaaatcacttacaattagattataggaattaattgttaagaaaatactgtgatttaagttatgtgtgaaaaattgttaaaatagaatttctgtatgcattcttatctgtgtctaaagtccttaagaccatccttactttagagagcatctagaaggacttacaggactcaagatgtagttgtacgcattactaagatttattatagcaatgtagtaaggatacatacttgggtcataagaggaaaagacataggttgagtctggagaaactcatgcatgtgattccttttgccccctgcctcctgtgaaggcacaggtatgcttgagtattgagtatactcctttttccaccaacaaaaaaatacactaatatgagcattgtttgaagcccattcagtgcccaaggttttcgttgggggctggtcatataaacaacctctgccttgcaagtaccaaaatcctggactcctagaaggaaagcggatgttcagtataagcttttctttttgtacagaaggctccacatagcaaaccactcttatcttagaggatgcggggaaggcaacttcccagacttcaccagtcaaggtccagctttccaagcaggctttccaaaggataacagtcttaggcttgctatattgtcttttttgtagtgttcttaaaataatgttttctaatgttatttgctttttattctagtcacagaggtacttctagctagatacattcctacattgaattaaattgaagttcttttagtaactaagaaaggggtatgagtagtaggtaggcagctactaatcctattatgctaagatttttttcaagtctcccttgggaaaaatttgaatgcctaatggggcacatcatgtgctacaattgcttttgttcactatgcttaagccacatcgatctcttttctggactttaaatacaacaaactttcttctgctgcagggcttttactgtgttattcacttttcctgttaggtcctttccatttttacttggcttataaccacttatttttcatgtctcaatttaaacttcatctgtgatacctcactaccctctcctcccatgtctcttaggttagctactcccagtattacctttcaattggattataattgtttactgtcttttcttttctagaggaacatattctcatcctagcatatcacatgaatgaatgaatgaatgaatgaatgaatgtaaaatttgggtggaggagaataggggagtgctagaggaaaaggagggaaagagattaaaatttgtatgacatttttgagaattatatatttaataattcaaatttaccctatctagtatcgtagccaccagtcacatgtagctattggatacttacatgtggctaatctgaattgagaaataagtgtaaaatacttactgggttcaaatacttttaaaaaaagaatgtaaagtatcttaatttcattacattttaaagtcattaaattgtttttggatatattgaataagtaaaaatgttaatattgatttcacctgtttttacttttttaatgtggttagtacaagattttaagtgacattttctaatagacagtacttgctcggaaagtgaggcgttgatgttttaccttagtgtgtggtcctacaaatttaaactttaggctattatcaagaagaaagtatctaaaaaatggcacattagcttttctttcctattgtactggtactagtttggggcaaaaaatgttgtgttttctgtttactcttttcattattttctgtttactcattttctgtttactcttttttcattatgtaagtaaatgatcaaaacaactgtaacagatcatgttcatgtttattccctctaataacatttataatagtaacaataattgctaacacataagtgattatcgtgtgcctggcactgttctaagggcttcatatatactaacacatttaatccttagaatagccctgttgttagataccattgtcattcctttttaacagatgaggaaactggggcgcagaggcagtaacacggtcaaggacacagcatgtttgagtcttaattccgctacctgataatgatagtacctaagaatgtgatttagagaattaaatgtgattcagagataatttactttcagagctctggctatatgacttactacatgtgacttttcacatagtaggcattcagtagatatttttttatttgaagaacactgagaaggtgtagtttctagtttatgctttccagctatattatatatgggtatttttgtgtatttcatttttggtaatatagttttgaatctcaaaatacaaaagagccgtgcgtatatgaacctcactaagcctcattataaaagacacatgagttgattccttttcttggcaaatccttccaggataaaaatagagctgtcactagaacaaaaaaagtatggaaaaagaaagctactagttttggtagtgactagggttgctttgggccatatctggttgtgccagtttgtttacttattatctatggtgacttttgcacaatgccagacttgagtacttgcaatagagatttcatggctcacaaagattttggccctttgcataaaacatttgccagtttctgactcatgaacatatcaatccaataaaagaatctagtgctggaccacaattaaattagaatctcctaggtttttcctgggctgctcccttaaaggtatgccagttagactgtcttgagattgtttttaggggaaagttggattttgattatatccaaatatggtcagagtggaatcctgagcgttcacaataagtgtatcccaggagttggcaaactgcagcttgcagtggcctggtcttgtattgcttacaagctaagaatgtttatttacattattagaggattgaaaaaagaggaggaagaagaagaaatgtgagtccatatgtagcacacaaagtctaaaatatttactatctggccctttatagaagaagtttgctgatccttggtctgcataatctgcactgttttttctgatcactaccctggtagtagccaaaaggagatgattcctttgtgatgacagatgcatttgttgacatttatttacagtcttagcactgtagactaagagagggtaagggaggtggagttttgtgtttcagttgatttataaggatgcagttttggtgtttgataatatttgatgcctctggattagatagcgaacatggaatatccatcaaatattgttgattgtttagctgttgtgtgctctttatgataaaagggcattgtcaaagtgccattgtcgtctggcacatggtcttgaaaactgaaaatatgtaatagcttaattgttatggccacagtggtgcagagggagtcagctgatcagaatgaatgggaggtgggtgggaatgaaataagtttgacaagagtagtctggaaagggatggagtggtaatgcctcatgcaatgtggcctttcttgtgatgtaaactggttgagttttggtggtcacaagtctgccatacagtggtaatctctgcatcagaaacagtcgtttgctttttgcccagtctatgatggtgaatatgttgctatgtgatacagtgatggatccaggcagcaattgtgacaatctgggtggtgcaggtttgatcaacaccttgattccagttgacctcatcctggaatgggcccctactgtggtcatcagcatgagtgacccagattatctgatcagcaatgattttttttctatagtttgtggcctctaagctttagtctttaaatctgccactctggttttccaagtggcagcgtaaacaggtaggccattggcaataacgatcagtcatttataacaagattcctcaagggaaataattgccagaattatgagaatggccttgaattttgcctactgagttatgcccactgaatagctggagctaagataaaacagcagcagtagcacgatgtataccattgggtttcagtttagttgaatgatcagtgaatcagactctgacattttggggaatttcatgtatcaaaggccccattaggcctgcagcttggcttcaagtggcaaaatgagggttaaagtttctccccaagggatgtgtcttgctatgttttgtgcttctataacagaatactacaggcaggataatttataatgaatggagatttattggatcatagttctggaggctgagaggtcaaatattgagatgctagcatctggcaagagccttcttgcagcctcctcacatggcacaaaggcaaagagagtgagtgagtgtgtgtgcacgcacactggtgaggggggctagtccgcttctgtgataacaagcctactctcgctataatggccttagttcatccatgagggcagagtcctcatgacctaaacatctcttaaaaatcccaccttccaatactgtcacaatggcaattaaatttcaatatgagttttggaggggacaaacattcaaaccatagcaggatggctgccactttttcatgtaaattcaaaagcttctgggtgccaagcctggtatgttcttgaatatgctgttttcatttgaccaggggcagctaccttactcagatcgagccagttgtaatgtctctctataagtttaaagtccataaaactggtgttgggcaaatcagaatttttttctgagagttttgaacttggaaccagagaaaaatgaggcttgtttttagtgacaaaaaagtgtaagaattggtagttgtcattgtttgtttcctgccatgatgagaaattaggtctacagagagcttaaagtcatctgaagtgacaaagagacagagttttggagtcatttgagactctgcttccaatagtttctgaggccttgtctttcccttatcttcactgggttttaccaataaatctcagcttttgtttaggctagtttaaattggctttctgtcactgattaaaatatgagtcctagcaaatacatattactctcttaggccaagtataattactgatggtttggcatgttaatttaagacatattaatttgtatttcacctagacccatttctgtttgtttgtgttgatgtcatggaagaaggaatgaaaactgtatgcacattaaactagatgtcatttccaaatttgtcagagttgttgttaaacatatgaagtgattttctctaagacacagaagaagcataaaacgttaaagtatactttggattaaaggtaataaaattagaaacaaagatttgattggcacaagcaagaaaagttatggagttttgggttatattggactcctagggaatatgaatctgtactttgaacatgacttagtacattggtgagagagctaacatgagtttggattgattctacatcagaagattcaccaggaagaactgagaaattcttcttagttttattcttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttcgtttcagaattttgagcagtactgttgacattagaaaagatttaaaaatacctaacaggtttccaataagctatttgaagaggaagaaaaatgaaaaggagagaaatgttaatttttttaaaagagagaggctttaataactattttcttatgaatatatctttgaagtttattctgttacacagaaaaaaacatacatctaaatgactattgcttttttaaattcttttagctaatacttttcagtcgcggacacaccgtgttctcagagttttaaaacttctttgaaattttttttggtggccaattttgcagacacacaaggaaatcagtacctcagctatttattcaggagtggagtctcactctgtcacccaagctagagtacaggggcacaaccatcatagctgactgcaaacttgaactcctgggctcaggccatgctcctgccccagcctccccagcagctgatactacagctgtgcaccgccatgcccagccagtacctcagcttcatatacatactttcttttcttttagagactcagaggcagacatagaaacaaaatgcaattttcagtatttatccagaactataccttttgttagaatataaagatttgttgggatccagtgttacttatctactgctcttggctctgaatggtatttatttatttcaaatattcagactcacccctcaaataatcaagatttggcatcactgggacaattaagaaggatgacctgtaggccgtaaatgtagttgtgaatgaagagtaccaaatatgtttttatcagtgaaacactgatttgcttagcttatgaatacttagaaagacaacacattttagtctgtctaatccactagcatagtcaggaccttatggtttaaattctagccccatgtaacttccttcccagttcacccccaatattggcatttactaactggtagtatcttaggcatcttacttagattcttgaaatttacaatttcttcattgtaaaatatggttaatactacatttttcatgttttggttgtgataaattgcattaatcacagtgcctagcttggtaattggtggctactgttattaattatagtaatagcagtgatcgaatttctcttggattatttcatgattttatgaagggtaacagggttttctaattctgtaaaagaaaggaatgagttaaaactagaaggaatttaggtggattaaaagaaaaaccagtggattttaaaaactcgaacaggatgacaattattcatcgtatgacattgtattatttgttttctaacatgtttcctttgaatggaccgtatgggtgctttgttaacatatacctcaattttttcatgaggcaaatagttgttaatgtctaatacaaaagatggccattacatattataaagtgctcattattggtgtatatatcacctttgatataggagattattttattttatatttttgagatagagtcttactctgccgcccaggcttgagtgcagtggcatgatctcggcttacagcaacctccgcctcctgggttcaagtgattctcctgcctcagcctcctgagtagctgggattacaggtgcacaccaccatgcccagctaatttctatattttcagtagagacggggtttcaccaggctggggttgaactcctgacctcaagtgatccgcctgtcttggcctcccaaagtgctgggattacaggtgtgagccactgtacccagcctgatataggagacgattttaattagtatgtgggaaactttaattttagaaattatttattttactgtgtattaggaaaaatatatcccacatatttatacacatgatttcaaatattactgcttaagataatagtggaataaaagtttgcttataaaataaatttattataatctaaatatagtaaaatgagtaaatttaaagaaaaaatattaatagtattgttaataattattgagtggttattatatatgacacactcttgtacatacttgctatctattgtgtcatttagtcctcacagcagtttagagaggtaggtactatcattatttccattgtacaaatgagaatacgagacattagcgaacagagaagtaaacattcttgcccttagttatgaatctagtaagtggcagagctggaatatcaatccatgtactctgacagtgtctgacctcttagcccctatgtaataactgctgcttcttcaataaataatagtacaaaggatatatggatagggtagtaataaagttggtatacaaatacatgaagtttgtacaaactgctctagataatgaaatatttctaatctacaaagaacgtattttcatatgtgtataaaattgaatagagatgcattcaaagaatgtattaagattattctaaatattaaagggaacattattgtcattcacataatgaaataatactttatttaaaaaaacaaagtatggcgaagtatagtaagtttttttcaccacttctgcacctgcttctgtgaaaaggaaatattcatagtttataaggagtgaaagttggttttttaggtcattcacaactgcattccaaactgtttgatattttagcttcaggatttaacatcctaacaaaagtcatgtgacatcagcagtgaggtgcactgagagctctctcaggaatactcttaatagaaaggaagactttaggtctgtgaggttgtgcgggcttgaatgtgatttttatttgatatatgagctgtgacataactgttgcatgactgagatgtgcttgtaagtgctgtactatgcagatgggttttttttctgaaacaaagccaaaaataaaatcttgaatgtgttcatgtagtgggaaaagaatacttcatagaaacatatggaaacatttctaagtttttttcattatatgaaccttttactttctaagcatttttatgattgttcaagttaacatgtcatttacctcatattttccaagtttagtgagacatgggaaatcttatagtactctgatgtttggaaacaaccagataatttttaggaatgcacattttaggattaggtgaaatgattattagaaaattaggattgaataatgggtttatttttcattacattattaatcataagactatagctaattaattatattaatctgatgggatttgatgaggagatgtattgagtggtttctttttactcacttttaaattaaagcataggacaacattaaaggaaatcataaaagtaaaaagatacaagtatagcatgactgtttttaattctccacattcccttccaactcatgtcttcgtatatacatttttacatgttttttatttattatatgtttaccattttatgttatgctcttcttttcataacattatgttttaaaatttctctttggtggtcacgtaccactctgattgtctctctcattgtgggaagcatacaaatagaaaattttcttagattcaaagttcctcccaaggtctcattttatcttcctcttttctgtcacagagaaatgacttagaattatgtacatgttgcctctccagttagctttgatgctgagtccggtgtatattttgtagttctaacttcctgactctgtatttgacatacgtagaactctcttctgatttgtgggctcttctcctttgtctttttatcgttgatcttaagagaatacactgagtaatctctttctcctgtgttgcttcagctacaacccatacactgacaactgcttcatttaatgctgtagcccagaacatcttcctgaaactgtgacatttatttgaatatgccaaggtatctaaaactcactatattcagaaggaaatttaactcttcttttcttttcttttttttttgttttttgagatggagtttccctctgtcgcccaggctggagtgcagtggcgcgatctcagctcactgcaaggttcgcctcccgggttcacgccattctgcctcagcctcccgagtagctgggactagaggcacccaccaccacgcccggctaatgttttgtacttttagtagagatggggtttcaccgtgttagccaggatggtcttgatcttctgacctcgtgatccatccatcttggcctaactgttattttctaatcagagctaatggtatcacaattcaccccttgttttatgtaaaacacctaggaattctctttaacttaaattttctcttgtctgcatcttgtaagtcatcatgttctgttatttcttcctgctaaaccttcctgggctctactttgtgttaccatgcttttgtttctaatagtactgttgtaataatatctttccaagttctctcttgttgttttgcaattcattctctccaatgctgtctcagtgatctttctaaaatggaattctgattgtatccttcagtgttttctcatttgtcctcaagataaagttggaacttcttcccatgttagtacatgatcatttcatgaccttctcttagactcatcatgggaaactttcttcttcaagcctctttctttttactttttttttgagacagagtctcgctctgtcgcccaggctggagtgcagtggtgcgatctcagctcactgccagctcggcctcctgtgttcaagccattctcctgcctcagcctcccaagtagttgggactacaggtgcccgccaccatgcccggctaattttttgtatttttagtagagatggggtttcactgtgttagccaggaaggtctgaactacttatagtacatttctagccaaaacatagagtctctcatacctccttgctgttgcacatgctactgcatcttcctgcaaaatcttccctactctcataaccatttcttcttcttgtctgcttaacctgttttccattaagacatagctgaagcttcaaatccttcagactgctttaggtgtacttcttttaagttcccagagtgtgctttctaacatcttgtgccagttatatagtatatgccttacatacttttaaattgaattatttaatattattccactgacgtccttttttaaagaaattcattaacacttgaaatttaggtgatttattgtttcttagatacagcattttgtatcttcatgcatgttgatatttttaagttattttcctgcaaaaatttctgagagcacaaatattgggtcaaaattaaggacacttcttatgactcttgggcattgcctttcaggtaatgattcttaatatcaatcttgcctaaattacatgttataggtatagtaattttcagaaagcaagactcttggtgctgataacattttctctgtgtaaagaaattttttaaaacggatacataatattttacatatttatgtgatatatgtgatattttgttgcatgcgtaaaatgggtaataatcaggtcagaatatttggactatccataaccttgagtatttatcatttctatatgttgagaacatttcagtttctttctttgagttacttcaaaatatacaatacattgttgctattagcctccctactctgccatcaacattagaacttataccttctgtctaactgtatgtttgtactcattgacccatttctcttcatctcctgcaactcatccacacactcttcccagcctctggtatctatcattctactgtccaccttcatgataccaacttttttagctcttacatatgactgagaaaaagaaatattttatcattaagaaaaacctaatcttgacctaatattaatttttgtattctataaacatatatagacactattgtatgttaatctctgtacaaggcactgggaacacatatagtaaaagtcttcccctccctgtttctttccttggttattttcaaaatcgatttgtcaagaactctgaaaagtaacgtacataatataattcatacatgtttattgtactcattggagctgcctgttaaatatgaagaaatatcaatgttatatttaacctattaatgccataagtgtaaaatattttgttatttatagtttagggaatggcttaattacttgaaaaactgcctttttccatattaacatttttgcttttatcttttagattttaggaaggttgttttaattaggatcagattttaataatgagcagcaaaaatgaggtgcttttttttggaaaatataattagtagattgctgaatgaagttcagttttatttttttaacaagttgaatgatgattaggatttataatatggtttatttgtgtgtacttcttaaactgttctggtatgtttcatatatccatattaaaatacaagtagtagatggttatactatttctttgtacatgatatccacacaagaactctttgtactgttggtggtagtgttatacagttccacactatagtaagtgaatatattacctcaaccattaatcagcctaccattgccattgatgacccaatgcttaagttgtaacactatgctgctgacccagactctgggggcttatttttattttttgatgcattgctgtaggcaattttaagggtgtggaaccaagccattttctctcttggactcatttccacttttatttcctatgggaggcttagccttcctttcaaatatttgaatttctaaattgttcacctattctgtgattactaggtggaggagtaatgcccattttaacatactgaatttaaaaaaataaaatggcttaactgttctcagaaaataaaatggcttagcaattctcaaaattaaaattttgtaatttgtgaaatgcttttcttatagaaactttatttttttcatggattacttttattttgtgcttatgtgctaggaatgtttggcttggtttttgtccctggagagtgcagttgagaactgacaggttatatgaagttgaaaagaaatttaatgagttgtaaaaaccagtgtttcatttttccttggtaactaatatgtacttgtgaggaagtgtcctaaaaaatttaaaacgaataggccttcaggttgcctagtagctttcaattttaacattaatgaatgtatctcaaaaatgaaaataattttattcactaagaaaaatacagttattttatttttagaacgtgaatgtttggggcttgaatttgctggccatagttatccaatctcacagataaaatatatgtaatccatatagttttaaagtttttttttttaaactcacttttagtttgtttcctttctttatcaagaaattgatggaacattctacttgtaccaggtacattatgaggcactggggtttttaatgcgaagaaggtacagattgcgggagctcctttaatagggaaacagatatataagcacgtaattataatagtgtgtggtaagtactgctggacgttcaaaaggaagccgtgagaaaacagcagatgattatatttgaaggcttcagagaagagttgacattttcaggttagggtgtgtgtgtctgtgtgtgtgtgtgttaatgttagtggaggatgagtgtgatagtaagctcaatcatcacatgtttcacataaaatgaatcttctgtgcgctgttaaaaatggcattttatttgtaggtataaggagtgatttttgaaatggaaacaggcctggttaggttttccagaaagttgaccctgtgatggaattaggactgcaaactgcgtactagagagcaacacctgtgaaaaaaagggtcgggaacaagattggttggaaagagtcatcacattgtgaagctgattttgcagtctctgggcaacccagcagggacctctggaacaaaggttgttggaatattcctgcattagtggaaatggctaggtccttctaccaccattattcaggcattggctctgggcttctccatgaggagaatgcccttggctgaaaagctgaagtcaacttaataaaagctaacagctgaagactgtcagctaatcatgctccttgtagccaggcaatgtgttctttgttgaaggtgggggtggactttgggatgatactaattattcatggattgattgattgattgattgattgattcagtgagtgttaacagtttgacactatgtactagggttagggctgggtatgggtgataggaacaaaacagacatgtccttgttctcatgtagagaaaaggtatggaagaagaattttctaagcaaacagaaaatctgatataaaggaccgttacgggcaaaaccttggcttaaaggagagatagaaggccactttggctaaagaattctgagattaaaaaaagagattacagggaaacaaggtcagagagtttggcaggtgtcatactctaaagccttgcaagccacagtaagaattttggattttattcaaatagcattgggaggtcagtggagggtttcaaccaaaggagtgatacagtttgacttatggtttagaaagtttactcctgcttacctgtttccacattcaatagtcataatgcaaatatatcttgacttctgacttatacaatgttgtcacttggataattctttcacatcaccagtaattgtgtaacatctgcagaaaacacacattaattccattattagagtttatttttcccattttctgtgtttctgtagtaactcattaaccagttattttgcttttaagtaactattactgaattgtaagagccatattaattttaatttttagttgggtatatagaacttattatacatgttggggttttttttgcctattcatagctctgaaaaaagtaaataaaatgcttgtgtaggaattttatttaggcattttaaactcttcatgtgaatatcttgagtcgttaaagtttagtcccttactcgatccatatggctctctgttgtagtacaggacacaattgaaagctcctaggtttcctgcatatagcagggacctgcacagtgctgccttctagaactgcttttattttccttgaggtcagaagtcctcctcccataggaaattttagatctcattcccctccaaaatattgacttgcctaattgaaagttattttattcatgttgattcttatttaagatttataattgtttatgaaaaccaggttccagttctgagaaatgtcttctcagtaccaaagtttgaaccttggccacaccatttgttaaccatatgatttaggcaagtctctttacctctttaacaatcagtttcctcctctgtagaacggggaacaccggtagaacttgctttatagagtatagtgagaagtaagtgaaataatatagaatgtctggtataccatgactgttctataaatggaaattgttacagttttactgttacttttaatagattattactttattagggatagtagaaatgcagattcaagttgggcattcatctgaaatctactctggtttcagctttggccttggcctttgggaaattgaatagcagcattgtcacttcagtgtcatttgtggcattcctgaatttgtgtgtgaaaatgcttaccattatatctagcagcctaacatttctttgataaatgaggcatgtcatctggactttttgttaatgtttcagtgtttatttttaattacaggtaagcattctaaatgtaatagacaatgaacatatgcttatatgctttatgtgttaaagttctgtcaatgagttaaagtataagtgtttatcaccagagtaaaatactataattgtcaataattgtagaagctgttagtttcatgtatagaaatcgtgatttcacaagttcaaatattaggtcaggagattgacagttaacacaaatactaacctagtacttttttttttttcttgttagctggatatatttcttttgttgttgttgttgttttctttgtcacagaacactgtttgcagtagaggaaactggtgttgcagtctggtggtataacggcttgctcacataaaccagtacatgttcatcctttagtgcaagaagccctaatggcacataccctattaaaattcacggcatctccaatattctctctctctttttctttgtcatcttttcttttttaataaatgttttcaaggtttgtctaaaagaaggccatataggttcttggctagcagaagacaattcagaacagttgttgcacaattggactctcaccttctccaggctggttgttgatatcttattttttttccaactcatttttattaagaaaataaatgctccaactatcagttttacaaaatctctaagagaaacacaagagcaaggtgctgaggcaaaaaacacctgaggtagctttttctgtgtgtttttctcatttataaaatcggtaaatttaacgccctgggccaacaaccttgtataaattgctactttccttcacatttttttaaaaaagaaagaaataattttgctgaatattgatggcttatacaccaaaatgcaaaaagacaaaatacattctttcattgtggaattttttctttgtttggttgattgattggtttggtgggttcctgttttcttcttccaaaatgctaggacaagtaccattgactcttgttcttttgagtaaccaagcgtaagttgaggctgacgtgtgtgttttgcttttgttccttttgtgtgttgggatactcaaagcactgctttccttgggcgggggcgagggtggtgttgcgtagatatgggattgagatggagggatgagggaattcaaaagaatggagatggagaagtaggggaggggagggaggtgagagataaacagagagagagatagagaattatatagcagtatgcgaaaaaccagtttaaaacccatgaagcaaagagaaatggatgtataagctagacaggcatgaggagtgacagagtttccttttcaaggagatggtatccctcctgttgatatacacagatgatccataattgctgtgagtgtccttccgacaagatttccctctgggtgaattttgtgtaggtcacctcgaagctcctctctacaccgtgaacctcccaaagaaagactttaaagtctagaaaagcctgctttctctttaaaaagaaaaaaaaattaatagttgattaaaaattggaattagttgagttatttgatatgttatttctaaaacatattaccgctgcaggcaccctgcgtaacccgcaggccacgtatcttaccatcgtccccttctaatatgtgcacacatgtacagagatttgccacaaaaaagggtgtgcattttgcatggctttgaacacgttcacctatgttacttcaaccaaaaggtacagcattgtgggagttaaggagagatctgagtggatggtgaagtggattgctgaagctgcagaagtcctgggaggtaggaggcagggcccggaggttctggcaaacctggctgaccttcccccgcctccttggcccctgggattctcagggcctctgcagagtccctggccgcctccgcagacttctcattcctcagatggtctttggtttgcttccgatctggctggctgtgtttggtctcattttgtcaggtgttggaagggctccattcatctgttgttttgctgatgcctgtgggaggcctcacttgctgcgctgtgaggcgactccctgagggtatttctactcctgctgcttcacctcttgtacagtttccctgatactgcgctgtgcagtctggctagcaaagaagtgcccgataattctgatgatcacttcctcattttcatcgggcgtttggtcacgaggcacaatgatttctgcactagttaagttatgcagttcattcacagtcttgccacctttgccaatcacccggccagctgtggaagagagcactctgatatgggcttccagcttcacttcttctttggggttaaagaagttttcttcttttagtttcccgaagatccgtccctgggccttgatggaggctctggcgagtcttgccagctgtttgatgtgtgcccctttcttcccgatgatggtacccacagcctgggttgggatgaagagattcacaatctcctgctcttgataagaatgctgatgcgggaacgggccaaactggtgatgggggtacaggctggagaaagtatctggagtgggtattaacagccagcatatcattttcaaaggcctcacgcagcttcttcataatctccatctcagcactggcataggcctccactgtgcccttcacagtgatggttctttccgggttgcatatgctcaaatcctgcaaggatgagattgttatcttggtccctgtttcatgttcatttttcttcacatttctgccttcttttccaatcagtcttccaaacaagccattgtgggccacgattttcagaggaatctcttcggctagtttggtctcatctgcctctttctgcatgctttcaagaatcgtgtggcatgcttcagaagtcccctctggggtggcatggatggtgacaagcttctctgcagctccagagttctcttttctatggatgtctacccgggactgggtctgctcagtgatgttcactatggtcaagccctcctttcagaccatggcaccaacaaactgggttggatccgcagcgggaaatcagtctgtccggcctgagaagagcccccagggcgtgaccttgctcccggaagagtggtccccaccctgggctcgctgagggggtaaagggggagctcacctcttcatccaggatgtaggaaatcttgaaggaatagttctcaaactgatgcccgcttagctcctccatggctattttgcttcttcccttgttgcatatgtgacattgacaacagcagtttctgtgtctgtgttgacttgttccacattctccactatcccgtgttgagccaaaggtgcatccaacatcgcccactgcaggtgaggaggtatgtttcaaatctgaattttcctgttccttagctttttagagaccgagtaatcaacttccatgattttcccatgcaattccactttaccttggcctcgccgccgccccgccccgactctacacgccggtagggaaggggcttccgcggggttggggttcaggggccgcagggctggggttcgggggccgcgtggctgggagcagagcttgtgctggcgagagttgggtagtgcgctcgcgcagtccctagtacattattaactttatgaaagtctaatttttctaagtcaaaatgttcataaacatttaaataaaaataagacattaatggaggttgcattatatcctcattctttgtataatttataaaattgtttaatgtacaagcattaataaaacatttaaactatatacattttctatttaattgcaacaagtctcccaaagtaatgccctatttgggatttattcacatttataagattgaattaaaaggagaaatagaatgtttgaggaaggggaacaaaatgattaacagtatccaagaaaataatccttgactcaaatataataatgaaaaaatatgaagagtatgaaaagaagaaagtgttagagaaaaattagatcatctagaacacaccttactttctcagtaatcttaaaataatagaattttacaagagtgctttacaaccatttctgtgtagatttttaattaatgaattgttggtataggggaaagaaaatataattagttgctagaagtatcagcatcttcagtgcttccaaaaaagtcttgctcccacatctatttcagttggaattgaacaccttctttgttactacaaatatgtagagactatagtaataatgtagcagctgacagcaggtgagaaattgagtaccatgctatcgtattaaaaatcaactcttaacatgcttaatagaaatttatattgaaaatttattttaaataaaattctacatttatctttgtattccaaaaagtcattctgcaatgatatttggcttttgccgcagcttagtagtgtgctatattttaacaatatggaaagtagtaaaatctgtaccttttctgtgtgcctatcatatttattaatttacccaaattatacagaatgttgggtaagtttagaagaaagtatttttaacagcaaaatcctgtgttttcagcctacatttttttagaggctagtttctattttaattaataatttagtaggctgcatattatatataaaatttaaagaagtttttgtgtttcaacatagaggaattgctaattattttcttcttaagtgatgcgttacattaaatccactgaagtacttttcaacataatttattacacaagtactaccatgtaacacattttcagtgttatttcgttttccctcagttctttcatgagatagttattagaactacttactgtgaattagagataatagagacataaaacaaaaatttgcttttttcccttctacagtagaaaacaatggtaaccacttatttatttcattgtcaataaatgaaaatagaatagtgtctactggaaatgggtgtggagatcttaaagtttaaaaacagctgcgtagtatccgaataagtaatataggatgcattttaacaatgcaagaactggtttgatttaattaactgtggtttaatatgttgtgcatctcactcatggtataccatggtggcatttactggctgatgcttcaaagcactactgtttttcatccactatcatgggtcaattgtgttgtagaggcattatctaaggtctggaaaacagttctcaaggattttgctttaatgataggtgtaacatctagttcatttgttgatgtcaattttttttttttttttaaagacagaatcttgctctgctgcccgggctggagtgcagtggcgtgatctcagctcactgcaacctccgcttcccaggttcaagcaattctcctgactcagtctcctgagtagctgggattacaggtgtgtgccaccacgcctggctaatttttgtatttttagtagagacagggtttggccatattggccaggctggtcttgaactcctggcctcaagtgatccacctcctttggccccccaaagtgctaggattacaggcatgaactaccgtgcctgacctgttgattttaatttgatgtaatctctaagctctcttcttaatgactttaaagtttgaaactgtaatgtttttaccaagtagcttttaaatgatgtttcctgaaggacagaacagataaatttgaatgatgtatttctaaatacagacagcagtgatcttcatgtcctattacattcaccctataaaatcacctggatgtttttaaaaaggcaaatggagaatggagaaaaaagaggcattgctcacgtgatgtgtatagtgttctaagatttcttacatttgataatgctgtggtagttatcttagatataaagtagtttcaaaaattccagttctataaccacatctgatagggtttagctgtgtccccacccagatctcatcttgaattcccacgtgtcgtgggagggacctggtggaaagtctttcctgtgctgttctcatgatagtgaataagtcttacaagatctgatggttttaaaaagagatgttccccttcacaagctctctcattttttacctgccaccatccatgtaagatgtgacttgctcctccttgccttcccccatgattgtgaggcttccccagccacatggaactgtaagtccaattaaacctctttctgtaaattgctcagtctcgggtatgtctttatcagcagtgcgaaaatggactaatacaacaccttaacttttgaagtaaatgagatacctgacggtatttccccccaagtaatttgtgtttgcttttacagatactttttggattacttgattaaaaatgcaaaaactactataaaaatagaggattatatctctttaacattttatcactgttatctttcaatacattgacaatgcaagggtaatagttgagggtttttgtcaaaatgttggggtaagcaaccaggctaatgtaaagtggaggcaaggaaaatgtttcagtgaaaaggaaaacaggccatgtaaatatattgtcagtgaaaaaaagaaatgaataaataaacatttgataaaattaatgactgaaacagaaaaaatcacgaatgtttttggataataggctataccacagggatatagaattaattgaggaggtgatggtgagggataaaagactacacattgggtatagtggtgtatgctgcttgagtgatgagttccccaaaattagagaaatcaccactaaagatcttatccatgtgacccgaaccacctgttcccccaaaattattgaaataaagtaaaataaattttaaaaaattcatacaaaaaaaagaaagtgtttgttacctgacctgcattgtgcaggttggggttatttttttttttttttaattaagaatggcaaactccttctgaaactcttaatggccttcgtttctccaatttcaggtcttgctgctctcatccctacttcctataggctgtactaccagtaagcttctgtaataggcctctaggcagtcccagttccttccttaggtttgtgggtcgtgcttttccattgcctggagtacttcaatttactctaccctcatcctcttatctagtttacttttctttatccttgagtatactatagaccaggataggggtccctttataatttcaaagtgccctatacttccactgtcatagtacttatattaattgtacacttctctaaattagtgtaagagtttgtgggagtgtgtgtgtgtgtgtgtgtgtgtgtgtgaaaagacaatgtctttagttaataagcacaaaataaatatgttttgaatgagtagattctggttctagtatttactattttcagatttaggaaacaattaaatgtttaaatattacttcttagtccactctggggggattaggggaaaactaatggccatggggcaagcttaggtgaaggatgatgcttgagctcagctgtgtaggataagttaatctggagcgagttgctgataaaagtagaataaattttggtaagaacttttcctccagtgtattttggcatcactttgtagaataaaaaataagttaaaggatgttagtctataataaaatttatattgatacttcatgttaatactgacagttattggctagtttatcttattttaattaataataaagctaaaacaattgtttttaagcactaagagaaaaactgtgtcttgaaaaataaatagcattacgtgcaaaacatgtaatatgccaaccggtggcattttgcttccctataattattatcaagtgaatgattagattatcattctagtgatatatctaaaaataaatttatttcttatttatttatatgttatatggtaaatcttatatttagaatcttacaagggaagggaaaaacatctttttcccctctccaaaaatctactgagagaggaaggtatttatttggcttacctgaattacatgagacaatatctcaagatttcatctgagtaagaatcacttggggttgtgctaaaatgcaggttcttaggccagtcctgtttttgttggtgaggcccttacatttgacctttaatgagcatcccagtgttatcacattccaatgtgataacaaattggaaaataatgtgtatttcagcaattatgtaattcagatactaatgactgacccttattctcctggccattgagtgttgtggctgacacattctatataaatctgaggttcttctcaacaggttatatccaattctgtcataaatttagagtaatcttaagtacattgaattaagtgttacttattgaatgcatgacatttcacctagaattgacaaaatcagtcaaattactttattcttatcatctggataccctattttgccgagtaaactgtgttacatgtggttttgtttattacagtctgtgcaaaaagaaacatcaacaatattactgtcatttcactttggtgtttctggtattccactaatgcctcatttgtaatagttaggtatatctttatctttctagtaaactgtttggtttttaaagaatactcatcctcagcatttaacttttttctagatgacagtattttgggcctagggatactgatgtaaataattgacacagaattgcagataaagagaggttctgaggttaagaatcagttcagccagagtcaatctaaagcatctaaggctactaggaagctttaaggagccatgaatcatacttcagggacccaacagtaatgaaggtgtccaggttgaatccaagcattttctgtttatagttaaacagaacaataagatatgcaataatttaaagacattaaataattataaaggtttcactctttcctcctcatttactttatttcctactttagatggtattttggtggctcagttaaaataatacttaataaagttaggcttcatgtagaggggtaggatttgtatcagattaatgtaacttctaagtccctttatgcattccagataagaggaagtgtgaaccccctgatgccagagactgctgtttcttgattactaactctttgacctcaaaattcaatgaagtttagtatattaggcatagtgcattcaagctcattttctaagttatctttcatgttttgtcaactgccaggtggactctgggcattttttggggaaatgtggttaaagcagccataattatcaactgcttgaaatacttacccggtattttaaagaatattaataaggcctcatttaatttggttcgcagcttttagatgattgtacagtgatcatgatcatgtcttacatttttatatattccctagccatttaataatgtacttgagaactaaatattttaatagtatttccttacagtctgatacagcagcaatgttaggtagttaaatgttgtctactacataatattgagctcaattagcttgaaatggcaagttcatctaaagtacatatgaataaaagggattataagtatagtgaagtgttacatagaactggtaaatattttaagtatatgtactcattatgatttctaaatattatagccaaagcatgcagttacaacaatttccaaacattaactgtttgaaaactctttttacattttacgcttaataaactaatttgtacataagccacattattatttatatttaaaactaaaaaaaatcactttctccagctattctaacaaaaacttagtaagtaagcattgcttttaaaatgacacaatctactagttatttggtaagactagcataatcataaatttcccatccatgctttttccaaaaatactaacccatattgttctctctggacctgttgtagggatgactaatccaactgctgaggtctccctttatgtgtttgatggaacacttggcttgctggactacagctgtgtgtttatgtgcagtgcacacctgcaggggcctgacaaatagctgtagtatgcagaggatacaaaattaccctggcagtgctgcaaataaggaagtttctgttttgaagtccatatgtgtgtgtgcttgagatgccagctggtgtatttatgttgcatgcacagatgtaaaactgccaactgattttacaccaaataaagtctaatctttttatatgtactttgtgtcaaagttatgaagtggtatgtaagaatattctcatgacttaggtcttttaaaataaaagctgctattaaaaatatgaactcataagatgattaggaaagagaggaaagaggatagtgatagagatggtatttcttaactattatcctgtgtataataatgttgttatgactatatcattagataagtaaagttttgatttattataattatgaatgatatatattctcttttgtggctagagtcagtcaggtctttgtgaaatcccaatttatgaatactgaaatgtgaaagacaaatttatataattacttgacttgcaggctttggctattctatttttcaagtacatttgattttaacaagttgaaaggatggtgcacttttgccatttttagaatgtatttaaatttgttctgaaagaaatactagtgtttataaataccagggataatatttcccaagtctatggaaattttaaaaccaatataaaaatagtggaaaagccagttattcaaaagaacctttgaaagaagcaattttttttgtttcttttaatatgtcttctctaactaaatgaagaaatatattttattgactatatccatcccaaacaagaataatgatttgatcactagaaaattgatcttcaaattaatatttgcaaatgagatactttatgtctgttacttaagtgtaaacatagattagagtggaagcttttgtttaaaattagtgctggatatattcattttctctaagaaccatcattgcttatgaagcagtgatttttttccatatataattggtttctttttttttcttttggagttggagtctcgctattgtcagcccagactggagtgcaatggcgtggtctcggctcactgcaacctccgcctcccgggttcacgctattcgcctgcctcagcctcccaagtagctgagattacaggcgtccgccaccatggccagctaatttttgtacttttttagtagagacagggtttcaccatgttggccagggtggtctcaaactcctgacctcaggtaatccaccccaccttggcctcccaaagtgctgggattataggcatgagccaccgcgccaggcccatatataattggtttctaatattaatggatatgtttcagttgaatcattttcaaaaatattgacttttactgtatttgaaatatatgtataaattaagaatttttagacattgctcaacaagaactgtttatcagaatggttatatttgtttttgttttatttataacctctttattgttttgtctcattttatatgtataggtttataaatatttgcaaatggagcaaagtagttcaagtgcttatcaaaatcatgttaactttcttattagaaaattttaatggtaatgtaaaaatacgttgtcatatgtaatcttgtattcagttttgcatctgaaacacactgaatttgtctttcacctaagtatatctagatatattgattcttctgatattagtgtaagttatacttgagttctgactttttacttatagaattgccttatcatagttccttatttgactatattttactgacattttgtatgctttcctaattattatttttattgatagcgtcaaacttgtaaatagtttgtaatgcctttacaaatttaaatagtgttttaataggcatgattcctttttcttcaatggtaggcatgatgcctttttttgtcataaaagggatgtatatttgccattttatctagcaaaatttcacttgaacttttactgtaattaaatttcagcaaatgtgggaaaggcctgagcttttagcattgtcccttagccttaaagtctaaattttgactaaatcccggcatcttaattcatgaggaaagtttgatttggaataagttttatataatgagacaggaagatggactagaaaccacatctcccagtggttgacctgagggataagatgtttctgacaaaatatacaattacttgtatgacaaaaagtgcatgaagaaaccaagtacctcaatttccaaaatgaaaggcagtatggtatagctgaatgaactcttgatcaggagacagacaaaattctagccctgtaacacacagttgtatgttattaggctagtttcctggagctttagtttagtttaatttttctaccagagaaagggaatagtaattctgattaatattgatgtgagtattaataataagataagggacataaagctgttctgtggtcagggtgtggagcatgtagtaggtgttcaataatagttgacttttttttttaaagcagtagtagtaacagtttgaaaaagttcattacataggaaatatacatgtaaagttaactcagaaaaggatagacataagaaagcttcactgatgtcttacattttttcctgaaaatatattttaaagaaaggaccaaacctcaaatttttacagctaaaagaatcttttattacttatttgagagattatgttccatacattgcttggttatttagtgctagggccaactgcctttagtaggatatcacttcaaacgctgctgccgccactgcaggttgcaagcatatgattgaaggcttctagttctcagctcatgcccagatgtctttcaataactatagccagtaatttcttcaaattgctcactttatcagcagcacatgtcatcaatcctgaagtggttgctcaagtcaactgcagaatctttagcttatagacacagctgcaaacaggtgaacaggcagaaagtaatttgtgcagcttggtggctgtcagacgaaagacagacaatctgtgtttaaaacagattgcaggccctgtatgggccagacaaaagggatttctccaactgcaaataattctaaggttaacatattttcctttctgccattaggtgatttgttaaaattggaaacaatgaacattataaatctacacagaaactggagacaagatgaaagagaaaatcagatcactaaataggtttacatttgtctttccaaagaagtataactggcattcatataagctgttttcttacaaattaagccaagttataaaataattctttgaaactgcaagattataaatatttcaagttgcattaagaattactggtattaaaaaagcaatgaaccctgaacagtccagtttttataagcaggttttagagttaattgttaatttgtagatgttggaatttgcttctttataaatattatttagtgtttttcttgcagctttactaagtagattttaaaagtagcatatgctagatataacacacttttcagcacataaaatctaccatggttacagaacaaaaattcgtatggagaaaaatattctgaggacctatgcatttaaaaaagttatcctcacattttcgccttggagttattcggataagaatgtgaaagatatctgaatctatctgtaaaatagtcatattttagaagatagttctataataacactaagagtattcatcattttgtccataaatctcaaaatgataaacttatgagagtctgaatcagcaaagttatttttcatcagtattagtccatataagtgcctactcattaaactaaacaggaagaaggactatattacattagctaaatgagtacctcatgactgaagatagacacacacaaagtttagatatttaaaatatgtgtacatgtgtggtgcatggatgcatgtatgtgtagggaggaacacatgagaaataattgagtagtccttctttgttatctaccagagcttatggctatgacatagagaactgtaagtgaatgttactgatttattctcattgttggctctcttgtgctttctctcttgtttcacaatcaatttagtacggtaattgtttttaatagataatgatctatataacatagtgtttaagaacacagtcctcagtgtcaaattggatttaagttccagtttgataatactgtgtgattttgaacaagttacttaacctatcaaatccttagtttttcagtggtgatagtgactgtttattaacttacgttgttttgtgatattaaaaactcatatgaagtattgtgccttgtgccttgtacttatttaaagcttcaataaactttaggcattttctgctacaatccaaacatcctgaggaaagggaatgtttttgtcttgctcttagctgcttcctaagcatttattaccatgatttgaaccgctaagaactcagaagtaatctgaatgaacttgtcaataattctgtaatttttagagtccactgtgctgatttcttttagtcataatattcctttcttgtcaaatgccttgaccttaaatatgagaataattcttatttatttatcaagacagagtcttgctctgtcgcccaggctggagtacagtggtgcgatcttggctcactgtggcctctgcctcagcctcagtaatcccaagtagctgggattacaggcactcactactatgtctggctaatatttctattgttttagtacagatagggttttgccatgttggccaggctggcctcaaactcctggcctcatgtgatccacccgcctcagcctcccaaagttctgggattacaggtgtgagccgctgtgcccagccctgatttattttttgagtatagacaaagcggtatgattattttactgtctctcatttcagtttttctaacattaggaaattgttcttgattacagctgtttgtcaaaatatagctagctgtggtgccttatgctcacagaataatctggcattaaaaatcaattatattttactgttttttgttttgttttgttttttgagactgtgtctcgctttctcaaccaagccttttggtctccaaacttgcccaacatggttccactccattctttggccaaaaatcaatgggttcaagaacacaagttttaactgtagggcttaactttagatttctcatatcaaaatcgctttgcctctagagcagtagttagagcttccaatatatgctgaccttcaggccctacaccatacctgttgttttgaaatctctgaggatggggcctggatgttgatctttcaataaaatctttttgtgtcaatctaatgtggacccatggttgagaacaagtgctctaggacagcgactggcaaggtatgacccatggaccaaatccagcccatcagctgtttttgattcgaatgcagtaaccaccattatttggctggttagttattatcaatggctgttttgtgctacaacaccagagttaaataaatgcaacagagactgtcttgcaaagcctaaaatatttattatttaacccattataaaaaatgtttgctaacccattttagattatgagctctgatgcggtggctcacgcctgtaatcccagcactttgggaggccgaggtgggtggattatgaggtcaggagttcgagaccaccttggctaacatagtgaaactccatctctacaaaaaatacaaaaattagctgggcctggtagcatgtgcctgtaatcctagctactcaggaagctgaggcaggagaatcactcgaacctaggaggtggagatctcaccactgcactccagcctgggcgacagagcaagactctgtctcaaaaaaaaaaaaacaaaaaaagattatgagctctgattatcatcagttttgcacatatttcgtgtttgttggtactttaggcaatctattggtgaattagctagatatttttgattacctttctatttcttgcctaatagatagtgaactgtttgagggcaggcactatattttatagctctttaaaatcctcaacccctaatatagttaattttgcatagttgggtgtaagtaaatgttcgttaattgactctagttattggcctttggttattgcatgaaggtaccagtaagggacagtgtggagcttttgctttgtgcatgttcaattttttttttaactccttctattaaaatagacattattgtattttagaatattaccaagtcatcattttataattatagaaaatcccttaattttttccacttctggaattactgtcaaccttcattactcattgtttgtacttaatgtttagatctaagctacaaaacagcataccatattttcatcatcattactcttttaaaaatttgccttcattccagtttcagggagtttgggcaatgcctgtgatatttgtgtcttgaaaatatctcagtggtctgtcagatatgaggttgatccaattttaataatagttttttctacttcctgatctttaatgggttgaaattatcttggcttttactggtagtgtagtcataataattttttaattgtaggtgctcaagagagaaaacagacacaaagtgttctgtattggttctatattattcccctggaatgatgtgtttaactagttttcttttaaactatcaactacataaattttgttcaaggctggtgtcttagcatttgcgttacaactataagtagtacacatacatgtcttctatattcatttagaaagatcactatcttaaatttttttttcatttcacttgttaaatatagtgaatatgttatttggggcagggaaaaaaataaggcaatcaggcaggttgctgacggcagtccaaatggctgatcagagagtctttatatgcattggtaatgtgttgtgcaatataagctgaaatatattccacaagggaggaaaacggaataggttacatacactgttcctaagtgcaatgaatataaaactccattactcactttaggcaggtgctttttatatgaggctttaaagtaatataaaactgctggtgaaatgattggtttatacagacaccacttagcttccagtgctctaaccagataaagagactaaaactattaagatatttctttaatgattcagggattgatgtttaatattcttttggtataatagcctgtccctataacattgtatagttatgaaatttgtgtgtggctgggttacgaaagacttttttcagggaaagaggaaaaaatttcttgtttttctttgttaatgataaggaaatgaatctccccaaaatttctttcaatgtatacatatatagaaatatatatatctgcatttaaaaatatttttgaaggactttctaaatacatttcttggtagtttttttcagcttttctccaagaatgactgaacattttataggcattaagattgaataaattttgtaatgtacaataactctctttaggataactgtgaagttggttgatgaacattataaagcattaaaatatgtattagtccataaagatttgcagtgatcccacctagatatacaagcccctatatttctcgtttttgacacttttaactcttacagagaacaagtaacctgcttattgtttaaacactgaacattctcttatgagtgaatttttataaactaaaagggatgttaaaaggataacaaataggtgtttttcaaatttgtcttaggttttaaatatttgaaccagatggttttctttctaaatctgtcattgattgattgattgattttccctccctcccatccctcagtccctccatgtctccctcccttgagcttctcccccactcccaagcccacttccccttattaggtgacatttacatacaatcaactattttagagtgtatgattcagtggcatttagtgcattcacaatgttgtgcaactaccaggtctcagtttcaaaatctttatatcactccataaaaataccccatagcttctaagtaattgctcataattcctcctctccctcatcccctggtatcctctaatctaatctacttttgtctctgtggattttccttttctggacatctgatattaaaggaatcatatattaatattatgtgaccttttggttttcgccacagatctagccaagttgttgtgtgtatcaatagttcattcatttttttattgctcataatattccatgatatggatgtaccacagtttgttaaatcatttatctgttgaaggacatatttgttgtttccagtttttggctattacgataaagctgctataaacatttatatacaagtttttgtgtgaacatgcattttcgtttctctgggactaatgcctaagagtacagttactgggctatacggtagttgaatggtttttttttttttttttgagatggagtcttgctttgtgctcaaggctggagtacagtggcgcggtctcggctcactgcaagcccctccctggttcacgccgttctcctgcctcagcctccggagtagctgggactacagacacccgccaccacgcccggctaattttttgcacttttagtagagacggggtttcactgtgttagccaggatggtctcgatctcctgacctcatgatccacccaccttggcctcccaaagtgctgggattacagatgtgagccaccgcgcccggcctgaatgtttaagttttaaagaagctgccaaacttggggccaggcatgatggctcatgcctgtaatcccaacactttgggaagctaaggtgggatgattccttgagcccaggagtttgccgaggctgcagtgagctattaccttcgcactgcgttttagcctgggtgacagaggaagaccatgtctcttgcggttgggggtggtgggggagaaactgccaaacagttttcaggagcggctgtacattttacatttccaccagcaattgtatgacttactggtttcttcacatactcactggtatttaattttgctgctgtttttttattttagctgttgagatagatgtgtagtgatatctcattgtgattataatttgcatttctctgatagcaacacaaatgatgttgaatattttttaatatgtttatttgctatcagtgtatcccctcagtgaaatgcttgttcatgtttttagcccattttctaatagtattgtttgtgcttttattgttgagttttgaagcctctttatactattctagatactagtccttcagctatatggtttacaactatcttttctcagtctgtagcttttcttctcttagcagggtcttttgcaaagtaaaagtttataattttgatgaggccaatttttttcttcttatggattataattttgttgttaagattaagaactctctgcctaactcagataccaaagatttccccctatgcttttttctgacttaatttttttaaggtgttagacctagatttggcattaatgtttttgcctatggcctattctagcacgatttgttgaaaaagactgtctttctttcattaaattgtatttgcacctatgtgagaaattatctggcatatttttgtctctgtttgggttcttcattctgtccactaatccgtgtgtttattcttttttttttttttttttttttttttttttttttttttgagacaaggtcttgctctgtcacacaggctggagtgcagtggcacaatcatagctcattgtaagctcaaactcctgggctcaagtgatcttcccacctcagagcctccagagtagctgggactacataaataatctttgatttctttcatcagcacttttagttttttgcatacaagtcctgtaaatattttgttagttttatatctttttttctgtgattttaaatggtattacattttcattttcagtattcacatatattcattgagaaattgataatttctatttttattttatatcctgtgaccttataaaactaagctcacctattacttctagaatgtgtgtgtgtgtgttttaagattccttgagatttatacatagttatgttaaatgcagagacggacagcattgcttttttgtttgttttttccatttcccatctgtataccttttatctctctttgttattgcatttgctagaattcacagcattaggttgaataacagcagtgacagccaaaatccttggctttgttccagtcataatggaaaacattcagtcttttactattaagtgattttaggtgtttttgtagatgatctttcttaggaagttcctctctattcctagttccctgaaacttttttttttcttttaatcctgagagggtgttgaattttgtcaaatgctttttttgcatcagttgatactgtcatgtggatttttcttctttagcctgttcatatggtggattgcattgatgtttttcagcattaaaccagtcatccagttctggaatgaatctgagttggccatgatgtattatttatatttgtatttacaaacacaataacacatcgctgaattctatttttaatattttgataagttcgtatttatattgatgaggaatctttgtctataattttccttttttgtaatagctttggttttggtatcagggtgattctagcttcataaaatgaaatggaaagtgtttcctccttttctgtgtcctgaaagatattgtgtagaagagatgttaattctttaagatttggtagatttctccatttggacctggagatttactttttgggttcatttttcttccccttgaagaattgattcatctagtcatagttttcaaattttgtgtgtagagttgcttgttttcaaaattaatcttttgataactgcagggtctgtaatgatatcccatttcattccttatattggtaatttatggtttctctctttcttattagagttttttcagttttattgatctttaaaaaacaagttttaaaaatcaaaattttaaatataatttctttattttttaaatttaaaatataaattttgttgatttctgctatctttgttattttttgtccatgcttactttggttttattttgctttccatgtttctggtgttttaggtgagagctagattatggaattaagacttacttgtactgtgcacattcggtgctataaatttctctctctgtactactttagttgtggcccacaaattttgatacattatatcttcattcaatttttttcttctgtttcatttgagaattcctctttggctcatggactatttaggtctgtttagtttccaaatttggggggattttcttactattttttaaaaaattgatttctaatttgaatctaatgtggtctgagaacaaactctgtatagcttcatttattttaattttgttcatttctggcccagtataatattatctaccttgttaggtgttttgtgggcatttgaaaagaatgtgtattctgctgttctataatctagaaacagcttattagttgatggcatttttaacattgttgatatccttgctgatattccgtctatttgttatatttgttgttgagagggtatcgaagtctccaaatataattgtagatttatattttcagctctatctctttctgcttcacatattttatagctatgttgtttggtttatacatatttcaaattgctgtgtcttttcagaggattggctcttataatttttttcctcttaagcctactttatttgacattaaaataaccagtttttttaaaaaaaaattgagataaaattcacataacagaaaacgtatcatacagctattttaaagtatacaattcaggagtttttagcaaattcatatagctgtgcagctttcaccactgtctaagtttagaacatttttatctccccagaagaaaccccataccaattaagcaatcattccccattcctatttccccacagcccttggcaatcactaatctacttagtgtctctgtggaattctgattttgaatattttctataaatggaatcgtggaatatgtaatcttttgtatctggtttatttcactaagcataattttttcaaagtttattcttgttgtagtatgtttcagtacttcatttctttttatggctgaataatatttcatagtatggttatattacattttgtttctccattcattaagagttagatatttgagttgtttccactttttggctattagaaataatggttttatgaacattcttatataagcttttgtgtggacatatatgttcagttctcttggttatctacataggagatgttctgctggatcatatggtcactttctgagtaactgccaaattgttttccatagcagctggaccatatgacattcctagcagcaatgtatgagggtttcaatatctccacatcctcaccaacgcttgttattgtttctctttttattataaccattttacttggtgtgaagtggtagctatgttctaatttttatatattgatgtttatataatctactttttccaccctttcactttcaacttgcctacattgttatatttgaagtgagtttcttattgactctttatatttggagtatgtttctttgatccagtcttccagtcttgtcttttaattgatatattgtgagagcatttatattaaatgcaataattgatatgttagactctatgtctgccattttattttttgctgtttgctatctctgtttttcatttctttttctgtcttcttgtgggttagttgaacattatttgaacattattagaattccattttggcttatgtgcagtaattttaagtgtatctcatcaagctttttaatgattgttttaggtattatatttcacatttctaactcattacagtttactgatattgtgttattccagttcaagtgaaatatagaatctatacttgctcttatgttcctttacccttcctcatggagaaccatatcagatattatttttgcttcaacatgaaacatagtttagaaaacttaagaggagacagaaagtctgtgtactctatttttgcttgctgtattctcccttctctcctgatatcccaaaaatccttattttattcttaactttctgtttggagatctttacctgtccttttactgtagatctgcttatgacacattttttttgtttgttttagtttcccttcatctgagagtgttttgttttctccttcattcctgaagtatatttttgctgaatatagaatttggggtacttttttttaaagcaattgaaaaatgtcatgctatttcctcctggcctctatggtttctaatgaaatatctactgtcatttcatttttccccctctatacataaggtgtagtttttctcttactccattcagtattttttcttttattttcaaaagtttatccatgatgcgttatgatttctttgagtttactctgttaggggctagctcagtttcttaatgtttagattttgtcttttgtcaaatatgggaagttattagcaactattttttaaattaattaatttttaactttattttattttattatattttatttatttatttatttagagacggaatctcactgtgtcacccaggctggagtgccgtggtgtgatctcaactcactgcaatgtctgcccacaggctcaagtgattctcctgcctcagcctcttgagtagctgggatgacaggcacccaccaccatgcctagctgatttttgtattgttattagagacggggtttcaccatgttggccaggctggtcccaaacttctgacctcaggtgatccacccaccttggcctcccaaagtgctgggattacagagccactcttttttgaagtacattttctgtttcatctttttatttttcttgtactggactctgatgacttgaaaggtagatcttttatctaactttctcataggtccttaagactcttttctctttttttccctgtttttttttctatatttcacattgggtaatttctgttgttccctcttccattttaatgattctttccttagccctctccattctggtatggaacccatttattgagtttcttggtttggtcattacatttttcagtactgaaatttgtttgatttgtttttatgtcgttgtccattttcttctcttttttttccctacaaattcctatttctttgccaaaatctattttcatttgcttcaagcaaaatgttaattggagcatttttataatggctgctttaaaatctttctgtgatagttttaccgtctttgtcatctcagtgacatctattatcttttttcattcagtttaggcccttcttggtttttggtacgatgagtgatttttatttgaaacctggatgtttggatattgttttccgagattctgtgttgtgtttaaacctgtgttagctgacttcctctgaaaatgctccagcagtggaagggaacatgcctccacttattactgctaggggatgtacaaatccaggttttccacttggcctgcattgctatttaaggccaggggggattcttgttacttctggcccggggtcaaaattctggctctcagtgaggcctctgttgatacatccctggcttggagtgtttagattgcctcattactgctctaagtgaggcctcccctgatgtcatggtggtgctgaggtggtatgttattgccgcaggttggtaaaatttttgactctccactaggtctctcttgacaccaccccagctgtaagagggaggggcatagtcttacttctaggttgagttaaaagtctaggccttctctttagcctagtcttattctacccaggcagggatgttggggttcatgttagagtatgctgaagatggaagtctaggcttcccacttgatctttgctgttgttggtagtggcaggaccaccatttttagagtggtgtttgggtggaggagaccagtttttgcctaaacattttctgttttgctaggatacctctttctggtcctttggctaaggagaacaggttggggaacttttttctgtctgtacccattggcctttctgggttgctggcttctaggatatatgagcaaaacaaaacccgtgatccttactaccatgacatttgctgggtctacatgtcccttcctttttaaggctgactaatattctattgtatgtatataccacattttgcttatttattcattctttggaatttgggttgcttccatgttctagctattataaatagtgaaactatgaacacaggtatacaaatatctttttgaaactctgtttttaattttgggcacatacttagaagtacaattgctggatcatatggtagttctatgtttaatttcttgaggaatcgcgatactgttttccactgtaccattttacattcccactaacaatatacaagggttccgattactccacatcctggatatcatctgttattattattatttttttaaatagtagccatcctaatgggtatgaagtagtatctctttgtcgttttgatttgcattttcttaattagtaatgctgagcatattttcatgtgcttattatccatttgcatatcttctttggagaaatgtctattcaagtcctttgtccatttttgaagtgggtttttttgttgttatttaggtctagagattatctatgtattctggataccagcgtctcatcagataagtgatttgcagatattttctcagattgtttccctccattttcatagcactctaacttgcaattttcacaatgttgaatatgtatatatttgtgtaatttttttaatgactgcttctctcactagattgtgaatttcatgagagaagagcctgaattggtcttatttacttgtctgactccaggctgagtctggtatagagtagtttcatagtaaatattcattgaatgaatgagagagagaataaaagacatatgaatcaaagttagcaccacacatgaatgaccattagtaaatgatcatgcttaggtgcagacaaaacttgcatccttaagctaggatgaaaatctagtgggcaattacatttcaatgtgagttttggagggaatatatattcaaaccgtagcagcaactgattgccctaaacttaagtgagaaacaggttagagttttgtgcagtagttctttatcatgaattgaagggctctgattgaagtagtaagattggaatcttggttgcacacagagttcttatagtaaaaaaatagcttgttggagtctcgatttcatagttaggtaattagccttgtaggatgacaattttgtgttgtggcattagtgagagtgccttgtggcatacagtgagttaaactaaagaaaggagaataatctgtgcatagtgagtaatgtactcatttttattccagtgtgttctttaccaactccttccaaacagacgtgcatgtgagtgcatgtgtgtacacacacacacacacacacacacgatgtttaaaatatagttttgtctttattatgacttcttttatttctttcagctagtcatttagcttctttagccatgcttcaaatatttttaaaaatctttactgatttctcttattgtgtttataacaaggtgttttaaaatagactctatgtttcctgtgtagtatttttaaatgacctcatttgatttttgccctaatgctgactttttttttttttaagttagtgcccaagagtgatgggtttctctctccttctttccctcttgggctgtcagaatatggggtttactataatatgacttttacatagtagtccttctttagatatttgtaccagtggttattactaagaacttagtttcatgtattttcttcccatatgtattatgaaattaactaatatgagaagcaggcattttgttttttcttgttattattttcatatcaatgccatgtgtttttttaagttcatatatgtggataatgctaaattatcatcatttagttttattttattattttttattattttaaccaataatttaaccaaataacattattattttaaccaataaattttagagaaaaaagcactctaatattgcatcactttgtacttagtttcatgtattttctttccatatgtgttatgaaattgactaatatgagaagcaggcattttgttttttttctcaagttattattttcatatttatgccttttttttaagtttatgtatgtggataatactaaatgatcaccattgggtattattattttaaccaataaattttagagaaaaaaatcactctaatattgcatcactttgttatcggtatcacaacaataattagttatcattcttctcctgacatagctctggagcctatgggggagatatcagagttttggaaagttttccttgcaatatcagtttataaacaaatttatagttattcctttaaaattttatctcagcttttatcactacctgactttgcctagtcaatattttttctaccatatattcaaaaacataactacttcatgtaattaattagcgtaagttttctttgcctctaaaaatgttgaaggtacctgactatattactacctgaaagactgtttatttcatattccattttgtcatatttatggtcttcgatccattgtagataatcatggcttttagagataaaagcaatcatagtcataaccaaatccagtccctgacttttttcaggtgaagaaactgggccacaaagttttaaatgcaacattatacagctttttgatggtagagtttttactagagtaaaggtctagggattagtgtatctttcagtaaactcccttattaatttttaatgtatatgaactgaacttttctaatcccagcttgtattgtttatattaatagtagcaataatgacaatatagtatctgacatttattgagcatttacatgccaaatgcactattaaccactgcccatttattattctactcagtgctcatgattactgtgtgaagtagctagtgatttatgcctgttttacagatgagaaaacttagcgtagtttaataaatttcagggctcatgatgtgtttaatttctttgcatatcctgtagtatttaacctcagaaattatgtttttcttcctcttctatcatggatgaaatcttaggagaaaattcgtttataagctactttttgcttaagaaacatatagcaagacttctaaaaaaatttaaaaaacaaagagaaaatgaaaattagtgttggaagtaggcactgatgctttgtgtgggttcccctaatgttctttggcaaccccactaaccagtggatttggattttgattaccagaagggagtgtgggcaagtaggggggaattggaagtgatattccacttcagtaagctcataatgtcaaagcactagtgaaaagatagaccatttcaaaaatctgtttcactccagatttaacaaagaaggttttttgtgttggccttgattgggaagggagagggtgctttcctggagaatttgtaaccacaactctgtcctcattcagattttaatttcttgcctgacctgggaactactgagctaataagttaaaatgtgatccttagtgggctaattacatccctgagtgtctagtagtaagtacaagtatttgctgtggcacatacccttacctctggcaatgtatgtgaaaaagaaagccttatgaaatgtaaactcataatctaaaattacaaagaatttgaggaaataattcagcaagagtaagagtgagcagaaaccgccagtggccaaattcaacttctgcaatgtcagataatatatcagaaacagtataaaagacttttaaaataattgaagaagtaaaagatggaattcaaattacaagagagacacaagatactatcataaggactacagaatttttataatgaaagaattttttggaggttggaagtccttaatggattaaatggattaaacagcagattagacacagccaaagacgctataagtgaactggaaggtggttataaagaagtttcccagaatgcaacattgaaaatagagatgatatgtgaaatacagtcaacagatctggatgttagaatgaaaagattctttatttctatcaactctcaggaggagaaagtgggagagaagcaatatttattgactttttttcccctgacaaaatagatgtgagatgtgaatcttcagacctgagaatcctaaattccaagtaggaaaaacaaacctaaacctctaagtagacacattgtggtgaaactctggtgtgctaaagataagcatgaacccttaaaagcaaccagagggaaaataaataaatggcatgatctgccaacatatatgttaataattcagtttcctgcagttggtaatgaagatgtcaaggatagagaaaatttatttcttcttgaacatatattatatttgaggcattgtattaacctatttgcaataggttaattggctagaaaggggaggatcactagattggattgaataggatcactagatcacttctttgaagtccacatacaatctagtgatcctcccctttctagccaatgtgagttattgaatcttcttttgagactatatctagaagttacaagttcctcagtattctgaagaaccaaactctgtccccttccaaataaaaatacttaattttctatttctagtctcttgtacccagaaatgttcttattcccacatttggaattatgacatagtagatcaatcaaagttaagtaaataagcttgtaatggaacaagttacttaagtttttctttttttaaaaaaaaacttaattttttttaagagcagttttaggttcacagtacaattgagaagaagatacagagatttcccttatacccccaccccaaaacatgtatagtctctcccctattatcaatatcaatatcccctatcagagtgatacatttgttaccttcatgaacctacactgatgtgtcacaattactcaagtccatagcctactttgggttttactcttagtgttgtacattctatggatttgggaaaatgtacatgttatgtatccatccttatcatatcatatagaatgtttcacagccctaaaatttctctgtgttctacctatttatcctatcccccaccagccaaaccctagcaaccactggtctttttactgtttctgtagttttgccttttcaagattgtagccttttcacattctcttagtaatgtgcgttatcatggcttgatagctcatttctttttagcaataatatttcttgtctggatttaccataatttattcattcacctactaagggacatcttggttgctttcgtgttttggcaactaccagtaaagctgctataaatatctgtttgcaggtttttgtgtggacttgtctcacctcctttgggtagataccaaagagtgtgaatactgaatggtatgataaatgtatgtttagttttgtatgaaactatcaaactgtcttgcagagtgactgtagccattttgcattcccaccaacagtgaatgaggttctgtttctccacatcctcaccagcatttggcattgtcattgaggttaattcttattagtaatgcaaataagttttctaagaatgtatgtggttagtgtgacaaagacatgtaggagagattgtgattcatacaattttagagttagaagcacattttatgtatttatttcatattaagaattatgtcataagcaaggtggcagaatgtattgctttaaattgaggcatttaaaaatcattctgtcactgtgaagctgaacttttacttgtcagatgtttatttgccattgctgtttaaaaaaaagaattacatgtttgtcagtaaatgcttgttgactccttttgctggtgattacagcaatatggacagggatttctgagatgcaagtgggggtagaacgatgaaaattaagctcttactgtacagactttgtgttttgttccttgtgaatatttaaagttcagttctgtcatttaatgatcactgtgagttgtacttttgagattactttttgtttcatgttgtttcagtggttatattttatgttctgctgaaaatagtaagtgctttttacctggatattttgacttaaccctagaatgggtcactacatctgttttttgctgttaaaatcattataatcaacaacaataataaaagtacctctacctttttaagtgtgctgtctcttaaagtttctcttttcagagggagatttttacagtctttgtcacctattgaatcttagaactaactagctttcttggtacacctgtcttattagtatttcctagcgagccacttttatttaggtttttcactttcttcttatgtgataaatcttcccctcatttcactttctccctttattcttcccctgaaaggataatacttacttcttactatatagtatgaaagatttggaagctcttgactatctctttaatgcatcttttaaaataatttacctcttttctctttcagaaacctttattatagttacactctcctgtgattttgttatttcccagtatcaatatggctcctggctgtttgaatgttttggatggtctgttgttgttgttgttgttgttgttgttgttgtttcaaacagggtctggctttgttgctcaggcaagagggtagtggtatgaccatgacgcactgaagcctcaagcaatcctcccacctcagcctcccaagtagctgggaccacaggtgtgtgtcaccatgcctggctaattttttatttttttttgtagagatggggtcccatcatgtagcccagacttgtctcaaactcctgagctcaagtgatcatcctgccttggccccccaaagtgctgggattataggcatgagcttcatctggccaatcttttgttttattttattaaattatagctttgcaaggcttgtaacaaaaagagcagtcttctggcaccctgtcatcctcactgctttttagaggcaatcatttttcaacttattcttagatatgtacctctaaatttctatatagtagtctttgttgcagttttcttatttttgatgtttttccatagagaaagtcagtgttggccctgaaagctaaatcattctctgtgttaggcaggagtatgtagatattatctgcatagttactattgaatatgaggatatattagttttctattgctgctctaacaaattaccataaacttagtcccttgaagcaacacacatttattttcttgcaattacgtagtttagaagactgaaatgggtctcagactaaaatcaaggtgtcagttgggctcctttttacaggctctaagataaaacccctttccctgctttttctagcttttagaaatttcctgaattccttggcctgtgacccccttcccccatctctaaagccagcaatgttacatttccgtgagtgtgcatctgtcatcacatctctttctctgactcttttttgccttctcctactacttttaaggattcttctgattacgttgggttcacctgaataatctaggatcatctccctatttcaaggtcagctgattaggaatctgaattttcctttctgttgtaatatgacatgttcacaggtcctgaggtttagcatatgaacatctttgggggggaccattattctgtctgtcatagaggatctagtttttagggccaatactcatagcctctgtcttttattcctttttcctaaatctttgaatataattatgtcacagtttttgcttaaatctatactcagtatgaacgtattataaacatgtatgtatgagttagaatatgctaccaattgcatttatttttcttataaaacttgtattcttggagttaataactgtcttggagttaataactgtctttttttttgttattgcttgattagtgttctatgtacttatttttaattaattccctcaaactctgacataaacatatcttctctcaattccttcaggtgtgtgagataattacttttaatttttggagtctttttttttttaatgctttttcctcctgtttttctgtttgttccctaggcctactgtagagatgtcttgaaatttccttttatcattgtcctgggatttccttttctccggttggatcccctgtttcttagaccacacatgttactctttcttgatttactctcttttttaggtggagcaaaatcctctagttaccttcctagtgtaggaagtaaacttttttcaggtctgacatgtctgaatgaatctttattttgtctttatatgtaattgattggactgtatatagatttttagggtgggagtgattttcctacagaaatctgaaagcatcacattattgtcttcttgcttttggcatttctgttgagaagtttgatgccattctaattgtttaacctttgtttgtcacctgtttttgtttttatatttgtctgtctgtcttatatcagaagtttttaggagcgtctctttagccttgatgttcaggtggtatgagtttatgtgtgtgtttttttcatttgttaatactggatacatagtaaacacttttaatttgcaactccttttctacagttttggaaatgctcttgaactatgtttttgattattttccccattttcttttaatagttccttctagaccttttggtttttagatattggattgcttatgttgatcttttcatttttcttccattttcattctctttggattttttggttttaatttatgggagattttctcaactttattttccaatctatttattaatttaaagagaactagcatcatgtttttaatttctatgtgcttgtttttgttgtttgaatattttaaataaatgttcatttcttattgcagtatcttctgtactctttgaggatagaaatcattattattattattatttgaagttttcttctgctcctggctttgtctgtttaccccatgttccttttattatgttttaaaataatatctgcctgtcacatttgtgatttccatctaatatttaacaatccttcatattgcagaatgaagtacaaaataactgaaacctctgtgtgaggttggaacttgttgattgtaggggaattggacacaattcatttttggtttgaggataatcgattatcagtgtcatgtttcctttttcttgagcttgctcgtttcagagagaaagccgtccatttccttcttgaggtttctaagcctggtacttagtaaaggaagggtagatctcattatccagtatgtgtatgccatatagattctaagataattccccccttttagcatatggttgtatctcatattccttagttgagagtcctcctggtttaacctctccaaagtaaaccctttagtcttctgccaggtgagtgtcaggtagttactgggctgcgtggattaaaggagaggatcctacatggattaagaaaaacgatctgtagtcactagataaaattttagtcatgcctcatctttttagcctcatctgcatccctgccttcagagcttcctggcctctttttaattcttatatttctggggcttattgcaggatctatttgcttattagcttaattacccacaggcacttttctctgttctactaaggctactcattgctacttgttcatcagatatccatctttcaaaatttagatgatagctcttgcttgtttgagagcggcctatttggctcttgtctttttattttcgtttctttgttagtttagcgccttaaaataatttcttaatagtcttttggtggacttcagtgggggaacagaagtaatcatatggtttgactccttaatcttttacttccacagagatatacagatcattctcattagttcatcatttaatatgtacatcataactacagaagtgatcataagctgactactgaacactagaaagttgacactgagggagaggtctcagtgagtcttaaagaattatagcgggcaagaaggttggtggaaaaagaattagggttagcctgggcaccatagtgagaccctgtctctacaaaaaaaaaacaggtgtgatagagtacatgcctgtagtcccagctacccaggaggctgagatgggaggatcacttgagcccaggagctcgatattacagtgagctatgattgcactactgcactccagcctgggcaacagagtgagactctgtctcttaaaaaaaagaaaaaaaaataggtttaatggtgcaccacaggactaagattatgtgttaggagttgatatttttcagaaaagtactaggaggatgatatgatttggctgtgtccctgcacagatctcatcttgatttatagttcccataattcccacatgtcacgggagatacctggtgggaggtaattgaatcatggggggtggttaccctcatgctgttcttgtggtagtgagttctagagggacgtgatggtaggtaattgaatcatggaggtggttaccttcatgctgttcttgtgatagtgagtgagttctcaggagatctgatagttttataagcagtttttccccctttgcttagctcttctccctcctgctgcattgtgaagaggattagtttgtttccccttctgtgatggccttcccagctatgtagaactgtgagtcaatcaaacctcttttctttataaattacccagtcttgggtatttcttcatagcagcatgagaatggactcatacagcaaattgataccagtagggtagggtgctgctataaggatacctgaaaatttggaagctactttggaactgggtaacagacagagattggaaaagtttagaggactcagaagaagacaggaaaatgtgggaaagtttggaacttcctagagctttggaaggctcacaggacaggaagatctgggaaagtttggaacttcctagagacttgttgagtggctttgactaaaatgctgacagtgatatggacaatgaagtctgggttgaggtggtctcagatggagatgaggaacttgttgggaactggagaaaagttaactcttgctgtgctttagtaaagagactggtggctttttgctcctgccctggagatctgtggaactttgaacttgagagagatgatttggggtatctggcagaagaaatttctaagtggcaaagcattcaagagtaggcagaacataaaagtttggaaaatatgcagcctgattatgcgatagaaaagaaaaacccggctggacacgatggctcatgcctgtattcccagcactttgggaggctgaggtgggaagatcaaaagatcaggagatcgagaccatcctggctaacatggagaaacccttctctactaaaaatacaaaaattagtggggcatggtagcgcatgcctataatcccagctacttgggaggctgaggcaggagaatcgcttgaaccagggggtctgaggttgcagtgagctgagatcttgccactgcactccagcctggcgacagagtgagactccgtcaaaaaaaaaaaagaaaaaagaaaaaagaaaaacccattttctggggagaaagtgaagctggccacaaaaatttgcataagtaatgaggagcagaatgttaatcaccaagacaatggggaaaatgtctccagggcatgtcagagaccttcatgagagtccttcccatcacaggccaggaggtctaggagggaaaaatggttttgtgggctgggtgcagagtccagctcccttgctgtgtgcagccttagtactctgtccccgccattctagtcatgggcaaaaggggtcaaggtagagctcaggatgttgcttcagagggtgtaagcccccagctttgggaggttccacgtggtattggtcctgagagtacacagaagacaaaaattgaggtttgggaacctctgcttagatttcagaggatgtgtggaaatgcctggatgtcgactcagaagtctgctacaggggcagagccctcatggagaacctctgttagggcagtgtggaagggaaatgtgaggccagagcccccacacagagtccctactggggcactgcctactgggctgtgagaagagggccactgtcctccagaccccagaattgtagatccactgatatcttgcaccatgtggccggagaagctgcagacagtcaatgccagcctgtgaaagcagccaagagtgggagttgtaacctgcaaagccatagggacagagctgcccaaggctgtgggagcccatctcttgcaacagtgtgatctggatatgagacatggagtaaaaggagatcattttggaactttaagatttaatgactgccctattggattttagacttccatgggctgtaactcctttgttttggccaatttctcccatttggaatggatgtatttgcccagtgtctgtacccccattgtatctaggaagttacaggctcataggcaggaggaacttgctttgtctcagatgagactttggacttggagttttgagttaatgctgaaatgagttaagactttgggggagttttggaagggcatgagtgttttgaagcatgagaacatgggattttgggggggccagggtagaaggatatggtttggctgtgtctccacccaaatctcatcttgaattgtagttcccataatcctcatgtgttgtgggagggacccagtgggaggtagttggatcatggaggtggttaccctcatgctgttcttgtgatagtgagtgagttcttaggagatctgatggtgttataaggggcttttccccctttgcttggcacttctctctcctgccaccttgtgaagaaggacgtgtttgcttcccttccatcatgattgtaagtttcctgagccttcccagccacatggaactgtgactcaattaaacctctttcctttataaattacccagtctcgagtatttctttatagcagcatgaggatggactaatacagaggaggaaaataacagtgcattattctatatttaattttattataaaaattggtaattatttttagattattgtattgactgtgcagtataacttatatgtcaattgcagtaccttagggatacctctttccttcctctagtggactatgacaacaggatttgagtaaaggaataggtgaatactttataaagcattttttcaaatgtgggtattttcactatctttgtgattgtccttttgactcatgtcagctttctttacatcctacaaaagcattatactctctttctaaattaagttctgtataaagtttagccaagttctcagagttaagcacctggaacaataactacagttattttggcctccttaagtaacaataataaatagtgactagccttaagccactgtattacaaggtaaagaatgctgcctatatctgaagccacattttagcttatttgctctttttgtttcaccacattgcttccctaatagtaaatttcttttcacagtttctgagagaagtattcctgtgagtggtgccctgagttgtataatgtcaagactgtactcctttctgcctttctattgctcacatttggggcattttataatttcagtttgatggtagagtggaaagaaactacgattatttttactagctacttttctctatttgatatcaatgtctatcaagagatgaatataacttttatataaaaatcccttccttataaaaatctgagcttttagcactaaaaacaaattactttataaaaaacttttcttaaggagaaattatgacattatgttcttttagttgttaaaccaaatttaaaaatacttgagaaatgtaaagttaaaagtgtcaaactgtattcttgattgtagttgtctaaatcaaagtgctttatataggtatataagatataagaatcttttttttttttttttttttttttttgagacagagtcttgctcgttgcccagactggagtgcagtggtgtgatctcggctcactgcaacctctgcctcccaggctcaggcaatttttgtgcctcagcctcctgattagctggaattacaggtgcttgccaccatgcttggctaatttttatacttttagtatagatgtggtttctccacattggccaggctggtcttaaactcctgacctcaagtgatcctcctgccttggcctcccaaagtgttgggattacaggcgtgagccaccgcgcctggccaagattgttatcagaagatgtttcagataacttatgataagagtcttatatataacatgtatgagatattaagaaatacttattatttatgattcaaggtagagtattaagttttggaaactgtaaaagaagccgtgttataaaataattctaaagaaactcatttggtctatccatattcttttgctcttgtatataccggaaactaattcagatttttggttctgaacaccatcaacgactctttagagaatcttttagtagctcttgtttgctgactactatataggtttcctgtatttcttttgaaaaaattggtattgaatgagagtttgacccttaaggcttgagagccaggggagggaaggctattattaagttctgtttctctctcatcatctaacatagtgattggaacagggtaagttatctattgattatagctccctgcaaccacagtagatgttaaatagagtagctcagcatcctttgttataaagaaaaatgagatccaggctttgccactttctgacttgggcctttgcaaaatccttatttctccaatccttttttaaatatatatatagaatgaaaatagtaatagctcctaaggattattttgtgtttgccgaataaatgaaataaactaggcatcatgcatggcactcagtaagtgctcagtgcatgttaagtgctatgattactattattgatactactgctgctgcttttattgctgctgctgctgctaccactaactactactactactactactactactactactactactactactactactacgatgatgattgtattagcatttttggcatcatttaattttctgagatattaaaatttcctgagacatgaattttgagaatctgttaaaaatgctttaaaatgcataaatatacagcattttagataccatttcataggtgtaatgaactctttaaagtgtgctctagaccataggtttagaactccttctcagaggataatggataccacttcaaatggacacaattcaggtggcaaatattggaaaatagcaaccaattagtacacaattatataaagacaaaatacaaattagcaaattgatagctccgagtattagtccgttcgcatactgctgtaaagaactgcctgagactgggtaatttaaaaaggaaagacacttgattgactcacagttccacatggctagggagggctcaggaaacttacaattatggcagaatgcgaaggggaagcaagtaccttcttcacatggtggcaggagagagaattgccaacgaatgaggaagtgccatgctttaaaaaccgttagatcttgtgagaactccctcactatcatgagaacagcatgagggaaactgctcccataatccagttacttcccacctggttcttcccttaaaaccttgggattataattcaacatggggtttgggtggggacacaaagctaaacaatatcataagggttgatttgggacaaggtatttctcaggataacattctctaaccatttgcaaatcatttaatgtgcttgttaaatgcagaattctgggccatagctcaggatgactgaatcataatttctttgagagattatgagtcttcttgaataccctagagtttaaagtcaaggattttagaataatgtttaatacaactatcatagaaagtgtatgatcttcttaattattcatacatagttaaagaagcttcaaaaataaaggatggaattatttaaccaaagtgtggaaagggaaaaagaagcaaaattacgttggtgggttttcatgaataattggcaaaatgagtgataaagtcttctgtgatggaatcagattgtgttaaacaccctagatctttcacatagcaactgttgtcctctgggcaaaaattagttaccttccctaatctattgcatcctcaatctgtaaagtgaagataataataatatctataatataggcctgttgtaaggactgaatgagataatgtacataacacatacttaagtcctcagtaaatgttaattgattagagttaattgtcattatcatcatcatcatcactatcatcaccattttagtggtggttgtccatactgtcagtataatattcttaaggtttctttgcctgtataattctcacctacccttaaggatcaaaatgaggttctcccttttgattaagttttccaaccatttatttatgggaattattaccttctgtgcttttatatcctttagcaagtagtacataataaagatgttaatatctactttttggttaatttataaaaatttatttgcttcctttttatctatacagagcatgtgaattttatttataagctattgtattttaacacaggaattatttgagctacaggttgagtgaccccctactctgaaaattcaaaatctgaaatgttctaaaatctgaaactttttgagagccaatattgactctcaaaggaaatgttcattggagcacttttgatttttgattttcagaatggggatgctctactgttaagtatataatacaaatattccaaaattcagcaaaatccaaaattcaggacacttctgctcccaagtattttggataagggatcctcaacctgtattttgtttctgtttcctcatttcacctgaccaaaatatttcagagaatttgtttactcaggtagttttttttttttttttttgagatggagtctctctctgtcgctaggctggagtgcagtggtgcgacctctgctcactgcaacctctgcctcccgggttcaggtgattctcctgcctcagcctcccgagcagctcggaccacaggcgcatgccaccacgcccagctaatttttgtactttttttttttttagtagagatggggtttcaccatgttgaccaggatggtctcgatctcttgacctcgtgatccgcttgcctaggcctgccaaagtgctgggattacaggcgtgagtcaccgcgcccagccttgcttgggtagttttatgtttaaatgtctccacctaggccgggcctggtggtgcacgcctgtaatcctagcactttggaaggctgagttgggtggatcacctgaggtcaggagttcaagaccagcctggccaacatgctgaaaccgcgtctctactaaaaatacaaaaattagccaggctggtggaatgcgcccgtaatcccaactactagggagtctgaggaaggagaattgcttgaacccgggaggcagagcttgcagagcttgcagtgagctgagattgcaccactgcactccagcctgggtgacagagtgagactctgtctcaaaaaaaaataaaaaataaaaaataaagtcttcgcctaaattaaacttgactttataagttaaatttgtttcaaaaagaaaaatcttattgttttctaaaaccaaatatgatttttaaaattatttcttgttttttttaaaaagtatttgtgcatttacttttatttcttgagcttgactaatcaagaattgaatgcataagtatagttatgagagttcagcccatttattttaaatttgcatcctttcacctctgaaatactaaactatgaaacctaacacaaatactgtaagaacatctgaggtagacagttagagtataattaagtttaaatgccttggtgaaggaatataaaaattatttaaattcaatcggctagtacatttgcagttttcttttattaggtgtgaaatctaagaatcccctgccaactcttgagggctcaatccagaatgttgaattgaagtactgcagcacatcattggtcaaatgtgcctctgggaccatgggatcaataaaaatttgtgccaaagccccaggtatgtgcagctggaccgtgtaaaactttattgcctgtataggagaattggccttgcgttttacaaggagcgttactgaaacaagaatttactcactgttgctatgaatcagacgttttaaatttttacttagaaatttttctaattgtgccaggatggtacttcttgactttaacaaatttttatttagggaaaaatacttagttttatgaatggttatgagggagaaaaattaaaggaatgtttattatactttttgggggaataggaggtgtatatatatgtatataatatgacacttaaaattaaattaaaaagttgttattgtaatataattaaataggagacccagttgtttttaaattttggttgtaaatgactttaccttcctaccaatattttatttcataatatattttaaaaaccatttgtgatttttttcagtgcaaactaaatttaaggtaagtttataaaagtccagatttcatttaatttttagaagacagtgtgtttagttgtttccttttataagcttttctggacatgttctgcattcattagcaaatatgaaaacttaagagttaaaaatgctttacattttatgagactcagtataattaaatgtatagctaatattatcaaataaagttgaaatgttatattatggtgttagtatattttaaaatcaaacattctcaagtgactcatgttttatttttattattgttttataaatatttcttttcagttgatagtggaaaagagaagttgattcccttgcttcagggtccttctgacactaaagaccttcatagcaccaagtggctcaatgagagtagaaagccagagtctctcttagctccagatttgatggccttcacaatccaagttccacaatatattgactactgccacaattccggtaagtacaaacctatcattattcccttgttttgcttttttttttttttttttccagaaaggcttttaaaattggtatatatttttttttttttaggtatttttgtcaattggcttactctgcagttgtgctttttcaaaattcaaatgaagaatttttgtatcacttttgttaattgaaatgtgtttataaataatgattttatttatatgagagaatttagctgtgtgtatagtggttaacttcagattcgtatatataaggaacaactgagttttaaaatatagcatatcattataatgcatattttcttgagatagtagcactttgtaacccaagtttgtcatgtgtaaattggtgtttttaccttctgtaattttttaggaatgaaaagatttgatggtagaactgagaagaaaatctcagaggtcattatctcatttcttagagttttatttttttctggtagcactttgaatagaatcgatttcattttattcaacactgtaatagcagagctatacctctcatgttgagagaaggtatcagaaggatcaatgaagactgagaaaagaaaaatgtatgataggtagagatcactatcagccatgaattcacttagccagtatgtggttagcaaagtcagggtgttcagtcaatgaagctagcaacgtgatagtaatatagacatttgttttaaaagatacgtggtccacattttctctctagaagtaactggccagtgagtagtttcaaatagctgctttagagtagagcttcattaacattattcaacaagtactgtagcttatagaaagtatgttcagcactagtatgttcaagtggaaactatgaaaagatttgcaactaactgagcagagactatgtagaggtaaatattgaataaagcagtgcacaaatgaatatatacagggacacaaaacatttgaaagatgagtatattatgataatatttgcagttgagtggtatccacattgaaaactggaaattagtatttgaaaggtgagtctaaggatgctgtctgtcagcatgcttcaaaggacagcacacctcaaaaataagatttcagcctggtaagaatgggtacagaaccataaagaatgaatgatcagaggatggctccagatccaaagtagggttgtccctatagagaaaagattttaccaatcttttaagacagggattggtaaatactttcttaaagggcctgacagctaatattttagggtttatggcccatacagtctctgtctcaactgtttctgctgttttagcacaaaaatagctacagacaaaacttaaatgaatggacgtgactgtgtttcaataaagctttatttataaaagcaggaagtgggccagatttggcctatgtggtttgtctaacatggttataagaagaaggaattggtggataaatatcatgactttgttaatgcctatttaatcatgttccttaaatatattgtttagtaaacttctttatagaattacccatatagtaatttttgttttcaaataataaacttaagatgatactaaaatgaccagaccattcagttacaattttgatacctaagaagagattaatctttctagaatcttgccacttgttcttgagttggacaggaactcttaatatttgttttaccacatatacaatgaaaataaattaataagttgagtgtatttaaataatctgttcttcaacaatatattaccttttataatttaaatgcatttctagggtcacaaaattttatttttgtttttaactttttatatagctctaaaagtaaagtggtataagaaaaattatctgtgacacctataatatttataaagttttaattttttcttgctgttaaggaaattcacctaatctgcaacattagtgttatggatagtagtatgtttatggatttgtgtgtaaaattttaatgtgatcatgtatttaatgctttgaaaatattcctttgggtatgttttgaacctaaaatgtaatatattttaacttaaaactacattcacatagtttatttatggtatttttaaatttaaatttttcatccaccttacaactgccacccacattcatggcttaggtatttatgatatggtttagagagctcataagtactatttttatgccagttttaaaataatttgaattaatcttatgttcttgtaacaagatttaatttgggtgtatatgtatatatgtgagtatgattgatgttatagacaagtcataagtaaatcttaaatgaaaaaatcaaaattccttaacagtccttcaagactttacaaaaatattatactttcagcaactactttcctgaccactgtatctaaatttctctctctgtctcctacacacatattgacacttcttacttatttttctacactcctttagttttccttagtacttatcagaatctaccatactatatatgttactgatttatattgttgattgtttcccctgctattagaattttatgcttcatttgggcaggacgttttgtctctttttggtcactactgtgttcccagcatctagaccaatacctggcacataagctaacaataaatacttattgaatgaataagcaagtaactgatgattacatttacttttctttgctttttgaagttgaagtatctaatggaatagagacaggaatctttctggaggcttaagggaagaaaaagatgttaggtggttaaatcttttaggtgaacagttaaagggaatcatgagtggtctctgcttgtgttttcagaaacagatagatgtcccggtgaggttgttaatgaacttttcccatggtcttatagaatttgaatgatgatcatactaactggctttttttgggtcatggcatgatgtgtggaagacagctgcccttgtgcatatactctcaaattgagggggatgggtggttaaatgggaccagcaaatgttgcagatgttacgtaaaagtcaattaggaagtgagttttgagaggagcttattacttaggcagccttttgactgtgatttgagaatgtgagggaatggacagctttattaatggggatttggaattatgacagagagaaatattaatggtattagtaaaactcattataaaaacagtactttacaattaaaatgtcacatttgtgtaaattgttttatttgcttacaaatcaaaactgttttaggcagagaaaatattatttgtgtcttgcagaggaggaaatagatgcctagaagttcaatgacttgtccaattgcctagcaagtcagtctttgaactagaacttggaacttctaactatacaacattttcccaccatgttgggtgttgggctgtttatcattttctcttttaaccttagaatccacctcactaaacactgtatccttcagtcttaaaagttcctaacgtaacggatctccttttttactttatattaagcactgtcaaaagagccacactgtcatgatcttacagcatttctttgtctttgaagtctcagcaattccctttacacttttcccacttccttccttgattgcattctgcacttgactaactctgattaacagcaaaggagctgaaggctcttattagaatacagtatgccagcacacattctgtatttatggttatttttcaggggaaccatttaatgacacatttcttaggtttgtgtagatacaacaggtcacatagagaaatagatgcttctctggttcctttgtaggtagaagcacttggtgactataactgacataattaaaacatttaaaaataggttctgcaggtgcagtggctcatccctgtaatcccagcactttgggagggctgaggtggaagcatcacttgagcctgggaggcagaggttgcggtgagccaagatcacgtactgcactgtagcctgggtgacagaacgcaaccctgtctcaaaaataaataaaaataaaaatgaggttctaaatattttcttcccttattttttattattattattttttagacagaacgttgcccaggctggagtgcagtgggcgcgatctcagctcactgcaacctccgcttcctgggttcaaatgattctcatgccttacagaggcgcaccaccacacctggctaatttttgtatttttagtaaagatggggtttcaccatgctggtcaggctgctcttgaactcctggcctcacgtaatccacccgccttggcctcccaaagtgcttgagattacaggcatgagccactgtgcccagactcccttgtctttttaatatagactttggctcttcttatgctatattttgcctatgattcatagcaggttctgcttgctaaagagttctgagtctttgttaatcatggtattaatgtgtaaataaattttggagtgtctgctatttaggaatataaaatgaccatgaattctatcagcttagaatcaaaagaatttaggccatcatttcaatttctgttttttcttttgatatggagtctcgtactgtcgcccaggctggagtgcagtggcgcgatcttggctcactgcaacctccgcctcccaggttcatgccattctcctgcctcagcctcccaagtagctgggactacaggcacctgttaccatgcccggctaattttttgtatttttagtagagacagggtttcactgtgttagccaggaaggtctcgatctcctgacctcgtgatccacctgcctctgcctgccaaagtcctgggattacaggcgtaagccatcgcaccaggcccatcatttcaatttctgagccagtgttaagagttctatttacatgtctcctgctctctctttgctctggctctgctggccttttttgatgttctctgtggtggttatgtatttacatatactgtttttttctgtctaggattctcacaaccatccttaccctttttatacctgtttatttccagctcagtctcaagatctcagctcaactactgtttctccaaggaagccttctgtgactctgccttttccctactccctcccaagccactcaatttaattaagtacctctcttacattctttcatagctgttaagacggtatatatttatatatgtccttaccacttgacagtaagttccatgagggcagaattaatcactggctgcttaccattttatctccagggcctatcattgatgaatgcacaaagaatgcatgagaaatcgtttgttgaatgaatgaataaatgaatgaacatttatgacagatgttcaagggtataaatttgacagataaataatcagttcttgatacatgttagccgccttttcttttctctatttctgtttcttcctcctcttccttttccttctgcatatatctaccactagagaaaatatctaccaatatctttctctgtaagacagttctaattactattagattatttattcactggactatacctcccatttcctggtctgattttattcttataaatgacatgaaataatatatcagcctgaaatatacctgacaacacatattatcttacctttcttagctttttttcacccttcctttcatttggtattcatcctctttagtctccagcatttactgctatggttgatcataccctttctattcaatccttagtctcttttggcttctagatgttcagagacaagtctctatagcagtggtcctcaactgttttggcgccagggacctgcttcatggaagacaatttttcaatagacttgggtggtgggggatggtttccagataatactcttccaactcagatcatcaggcattagattgtcataaggaatgtgcaagctagatccctcgcgtgcacatttcacaacaggctttgtgctcctatgagcatctaatgctgctgctgatctgacaggaggcagagctcaggcagtaattcttgcttgcctgcccactcctcacctcctgctgtgtggcccagttcctaacaggccacggactagtacaggtccatggcccaggggttggggaccgctgatcgataggtcttttttgtttttgcacttcttgcgaatggaggcactgactgccctttgttctggactgtctattcagagatgttcttatagtgaacagccttggaagacaagtatcatgtctcattctggagcaaagagaaagcatgcttcctgttataaaacatttggttccttaacttcgggttcatctcctgttatgtaattcactgcatgtacaggcagccatctgaacaaacgtgcacatcatcacctctgtgagacttgtgggcaaagggaactgatgcaaatatgttgatactggtgttgctccctgtgcgataagtaataaagtccttatctgtgacttgggatccttgtcttctgcagccttcatgaaactgtggtagcgtatgatcttaggtccctgacaattcttgacaccagaacaatgtcgtttcttggttttccttgctttgttcccctcctcgaagatgtttctttcttctgttccttaaatgtaggttgttaccaagattatgttattgaccctgtctttgtatctgaatgatctaatcaatacatctgttttcagcaaccaaccataagtttatatctttctgtccatttttttttcttttgagatctggactgcaaatttcagctgcttcttaaatattttctttggatattttagtggtgcctaacacattcaaaactaaactcagtataattttttattccctatttcatacttcattattcactctttcagttaataatggcactatttccctcttaatactgtcaatttcagcactaccttgattctgccttctttcttccctgcacatggttgatgttttacaaaagcctccaccaccccaccaattaaatatcctaggcaaaacatcataaatttatttcagtaattttctatatgatttgtcttcagattgtcaaactgactacttccactacatgtttgaaaatatcttctttaaaatgttaactccaaaatttaacacagtcttccacataccacaaagtacaatatatatacttctcagatttgtatagggaacttctattcagttgctatttgtcttgagcttgtatgctacttggaaaccgtggatctttttcacacgaactactcttaagacatttttacatattttatatgtctacattagtttatgaacctacttggaaagctttatacttatttctatgaaatttcacctaattgattttggtccaccattaatgaagatgataccttttaaagtatctgcttagctgtagtcacttgtgcaattcagatgcacatgctatttttgcttttaatataatggaactaaaaataacgttttttactaaggtaagaaaaatagatttatgtgattatgatgttattttaaaataatttaaaataagtgttcctcttaacgtatctttaaatgtaatgccaatgtaaaccagtctttattatcttgtataatttgtttcagaattaagtagtataaattttttaactttaccaaattgtgataaattaaaaataatttaaaattttacccatcgcacatgggaaacttttggtcattgttattggaaaggaaagccacaattacaactctaatctctgtaaattaactgttacattgggaggtagttctttgtcttgattaaaacataccagcaaacagacacactcttttggttcaccatttggagttggttggttagaatatattgtttaggagttttaaaaatggagacagtattttatattgtaagttttaatttgtagggaatgtcttttttggtttcaaaaaattctgctcctaatgtagaaataagtgaattgccttgaagttatatgtttagtatttttgacagaacatatgagtaagaatgcttatatattgtagcaattaaagacaattcacatttgtggtttgggcataaatgtgtaaaaattatacccatctatcttattacatttcctctttcctccctgaggacgttactatgtattttatctgtaattgttgccagttttctatcacgttcccactgggcttttggtgcaaaaaatcttatcctcttgatgacagagcttgcctgaatgatttcatgctcctagcatttttgttcacgggaattaggggcaaaatgtaactacagctgaacagagcgtctatttttgtaattttggagtttaggctctgttattggaactaaatgaagagatgcaggtgttctccagtccaagccctttgggagttttgatggtagatgcttgaaaagaaaatgcatgtgtttccacagtcaaacagcagctgtgagacaaggatttatgcttttctcagaactttgggatttcaaaatgttacatttaatcacaagcccagaaaggggagcaaatgttaaagatgttacgcataaaagtaagtttactgatttctttaccatacgaactagttgtgggaacataggaacaaagtactttttaatcataatgcaaacaatttctaaaggattatgataattgtaaggacattgccttttgaaaatgttacatttgtagtgcagagaatttttttatcctactaatttcctaaaatatattgatattttttcccgttaagagatgcaaacacatacacacacaagacgaaaggtgtggtaaactatttgccatatgcattttaatttttttccccaaaaagtttaataaatatcttattgtaaaaacaatattttcaagtactagaaatgtcaagttctagctaggatactaactaagggaatttatagatatttaaatacaggtgtatatttaaatgtttacacaaaacaaagcatatgtatatgtttaaaatattttttcttttttcagatcatgaaattactttgtgttagttgattttcaaatttatctttattaaagcaccaccttgcagtatttctttgccattctcctatttttattgctctacttttttagcataatcattcatttattcatctaacaagtatttattgcctattttttgtgcgtagaactataacgatgcatcaaagtctctacagtgaatcaacttctaatgaggagtaagcatataaacaactacagctgaataaatgaatgatataaaggcttattttttgggttcagcttcatccattataaattatgttactttgagcaagtaaacctttctgagtattggtttctttttttctttacttttttttttgagatagaatctcactctgtcatccaggaaggagtgcagtggtgcttgcatcctctacctcctgggcccaagagatcctcctccctcagtctcctgaatagctatgactacaggcatgagctgccacacctggctaaatttgtgtgtgtgtgtgtgtttttgtagagacagagtcccactatgttgcccaggttggtcttgaactcctacgttcaagcgatctttccaccttggcctcccaaagtgctgggcttataggcgtgagccacagcacctggcctagtgttggtttgtcacctataaaatggagatactcttatctgcttactaagattgttgtgaagattaaatactgtatcctcaagtacattgtaaactttaaaacataatgtggattttaagtattaattattcttttcacaatagtaccctatattaaccagtgattgaaaatgtaaggtttttctgagtcatttcttttccttccttaatctcaacatcccagttaatggaatccactttaaattttttctcaaggtaaaaatttgcaaacctatgattatgcatttctgaagctaggagcaaatcctttacctagtttcgttattctccttccacattgaaatgtaccctggacgctatgatgttaggagtcaggaacagttgcaatagcaacaggaaattactttgcttgcttcctttgaaaggtcccagattctggaaggatgccagagggagaaatcccttgagccttaagggtaaccagtttccctcatttatatagcacaaggtcaaattttttgcattttattactgcttgtatagtaaaagtaaactggtattcagagtaaatagtagcttcattagtaagtagtaaattagtatacaaaaagtattcgggttgtatactgggctgcaggtgaacttcactagaaaatacggactatctcataatttgtttaaagtatgttttatatggatcaaaaaggtaccagtattactttattttctacttagaaaataatatacattttctatgtgagtttttatttttgcaactcatagcttttgtgtttaagacccaatgacattagccttgtgatcctgtgcagattttgaagttggctgtatagtagctttcatataggccaaaagaggagttgctttataaaacacttacgggtgaaattcacatcaatctttgctacctgccccttctcctagttgttctataccctctagaaaaaacctcattctactgacagcctttgcattccttttattcagttcagtatacatgggagtcattcttataccattgcattgttttgtaaataagtgagactcagttgtctgttaatgtgtgagagtttaagtgttttactgaggatatttctgttttattttcacctccctctgacttttgcccttcctcctccccatccctttcctctcccctcccttcccaattaattactcccttctaagcacaaccatagcacttttgctgtatcatgctgcaaatagtcttaactatttataggattccttccccatgaagttgggagttcttaacagcagggaaccataactagtgtatgataggtattcagtaaatgtaggctggtccaaaggaaattatttttgccatttgggcatagccctattgttcgcaggtacatatttcatttctgaattgctctatggggaaaaatgtagtctggcttcggtctgttaaagaataatttttaaatgtaaaatcataactctcatatagaaataagacaagtgctaaagattttatttaactcatcattaatgagagaaccaggcatatgttacaactagatcaaaggagaatttaaaaaacagaggcatttgttgatcagtaatatcaaaatagatttggaaatgaacaaactggcttttcccttaatggggaaatgagatcaattgaacttctacctgacagaatttgcgtaccttcagtcaataattattttgcattgctatcagttatctataatttactgatttgtaaaatagtgtaaaggcaatgaaaggtgcagagtaacatagagtcagaatcagataacctgcaagggtgtgcttttaaaaacacagagctctacattgaagcacaagttatttcctaagaggcttgctaaattccagatggctaggatatttctagctatgggtggtttaaatatagaggcagatcagaaataattttgtgaaggtttagtgcatggtgggaaaattaaagagaaatgataccaccggcagagggcagtaatgaaataacagttttttgaagacaaaggaaatattgattgttgataattctgggataattctgttgaccttaacttgagttttacttttcaaatattgccgtactaggttcctttcagccagctgctttgccaatacctggaacgtgccagaataaggctcattttggttttgttttaggctttgttaatgaagtaaataaataaaatattctaacctggttttagttaagtaaataatgtgttctaacttctaagtactttttctgtatggcagatatttgagtatctgttgtagattaggtgttgctttaggtattaaggagatatatgtgtgtgtgtatctatctgtctgtctatctatctatctatctatctatctatctatctatctatctatctatctatctctccctccgtactgtatagatagatagatacatctccttatctatgatgagttatgatatgatctatgatagatggatatatgtagctatctacacacatgagagtttccaagcctcaccaaagtaacattctgttgattatgatattttaattttagtagttaatttattctattttttatgagaataaaacacttaatatagtattatttaaactatcagaagtctttctttgaatgtaataatgacatcatctaatttccactaaaagataaaaatctaaaatattgtgaaaatatctatctggaaatatatgatagccaaagttatataaaacttagttatagataaataataaaaatgcaaatacaccataggaaaatggccaaaggggacaaaagtaagaagcacaaatgatcaaaacacataaaaaattcaaattaacaagtagtcaaagaaatcgacattaaaacactaaggaacatttttttacctgtgaaattgataaatgtttactaaatgataaaacaaagctgaggaatttataatgagatgagtatgtccataaaagtctggcaggtgtatgaattagtacagagcctctaaaaatcaatttagcgaagtttatgaagaatttaagagtggttatcttttataatcccacttctaaaactatatcccaagtgagtaatccaagatgcgtttgaaagacttatatttgaagtataagggtatttatgtcagcttatttatgataatcacaaattatctttgttgtctaatagtaggcaaattacctaataaatcagtatattcctagaaggatattgatgtcaaaggaaaatgttcatattaaaagcttgtgtgaaaaaataaaagtataaacctacatataagattccagttttgtaaaatttcttcagtatatacatatgaatatatgcatgcatgtatatttatgtattcataaaaattacttttaatagtgattaccagtgcttaatgggattatgggtcaactcccagtcatacttttactcttctatgttttttgatattttctgcaaacataatagatattaaaaaatatttcttctccagaattacttattttcaaccaattatttagagagaattatggttatttggctcacacatagcattcttgcacacttaattcttatataacctttaataatgaaatacaatttcatttttaaagaatatatataccctgaaagtcacagagtctatagctcaatttttgaagatgctttgaggggcaagtgggaggggtctcaatatgtatgtgaataaaataccaaattttaagatatcataatttacatttctctttgaatagttttagtctagtgactaaaatatttaaaataactttatttttctgataattgttttctaattataaataaaatgtgtcttctttttgatgtatagttggaattttatcattagtcaactatcaggtatagtacaaatcaaaagaaccttcaatgacttatgatccagcatccagatattcacttgaaaaatagctctttgactatttgcatgtattttgacataggaacaaagatattgattgtcatagttaaactccaagttcagctgggtgtggtagttcatgcctataatctcagcactttgggaggctgaggtggaaggatcacttgagtccaggagtttgagaccagcctggacaacatagtgagacccctgcctctatgaatgaatgaatgaatgaatgaatgaatgaaagaaggaaggaaggaaggaaagaaagaaagaaaaagaaagaaagaaagggaaatcagggtcaactcatgaaatctttttttgttaaaccttcgataaagttgaaattttccaaattcttaatggaaactaatggaagttaatactctagataatgatcttacaggaagagttaagaacaatagtaaatttgaataatatctaaaatcatctaacttcaggtaaaataggtttagttaggagaatgctatatatacttctgtagagacactatcaaagtatttttcagtgtatctataataggacattagagtttgatgatattgccgttcttttttgtttttaccctcacttccagtcagttcctgtcttcttgatttgggctttatttagaattattagctatggttagtgttactttgggctcaagttgagaactagaaagaacatttccttgagatagctggatgagttgacagagatacaggaaatgtcaagaatctaaagacgattcatttctatgtgggcatgagaatttctgaaataatgagctgtagttgacgaaaagcaagcagagcttagtgaataatcttttcaggaagaaagaaggtgaccaggccaaaatgtatcacctctgcagggtgataaatagccactgaatggagaggaaagagtgaaggaggaacaggcaatattaaagtaagttgctggtaagtttttaaaaaatcagtttgatattgttgaatcattaatcatcagttatcctaaaaacaagatttattataatgacttatcctgtgtagaaaaatacatctattttgagtgggagactttcaagatcatttctagtccagaagaaaagaaaaggcaaacattttatttgggcaagtgtcattagagttaagcatctagtgagtggaggaggtaagactgactcttgttgtctggagttctttttattatgtatattactttaaatggccattttcaggtgaccatgtagttacctgtattcattcaacacatattttcttggtgctggaaccttatgatataaagatgaacgagacccttttatctcttattaatgagcttatatgtagttcattgatggagacgtacaggtaagtagacatttaaaatgtagtttattgtggcactattcacaatagcaaagacttggaaccaacccaaatgtccatcaatgatagactggattaagaaaatgtggcacatatacaccatggaatactatgcagccatagaaaatgatgaattcatgtcctttgtggggacatggatgaagctggaaaccatcattctcagcaaactaacgcaagaacaaaaaaccaaacactgcatgttctcactcataggtgggaattgaacgatgagaacacttggacacaggaaggggaacatcacacactggggcctgtcatggggtgcggggagagggaagggatagcattaggagatatacctaatgtaaatgacgagttaatgggtgcagcacaccaacatggcacatgtatacatatgtaacaaacctgcacgttgtacacatgtaccctagaacttaaagtataataataaaaaaaaaaaagaaaaaaaaggtagttcaaggaatgccacaaaacaaggtattatgaattcacattgaaagaaatccttaacccagtctttctgacttggaaaaggattcctggaataagtcatgtctaagatgagtccttaattaagggttggagaagaaacaattggtcaagtttggctaaactgtaaataatttctgtggatttgaagatttgaatgggatgggatcaatggtaatagtttgtgcctgataagataagaaagctccctcagattaaaacgggccttgaaagtcattttaaagggtttggactgagtgccaaaggaaatagttaaaaggctttttttatatttatgctttagaaactagcataggcagtagtgtggatgaggataaatgacaggaggccatgagaaaagttaggaatatgttgcagtgaaaaaatgctaatgtcaatggagagaattacacagatttgtggaatattaatgggttggaattacaggaggtgattaattgaatatgttggccaaaagaaagagcacagtaggcaagcacccaggatgtggatttgaagagctgggtggacaataaaatgccttttactgaaatgaggaacaaagaaacaagaaccaagttttctttagggtaatagaagcaatagatgtaataatactaatagttctttctacgtgccaggaattattctaagcattttacagagaacataggcagtttgaataaagaactcatattcttcaccattacgtgaaacagcacaggctatggagatttcagactctagataatttatgattcaattcattgaattctatttactttaatttattggctgctagctgcattctagaggctggtatagaaagttactcagtacagggccctggtcaagtagtctatatacacatacaactaattctaatttgactttcacaaatgatataattgattgggagagaagttctgctatccaaaaatagaggaaaaagagattaatttgaattgaagaagggaggactgaatgatattagaaagatctctcaaggaaggattgatatttaagccttgagtgataaaggattgcacatgagtggaaaattcttattttagcattgcaaatattttcaattagcttacattgttttcttttaaatggtaattattattggatgaagacaatattcccataaaagtaaaaaatatataattgttgttaaaaagtgtttagtacatatttgtggtaaggtaatttttcctctacagtatttcagaatattcagataagtataattaggaatcatatttaaaaattttaaaagattgtagaatataagattggattgttattgctgctttgttttctaagacaaatttttaaaatttggatgttgggattattagatttaatctaatttatgtgggtaagcttggagttaattattaagtagaacttgatttttagccttagaataacaaatgcagaagtgaagaaaacttttaattggatttgttgttaacaaagcatggcataagtatgcctcagccagcctgtgaaagggatgacttaacacaactgttgatgcatttagagtgaaacatctttatcaagttaatataagaagcagtcatgccctacttgaattactcatttataatagctgaacagcagcctgcatgtggactttgaaatcctgggaaaataagatgcctgcatacatccaaatgttgaaagcttttacccttcagcagctggaaaatgttgagctcttttgtcatctactaggtttttggccctcagggagatgtgatcaatttaattactgaccagctttatctattacttttaatgattatagtcgctgaagtaagcctctgcagtttgtagctgaaaagatcatgtttagatattatgttatttaaaatctataaaagttaaacacatggacctagatgtttctactttgctcaggtttatcccatatattgggatcactaaaaatagcaaataatttagatatcataaaaaataatttatccaccttaaatggaatctaaaaggggcacacaatataccccatatattgcagttcttgggtaaattttatatgttatatctatttttgtgcaactgtttgtaactttcctaagatacagacagtggtttattttgaatcagaactacttataaacacacaatgcaactaattatttgtgcttcttatttagcttcttttcactatctttttgatgactggtccaaaggggatttttagaaaatagcatggagtgaagactatactttcagggatcatttctatagtttgttactagagaagtttctctgaacgtgtaaagcaccatttaaagttcatatggagccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatacctacaactatctgatctttgacaaacctgagaaaaacaagcaatggggaaaggattccctatttaataaatggtgctgggaaaactggctagccatatgtaggaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacgaagggctaatatccagaatctacaatgaactcaaacaaatttacaagaaaaaaacaaacaaccccatcaaaaagcgggtggacatgaacagacacttctcaaaagaagacatttatgcagccaaaaaatacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaaaacacatgcacacatatgtttattgcggcattattcacaatagcaaagacttggaaccaacccaaatgtccaacaatgatagactggattaagaaaatatggcacatatacatcatggaatactatgcagccataaaaaatgatgatttcatgtcctttgtagggacatggatgaaattggaaaccatcattctcagtaaactatcacaagaacaaaaaaccaaacaccgcatattctcactcataggtgggaattgaacaatgagatcacatggacacaggaaggggaatatcacactctggggactgtggtggggtggggggaggggggagagatagcattgggagatatacctaatgctagatgacgagttagtgggtgcagcgcaccagcatggcacatgtatacatatgtaactaacctgcacaatgtgcacatgtaccctaaaacttaaagtataataaaaataaaataaaataaaataaaaataaaaaaagaaaatagcatggagtgatatggcatagctaagacaagatccctgttatatgaaggaagaaatgtgtctgtaacattaaagctgttactctggaattctaattctggatcttaatcttggtgtaaatcacttgagctcaatttgattgtttcttaatctgttaaatggttgcaatgccagatactgaatactgttgtgttgtccattgcataaagacacccttttaaagaggtcaccattcatgttgcaaactaagttaatttgtttattattattgctgttctcacaaattggtgtattatgacagtattctacagatcgaagtaaaaataaggatggcatcatgtggctggtggtggctgtggatgacattgatgatcctatgtttgactagtttctcctttttagttgatgtgttaaaaatatttgttggtattagaaaatgtaagagcttatcttcattgacaaacatttgatcatatatgtagatgcattatgctagtgacatactgagattttacagataaaataagcagtagaaaacagttagggagatatattggaaattaatttaaaaattgtctcttggtactaggtgataaaatgtcctaaaatttcaaaataaaaaagaagttttacatcattaatatgtatgatattttacttatataataactttatatacaggttaatgatacatctataaacagcctaaaggaaaaaagattaatgaaataagtatcttttgaaagaggttaagtaatggattttatgatcagaagggacttgttctaaagttgacagaagaatctaaagtggtcagaaactgtgttcaaataaaagctacagaacatatatgtatgtatgaaaactccttgacttatgatgttacagcttgataaatgctttgtaaatagaaaatattaagtagaaaatgtatttgatacatctaacctattgaacactatagcttagcctggactaccttaaatattctcagaacacttacattggccttcagttgggcaaaatcatctagcaacacagtgcactgtagagtacagattgtttacccttgtgatcactttctgccgctgcccagcatcacaagagagtagcatactgtatatcgctagtccaggaaaagatcaaaatcaaaatttgaagtagaaggccaggcgcaatggctcatccctataatcccagcactttggaggggaggtataaggattgcttgagcccaggaatttgaggccaacctaaacaacatagagagactctgtctctacaaagaataaatttaaaaaaattagctgggcatggtagcatgcccctgtagtcccagctacttgggaggctgagatggaaggagcacttgaactcaggaggtcaaggctgcagtgagctctgtttgcatcactccactccatcctgggcaatacagtgagaccctatctcaaaaaaacaaaaggaagtatagttcctatagtttctattgactgcatatggcttttgcaccatcataaagttgaaaaattttatgctgaaccattgtaagttggggaccatctgtacattatgtaaatattaattctaaaaatgagtttggagtttattcatttgccttttttgttacccttttaattatctatccaaatattacctgtgtacatataatttctgtgccagatcagggcaaggatgtgaagagcatttattgttctagaagctataaatttttaataaactttttttcactggaaataaggataatatctatgtaattaatgatagaaaaatattttggaagtactacatatttatatataggtaggacatatgctagattcttatttctaatattactacaatatgccattttttctaatacataaaatggaaacctggactgaatgtaaatttgaatgaatttttctagtatagttaaatctttctttactctaaaaacaagcaaaaccttatctgtgcatattgtgaatgcatatttatgcaaggatggtaattgctgtggtctgaatgtgtctcctaaaattcctatgttaaaacttaatcaccaatgtgataatattaggaagtgggtcctttatgaggtaattaagtcacaagggttggcccttgtgaatggaattagtgaccttataaaagaggttgaaggaagcactcatctttccttattgtccttctgccacgtgaggacatagctttcaggtctccatcttggaaacagagaccaggacttcaccagatagtaaacctgcaggcatcttgatcttggactccctaggttccagaactgtgagaaataaagttctaatatttatagattacacagtcttgagtattttgtcatagcagcacaaatgaactagaagagtgataaacaccaatttaagtataaatatttgtgtatttatatatatatatatgagggggagggattttttgaagacatctcgtgtactcatgtgaaatacatttctcaacaaattcagaaaatttgagactttagatgctaaaatgtaaaatgaaagtaaggtttttatagggtttatttgcttattgatctgaaattctgatgacaaaacttagtttagatttttctttttttcttatattgaaaccaagtgaaagattttgtttgaaattggctattgtttcattttaggcagccctttttgagatgcgcataggagctctgcattggtttttcactagctgttagaactttgttctttttaatgtcaacctcttaacagcctaaagtattaatccttgtaatcacatttgtaactttatattttggtgaaattaggaaacttgtcagctattttcttattaaaataatgttttttaaataattgttatatgaatcaactaggtctaagggtttgtgtaataagacatcattacttcatattgagtaatatgtaaaatcatgtgctaattcttttcttccttttttctttttacaaaatgaaaatgtcattttactgttctgataaatgcataatgcaaaaattcccatggaaagaaaaatattaagaagtgttagcaatctgaaactatgtgctagtggttagctagtgtttatgttttggtgaacatcgttttagacaattttctatgcaacgttagataaacatagaattgtacacgtatgattttgtacccatacattttcttctgtacctgcctttccactcaacagtgttttaaagccatctttctatgccactaaatacagtttttcttcctcattttaagtgacattgtagcatcctgttgttggctgtcttgaaattaattaatgtcttcttgctgggtaatacattattggtggatatttggatattgggatttttctaattttttaccaatagaaagaagggctgagttttgttatattcatctttttgagcttgcctgacagtaactttattaaaggcatgttttggtgcattattttgcccttgataaacattgtcaaaagtttattcttcaaatattagtgctaaataagtttaactacaaattttatgatgcagtggctaacttttcagagagttccagtgagtctttcttgtctatatcataattaatatacttttgtcggccgggtgcggtggcttgcgcctgtaatcccagcactttgcgaggccgaggtgggtggatcatctgaggtcaggagttcgagaccagcctgaccaatatggagaaaccccgtctctactaaaaacacaaaattaactgggtgtggtagcacatgcctgtaatcccagctacttaggaaggctgaggcaggagaatcacttgaacctgggaggcagaggttccggtgagccgagatggtgtcactgcactccagcctgggcaacaagagtgaaacttggtctcaaaataaataaattaattaattaaataaaataaaaataaaaaagatatacttttgtctgatagaaagattatcttggagatcgtcaagatgtcatataaataattcactcaatgacatgtaagtattttttcctagaaggttttaatgctttaattctactctcaagtatcttgtaaatcatttctttagtttcattatcccaacactgtttaagagaaagaggttagactttggagtcaggcaaacctgttttcagatacctatttgctttaactttcttcatgactttgggagttaattgtcttcccaagtgttattttttcatttgtaaaatttatttaaaaaattggcccccttacagggattgtttttaggattaaaggtagggaatatgaagagctagcacaaggccaaggagtgagtggcaggtgctcagaaagcagcacctctgctttgcagggatggtttttgatggtcagaaacactcttagagttagatgtgatctggagtttcagtcctgccacattccaaagagcgatcttggccaagttattccaccacttttttttttttttttttttttttttgagacagagtttcactcttgttgcccaggctggagtgcaatggcactatcttggctcactgcaacctcagcctcctgggttcaagcgattctcctgcctcagcctcctgagtagctgggattacaggcccccaccactacacccggctaattttttgtatttttagtagagacggggtttcaccatgttggccagtctggtcttgaactccttacctcaggtaatccactgcctcaggctcccaaagtgctggaattacaggtgtgagccactgtacccggccaagttattccaccgctttacgttttaatttcttcattaaaaagaatcagcacttaagttttgtaaggcttaagttaaattatgcacataaagtatgtagtgcagttttttggcaaatatttcttgtgttactactgatatcatttttaccagcagattaactccacatttaacatgaatttatattttagtttttttattgttgcaccatgctaaacttacagattttttttttttcctgtccatccttacattttaaaagtaaatttggccaggcacggtggctcatgcctgtaatcccagcactttgggagtctgaggcgggcagatcatgaggtcaggagttcgagaccagcttggccaacatggtgaaacccagtctctactaaaaatacaaaaattagctgagcgtggtggtgggcctctgtaattccagctacttgggaggctgaggcaggagaattgtttgaacctgggaggtggaggttgcagtgagccgtgatcgtgccattgctctccagccttagtgacagggcgaaactccatctcaacaacaaaaacaacaacaaagtaaatttatacttaacataaactgagtagcttgccttgttgtgttttgttatatgatcatataactactacctgattgtctaatgggaacatgtgccaaaagttctgtttacaagatcaaaccagtgtgtttctaaatctttgagtctgcctctctctaatcctttcctttgatattcttgcccatagctgtcttatttagacttatttaagcaaacttgtgtgtgtgtttgtgtgtacaccaggggtgagcacaacattttgaggttttcatatgtcctcatttgggaagccatctattgtctgcaatccccaaataccacttgggtcactttatctctgctttttgctatgttaatagcatatttggcattaatgtgcactttgataaacagcaggttacttattctaaataattttatgttagcttttgaaagcaaatagttaaaagaatatatatttctcaataaagcattggttgtaaatactgcaacagtatgcaattgcaacatggtaacattggtatgttgggtgtgttttctttttatatagacttctcaaccagcgagtagtagcttaaagttgttgctgtattccaagtcagtttgtaaccaaccctaatatgtgtttggctaagagtacaggtttccacgtccttacttgtttatccctttcagcctaggtatcatttttgaaggaggttttctgggagatatgatgaatcatcctgcattctcttcccagttccttttctttagttatccattcaagagagattgtctgcattactcttacagagctgggttttagcctcagctatatcatttattaggtgtttgtcattaatgtgctgctgtgtacctcaagtatcccactgtgaaataggaatattaataagtgttagcctacctcatagtgttattgggaaaaaatcagattatttaatatagtttttttttttttttttttggtaaaccaagttctgcacacataataaaaatattaacttttggcccggcatggtggcgtgtgcctgtaatcccagcactttggtgggtggctcgcttgagccccaggaatttgagaccagcttgggcaacatggtgaaaccccatctctacaaaaaaataccaaaattagttgggtgtggtgtgcatgcctgaagtcccagctacttggaaggctgacgtggaaggatcacttgagcctgagaggtcgaggctgcagtgagccatgagcatgcaattgcaccccagtctggataacagagcaagaccttgtttcaaaaaaaaaattttttttaacttttatttagggctcgttagtatcaggcactcttttaagagtcccatcttgttttctttctttctttttttttttttgactgagttttgctcttgttgcgtaggctacagtttaatggcgcaatctcggctcaccgcaacctccaccttccaggttcaagcaattctcctgccttagcctcccgagtagctgggattacaggcatgcaccaccactcccagctaatttatttttagtagagatggggtttctccatgttggtcaggctggtctccaactcctgacctcaggtgatctgcctgcctcggcctcccaaagtgctgggattacaggcgtgagccactgcacccagccaagagtcccatcttgttttatcttcgtagtaacttaatggaacgggagcttattcagtaaaaagttgaaagcagaaattgtagatgatatatcaaaggtatttatgtaagataaggcagaacttagagtccttgtttccatctaaatccaaagacaaattaatggatatacgtttgtgttttatgtttaaataaaatggttttgtttttgttttttaaatacagatggggtctcattatgttgcccaacctggtctcaaactcttgggctcaagagatccgtctgccttggcctccccaaatgctgggataacaggtgtgagccactgcacccaggctaaataaaatgtttagactgtaaatgtattctttcttgtgatttcttactttaactaatttttttcacccttcaactgaagcagtactcatagtgtcaaataagagagctctggagctccttatttcaatgatctctaatgggactcagtctaagaaaggaggggcatcagattttctgctgcacgaggctgttctgaagtcattattctagggtttgaagatacttacttttctggcccttacttgactcctccggccatagctccaaactgtctagccagattaccagggttggcttcagatgaacactttagtattttgatgctaaataccagtgataactataaatatttctcaacttatgatgtgtgttttgttttaataaatctactgtaagttggaaatactgtaagttgacaatgcatttaatatgcctaacctactgaacatcagcttggcttagcctaccttaaacattctcagaacacttaccttagcctattattgggcaaaatcttctaacacaaagcctattttatgatacagtattgaatatctcatgcaatttattgaatactctattgatttttttttttattaaagacagagtttcactctgtcacccaggctggagtgcagtggcaagatcttggctcactgcaacctccatctcctaggttcaagcaattctcctgcctcagcctgccaggtggctggcattacagggtatgccaccacacccagctgatttttatattttttgtagagatggggttttgccatgttggccatgctggtcttgaactcctgacctcaggtgatccacctgccttggcctcccaaaatgctgggattacaggcgtgagcctcagtgcctggcctgaatactctattgaaagtaaaaaacagaatggctccatgggcacgtgaagtacggtttctattgaacgcatattgctttagcaccatcctagagtcaaaaaatcctaagttgaaccaacctaagttggggaccatctgtgtaatatgatgaaaatgtctgtctttgttgtttaaaactagtttagaagggccgggtgtggtggctcaccgcctgtaatcccagcactttgggaggccaaggcgggcggatcatgaggtcaggagattgaaaccatcctggctaacacggtgaaaccccttctctactaaaaatacacaaaattagctgggcgtggtagaatgctcctgtaatcccagctacttgggaggctgaggcaggagaatcgcttgaacctgggaggtggaggttgcagtgagccaagattgcgccactgcactcagcctgtctcaaaaaaaaaaaaaaaaaaaaaggaaaacaactagttgagaaggagaactgaaacattgttttgcaaaagtgttgctgtgaacaatgggcgctcatgtcctctatggtgcagattccccttgattcatagagtgctttatctttgtaactagctatattttttctatagtaataccaccattaaaggaattaaagtgacattaagaatgaagaatgttttaaatcttttaaagtcttgtgcattctagattcagtaaaattccagtagtaacaagattttgaagcaactgcagaaactctgcacagccccacgtgtaatgtggctttagaatatgtgtttcttcgcctgtagtctcagctactccagaggctaagacaggagaattgcttgaacctgggaggtggaggctgtagtgagctgagattgcgccactgcactccagcgtgggtgagacagagtgagactccgtctcaaaaaaaaaaaaaaaaaaaaagaatatatgtttctttcttgtgattgtgtgttgctgtggttcagtgattgtgtattgattgtggctcagtgcctggcaaaacatttgtactacagatctctcagtaaggtgatctatttttccatttatatgcatatttatttatgttaccatcagtagttctccatagcttcttttgtagttctccatagcttaattttgacgttcacataatcctgatttcttagagtaatatcatttatgacagattttatagtatagtggttaaaaatatgggctttataagcagactgatttttgtctccactgcatgtgatttttgtgatcatgggctagtttgaatctttggtaactttgttttcttattggtgaaatgggtataattatagtatctgtctcagggttgtcatgaagattaatgaattcatgtaattaaagcatttagaataagatttggcacatcaaaatagtagttattattataatggctcgagtttttggttggaactcaaaaaacaaataagatagtctttgttttctgttttatcagaaagcacttccctatgagaggataatcagggattaggaaagaaaattttaaagaaattcatattttctattggcagatgtgattgctttaaaagaaaatcatgttttgttttttttttcatggaataaggcattgaatccagtggctaaaaggaattgatattgtgtacccagtcttggataatgccagtcaattctgtaaagatgaaatattaaatttgtgctattctgtaacattggtagtcccaacatttttcctggactgtcaatgaatttttgattatctgtgaacattgtctcttggataattcatgagcacattagacccagcacttccaggttaattttgccattttactccaagcctacaccttgacctttattctctgtacaatgaatggtagtattatcagtcaatccattcataatcctagggatcatcctaaacgtttctgttctctcattttccatcttttatatctgggcaatcaacaaattctgagacttttctataaaccttctctgtaagacagatgtgatctttttgctccctttcaaaatatgttttactgcccccctcccaatgttttctgtataaagttcagacttcttagcaggacaacatgagcctcatattgtgtggtattttcatgtgcatatcatcctcccatcatgtggaacgatttgcaattccatgaaaatgccattctcttaccattttcattagtgtaaacaatttttagtgcatagaaagctccctaattttcttcttctcttactttattatctccattttattcaactcaatcattacctcattgaaaatttatttacaaattcgcttcccaagacaggttaggtgtccattgtattttgcttctcctttacattctgtaacttcatatgaatacagttggctctttgtatcaatgcattccacatttgtgggttcaaccaatggtggatcaaaaatgttcaggaaaaaacaaccaataaaaataataactagtaaaaataatacaaataaaaaccaatacagtataataactgtttacatgacatttacattgtactaggtattataaaacccagagattatttcaagtatatgggaggatgtgtgtaggttatatgcaaatgcaacaccattttttataagggatttgagtatcagcagattttgatatccactggggctgctagacccaatcccccagatactgagggattactgtgtctttattaaagcacttatcaaacaatatgatcattagttttttatcagtgtctcccactaaattatgaacagttcaaatacagggcctatttatctctaagtgcttaatgtttacttttaggcatatggttggtgttgagtaaaagtgttttgaattagtaaaagattttgaactaaaaatctttggtaaaagttacatgataaacctgtctttaatgggagatgatgggaattaattgctaatagctattatcaagaggcaaaaataaagaaatggactgacatccaggcttttacccgtttgacattagccactctgctagtttcttcctcttactggtttatcactttggtgttaactatttggtcttgtctgctttcttgttagtactaatcaactctgtcaaaaattgcctgtttctcacttaacctagttatatcaccactgtatttttaatactttttgttaatgctgtttatttttatcagatgactattaagacaaaagttttcgcttatgtttggcgcattggttgtaataaatgtgaagtggattctttaagtcaatttaagggcatctggcaactaggaagactaatccttggagtgaattaagggcatgaagacaaggacctgtcatttataggataagaggtcagtgaactatgtgggcaggataaatatatcaattagggagtttccctgagagtgggcaagaggctaagaatctgagtcaataggtcaggaatatgtagacagtaggtaaaagacatatctagagtgccagatggactagtgaggtagaggttatatgttttcattatattttaggggtatttgactattaagtgagaaaataatgctgtttgggggaagctggccttggaaaatagtgcattcccattagaagttgatagaatatatacgtagtggaacatcttggtcctggtagtgggatactaattatgtttattgtattaaccctatttgattcaggattgtttttgcctacaaataacttagttcaaactaggtcttaacaaaatgcaagagactaatgttcatatttatttagtgaataaattggagtagttttctgtgctattggtggaacaaattaaactttcactggttgagggcttacacctacacagtatagtgtgggaggatcatcagccagtttgtcttattgttttattggcagcagaaaactcttaaactgtgttttcccatggaagaggcatctcacttgaaatctcagaacttatactaaaaaatttatgaagtgggatgatagtgaattacagaagagtcatcaaagaaagtatgtgattaactgacagtttattgacttcatcctcagggccaatttaaagaaaagtgaggcagagttagatttcaagctatgctttgaatgctgtgtgaggtctttttgagctttttggttaagctgtaattaattaactcgattaaacaagtattactacatgaataaaagtacacacacggatttttcaaagaggtaataatgggttcactgctgataaaactgtggatctgagtttggttaacattaaagagcactccaaaattcacctgttgttttaatctcttgatagagaatggtaataattagggttctatatatgtattctatatcttttaatatatgtctatctctgtatgtttgtatatatttatttgacttcagagaaaatagcattaaggtttccttttccttttcaattatattttaaaatgttaacttttaagttagcttgaccctttgaaaaattgttaaaaattactgtcctcaggctttacaacttgtacagttatataatttcactcacagatatgaaagcaaagaaatattttaaagtcttctattttcaaatgcttcctaagaaagatgcttccagtttatgaacaataaaatgaaacttcataggtagaacattttttttaattcctgaatattgagatactgagtcccttttggtttgttccctaaatataatttcatttagttatttttgttaattctgaaagcagcaacagtatatgctatttcactggttattttcatatctgattttgtttatttgggtcttatctcttttttgattattacaagcaaccgaccatcgattttgtttatctgttaaaaaccttttccttttgttgatccctttttcattgaagtttctatttcatttagttctgctctgacttttattatttcatgtcatctcctaattttgggtttggtttgttcttgcttttctaattccttgaggtacaacattagatatttgaaatctttctacttttttgatgtagatatttattgctgcaaatttcctaactagcactgcttttgctgtattccctaggttttggtatgttgtgttttcattttcatttgtttcaagaaactttctaatttcctccttaatttcttcattgacccaatggtcattcaggagcattttgtttaatttctgtatacttgcacagtttccaaagtttctgttattgatttctagttttatcccattgtggcctgagaagatacttgatataattttgattttttaaaatttcgtttagactttttttttgttttattttttatttttaattttttttttaattacacttcaagttttagggaacatgtgcacaacgtgcaggttagttacatatgtatacatgcaccacgtcggtgtgctgcacccattaactcgtcatttacattaggtatatctcctaatgctatctctcccctctcccccaaccccatgacaggccctagtatgtgatgttccccttcctgtgtccaagtgttctcattgttcaattcccacctatgagtgagaacatgcggtgtttggttttttgtccttgcgatagtttgctgcgaatgatggtttccagcttcatccatgtccctacaaaggacatgaactcatccttttttatggctgcataggattccatggtgtatatgtgccacattttcttaatccagtctatcattgttggacatttgggttggttccaagtctttgctattgtgaatagtgccgcaataaacatacgtgtgcatgtgtctttatagcagcatgatttataatcctttgggtgtatccccagtaatgggatggctgggtcaaatggtaatttctagttctagatccctgaggaatcgccacactgtcttccacaatggttgaactagtttacagtgccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtctgtgggctgcatacgtgtcttcttttgagaagtgtctgttcatatccttcacccacattttgatggagttgtttgtttttttcttgtaaatttgtttgaattcattgtagattctggatattagccctttgtcagatgagtagattgcaaaaattttctcccattctgtaggttgcctgtttactctgatggtagtttcttttgctgtgcagaagctctttagtttagttagatcccatttgtcaattttggcttttgttgccattgcttttggagttttagatatgaagtcattgcccatgcctgtgtcctgaatggtattgcttaggttttcttctagggtttttatggttttaggtctaacatgtaagtctttaatccatcgtgaattaatttttgtataaggtgtaaggaagggatccagtttcagctttctacatatggctagccagttttcccaccaccatttattaaatagggaatcctttccccattgcttgttttcatcaggtttgtcaaagatcatatggttgtagatgtgtggtattatttctgagggctctgttctgttccattggtctatatctctgttttggtaccagtaccatgttgttttggttactatagccttctagtatagtttgtagtcacatagtgtgatgcctccagctttgttctttttgccaaggaccgtcttggcaatgcgggcccttttttggtaccatatgaactttaaagtagttttttccaattctatggagaaagtcatccgtagcttgatgggggtggcattgaatctataaattaccgtggccagtatggccattttcatgatattgattcttcctatccatgaacatggaaagttcttccatttgtttgtgtcatcttttattttgttgagcagtggtttgtagttctccttgaagagatccttcacatccgttgtaagatggattcctaggtattttattctctttgaagaaattgtgagtgggagttcactcatgatttggctctctgtttgtctgttattggtgtataagaatgcttgtgatttttgtacattcattttgtatcctgagactttgctgaagttgcttatcagcttaaggagattttgggctgagacgatggggttttctaaatatacaatcatgtcatctgaaaacagggacagtttgacttcctcttttcctaattgaataccctttatttctttctcctgcctgattgccctggccagaacttccaacactatgttgaataggagtggtgagagagggcatccctgtcttgtgccggttttcaaagggaatgcttccagtttttgcccattcagtatgatattggctgtgcatttgtcataaatagctgttattattttgagatacgtcccatcaataccgaatttactgagaattttttttaagcatgaatgcctattgaattttgttaaaggccttttctgcatctattgagataatcatgtggtttttgtctttggttctgtttatatactggattatgtttattgatttgcgtatgttgaaccagccttgcatcccagggatgaagcccacttgatcatggtgtataagctttttgatgtgttgctggattcggtttgccagtattttattgaggatttttgcatcagtgttcatcagggatattggtctaaaattctctttttttgttgtgtctattccagtctttggtatcaggatgatgctggcctcataaaatgagttagggaggattccctctttttctattgattggaatagtttcagaaggaatggtaccagctcctccttgtacctctggtagaatttggctgtgaatccatttggttggtaggctattaattattgcctcaatttcagaacctgttattggtctattcagggcttcaacttcttcctgttttagtctttggagggtgtatgtgttgaggaatttatccatttcttctagattttctaatttatttgcgtagaggtgtttataatattctctgatggtagtttgtatttctgtgggatcggtggtgatatcccctttatcattttttattgtgtctatttgattcttctctcttttcttctttattagtcttgctttggtctatcaattttgttgatcttttcaaaaaaccaggtcctggattcgttgattttttgaagggtgttttgtgtctctatttccttcagttctgctctgattttagttatttcttgccttctggtagctcttgaatgtgtttgctcttgcttctctagttcttttaattgtgatgttacagtgttgattttagatctttcctgctttctcttgtgggcatttagtgctataaatttccctctacacactgcttcagatgtgtcccagagattctggtatgttgtgtcttttttctcattggtttcaaagaacatctttatttctgccttcatttcgttatatacccagtagtcattcaggagcaggttgttcagtttccatgtagttgagtggttctgagtgagtttctttatcccgagttctagtttgattgcactttggtctgagagacagtttgttataatttctgttcttttacatttgctgaggagtgctttacttccaactatgtggtcaattttggaataagtgtgctgtggtgctgagaagaatgtatattctgttgatttggggtagagagttctgtagatgtctattaagtccacttggtgcagagctgagttctggtcctggatatccttgttaactttctgtctcattgatctgtctaatgttgatagtggggtgttatagtctcccattattatagtgtgggagtctaagtctctttgtaggtctctaaggacttgctttatgaatctgtgtgctcctgtattgggtgcatatatgattagggtagtttgctcttcttgttgaattgatccctttaccattatgtaatggccttctttgtctcgattttgatctttgttggtttaaagtctgttttatcacaggctaggatttcaacccctgcctttttttattgtctgtttgcttggtagatcttcctccatccctttattttgagcctatgtgggtctctgcatgtgagatgggtctcctgaatacagcacactgatgggacttgactgtccaatttgccagtgtgtgtcttttaattggaacatttagcccatttacatttaaggttaatattgttatgtgtgaatttgatcctgtcattatgatgttagctggttattttgctcgttagttgatgcagtttcttcctagcctcgatggtctttacaatttggcatgtttttccagtggctgctaccagttgttcctttccatgtttattgcttccttcaggagctcttttagggcaggcctggtggtgacaaaatctctcagcatttgcttgtctgtaaagtgttttatttctccttcacttatcaagcttagtttggctgaatatgaaattctgggttgaaaattattttctttaagaatgttgaatattggcccccactctcttctggcttgtagaatttctgccaagagatcagctgttggtccgatgggcttccctttgtgggtaaccggacctttctctctggctgcccttaacattttttccttcatttcaactttggtgaatctgacaattatgtgtcttggagttgctcctcttgaggagtatctttgtggcgttctctgtatttcctgaatttgaatgttggcctgccttgctaggttggggaagttctccggataatatcttgcagattgttttctgacttggttccattctccccgtcactttcaagtacaccaatcagacatagatttggtcttttcacatagtcccatatttcttggaggctttgttcatttctttttactcttttttctgtaaacttctcttctcgcttcatttcattcatttgatcttcaatccctgatgccctttcttccagttgatcgaatcggctaaggaaggttgtgcatttgtcacgtagttctcgtgccatgtttgtcagctccatcaggtcatttaaggacttctctgcattggttattctagttagccattcatctaatcttttttcaaggttttcagcttctttgagatgggttcgaacttccttctttagctcggagaagtttgatcgtctgaagccttcttctctcaactcgtcaaagtcgttctccatccagctttgttccattgctggtgaggagctgcgttcctttggagggggagaagcgctctgatttttagaattttcagcttttctggtctgttttttctgcatctttgtggttttatctacctttggtctttgatgatggtgatgtacatatggggttttggtgtggatgtcctttctgtttgttagttttcctgctaacagtcaggaccttcagctgcaggtctattggagttttctggaggtccactccagaccctgtttgcctgggtatcagcagcggaggctgcagaacagcaaatgttgctgaaccacaaatgttgctgcctgatcgttcctctggaagcttcgtctcagaggggtagccggccctgtgaggtgtcagtctgcccttactggagggtgcctcccagttagggtactcaggggtcatggacccacttgagggggcagtctgtccattctcagatttcaaactctgtgctgggagaaccactactcacttcaaacctgtcagacagggatatttaagtctgcagaggtttctgctgccttctgtttgcctatgccctgtccccagaggtggagtctacagagtcacgcaggcttccttgaactttggtgggctccacccagttcaagcttcctggccgctttgtttacctactcatgcctcagcaatggtgggtgcccctcccccacccttgctgccatcttgcagatggatttcagactgctgtgctagcaatgagtgaggcttcgtgggcttgggaccctccaagccaggcacgggatataatctccttgtgtgccatttgctaagaccgttggaaaagtgtagtagtagggtgggagtgtcctgattttccaggtgccgtctgtcacatgttcctttgggtaggaaagggaattccctgaccctttgcgcttccctggtgaggcgatgccttgccctgctttggctcatgctcgttgggctgcacccactgtcctgcccccactgtccaacaagccccagtgagatgaacccggtacctcagttggaaatgcagaaatcacccgtcttctgcgtcgctcatgctgggagctgtagactggagctgttcctattcggccatcttggaaccacccccgagacttgttttgtgtcataacatgtgatctaccttggagaatgttccatgtgctgatgagaagaatgtatattctgtagctattgaatgaaatgttctgtaaatgtttgtaaggtccatttagtctaaagtacagcttaaatctggttatttcattgttaattttctgtctagatgatttgtctcatgctgagagtagggtattgaagtccccaactattattatattggagtgattgtcctcctacctcagcctctcaagtagctgggactacaggtgtgcatcactgtgcctggctaattttaaaattttttctagaggtggagtcttgctgttttgtccaggctggtgtgaaactcctggcctcatgcaatcctcctgccttggcctccgtaagtactgggattatgagcgagaaccactacagccagcttatctcccattttagagctaatgatatttgctttatatatctgggtgcttggtgttgggtgcatatatgtttagaattgttaaataatgtatcctcttgctgaactgatccccttattattatattatgaccttctttgtgtctttttactggttttgacttgaagtcttttttatctaatataagtatagctgttcctgctcttttcttgtttcaatttgcatggaatatctttttccatctttatgtgtctttacaggtgagatgagtttcttgtcggcagcatatagttagatcatgtttttttataatccatttagccagtccatattttttaagtgactgtttacattcaaggtttttaaaaatttatttttttgttttttgatggaatctctggcatcctgaatctggatatctaaatctcttgctaaacttcagaagttttcagctactatttcattaaatagctttattccttttgctttctctttccctctgggacactgaaaatgcaaatatctggttgcttgatgatggcctctgtgtcatgcaggctttgttaattgttttaaattctctctctctttttttttttttaactaactgggttatttcaaaagacctatcttcatgtgctggatttttttcttgtgcttcatttagtctattattgactctttcaagtatatttttaattttattcagcagattttttatttccagaatttccatttggttcttttgtttatcctttggtaaatgtctcattcaaatcttggtgttttttttttaaatttctttgcatcatttatgtgtgttctcttatatctcaatgagcttctttataatcaatattctgaattatttccccaggattttgtaaatttctttttttttttttgagacggagtcttgctctgttgcccaggctggagtgcagtggtgtgatctctgttagctgcaagctccgcctcccgggttcatgccattctcctgcctcagcctcccgagtagctaggactacgggcgcctgccaccgcgcccggttaatttttttgtattggaatttgttgcttgagaattattgtgttctttgggaggtgtcatatttctttgccttttgtatgtgtgtttcttttgttcttatgttgatatctgcccattggtagaacttttgctccttccagttttttgaatttgtttgcataggggaaggcttttacctgaagatgtatctgtcatcttggttgggttagggaactttggtgttgattctgggtgcattatatggtggttttctggtgggatgcataggttgggctagctgtggccctggtgctctggaaggcagggttgctttcagtgtcagtggtgtaggcttgcaactggagaatgcctgctttggccccaggtgttggatgtgagtggggtagcctgtccttagggtgcttataaatgcacagttgctttgctacttggagtggcagggccactggcaatggcttttgctttgggcctaatggtggcaaccagccttagtggcagcggagggcagggaatgtcagtgggaatatagggatatggagatgtaggggctttttggccccaggttatgatgcaatctggtaggacctggattctcaaagtggtgctatgctgtagttgcttaggcctcagggcgtttgggacatggcataagcgccctctctgcagcaatgccattacatggtttcccagcacctccctatgttagtttcaggggcctgtgagggtcaaggttctctctcttcactagaattacagggatctgtgggggaaatgtggactgctggaagtttctcactgaccctttctcctcattgggatgcctctccagggtcgcagccggtcccagtcaagcatgctccctcacttctttttccttcctttcttgtgttttttctcactcttgttgaattccattgttctttcttagaggatctatttgaagagtgattatttactcactaggttcttctgtgtgaaggggatgagtaccagatgcctctagtcagccattgtgaagcccctgtcttgtggctttatttcttatttcctgttataccagtagctttgatgtgccatctttatgcaacaattttctaatgcacacaatttttggaatctttttttctgttttagtgatatatgaaataatgtcgaatcttgatattatgaaatacagaaacaaatgttcttactaaaagggaatgcatgtcagctataagaaatggtgtatggccttggggctgcttcacaggtggcatagaatggcctttgtaggaacatcttttgtggctcaaagttataatgagttcatctactgtattccttgctctgtttataagcaaaacctctttgaggttatcccagatctggcaagccaacatagtttcatatcttgcatgattatttagtgagtgggtatggatctgaactttagataaagtttttttttaaattatttgtacttatttatggggtacagtgtgatgtttcaatacatgtatacattgtgtaatgattaaatcagggtaattagcatatccatcacctcaaacacttgtcatttctttgtgatgacaacattgaaaatcttctcttctagctgttttgaagtatgcatacaaatcacaaggaatttataataatactatgcaattacagaatatagtctaataatgttactatttccaccattttaggttttcatatacatttgtgtgtctgtgcatgtgtgtgtagacataaaattcattttattttttaataaattatatgttaactgaaatcctctgggtaaccattccttcttctcagtcctcccttaatttgaagtgataacttctaaaaattcactatgctgtatggatgtgtatgtggatttaccttggtgtaataaaaatatcttgaataataataataaaaaaggcctagagaacctgaaccattcagttattatttgaacaatgggacttctctttgaattgagaggtactgaaggacttgttcatcattaatgaggatatgtaacaccatgtgaattactcaattcactgttttaaaaagttttgtcatgaatgtaggtgcatgcactaaggtactataaaatcacaagctaataggggatatctgttttatatatgtatatatatgtgtctgtgtgtgtttattccaactgtgtttttttggggggttaggaacattacggagcctttagaaagctttactttactgttaacatttaaaactttgacagtagttttcaaactcagatattaagtttatgccattgtgttcttgccctaatttactgcctttgcaaattaagcattctttttgaattttcctattggatggggtaatatttgagtgtatataaacaaccaaaagactattttgagtagcaagcattcataaaatggttgatgtgcttattcagttcatgagcatactgatattgaataacaatgctgtgcaattattctataaacaaatattcattgaatacttattgggtaatatggtatgtaaaagagagagattgatgaataaattccagtgataaaaatatagcctctttatggtacttccagtttatctattcctgtcctgtatggtagatctcattttaagacaaagaaaagaataaacaaatttaaattatggagtaaggaacttcaatataagaaaatatcctgtcattgagagtaacttacatggaattattattttttttatttttgggatggagtctcgctctgttacccaggctagagtgcagtggcatgatctcagttcactgcaacctccacctcctgggttcaagcgattctcctgcctcagcctcctgaatagctgggactacaggcacgcaccaccaagcctagcagctaatttttgtatttttattagagacggggtttcaccatgatggccaggctggtcttaaacttctgacctcgtgatccacctgcctcagcctcccaaagtgctgggattacaggtgtgagccaccacacccgccctacatgaatttctttatgagagaagggtcttattactgagattgttcaggtgtgttattttaaggccaaagaaagtctagttattgttaaaattaggggcataatgatgtaatgtagtagctctcaaccctatcaaatctaatgcccctttttgtaacatgtattttcttatgtccctttactatcttgaaataaaattcataattgtactttcctaagcttatgatttatgaataaatctatataatataatcttattaagggagaaataaaaggaaagtaatttataatagaagcacacatttttatatttagagcataactagatttgaagacatgatgaggtgttcaggtaagatactcagcctgccacatgtattgtaccgggacagttacaagtcttgcctgtgtatatgtgttgcatattggcaatgaatatcctcaaatgaaatagccgtgagtgatgtgattttctaaaatggtaaacatgtctttgtcaaatgcgaaatgatataaaattttctcctatattgctgagagatagatttctggagctttctgggtctattaaaagtgggtgaaaactgctttgtatttagatgtaaaattgagttagagtctaaattcaagtaattatctacaggtttttaacttacatggaaatctgcgagaatatttcaaaattgttcaggatgtacgactgttctttgttgtaaaaggattgttttggacattgaacaacttcattattcttggttgatggttaatgtcagtactgtctcctaatcattgtgacaaccagaaacactaatttttaaaaaatgcccccagagtgtggtgcaactttcatatagaattgactgtctgtagaacaaagagaaagtctacaggcaagagtcacagccttggatttgattcttgtttcttctacttaccgccttcttactgaggttttgatattggacaagataatcgaccttttacagtcttagtttcctgtctggaaaactgggatgataatatctcacagagttgttttatggattaaataatataacgtattttaggtacctgacatgtgcttcatgtgggatgggactatatctcttttatgcaccactttttcatcactagtagacacttaataaatacgtgcttactcttgttatttaactcctatatgtcacactctgttccaatattaaaagcatgagagggagtgattgtttataataggcaccatgtctatcatctgtgtctttcctttcaatgttttagaacttgtgaatcttagatgagaatgcttgttctttggaattgtggccttcagtttctaagaccttattaaatagaaatatgatggtttgctttacatttgaaagggatttatgggataaaggtccgccttaataagcacactaatttcccagcatcctgatattttttcttatttatttatattgttttgctaatgtcaggatggatagtgggggctatgtaaaagaccaaggacctcccttctcctgggaatcctaatctttgttacactaatgtttaaaatacaacatcagtaatttcttcctcttcttcaattttctttttactcttcctgtgattttggccaattaatgttgatatattttgttttcttagtaaatatttgctatctttgttgtgttacttgtttaactttaatcttagatgattcaaaccatttactaatgtaagatagaatagttacttttggcaattttaatgcaacttattactttgaaaatgttagaagggacccctagttttcctttgtaaattgtcgtttatttggcagagaaagcatttaatctgtaaatgctgctctgtgttttatagaatggtgaaccttacaagtattttatcccaaatagatgtttattaaaattttaacttaaatatttgatgattattatgaataagagtttttaaagcagtcactttgctttgatattcacagtgtgaacaagctaaaattttctacctactttctcttctttttattcttccaggtcacctttgtgtcaggcattgctactttggcaaacctgcttgcctttgacctttggttactcagttttagtttggttttgagccagtgtgtgctgaaatctttaaaactaaacaaatatttagcattcatttgatttaccaacaattgtctttttaaatattcagtcactccacaagaaaagtaactattgtcagttacagactgtagtaccaaagtcagattctggaacattctataaattactaaaaaactatcaggttataatttagattggctcagatgattttaggttgttttagaagctgacggtatttttactcacaattttctttcttttttctttttcttttttttttttttttttgagacagagtcttgctctgtcgcccaggctggagtgcagtggcgtgatttcagctcctgcagcctccgcctcccaggctcaagttattctcctgcctcagtctcctgagcagccaggattactggtggcaccaccacgcccagctaatttttgtatttttgtagagacggggtttcactgtgttggccaggctggtctcgacctcctgaccttaagtgattcacctgcctcagcctcccaaagtgttgggattacaggcatgagccgtcgtgcctggcctattccaaattttcgaatgtgcgtaaataattaatatagatgactatattagataagggacatgatatttttcctaataaaagtttaaaccatatttttatccattctctggtaattatttcttaaaaatgtaagtacatcagagaaatgatttattcatttccaaggctgagaaggtgaattttaaatttgtatttgaataacatttgtaattttactttacttgcacataacattatttttgcttagtaagcttatgaatcatttaattcctactatatgagaaatgtgttatgggatattgagaacattatgatttaaacgtaatacatatttagttgtcttcaatctcatttctatctctttggaaattaaaaggttccaaaactaagactgtgggaatgaaagtgagacttttgttttcttttagttgtatcaaaatgtaaattcctgggaaggctatttttgccttttgtgtcacaattattatgggaagccaaacaagctgctattaggtgttagagaatacaataaaattagacccttatttgctcactggccaaagaccacgtgttcctttagttgtatccttcagacgagcaaccttgttgtttgtgcccttgcttttgccttttcctttgtgtaattttgttcttttcctagagccatttgtaattgactgctgtttactaatagtttagagcaaaatagccacctttttcatggaacacttcagagccaactgcatcattaaaatgtacaaatgctctatgaaaatgtattcagttagtaagattaggctgaattgctagatttaggctttactagatcactaatattttcacttaattaaggctagtactttttttcctgagtagagattccgtttgttttcaagaactcaagaatatgctgctgctctttatgttgctctggaggcatgaatgtaattttgcacataaaaatattctacaaatctttccttaagagaataagggaggaaaataaaagtacatttttaatttgagggttggtcattagacttattttgcctataagattgacagcgtgactgctctttaaatgttgaattgggagtttaacatgaatgcaatccacatgtctgtgtcagagttttttgtatttttttcctggagatgggaagtataaacatgcaaagacttagctattgcaagaaccttattttggtttcttaccctgttctgttttgtatctgcatttgtaaaggaatttaaggaagttggaatggatgcaaagaaaaggaataatcatcattaggatagaaacaaagacacaaggaaaacaaagtatagttcttaaacacgattgtcttacttccttgataattctttctgatgtgtgttatcttctgcactctgtactaagtcacaaaagatgtacaaataatttttaccagaaaagtatagaacagaatcagaatgtgaattacttgctcaggacatagttatccaacattgtttaataattatcacaagagagccaaatactaggaacgaccgactgagatcttcagcctagagggtggggtagacaggcttggccagttcgtactctttcgttccttttgagcaagggaggaagtacaggtgaatgtgtttaatagatacgtgttcactgatgtatacacaacaaactttcactttgtttttcctttcatacctatcatgacactcttagctgcatgacggtaattacagagacagagatttcttagtaatcttctcagggagcatagagagttttaaacagtgactcttaggaaagttggtcattttctgtctcaacaaaggatagagggaaggaaactaacaattattgaacaatatttccagatactatggttgatgcttattttcttacatccttaaaaactcagaatagcccagtgaagaaagaactccttcatttttgcattgagaaaacaggcttaggcaatatattgcaatatggcttattaaccatctcaaagacacataactaataagtggcacaacaaggaattgaaccaatatgtttatatccccaaagctctctattatatcatgccatctcaaatcaagtgtctaaataattggaaatggaagtaatagagagtttagttaagtacaacttagataggctattatctaagcacaattaaaacttagataggctaccaagtacacttgaaaacatagtgctgtattcctcttccccaataaggttgttgttctaaataattagcttgcattttgattaatcttgattgtgctctgatacaaaatattgcaattatttgacttgcaacctgctttatagagttagtgatttattgaatatcttggaagcaagtccttgacaggcagtattttaaggtgaaattgctatgtgaggattttgttaacctgacgttttgtggtttcgcctcataaaactggcaaaggactcccagcgtggaatgttaatggggtgaagtaatgaatgcaggctgagttacaagcatccagatatgagcaatcctatagttcatactccatgattcttgcgggaggtctttgtagacagaagctttactaaaagataaaagcagtaggagatcgttaaaactcagcagttgatcaaactctttctgaaacctaggcttagaagccaagcagagatatgaacatgggaaagtaattaatctattatagtctttcatgataattttcactttctcaaactgttgaagtaaataattgttgggtacctatttactctaaccaaatattaacctttttattcttttcagcttttaagtactgcccattccacttctatattttgatccctcaatcagatagctaatttaattccagcattagttatgcagattttattccactggaccaaagcaatatactgtgttcctcttcccatttaattttattttaaaactttgcttgcagagctgaaagatttcttagagttttcatggggctggggttctggctgcttgcttctagattgtatcaaagcagctctgccttttttctgatttatttgttggactactccatgagattttgtctgaaaaaaagaaaaaatgtcctgttcctaagaaagtttgaaagccacatatatagctgtttaatttaaagggtatcaattgtaagatatgttttcaacatttttgttgatcacgtatttcaagtgacagagcacaagggtatagattaccttgaatcttgtattctaaagaaaagaaccaattatttatatattgaggggaattttaggacttgttactataatgtagtcagttttgtagattacatctagttacaaagattatatatggttttaaaaattgttgtattttgatattttatttttaattaaaggctcttccttctccttccattgtataatcatattaaggtatcttttagataaaatctgaaaacacttttcttaatcattctcattttcattgagattctgaacaggtaggctagcattattgttctcaaatggctaatgacatattttaatctatgctttactgcttatacaattagttaaaaggtcttaaaattctttgagattctcttctttaagaaaaaaaatacaaagttccaatatgttgaagaggttgggctcaaactcctgggttcaagcagttctctcacctgggccccccaaagtgttggaattacaggcatgagccactgtgctcggccaagattctcttaaattcatcttttgctttttatttccgcttaccctgctttagactaacttctcaccgtcaatcacagaattggttggatagtttgctttcttgctaattttgccttctttcacttgttctctataaattgtccagactatcagataaaatccaaatgtttcatcctttgcaactgctcatatactgtctaacttagtgaaacaaactgttttcattgttatttgttcttcagaatactacctcctaagtaaatggtacctccctatcaaaggcaattttgtgaaatgtattattcaaagcaaccttagcagtataattcttatctgtgtatatctgtggctcaagccaaaatctcaatcagcttaaatctggcatctcaggggagagttattatttagttcccttaacattattttccatgattggcaaggacctagtcaagatgtttttgttagttcctcttagaaaaaagatcacttttgggatatcagctttcaagtatcaggtaatttcctgtttaggtctttatataaatgcctatcaacccttataatactttttattttatccctttgtatctacattccaaataattaaatcatgcattccttttacggcccttagtatctcaaccaaaataaatttttattctttagatttttgccctgattaaattatttatttgttttccataggatatgttttttgggggtcatttctcaatactcccaaagctgtaccttaatgattggtttacttacatacccttgtaaccagtttattgaaaacaaaaattatttcttactctacagttttccttcttggcaatttcttattgcatttccttctattctgtgcacagaaaaacaataatgtattatagtggaagtattggggagatagtgactcaaataattttctgtgctttgtggtttagatgaggaaccctgcttgaaaaaacaggcatgtgcgacaggtactcagtgtatatattgagtgaataaatttgtgttatttacattttatgtttgatatgtgtatcttatttcccaactatattctaagcttagggagagcttaaacaatgtcctcttctatatgtgaatttgtctaattggtaagtaagtagtttatgaaaaaattaaataatttgaaataaggcagaatttctatctatcatctctaggtagcttttttttttttttttttttttttttttttgagacagaatcttgctctgttgcctagtggcacaatctcagctcactgcaacctctgcctcccaggctctcctgccctgctaatttttgtattttttgtagagatgaggttttgccacgttgctcaagctggtctcaaactggagagctcaagcgatctgcccacctcagcctccgaaagtgctgggattatagacatgaaccaccatgcccagccatccctgcatattaataaatttcatgtatttgttagtctcctacaaatatatcatttatcacaatttattttatcaattttgagatacttttttcatactttaacttttctgaaaataaatggcctcttactactggcctcagttgaagttcagctctgatagagggagtttgtgtttgcctctggcattcaatctcagacacatgagaccactttgaattaagttgttagatgatttttggatttcactgatagtgtgaatttagactgccataattgttaatactgggttttggtttcaattttatgagatttcttcccctaccctccacctagtacaaagattcgtttatgagtttcttcctatttctgtctacttcgaagagtttttttctttaatcttaaacaaaggtgtaccccttgggtcttccaattctatgtacatgtaaaataattgtgtgtcatgattgatggtgtcttagataagaagaaatacagaattgcagtcaacctaattgggtagaatggcaactgcaggaaattgagtcatcccaattcaatttaaattttgaagtttaccaatgactaaccaaatattattaaagaacagtgattttatttgggatttcactttcaaaatggaatttacattaatgtagtatttagatttaatgtattaataattaatataggtagccagtcaaataaatggcagctagccagtcaaataaatacaaaaatttgcatcagagcacagtcaagattaatcagacacaaggtagaagcatggggagacagatagagcagtcaacacacataagatattatacaggtgggagggaaagagcacatggggttaattaaaacacaagttacaggcaagagactagagatagggcagtcaacacacttcggatactgtataagtggatgggaaagaccacactatctgaatctggtggcatggaatgtttatgtatcccctgcccactttacagatgactaacttaccctctatgtttataacacattttatgatctctactgtttcataagctactttggttactcacaatttgtatgatttctatctgtatctcataagatgctagtttacttactatctatggttaacatttcttatgagtcttattcatcctgtttttcttgatttataatgtaacagaatattctcaaacaatacacaaaatataccttacaaaaattctctatcagtcaaggtttaattagagaagcagaaccactaggagatatacttttaaagtagaagtccccgatctgttggccataggccaaaatggttccatggtctattaggaaccaggctgcatagcaggttagtggtgggttagtgatcattactgcgtgtacaccatctcatgtcagatcagctgcaacattagattctcctaggagtgcaaaccccattgtgaactgtgcatgcaagggatctaggctgcacgctcctcatgagaatctaatgtctgatgatctgaggtggaacagtttcatcctgaaacaatcgccatccctgaaccaagtccgtggtaaaattgtcttccacaaaacctgtccctggtaccaaatggttcaggagtgctgatagaaaggatttattataaagatttctccatactcaattgtgggagttttaaaaaaattctgtgggaactattacttttgtgtttggtgctatcacctgaggtcagcaaggcaggaagttgagctgggaaaacagatatgaagtaggggaagcaaggacaaatggcaacctgaaaggtttagtgggacctggatactctctgtttccaactttggtgatataggtgtcttgtaggagaagatagctaaattttaaacctgagatgattggataagataacttttaacaagtttcaagtatttgcaaggagatagaaaaatcaggaattgatcaagttaagatttttgttactatgttggtctttttataaaatggctattttatgcaaataaagaagcagttaatttttttcagtcagtttgagtgttttaaatcaaaatattctttgatatcttctgaggagatctcaatttgtccagctacatccctgcagtagaagaagagtgtgaattcatacatctgaaaattccagcccaaagcaagcagctacgaaaggaaaatctactttacgtctcttagattaaaaatctttgtaagtttgacattctactccacaatgcattctgtttgttttacctctcctccccctagttattagattaagttgctcatctactaagacctactgtgcttattttttcagttgagtgcttcttagcttaccactatacatgcctatatatgtaagtaccctcttttgaaaagtctagctcatgatgatttctaagattccttccagttgggctctttctggattatagacttctaaagtattcaaaattgtgaactgttatctttccagtttttatgtgaaacatatagagtgaaaatttaattctcttggccttgttttcataggtataaaccctgtattttagtttggggcatattctgaaaaaatgattcatttcaataaaagcagctatagtatattacaatcaatgcttatattcaagcatgtgtttagtaaaatgaaatattattaattttgaaaagatacatttttaaggtattatggaagaacattgtggtctatatattttgttttgacaaaatcaccttagggaatgcagatcataattttatgtctacatttttttgccttgacatccaatgcatgtttttagtaattcaaggaaatccatctgctttaagaggaaaaaccctgttaattccagattataaataaaattgatctttttgagtgtaatttccagtttcgtttttgaagcaacttatttctttctgagccatcagctgtagtggattacattaaacataaccactaagcattctcagtgaactttatctttctgtttttcctacaaatatatttcctctaggattttattaaataatgtcattcttatcatcttgacagattctagtaacagactgcaacatagtgaatctaacagcaaataaaaataaaatagataaatgatagcattcagtattcctttcaagcatggtattttgacaatggcgtgaaggacattttgggccacataattctgtctcatacattgttggatattctgtagtatccctgacctcttcccactagataccagtggcacccttggtttgtttccagacagtgctatatttcctatgggtgatgaagtcacccctgtttgagagtcactgtttagagtatatattttattctgtaatatatattaactcatttgagatgcctatttggagaggcatgtcttccaaggattttagaaaagaatttaaaattgtcttcaaatatttgaacatgttatttggactagttattttggggctactattccagaacacactggactagaattgttttctgttaaagtaccccttattaaaacttttgatcatatatataatattaaaaatagtattatcctcattgctattatattatgccattcatagagaatgaatgatgaggccagtgatgggggtatgttattttaataatatattctatttggaggttgagactttggatgagaaaggggaattcaggaatttaatcaagtactgaataaagaaccagagtcagagaacagaatttcactttctgaaccatcacttaatatagttgtttcttacccctgacctaaagctcatgcattattccttctgttatcttcctgtcttccctcacccctactcctagcccaaattaattgtttcctaagtgttcccccttttcttcctcaattttgtttatctaagcacttacaatctatattttaattttttcttccttctaagttgtgggataatggagtgctgggttgaaaagtggaggattagaagggcgttacagtggtaccactggctacctcaagaagttatttgatctagtcattgtcttcaaccagaacggaaactatcaatatcttgtttcttagtggcttgtagagactctccaagtacccatggtaacttttttttcatatctaaagccattaagcaaaattttatttcttttgttcccccttgtcttaaggcaatttagggttagttttttattgcattagagtattaggtgaagttgagtctcttaaagaaaattccttgtattcctggtaagaattcctccttcacctttcagcttcattctcatatacattaaaatgctttcattcagattctttaatcatagataattttatgaactatccattgaatttcctctgattttttaatattcttttcggaataaggatgcatggttccactaaactcttacttatctggtttgtggcagagaatgagacctatagaagaaaatttaaacttaaatgaacagtgctggcaatttacttgttgtggttgtttttaaataatgcactggtcctacaaagtgcttagaaaaccttacttaagggatcaacctgttcattttaagtagtgttgcttgtcattgcgttactcactagtcatttactacagtagctactacattgacaggtaaatgaccatagaactgtcagcctgtgtagcaacactacttatagactacttctagaatcttgcagtttagagctgtagagcagccaagatccctttataaggaacatttaaatagacttatgttctcattagcataaacaccactagtagttgaactggaatatcaattttaaaattctgaattgctaaaaaactgatactttactagtaaatcaagaaaaaaattaaaatataacctgtaagggccagttggttagttatgttaacaacatatgaaatatgtaggttgcatttgtgcatttttgtacaaatcaatacagtaaacttcttagtacgttttgactttggtgatgttggtttggtgtaggttaaattgtaaaatttaaggttggaaatgaaatctgaaagctgctgcaaaaataatggaatttaatttaaagtattgcatgtttacatgagacagaaggatacattgcatgatcttacagcattttataggtggttgacaagaaattgtatttggagttcaacgttgtaactgcatagggataactttagtaatttaagataaaggaatacttaacacagtacagcataaattctgttttgtttaaggaatttttaaaaaatttatctcaaaatcattttttcagaaatttgagcatctttgtaacaacagtttggctgctccagaaacgtagaatagagctttgtttttatttattgtagaaaattgtgaatttaatggggtttcttataacatattgataaatcagacagaaatttggccagtcttatgttctgacatccaaaactatattaggtgaactcagtgtaaagactcattggatcatttaaataatagactgtgacttaggttttttcagtatttgtcttgtggttcataaagaaaatggctaaatagtaaacctgagataattggattaaatgattatttttaacaagtcccaaacatttgcaaggaaatagaaaaatcaggaattaatgttaagatttatagttactatattaatcttttcatatatggccactttatgcaagtaagagaacagttaatttttttttgttcaatcagttcaagtgttttagatcaaataaaatattcttttatatattctgaagaattaattcagtacattctctgagtgtcccaagaggtacagtgtggaaaggatgtttatggtgatttacttgtaaagtaaatgttacccttactctgcatcctcagttcagtgctttacgtacagtcataggctattcttcagaacatccttaaaagcacagtacagaaaacaagatgaaagttttagattaagagactttattcattttcttccagactctccctaataaaatttcttctgaatttcccatatgaattctaaacattttaaatatcaggcttctaataacacttttttgtccatttatttatgttgaaattctactggtattgcattaatctcatgttgataggaaaggataaaaagttggctcacatgtttttttatagcagggtggtcaaatataatagtgttgcttatttttcttaatgatgaaatagtaaaatgattccaaggcctacttagagaagagcttagacttcagacagtgctttatctacatgagggagtaatcataattcttcagacatgtaagtatcagaagtctttttaaataatagtacttagtctatttaaatagtattaggttactggcagctttgtagtgagagtttgaatttttgtagagtttatatattttagacaagaatctgacatttagaaatgtaacattattcttaaattttaaaattgtttttatctgaagggggtcagggacatgtaaaattaatgcccaggaaatctgtttttggagaaagatgtgcatgaaaagtaaaggccacatatatggtgatttttaaactttactttcttttaatgaaacattttcttttgaggtaattatgtagattcacatgcagttgtacaaaataatacggaaggatcctatgtatcttcttctcagttttccttaatgataacatcttacaaaattataatataccaccccaaccaggatactgacattgatacaatacatagatcttgttcagatttcccctgctttactggtattcatttgtgtttgtatgtatttaattatatgtagttttatcacatatgtagattcatgtacctaccaccatagtcaagatacagaatagtttcatgactgtaagaatcccttgtgttacccttttatgtccacatctactttccttctgcttcctcctcaccatccactctaaccccaagtcttaaccactggcatctactaatatctctatgtctccaattttgtcatttcaagaatgttatgtaaatagtcatgtaatatataacctttctgggattggcttttttcactcagaataattctctggatgtatacatgtatgtatcagtgtctagtgttttacacaatgtttttgaaatcgtttgtcttgtgtatatcggtagtttattgttttgaattgctaaatagtattccattgtatggatacagtacagtttacttcttcattctactattgatggacttctgtattgtttctattttgtggttattgtgtttaaacctgctataaaattcttttacaagccttttgtggacatatattgtcatttctattgcatacatatttagaagtggaattgttactataaggtagttgtatgtttaactttataaaaaactactagactttttttccaagtagttatatgacttaaactctcccaccaacaatgtgtgttacaatgagaatgacattgttccattcatatctttgccaatattaggtgtagtcattttatctgttttactaagcttgaaatgatatctcattcttgttttaatttgtgcttctcagtaactaataataataatcttttcatccttttggcatttcagataccttcctttgtgaagtgtcttaaaagacttgaaggtcgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcgtgaagcgttgttgaattttgtcaaaggccttttctgcatctattgagataatcatgtggtttttgtctttggtcctgtttatatgctggattacatttattgatttgcgtatattgaaccagccttgcatcccaggggtgaagcccacttacttgatcatggtggataagctttttgatgtgctgctggattcggtttgccagtattttattgaggatttttgcatcaatgttcatcaaggatattggtctaaaattctcttttttggttgtgtctctgccctgctttggtatcaggatgacactggcctcataaaatgagttagggaggattccctctttttctgttgattggaatagtttcagaaggaatggtaccagctccttcttatacctcggtagaattcggctgtaaatccatctggtcctggactctttttggttggtaagctattgattattgccacaatttcagctcctgttattggtctattcagagattcaacttcttcctggtttagtcttgggagggtgcatgtgttgaggaatttatccatttcttctagattttctagtttatttgcgtagaggtgtttgtagtattctctgatgatagtttgtatttctttgggatcggtggtgatatctcctttatcatattttattgcgtctatttgattcttctctcttttcttctttattagtcttgctagcagtctatcgattttgttgatcctatcaaaaaaccagctcctggattcattaatttttgaagggttttttgtgtctctatttccttcagttctgctctgattttagttatttcttgccttctgctagcttttgaatgtgtttgcttttgcttttctagttcttttaattgtgatgttagggtgtcaatttcagatctttcctgctttctcttgtgggcatttagtgctataaatttggccagggcaattaggcaggagaaggaaataaagggtattcaattaggaagagaggaagtcaaattgtccctgtttgcagatgacatgattggatatctagaaaaccccattgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccactcacaattgcttcaaagagaataaaatacctaggaatccaacttacaagggtcgtgaaggacctcttcaaggagaactacaaaccactgctcaatgaaataaaagaggatacaaacaaatggaaggacattccatgctcatgggtaggaagaatcaatattgtgaaaatggccgtactgcccaaggtaatttatagattcaatgccatccccatcaagctaccaatgactttcttcacagaattggaaaaaactactttaaagttcatatggcaccaaaaaagagcccgcatcgccaagtcaatcctaagccaaagaacaaagcaggaggcatcatgctacctgacttcaaactatactacaaggctacagtaaccaaaacagcaaggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaacactggctagccatatgtaggaagctgaaactggatcccttccttacaccttatacaaaaattaattcaagatggattaaagacttaaacgttagacctaaaaccatgaaaaccctagaagaaaacctaggcattaccattcaggacataggcatgggcaaggacttcatgtctaaaacaccaaaagcaatggcaacaaaagccaaaattgacaaatgggatctaatgaaactaaagagcttctgcacagcaaaagaaactaccatcagagtgcaggcaacctacaaaatgggaaaaaattttcgcaagctactcatctgacaaagggctgatatccagaatctacaatgaactcaaacaaatttacaagaaaaaatcaaataaccccatcaaaaagtgggtgaaggatatgaacagacacttctcaaaagaagacatttatgcagctaaaaaacacatgaaaaaatgctgactatcactggccatcagagaaatgcaaatcaaaaccacaatgagataccatctcacaccagatagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctatagagacacatgcacacgtatgtttattgcggcactattcacaatagcaaagacttggaaccaaccgaaatgtccaacaacgatagactggattaagaaaatgtggcacatatacaccatggaatactatgcagccataaaaaatgatgatttcatgtcctttgtagggacatggatgaaattggaaatcatcattctcagtgaagtatcacaagaacaaaaaaccaaacaccgcatattctcactcataggtgggaattgaacaatgagaacacatggacataggaaggggaacatcacactctggggactgttgtggggtggggggaggggagatggatagctttaggagatatacctaatgctaaatgacgagttaatgggtgcagcacaccagcatggcacatgtatacgtatgtaactaacctgcacattgtgcacatgtaccctaaaacttaaagtataataaaaaagattcctaaggggaaaaaaaaaaagagttgaaggtcttttgcccattttatgttaatggtttgtctttaattgaattgtaagagttccttatatattctgaatacaggtcagctatatgtgtgcataatatattttcttagtcttttctttgttttttctttttcataacaatgttttacaaagaataaaattttaataccttggtaaattcacatttatcaattttttagtgattagtgcttttatgattagtgcttttttggacttctctatgaaatccaggatatccttctatattttcctctaaaagccttatagtttagcttttaattctatgattcaaaaaatcaagttttataaatagttgtgaggtagagatcaagtttttgttttttttttctcattcatccagttattaaagcatcatgtgttgaaaagactttccccattcagtgccctggcatgtttgttgaaaatcaatagacaacatatgcatgattttatttctggaattctattctggttttttaatctgtttgtccatggtcatgccagttaccatggtcttgtttgctggggctatataccaaatctttgaatcaggtaatatgagtcctctaattttgctatttaaaaagattatataaagtactatgtgttttttgttttctttctatattttattatcaactggtcagtttctattaaaaacacctgttagaattttgattgggatttcattgaatttgtagataatcttgaagaacaaaatggacattttgacaatattgagtctttaatccttgaacgtagtgtatctcatcatttttttgggtctttttctcatgaggcttttgtacttatttcttgcgtactacattccattttattctttatataatctgttagggtacccacagaatatttttctataaggatatatttatatttcaaaatttatataattatacttactgagaaaataagatgtgacttctaagaattgacagttttgacggtatgtgattcacatgttaaagcctcttctgagcacattatatttaattttagcttttattttgcctaacatataaaaatggattcaatgttatagttaatgaaaacaatgtcagattattttgttaccttatgttgcttatacatggaagcattattttgaaattcagtgtctctcaatcgtttatatgttgcagaattttattgttttgaagcttagacattcttataatttttattaattaacagaggttgttaccatgataaaattttagtatctttgattaataatgaggtccattacatacaggaagacatgtattctcccactctatctgtggtagatcagtgattatttcttttttattatgaggtatgtcagacatgcaaatagagaataatataatgagtatcacagatcaaaaagaaagtcaattttttaatttcctcatgatgatctttctcctgtttcaccatatcagagttggacactattctaaagttagagattattattcctgtgcctgtaaatacttttagtatacatatgtatgcacatatatatgtatcattttaaaaatatttaagtttcatattgttttgcatgttttgatttgtttgctatttgtattcttttgaacatttatttaatattaagtttggaagagtttttgtattaggtcgttcttgcattgctataaagaaatacctaagactgggtaacttataaagaatagaggtttgattggctcacagtaggctgtacaggaacgtgatgctggcatctggttgacttctagggaggcctcaggaagcttaaaatcgtgggggaaggtggaggtggagtaggagaaagagagaatggagggggagtgctacacacttttaaatgaccagatctcatgagaactcactcattatcatgaggacagtacacagggagatggcactaatccattcatgagaaatccatcccatgatccagtcacctcccaccaggccccacctccaacactggagattacagtttgacatgagatttggtggagacacagatccaaaccacgtcagtttttttttttttccagtttttttcaaacaagacaggctttatttaggtcactaaaagtaatgttttacggaaagggaaccataacattgcacaacaaagtatgctgtaaaatctcaaacaagaaaggcagtgctttctttaggtcaccaaaaatcatgtttcactgttagaagcaaatgtatagctgcattttttcccccaattctctctataatactttgagactactttgcggtttccaaatataaactaaaatttgttggacagagttgctcagtctcatcaatagaataaaaatagcttgcaaaaaatttttgtttaatgccaacaaataacaaaacaatgtggtttctgcttactaactccaacatctagtgaaatggcctaacctatgtatactttcatgaacatttcactgtgaacgcagttgccctttttttctgccatcacagatagcctccttagtagcaagtatcttgtcagagcactttcggacacccaggaagtaattcctaacagaataactatagttatgtgggcaactgaaacaacagggcccacctctgccagagtccccacgtggtgttgcttttgtgctctgggtaaataagacccagcaccttgttagttggaacagttggaacccagagtgcagagctagatggaggagttgttgttacagacccatcaacactttaataaattgccgggggtttctaggtgctatagtatgcctcataggcagcaacataagccaactctgggaagaaatcatcatggtatatattctgctaaaaacttcagaaaagatcaaagtgtttcaataaagccttcagattcttctcagactaggacatgtttccaaggatttctggaagttttaccaaaagtcacagcaaatgttgtgccccataaatgtgaagggggtggaggtgtctggtcacctgggtggtaattatcaggcacaagcttccacgagaggacctcatttatttaattagttcttttcccttcaaagccagtaaatgcagcactttcttccttgctaggaggctgaggaatagttgaagatgatgcacaggtgttttgttctccaggttcaggagcagcctggggcatgctagtagatgtggcctgctgctggcacttgggcgaggtgacgcctgctctcagccagcctgttgcagttggtggtgtggcacgcggaccgcctcagagcctgcaatgcttccggcttggctttgtgccttttgtgggtggctggttcagctgtggttgtctgactctctgtggactgtggtgtggatggattcaacaaaggtgggctgggagagagctccccctggctcattttattgtctgtggtgctttccgtaattgaaagaaaacacttagctgaagtcacctttttatactgagcttattcccatggatagattataactgatgcggtagtgtaatcaaaggttattcttaacccatccaccatctccttacaaaggtcagcattcttttctgctgggaattattataatgcaccttcatgttggtgtgccgcatagtgtggtggtggcaaggcctctcactggctgaaaaagctgtgttgatagcaaaatgcttctcgtaggactccaaaatcattatgatgttggtctgtcgtggaagtctcattaactgtttccttctgttaatgtagtaacgatcactctcaagctgcttgttcagaacttcggggatttctatagttaatattctttcttccatttccctttctgtttacagctccagttcttgcacttaagtctcttcttcaataacacttccttcacttatttttcatccttgtcttcactactgttggagaactgcttattgaattttcagcattttcatctttgtcttcaactggggggcttttttagacagatttgatgccagacagcctgcagcacttccttcttcctgtgcttctcaggtgagctgcagcttttcttgccaattcatgctgtcatccttgatttgcacctgtattacagtgtacgtgatctttggctgcccatctatcacagcttccgttccaactattaaaatgtattagatattctgggatctttctgccttttttgtctttcccaccaataacatcagcaatctgggtcaaacccccaggcgtcccaccagagcccacgtggcactgggctgcacaggaggaaagaagatttaacgcaaaatagagaccatagtcaagaggcctcctccactagctgcaaggccaaaccgcagcctggcctggacagcgcagacacaaggctcccgactggggctgggagagttttccattttgagttctataattcttaattcaggcacttaattgctatgtagtaattccagttttatgaatacaatgtactgcaattatttttattgctgatgatttatttttagaatttggtaaaacaattttagattgtatactctttattatttaaaaaattactatttttaattgacaaatcataattgtatacatatatggggtatagcgtgatgtcttgatatttgtatacaatgtggcatgattaaatcaagacaattaacatatctgtcatgtcgtttacctatcctttttcatggtgagacatttgaaatttacactcttcattattttgaaatacatactacattattaattgacttcagtcactttattgtacaatagatctcaacacttatgcctcctctctgtctgaagctttgtactctttgttcaagaatttccattccctctcttcacatctttctagcctctggtaaccatcattctgtgctacttctacaagttcaacttttttagatttcacatacatgtgagatcatatggtgtatctttctgtgccttgcttatttcacttagtataatgtcctccaggttcatctatgttgttgcaaaatgacaaatttttatttactttttaaggctgaatagtagtctattgtgtatatatactgcattaaaaaaatcagtttatccgttgatagccagttaggctgataccatatcttgtctattgtgaatagtgctgcagtgaacatggcagtgcagatatccctttgacatatttatttcagttcctttggttatatacccagaagtgggattactgagccatatggtaatcttatttttagttttttgaggaacctccataccgttttccataatggctgtattaatttacatctctagcaactatgtacaagatttcccttttctctgaatcctcactaatacctgtcatctttcatctttttgataaaagcctttctaatgggtattaggtgacttctcattgtggttttagtttgcatttccctattgattagtgatgctgagcatttttttcatgtacctgtttgccttttgtaggtcttcttttgagagacacaaatggcaaatgttcaggtttattgcccatttttctttcttttttttttttttgagacgggagtctcgctctgtcgccaggctggagtgcagtggcacaatctcggctcactgcaacctccgcctcccaggttcaagtgattttcctgcctcagcctcctgagtagctggcactacaggcacgcaccaccatgcccagctaatttttgtatttttagtagagacagggtttcaccatgttggccaggatggtctcaatctcttgacctcatgatccacccacctcggcctcccaaagtgctaggattacaggtgagccactgctcccggctgattgcccatttttcagttaggttgttttcttgttattgggttgagttttttatatattaccccttatcagatatatgctatgcaaatatttttttccattttgtgggtttgcttcactttgttaattgcttcctttgctgtgctttttagttcaatgccatgcatttgtctatttttgtggttattattgcctgtgctttaagttgcagaatacaaaatcaacgtacaaaattagtagcatttctgtacactaataacaaactatccgaaaaggaaattaagaaagcaattcaatttacaatagcagcaacaacagcaacaacaacaaaagtaggtataaattaaacccaggcaatgaaatgtcttttcaatcatttaaaattgtaaaaccattctgaagactatagaacactgatgaaagaaatggaagaaaacataggttaatataaagatatcctgtacttatggattgaaagaatcaatattatgaaaacatgtgtactatccaaaacgatttacagattagtgcaatccctatcagaagtccagtgttgtttttcacagaaatagaaaaaacaattcttacaaacccacaaaagacctcaaatagccaaaacggtcttgaccaaaaagaacaaaatgacgatatccaactctctgatttcaaaacatataaagctattgttatcaaaacaggatgatactggtataaaaacaaatacattgatcaatggaacaagttagaaggcctggaaacaaacccactcatttatagtcaattgattttcaacagagatggcaaaaatgcataatgaggaaaggatagtctcttcattaaatgttggaaaaactggctgtgcacatgcacaaaaatggaattggatccttatctcaaaccatatacaaaaatcaagtcaaaaatggattaaagacatataaaacctgaaactgtagaactactaggagaaaacatagggaaagctcctcaatattagtctagacaaagtatattgtttccttattgatgtgttttcgaatttctcttggtctatacttaggttgaaattgctgagttatagggtaggtatgtcttttactttattggatattgccaaattactctaaagtagcagtaccacattatatttcctttagaagagcaagagacttcttgttacttcatattatgtcttcacccatatttgtattgtgagacttatatggatttttgctgatctgaatgctaagtcattgcaggtttattttgcccttccctggttattagtgaatttgaacttttttttcaggttactcagatgttcctctttttttttccagttagtttttttcttctcattggtttgtacaattttttatattgcagattctaattcttggcaattatatgtgtggcttgctttccaattttttatataatgagttttgatgcatgggaaatttcagtattaaagtagtcagatttatctgtcttttcttttacggtttgtgttttgtgtggcttgttgaagaaatccttttctaccttgaaattttaaagatattctgcatattttaaaaaatattttcaagttttccaagttttcctcttttcatttaggaattgagtcttgcccatctcattctttggtgttagttaggaatcaatttttttccttgtatggatagctagttctccttgtacaatttcttgaataatttatcttttctccttaacctacaaagccatcattgctatagtatgcaatgctaggtatgcaatactatagtatgctaggtatgcattgctctgtttctgagctctttagtctgcttgcttttctttttccttatttttataccgatgtcttaattactgaagtgttatagttcttggtatcttctagagcaaatctgcccaccttaaccttctttttcaaaatcaggggctggcaaactatttctataaggaccacatagtaactattttaggctttgtaggccatacagcctttattgcaactgctgaattctgtcattgtagtgcaacaccaaccgtgggctatataaaggaatgagtttggtggtattttgtgtaactttcacatatacacattgttatatattttttctttttttcaattatttaaaattgtaaaaccattgtttgtaagccatataaaacagtgagtagaactttgacttttacttaaaattgtctgtgctatttttttatgccccttttcttatatacactttttgtgaagttaagcttcttattttccctacatgagcaaaaggttatttaaaattcttcagtcaccagtgaaataatgaggcaggagaaaaagttctttaggtggtagtcttgtcatcaaaaataaatacagttgcatggaactgctcaagatctgaatcaaactgaaaaccggaaggcaaggggctgaaaattaagaacccctccaaccatgagttattcttcaggtcaagggaggcgagggcagggagaagtgtctagccatgccatcttagagcagaaggccatagctggatcagatccaattctcatgacacacacaaggaactacacttgtggcacctgagctggattcagatagcagagtgggcaggcaggtgggcaggcagagcagtggttggatgagcttagagctcagtactatagctccatcattctgttcagagcactgccaacatggaaccattgaatcagggtcttgtagaagttcgtggttcaggaggatggtttcctgaatcctcttggagttcttgatgatacatttgaggggcttgacagggcaaagcctttccagccttggatgatgagattacacgcagggtagatcttatagtttgtcatgtcagtaaaggtaagggacagcaggttggtttcttgaagctagtttcctggatcctggtaaagctcttgatgatgatgccctgtctcccaaggtggcagggttctagtggtatatgctcccagcttgccatggctctcatctctgataaccatctatctgatggcatgtttcttacagtagtgggccttctcctggtgacaacattacctaaggagttggcatttattgttttcagtgtttatggcaccaataagcaggttattggagatgttgtactggtgcctcaataacttgaaccatatgccaatattcaaaatgtagtgagtggtatgcttccttttcacttttgtaaggatatgtgaatctgtaggtcatccaggtctttgccttcccacttgtcaaaaggctccaggagctgtaggcacttgttgggtgtgctcatatccaccctctgcctactgatatccttgtggtaggggtgctggtagttgtccttcctggagtcaactctgcttagggaagctcatctgcatctggagcctccaatttgtacttcttcccatacatggttgtcaggaagtaaatctcttggttgaagttgatggtgacagaaatggccagggcttgaggatctctagggacatgatgaaggcttgggcctcaggtttgctttattgtggcctgtcaagttcctcttgtaggaggtgaagattgcatttttctccatctttattatgtcctacctgttccactggccaatgcaggggccacagacagtggccaggacaatgcctgccatatcctatgggatctgtgaataactcttatgctcaatattagtgtagatctgcttagatcccagtgctgtggtgagctgtgacttgcacttgagcccatgagctagcacttgcttggccatagctgttgagcacctgatgtcctcatagcttgagttggtacagctgttgatcagacccactttgatgtccaaaggccatccctccttctccaccacagtacctacttcttccacagtgtgggctaggtcggggtaaagggcttatttacatggggcttcagcttgttgaggttaatttttacctgtcatttataatggcaatcagggtcaggtaccaagtgatccttgattttatcttggattggcattgtctccttagcctgtcttacccagttattgctttattccgtggttctaagagaacactgagggccccaatttctacacccgtgttcagattatcatcaggccaatgtatgagatgggctgtatgctaggctgctggtactccacagtacgcgtgtgccaccttcaggatcacatctgtggatcagatctagcttgagattgtgcctgtcagcttcacaccattcatcttgtggcacttcaactcctaaataatttcaatcctgccgtccactgcatcagcctccccagctccagtgtatatgctctgcaagccaccactattgaggtgtgggagtagtggaataagaagaatcctggggtatatgtagctttcaagaatgatctggtgattgattctaggtccatcttctaaaagcccacactgtagttcacatctgcagttgctaggaaattatactttctgatttatgtccttggcctggcacagacctttcttttccctgagctgagccttgtctggtgatcacagtggatggtggatgatatggccatttggccacctctctgcttatgaactgcactgtggccatacggtccatagtatcctgaatgcctatgcaggtacatcttactctgttcagttgcctggggtcatctaggtatccatacatgatctccaagaggatcagagcctggttcaatcattcgttaacactgttaattttcttttctaggaggtcatagtggatatacttgttgactccagttagctcatggtcaccttggccttttggcacaggactgatgccacatgatatttctgcacactggagggctttctgcaacagggttactaatagagtatgcctgccataagagttctctatttcgtacaaaaatcaattttatggcctatgtttttaagttgctaacaaaataaactcgctttctagcccatatttagcacattgcatttgtgattatagatgaaatcaagattgttaaataaagcagtcatgaaaataaacttttcagatgacatgcaaaagttatttgttttacctctgcagtgctaaacatcatggacataaattagatgatgttagtttccctgtggaaccatttaaaacaactatctattctaaaagtcaaatatggtgattttgatcagaggattagtgttgacattaacattttaaagtttgctttaaatgatataaaattggtcatatcattttatcttcatggaataataaagtacaatcattacttataaggaggaaccacctaacaaatgcctttatttttcagtaatttatagtgttttgttcttaagtataaatcacttgtttcctgccataattttaatgatacaatgttaatatatagttaaaataatttattttttttaaacgcacatgaaattgaattggaggagtttttttgtagcatgaaaacatgctgccaattgcccactttgaatattattctgagaaaatttataacacttcaagtatgtcagtttttcatacttgaaatggattacttcctgactcactaaaagaatagaaatatatttttaaaggatatgagatattttttatatttgaaaatagcggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgtacccgggaggcggagcttgcagtgagccgagattgcgccactgcactccagcctgggcgacagagcgagactccgtctcaaaaaaaaaaaaaaaaaaaaaaagaaaatagcatgctttttctttcttttactactcagactaatagtttcttattggaggtacaacttaagatcccccacaaatgtaccaaaaactaaatctagaatccataatggagaaaatcacatttagcacagtatgtattttatgattagagttgccaggtaaaaatacatgatgcctggttaaatttgagttttagataaacaacaaataatgtttgggacacgcttttattgttaatctgaaatttgaatgtagctgatcatcttgtatttttatttgctaaatctggcaaccctaattatgattcagtgtttaaaaatatataattatagatacatacttttctataatcgttgaaaaaagtcttcgagaatatgcagcagaatattaatggtggctgtttctggtggttagaggggaggaaggaagattttaaatactttgtattctctacattgtgttaatttatttcagtatatacgtattttttatacttaagtcacttgttttcggtggagtggcaaagatacagtggatggcaaaaatatatagaaatatctgatacttaaccatcatagagcatatgagtgggaaggacaagaaatcacacatataaaattgcgattgcagtaaacatcacagaagagagatacatcagtgttatgagattatacagtcagaggttctgttggtttggaagatcacagaaaactttcttcaataagtgaagtttgagattagatatgaaggaattcgtgtaggcattaactcggtcaagatgatggcttttcaaacagaatgaagggggagaaataatttggtgagtaggaggaagtaaaggaggggagagagctccagagaaagtagtgcaagataatgctgtagagaaacatagtggccacaatctgtggagacttgtgttccgtgtaaggtttcaggttttcatctttaaagcaatggtaagccattgaaaggggcaatactggtgttaacaggatcagaatgtgttttgcgaagatcattttggttgcagtgtggagaactggtatgatgagtaaatgtatgcatgagagtgagtgttgcttgaccagtaaagagaatgttgtagcagttcttatgagagagaaataggagtttgatcttagtagggaggtttgatgataatttaggaagtaaaattttcaggatttagtgatgctgttgatatgtggcagtcaccaagtgagaagtattaaagttaacatgggtttctgatttgcacaaagatgcaatgaaaaataatatagccaataaaaaatttaaagtaattacatagataaataggttagcaactaaaataaatcacttggataggatttgtaaagtgaaactgtgtgatggcaggaggtaaatgaatcaggagattgtaatatgaatatgcaatatgtaattataatatgtatatataatatgcaatatgaattatatatgatatgaattatatgtatatgtaatatgtaaaatgaattataatatgtagtatgaatcaggagattgtaatatgtaatattttgagttaccttgaaattaattttagttatttagtactgttcatattcaaatagatatcattttaaattataaaattatttcagtatttttagaataaaagaaatgcagtaatggtaaacaaaaaataagaagtgcagattttcttcttaacttttcccagggagacttcccctaccttttataatttattttattggagaaatagatttttgaattgaaaatgctattctgaaataaggccatttgccaacaaatcagtacctaaatgtatcttttctcttaattatgtttattttacagcatttgttgccttatgtcaggtttctctgtctctagttaatcaatccctttcatgtatctatcttttcctatacagattcggattagataattcctatgcttcaaaaccttttatggttctgaaaaggaaagtttaaacttaaagttaactccaactgtcaccttcttgaccagtttatattatgttcatttcttttctccttcctcaagagagagagagagagagtgtgtgtgtgtgtgtgtgtgtgtgtgtatgtatgtgtgtgtgtttattttcatttcttggtatcttcgaatgtgttcacctttctttctggaatccctttttagtctggaaaatactggctgagctttcttgacacagatcaaacattacctctctcaaaatgtggtcaccacctgggagacttaggaatttttgcatagcgtttcatttatacttattctattattttattatataataaattactagtatcagatgtagtataaataacaaatatacatcttacttatactacatgatatcatgtgtacttgtttaactatttccattaaatgtgagttttaaggaaagctgacatatgatagttgttcagtaaacctttgttatgagttctgttaggatggagatgttttgctgttgtctgtggatggtagataaatggacaaataaattatcaaatatcttaatatccagaagggaaaagagacatatatattattaataaatcagtgtggtagtattatgagggatgaaagtactctcgggagtctggaagagagaattctcagtttatcttcataaaggtgcttggctgatgttaacctcctttagaataaagctgtaactgcttaggcttgtgttatattaaatggatcatttttcttgccctcctcctgtggaatcatagcattccaacatttatagaggaaatagagtggaagctaccgaaatgggtccaccttcataatttaaaacttctaatttcaaagttataccagtaataggcagtcctccccttgagtgattttgtttccaataatttctaatgtatagagccctattaactcctattactggttgcaggcaggcattacacaaatgaaatgacctcatccagtttcttttctgaagagttccatcactttgttcctagtctgtttttttctgcagccatcttacacagcatggtgatctcttatgtcataaatagtcccatagagattattagaagaaatgagtggtaataagaataaagttgagttttaaaagatgaaagaaaaatgtatatgaccaggaaaacttgagctttgactaacaagtaaaagaaaatacctggctgggcgcagtggctcacgcctgtaatcccagcactgaggtgggcagatcgcttgaggtcaggagttgaagaccagcctggccaacatggtgaaaccctgtctctattaaaaatacaaaaattagccggacatggtagcgggcgcctctaatcctagatattcaagaggctgaggccatagaatcgcttgaacccgggaggcggaggttgctgtgagccaggatcgtgccattgcactccagcctgggcaacaagagcagaactccatctcaaaaaaaaaacaaacaaacaaacagttttttttggaatgtcttttccaaagggcaaattgtaaaaattgtatgcaataatagcatagtttgattaaatgctttttcttccagactttaagttctaatgaatttacttaaaaacaaacaaaaaacttattattattattattttttggagacagagtctcgctccagacccaggctggagtgcagtgtcacaatcttggctcactgcaacctccgcctcctagattcaagcaattcttgtgcttcatcctcccaagtagctgggattagaggcatgttccaccatgcctggctaattttttcatatttttaatagaaacaaggttctaccatgttggccaggctgtttttgaactcctgatctcaagtgatccacccaccttggcctcccaaagtgctgggattaccagtgtgagccaccacgcccgaccacactatgttcttgatagtcaaccatgtatcagtccttggaaaaaactgataaaagaaaagcagatgtagtgactgtattctgaggaaaattgcatgactgaaacttatgtggtgaaacatttaaccatgtagagttagaagaaacctcagtattctaatcctttgacattgtggagcagtgtgttgtaaaggattaagggattattaatttcaggacaaataaaaatcggttcatcaattttgaaggcacaccttacatgtaaattgaagtgcttatttgaggagatacattcttactagagcagacagacttctttcaaaaaaaaaaaaaaaacaacagaatacccagcacttgtttgcttatgttattacttattaagaaaaaatagcactagatgcattcctggatctgcttattgtcattccatttatttgaccttaagttttgccaaaattctgttttccccccaaagtgactgaacatatttccaaagaagtcttagatttcatatccttgatgaaggctcttcactgacttgtagcagtaaaaactattatgaaaaataaaaacttcgaagactacactgtattattatataatattgtctatgattttatgtaattgtgttttgcattctataaagctttatggtatataaatgtgtcatttataattaaatgtggttgaattgatttccaaaattatcagatccatgattaacaaaataacttgttgtattacccttcttgttataagaaaaggggatttaagtcttatttcctgattttgtaacatgttataactacaaataatccttgtttagggtaataaaaatagaaacatttgctttctgagacttggatagtatttggaaatatttgattcaagttgggaagtgatttttcactcttaatagttgaaaatttacaacttttagggaaaatcgttgtgagcattctactgtagccccctccccctgcctttttttttttttttttttttttttttttttttttttttggtatttcagagtctgtgctttctaaacaataaagaacaaatatcccaggatacaaagaaatgggaaacttaaaactaaaatttgctgtttcatcagattcctgagagtggttttaattttctatagatgtctttagtatgttcatgtgcctggaatttatataatttatttgttctaaaactgcataaaatttttttacatttagaaagcatgtcaaaattggatttttaaatggaaatatcctattatggttctgtttagaattttcttatatataggacaaactatattattttagaaattcattctggttatttatggagatgtcttttttagctgcctctattcagaattcaaagttattaaaataccaagaatatttagaatatttagtgaggccaaggctcaatagtgttttattttgtatttaaaaaatttctttgtctcgctgtattgcctaggctggtcttgaactccttggctcaagcgatcctctcaccttagcctcccaaagtcctaggattataggagccacatgcaaggccccagcagtctttggagacaaaaaatccagctctgattcgggcaacactcagagtggatttttagcctagggagagaaaaataaatgatataaaaaacagacaaacaaaaaacctagtcatgggagaaagggagttggagagtaagctttggaagagtactatctataattctgttagaacagaccttctgaaagggggcaaggagttttaactccattgccattatttgttggagaatataatttccctcaggcatttagggcaaggaaaaggttaagaactgctgtaccaattaagttctaataatctaagcttactctgttaacattctatctcacttagagtgatttttcccctttaatgtaaatcagcttatgccattcccctattaaagccccctcttttcatattgtgaattaaaaattccaactgcttttcttaacttaaaaatcccctactggctgggcgtggtggctcacacctataatcccagcactttgggaggccgaggcgggtagatcatgaggtcaagagatcgagaccatcctggccaacatggtgaaaccccgtctctactgaaaatacacaaattagctgggcctggtggcacatgcctgtaatcccagctactcaggaggctgaggcaggagaatcgcttgaacctgggaggcggaggttgcagtgagcctagatagcgccactgcactccagcctggagacagagtgagactccatctcaaaaagaaacaaaccaaccaacaaaaaaccctacctacctctctaaatgaatgtatgactctgccctttccttcataccaagtatgttcctatttagggctgttgttctagctgtgccttttgttttgcttggttgtcttactgttttgtacttgactggtcgtatgtcagctcacatatcagtttcataggcatttgtgaccactcaatattaatatgtcatccagttctcttttctattacttataattattataattatacttgtcacaatctgatgttttcttgtgtgtttgcttctttgttttatttctctattaactactatattgttagtgcttggcatagagttggtgcctaagaaatatttgttggatggatgagtgaatgaaccactgccctaggttaggggtgctacccacgtcatatcattgtatctggtgcaggtaatattatccacaattttcagaaactaattgcttatattataatttttattggggtgaaaatagaggcctaatattaacactgaaaaagaattttcaggtcgaagactggaaaactgatttaagtctcagcacttttacttgtaatttagactgtcactatacctttgtgactatgtttctttttctataaaataatatctcaaagagttctgagatttaaatgaaatggtgtatttaggagtttttcataaagcactaaataaattattttacattctctcctaccaccctaaaaaagaagtaaaatacttaaaaacaagcatcttgggcaaggcgcaggggctcacacctgtaacgttagcactttgggaggcccaggcagggggattgctggagaccaggaattcaagaccagcctggacaacatggtgagaccctgtctctacaaaattttaaaaaattagctgggcatggtgacacatgcctgtggtcccacctactgggaggctgtgctgagaggatctcttgagcccaggagatcaaggctgcagtgaactgtattcgggccactgcactgcagcctcagggacagagtgacaccctgtctcaaacaaacaaacaaacaagtatctttaccatttttttttgataaagtaattttaaaaggtgagctttacttttatattataattttactacatgtactatccaacgatggaagttaaaattaattactttggagaatctctagtattattgaatattttatgaattgcaaacttatagactgaatactttcttcaaccttttctgtattagctctttcatttctgttttacttcctttcctatgtcataatcatccaatttcctttgtatttatcctttatctattttgaaatctatttttttgctttctgaaatatttattatagaaaatgtaattaatttactagaaacatagatatatttattcacctctaggctttgaaaaccctgaaaaaataaagctaattcaacttttctacgttaatttcttctatgtgaaaacactacattcaatctaattgatcaactcctaagcacaattttccttttctgcatctgtattttcatgcaaatattattaaactgatcagaatgccctttcttcctctacctcacctattcagacctctatctccagaaagattcagttcatctcctttttcactgactttcccagcctgctgtatctgaagtggttgcttatgttttttataccatgtcaggtattatttgtaattaatcatattttaccctttttaatatcttatttttttcattaaccgttggtaactagtcattttactttttctattttattttgtggtttctgtcactatatgtttcagattaacaaactgttatgtttctaatagatctcaagctcttttaggtctcttttcatagcatctgtcccagcatttttattcattttgtgtgcctaataaagtttttttggtttgtttttactccccattaaacagccatttattttattccaaaaggaaataattgtgtgttttgtgagtgacaatattgtgatgtgttcagtggtatacttcttgtggccacattacttagatttgatcccccattttagtacttaatagctgtagggtcttagtaaagtcattcagcctctctgtgtctccgttttctcatctgtaataagaagatcttttagggttgctgtgtggattaaatgagacagtaaatgtaaaatgcttaacactttgttgtcaattaagtactaacaatcttcatcaacattagttaaattattttatggcataacggaaagaggcgcagaagtcagatagactgtactgcttatgtgaccatgggcaactttctttgcttttctaaaacccagtttcttcattggtaaaatggggatggtttattttgaggattaaatatcacacacacacacacacacacacacacacacaccacacacacttaatatatgtgcccagtgacaattctctttttgcatttgtattgctgctgtttttctgaagccagaccgctgctcctctgcgtccatccctcatgtctgtctgactgattaaaagcatcttgaggaagttttgactgcagcagttggtttggtgccttcagaagatgaattgtgaggaaactccatgtttttctaagagtccattacattcagaagatgagaactgaataaaaatgttaatctgaggaacagattttgggcagtatcagtgtgggtttcataatactggactatttaattataatttgtaccagtgtcccactattcattggtaaaggagtcttgatttgtgcttaataataataatatattcattgagtgtaaattagtgatttcatctgacagtagtgtaaagatagttgcttatagagttattttctttacacataaaataccgtaaccatatgagaagaatgtcaacacaaaccaaatatttattcgaaaagattataaattcaaaatattttctatacccagtagtcaaaaaccttcaaaaattgttaatgttttgctttttcttttggactagagattgtttcagttggtattcactctgaggggtggagagtctcactttaggacacatctgaagaatagcagacagttatgagaggctgttagcaccaccttgtggtgtctgctgtaccctgccttttacctttagtgccctgccattattatatagatcttgataaccagggaaagataagtagggaagacctcattttaacaattatcttttgaaagtacatgcaaattttgatgattgggtactgattactattgaatccttaatatttccgtaaggttttacgtgtaagatcttgcctattataataattgatttaagtgtttcagattcttaggtatatattaacaacatagctttgcaagtacagaaataatgttttaagactactctagtagatacaactttttctctaaattacattattataaataagtccttttttcttaaaattattttagaaattagtatttaagtgtggtgtatttgatgaattttttcttgtttgctgtcataaaatgcaaaaaatgtagtccttgccagtaaccttaaaacacaattttaatgttttttaacagaattttatagtcataaaataacattgattttagaaacaacattttttataacagagtattttcttccaagattctattttagagttttgtactttgaacagttggttccttaatgttattgtccattagcctatttttagatttttctaatttggcttgaaagcaaaatgtgtcattatattctggattgtggggtttatgtaatttctaataaatatttcaatgttcatgaagagagatgaacataaaggctaagaatcgtaagtaatgcagataccacaatgaaagacattttgtattttagacaacaaagtgaagtatatactagatatatgacatctttcatgtaattaaaaaaggtacaaatatctttaaaataaatttaaatttccaaagtttactatgttagtccaccttgtatatttgtaataaaattaaacaacagtttaaatgtagagttaaatagaattagcttaattcaatacgtggattaaccacatagtaattatacattgagtagtgtgcccattctaaatgaaaagtatggcctctacattagaatcagcgtacaaccaaaaccatgtgtattactatacttcattgcaaagaaaacaggatctctctctgttgcccaggctggagtgcagtgataagatcttggctcactgcagcctctgcctcctgggttcaaatagctctcctgtctcagccttccaagtaactgggactacaggcacgtggcaccatgcccagctaacttttgtatttttagtagagatggggtttcaccacattggccaggctggtctcaaactcccaacctcaagtgatctgcccacctcggcctcccaaatgctgagattacaggcatgagtcactgtgcccaacctgttttttttttttccttatctttctttctttctttctttctttctttctttctttctttctttctttctttctttctttctttctttctctctctctctctctctctctttctttctttctttctttctttctctctctccttccttccttccttccttccttccttccttccttccttctttctttttttttgttatggagtctcactctgtcacccaggatggagtgcagtggcacgatctcagctcagtgcaagctccgcctcccgggttcattccattctcctgcctcagcctcctgagtagctgggactacaggtgcccaccacctgcccggctaatttttttgtatttttagtagagacggggtttcaccatgttagccagtatggtctcgatctcctgacctcgtgacccgcccgtctcggcctcctaaagtgctgggattacaggcatgagccaccccacccggccatttcttttgaaaacattttgttataaacttgaagatacaacaaaatacgacttcttaatttatgtaacgttgttattttatgattatacttttttcatggacatataccggcttgagtatgatctactggcaagggcaaaaggtggtgtagctagtctgttacctaagaattgtagtgccactgacagaagtaagggaattaacaatggaagataattatgatatgtaagttaagttcttagtcattttcaaaaggttttcttgggtagattatatattctttcagggatattggttttgatttctataaataaaatatttattattgcatcattatttacatcactataggatattattgtcctttgagagaaatcatcactctcaatccgttcttttctgttctcttttaccaggcagtactgcttatgcccacaggctttaggggagacaacactgggattgacttgatatgtatagtaactttgaaatgttaccacttctcaatgatcctcagtttcctaatctgtaaaatgaagataatacctggcacatggtaataagcactggataaataatggctgttacttggaattatcattagaagagaatcagaatgatcttatcagagtctcattggaaaattcattagacactcacctgcattattgaggaactgataggtgttcagtgcctctcagtttttaggctaagaaaccataccttgtcaaatcaggagttagcaaatttttaataaaagaccagataattttttaggctttgtggcatggtctttgaatggtctcttttgaaactactcaactctgctgctttagcaggaaagtagaagcatttcctgctgttttagcaggaaatggagaaaaggtgtgttattttgtatggcttcctttaggcatatatagaagccagtgtccttaaagacctgctataaagaccagcttgattaaattataccccactcttgcctattattttaaccctactaggttttcattttttgaatgtgcctaccagagcactgtctctccttgcgcacaggacacactgagtcttttctcctctttgtctttctcttggaagattgttttgtaggattggttaccttagccagataattcaacaaacttttagtgctggaacatgatgcctgtataggaaagctgaaggcagaactatttttaggtctccatgtaattttttatctaagataatgatgattatgataataatgatggagtagctattactttttaagttcctactgtataataggcatgttataaatgtctcattcagtcttcataacaaccctacaagttacgtggtgttagtctcattttacatttaagaaatctgcagtgaagtgatttggtcaagaatacacaacaatcagtgccagatatgggcacacacctttgactccaaagtcttctgctcctctctgtttccattaaactttgaccatgactaggacattcgtttactttgttgtttttactaaataaatgttgataagggcagctattatattttaatttgtctttttttttttttttttttttgagacggagtctcgctctgtcgcccaggctggagtgcagtggcgcgatctggctcactgcaagctccgcctcccagtttcacgccattctcctgcctcagcctcctgagtagctgggactacaggtgcccgccaccacacctgctaattttttttatatttttagtagagcccgggtttcactgtgttagccaggatggtcttgatctcctgacctcgtgatcctcctgtcttggcctcccaaagtgctgggattataagcgtgggacaccgcgcctggcctaatttgtctttatgcctttagtttcattatagtggataactaataaacgttaatttagttaatgattgaataattgagggcagattcaatataaatgatgaagtaagggaaaaatggtcttatttgaattagaaggtctccattggaaatgtagtatgagtaaagaggaacatttaaaataaagtgtctttcctaaaacccattcagggcatttaggttttaaatgcctctccattgtgtgtatgcatcacattttaaaaatctgttcatctgctgatggccatttatgttgcttccaaatcttggctattgtgaacagtgctgcaacaaacatgggagtgcagatatctctttgatacactgatttcctttcctttgggtttatacctagcagtgggattcttggatagtatggtagctctatatttaccatttgtatgtcttcttttgagacatgtctactctggttattaatcccttgtcagatgagtagtttgcaaacattttcttccattctgtgtgttgtttcttcactttgtcgattgtttcctttgctgtacagaagtgttttaacttgatgtgaccccctttgtcgatttttgcttgtggggtattactcaagaaatctctgctcagaccaatgttttggagagttttctcagtgattacttttagtagtttcgtagtttgaggtcttagatttaagtctttaatctacttggatttgatttttgcatatggcaagagatagagggatggggtctagttttattcttatgcctatggatatctagttttcccagcaccattcattgaagagattgtcctttccccaatatgtgttcttggcaccgttgttgaaaatgagttcactgtagatggatggatttgtttcctgtttttatgcctgtgccatgttattttgtttactgtaactctgtagtaaaacttgaaatgaggtaatgttcaatttttttctttttagtcaaaattggtttggccattttgggtctgtttttgattccatattatttttaggataattttttggtttttctgtgaagaatgtctttggtattttgatagggattgcaatgaatatgtagattgctctgggtagtatggacgttttaacaatattgattcttctaatccatgaacatgaaatatatttttattttattgtgccttcttcagtttcttgcatcaatgttttatagttttcgttgtagaggtctttcacttccttggttaaatttatttctagttattttatttgtagctattgtaaatggggttactttcttgatttctttttcaaagattgtttgctgttggcatatagaaatcttactgatttttgtatgttgattttgtatcctgcagctttactgaatttatcagttctaatagtttttttggtggagtccttaggcttttccaaatataaaatcatatcatctgcaaacaatgataatttaacttgtttctttccaatttggatgccttttatttctttcccttgtctaattgctcagctaggacttccagaactctgtggaataatagtagtgaagtgggtacccttgtcatgttccagttctcagaggaagggctttctgattttccccattcagtatgatactagctgtgggtctgttatatatggcttttattatgttgaggtatgttccttctgtactctgtcttttgaggatttttatcaggaagaatgttgaattttatcaaatgctttttcaaaatcagttgaaatgatcatatggttttctccttaattctgttgatatgatgtatcacattagttgatttgcatgtgttgaaccatacttgcatacccaggataaatcccacttggtcatgatgaatgtttttttaattgtattgctgtattgctgaatttggtttgctattattttgttgaggatttttccatcaattttcattatagatattgtcccgtagttttcttttttttgtttttgtttttgagacaaggtctcactctgtcacccaggctggagtgcagtgacatgctcatggctcactgcagccttgaccttccaggctcaagtgaccctcccacctcagcttcccaagtagctgggactacagacatgtgctaccatgcacaactaatttttgtatttttagtagagacagggtttcgccatattgcccaggctggtcttgaactcatggcttgaagcaatccccctgcctcggcctcccagagtgctgggattacaagtgagagccactgcgcccgttgtagttttctttttttgatgtgtctttgtctggtttttgggatcagggtaatacttgcctcgtagaatgagtttggaagtattaccttctctattattgaaaatagtttgagtaggattggtattagtttttctttaaatatttggtagaattcagcagtcaagccatttggttctagacttttctttgctaggagactttttgttacaggtttgatctcattacttgctattggttggttcaggttttgtatttcttcatgcttcagtcttggtaggttacatgtaacaaggaatttatccatttcttctagattttctaatttattgttatatagttgctgatagtagccactaatgatcctttgaatttctgtggtattggttgtaatatctcctttttcatctttgattttatttgtatcttacctttttttttttctttatctggctaaaactttgtcaattttgtttaccttttcaaaaaatcaatattatttcattgatcttttgtattttcttcatttcaatttcatttatttctgctctgatctttattatttcttttattctactgatttcagatttgcttgctcttgcttttccagttatttaagatatatcattaggttgtttatttgaagtttttcttatttttgatgtatttgtttatagctataaacttagttataaactcccccttagtcctgcttttgctgttttggtatgctgtttccattattatttgtttcaagaaattttccaattttcttcttcttcttcttcttttttttttttttttttgaggcggagtctcgctctgtcgcccaggctggagtgcagtggcacgatctcggctcactgcaaccactgcctcccgggttcaagcgattcttctccctcagcctcccgagtagctgggactacaggtgcacaccaccacgcatggctaatttttgtatttttagtagagatggggtttcaccatattggccaggctggtctcgaaatcctgaccttgtgatccgcccccttcagcctcccaaagtgctggaattataggcatgagccaccatgcccagccctccaattttctccttaatttctttattgatctactggtcattcagggacatattgtttaattttcatatgttcccatgttcctcttgttactgatttgtagttttattccaccatggtcagagaagatgcttgatattatctcaggttttttgttgttttttttttttaatgttttaagacttgttttgtgacctaacatgtgatttgtccttgagaaagatccatgtgctaaagagaagaatttgtattctgtcgccattgaatgaaatgttttgtaaatatctattaggtccatttggtctacagtgcagattaaatctgatgtttctttgttgattttctttctgacagatctctccagtgctgaaagtcgggtgttgaagtctctaccttttattgtgttggggtctatctttctagctctaataatatttgctttatatatctggatgctccagtgtttggtatattaaaatttacaattatatccccttcctgaatttaccatatatcattatataatgacctcctttgtctcttaaagtttttatcttgaaatgtattttgtcggatataatatagctactcccgcacttttttggtttccatttgcatggaatttctttttccaccccttcattttgtatttgagtgtctttatgggtgaagtgtgtttctgtaggcaatagatcattgggtcttgtttttttttgtttttttttttttaatccattcagccactctatgtcttttgattggacaggttagtccatttatattcagtgttattattgataagtaaagactttcttctgccgtttcttattgttttctcaattgtggtcttccttcttttctattttcctgtcttttttttagggaagttaattttctatgatggtattatttaatttcttgcttttattttttgtgtatctgttgtatgttttttgatttaatgttactatgaggcatgcaagtactatcttataacgcattattttaaactgatgacagcttatcactgcttgcataaacaagcaatcaagaaaaatgaaaactaacaaaaactctacacattaactttacccccttgctttttaactttttgttttttctatgtatatcttattgtactgtcaatgtcttgaaaagttattgtagttattgtcctagattggttcatcttttaatctttctacttaagagtagtttgtacaccacaattacagcattacagtattctgtgttttttctgtgtgcttactattaccagagagttttgtaccttcagatgttttcttattgcttaatgtccttttctttctgattgaagaaattcctttagcatttcttttaggacaggtctggtgttgatgaaatctctcagattttgtttgtttgggtaagtctttatttctccttcatgtttgaatgatattttcacaggatatactattctagggtaaaaggtttttcccttcagaactttaaatatttcatgtcactctctcctggtctgtagtttccactgaaaagtctgctgccagacatattggagctcccttgtaagtttatttgtttcttttctattgcttttaggatcctttcttcatccttgacttttaagagtttgattaaatttcataagattgtcttctttcggtcagatctggttggtgttctgtaaacctcttatacctgaatattgatatcttactcctggtttgggaagtcctccgttactatccttttgagtaaactttctacacctatatctctccctgcctccactttaaggcaaataactcttagatttgaccttttgaatttattttctagatcttgtagatagatgtgctttactcttctcttttttcttttgtctcctctgggtgtgtattttcaaatagcctgtcttcaacctcctgggttcaagctgttctcctgcctcagtctcccgagtagctgggattacaggcgtatgccaccacgcccagctaatttttgtgtttttagtagagacagggtttcgccatgttggccaggctggtttcgagctcctgacctcaggtgatacacccaccttggcctcccaaagtgctgggattacaggcgtgagccaccgcacctgaccatttggttccatttttaaagggattggggaagggagatgaaccatgccactccaaggagatttagttctaagactattgttaattattgggaaagaaagagaaccaagggaaataaaacctcagtaagaagactgttgttcttttcataaaatcaaatgtttttaaaagcctaattttattagcatttggtgcttggaccattctcttgaaaatgctgaagaaagagacatatgatagccttagtttttgtatcctgattctgtccttttgaccattccttaatttccttttcaggtttctcttataatttgattagcctaactgctttcttcactgtagttcagttgcagttctagctctgggagtcccccctaccccaacacacacacaatgttagcttatgtattttaaatgcttctcaatgtgtttatatgggtaaagatgtcccataaatgtccctaatttcccaaattaccatcttcatctttctcttcaaattcattttttttagtccatttcataaatgattgtaccattgtatcctctcagtgcttcaaactatttcttcctgtatcttaaatctatttagttatagaatattatttctgtctctaaaataaaatatttttagaaatctgttactcttttcagtctgacttttactatctcaggtcatgcctttgtgatttttgtcccaaatgccttaaataattttaaaaatagtggtgctaaatagtgtttacctattttgtaccccaaatcccccaatccatagtccatgctccattcatttttattttccttaaatgcacacttgagattttatttttccccaggtgtatttaagtctttagttgtatttcatgctcccagaataaaagattaactccctagaatgggcattcatgatctagccatattctctatgtatttttgctccatcctttcaaaactactcatgttcctgaacgtatcatacttttccttatttccatgttgttgcacaaggtggtgtctatttctgtgattttctttcctgcttcttgtatgattggcagaatccttctccttctttaggactctgcttaaaaatcgtttgtactgtgtcccttttcctttcattgtgaggcatgttaaccctaccctttccatagttttaaagttgtacctatcccttattttataattgtttattgctgttcctctttcccactatcaccacaagattccttgagaatgctattttcctttattcatctttgaaccttgagtcgctagcacaataatttgaacataaatgttagttaaagaatgaaagaaagggagagggaaggaagaggattgttatgttgaccaaattatatgcataggataaaatgaaatatatatagatttaaataggcaagtaagaccaatttatgacacctggtttaagccacatacatatccgcaaggcataggagtagagaacaccttgattgataatcccaataaactatatgtgattgtgaggcagtgggcacgagtctgggttctgtcaggttgtcctgtgtagaactggtggaagcccacacagaactggaataagaaacaatttaggcttacctggagagttagggttgtctgggacaaggggaaaggaatgcttgagagtatcatctactttgacacaggaaaaatgacacaggaaaaggctcttcataaaagataaagcagttgtttttagaatatatactcgttggggatactaacttcatgggctacaatgttgaaacaactagggttttaagtcatcaaatatgaggagtttcatctatagcaaaatgttaatattgattaataaaacttccttttcttctccctccttttttgttgatcctacagtgtccccagtgattctatattttttatataatccaaataaagactaaaggaatagcatacataaaatagtattaccctgaaacattggaaactagtccagaaaacagttttacctgtcattagtaatcacagtgtgtcttttattgagtactatttggagtattctttgatttgaagcatactttacaataactacttctggatgaaatggagctacactttgtaataactgcttggaaaattaaagacagatataataatatatttatacatttattcaacagattttgtattttttaagtgccagtcactgtgcttggcattggatgtaatttgaacaatacaaatggtctctgatatgaccttgcattccatccgaggaggtaataagcaaataattacattattataaatgttaataacaaacaaggtaatgtgatataaaagaatgggaaaacctaatttgatagggtgttaagagacagggctctctgaagagatcatagagaagtgatctaacctgaaggggcagcgaagaatttgatatattgaagggtagctggagtatggtcaacagggagagtgccactggatgagaattcagagagaggcgagaatcagcttgtatacagctttgtaggctatggtgagaagtttggatttaatttagattggtaaagcagtgtttaggcagaagaataacttaatctgatttatcctctaaatgcataaaatctgtagatgtctacatatattgagtgaagggcttttttttttttttttttttttgagatggagtctcactctgtcacccaggctcaagtgcagtggcgcaatctcatctcacagcaacatctgcctccagagttcaagtgatactcctgcctcagcctcccaagtagctgggactacaggcgtgtaccaccatgcccgactaatttttgtatttttaatagagatggtgattcaccattttggccaggctggtctcgaactcctagactcaagtcatccgcccatctcggcctcccaaagtgctgggattacagatgtgacctgctgtgcccaaccttaagtttttattataaaagtaattatatctttagtaagtaggttttggaatattaaaatatggaaagcagaagaaaaataactcaccaccaaatcacaaaccgcttgaaatttttttaaacatatatccttctaggtttttattctactgatacttatttgacatttattaaattgtatttaaaatctctgttaatgtcacaagaatgttatcattatcacatattcttcacaagtatctttaaaagactactaccattttgttacatggctaacaccacagtttgttgaaccagtcctcagttttggacctttagatggttctatgggaaatttttaatattaagcaatttatttccttagcatagatttctggaaatggaattagtaaaaaggtattaactttatagatgcaccatttattaaatagggaatccttttcccgttgcttgtttttgttgggtttgttgaagatcagatggttgtacatgtgtggtgctatatctgaggcctctgttctgttccaagggtttatatatttgttttggtaccagtaccaggctgttttggttactgtagccttgtagtatagtttgaagtcacgtagcgtgatgcctccagctttgttcgttttgcttaggattgtcttggctatatgggccatgtgaactttaaagtagttttttccaattctgcaaagaaagtcagtggtagcgtaatgggaatagcactgagtctgtaaattactttgggcagtatggccattttcgatattgattcttcctgtccatgagcatgaaatttttttccatttgtttgtgtcctctcttatttccttgagcagtggtttgtagttctccttgaaaaggtccttcacgtcctttgtaagttgtattcctagccatatgcagaaaacagaaacttgacctcttccttacaccttatacaaaaattaactcaagatggattaaagacttagatgtaaaacccaaaatcataaaaaccctacaagaaaacctaggcaataccattcaggacataggcatgggcaaagacttcatgactaaaacaccaaaagcagcctgtaatcccagcactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcaggagaatggcgtgaaccccagggggcggagcctgcagtgagccgagattgcgccactgcactccagcctgggcgacagcgagactccgtctcaaaaaaaaaaaaaaaacaaaaaacaccaaaagcaatggcaacaaaagccaaaatcaacaaatgggatctaatcaaactaaagaacttctgcacagcaaaagaaactatcatcagagtgaacatgcagcctacagaatgggagaaattttttgcaatctactcatctgacaaaggtctaatattcagaatctacaaggaacttaaacacatttacaagagaaaaaacaaataaccccatcaaaaagtgggtgagggatatgaacagacacttctcaaaagaagacatttatgtggccaacaaacatatgaaaaaaagttcatcatcattggccattagagaaatgcaaatcaaaaccacagtgagataccatctcacaccagttagaatggcgatctttaaaaagtcaggaaacaacagatgctggcgaggctgtggagaaataggaacacttttacacagttggcaggagtgtaaattagttcaaccatcatggacgacagtgtggcaattcctcaaggatctagaaccagaaataccatttgacctagcaatcccattactgggtatatacccaaaggattatgaatcattctactataaagacacatgcacacatatgtttattgcagcactatttacaataggaaagacttgtaacccatccaaatgcccatcagtgatagactggattaagaaaatgtggcccatatccacagtggaatactatgcagtcacaaaaaagaatgagttcatgtcctttgcagggatatgaatgaagctggaagccatcattctgagcaaactaacacaggaacagaaaaccaaacactgcatattctcactcataagtgggagttgaaaaatgagaacacatggacatggaggacaacatcacacaccggcacctgttgggaggtggggggcaatgggagagaaagcattaggacaaatacctaatgcatgtagggcttaagatctacatgatgggttgataggtgcagcagaccaccatggcacatgtatacctatgtaacaaacctgcgttttgcacatgtatcccacaacttgaagtaaaattaaaaaaaaaaaaagaaaaagaagttctgagcttttcattgtcaaagctgtctataattatctttattattttagtagtgtatattgtgattataaagtcagaggacaactttggaacatcttaaagcattaattactgactcatagtttgaggttaccattacatcttcctggtggattctgtgacaaatgagaaataagacacataagtcagatagaaggagataaaatgttaacttaggccgagcactgtggctcacgcctataatctcagcactttgggaggctgaggttcactttgggaaggatcacttgagctcagtagttcaacaccagcctgggcaacatagtgaaacatcgtctctgcaaaaaatataaaataaaaatagccgggtatggtggcacccctgagcctgagatgggaggatcacttgaagatgggagattgaggctacagtgagctgtgatcatgccactacactccatcctgggcaacagagtgagaccctgcttcaaaaaagtaacaaaaggaactcttctgtttttaccaacatatttaccctttgttcttcattccttctgtagaattaagtttatatctagtataatttcctttcaatctaaagcatttatcttatagtttattgtagcacaaattttctgaagacaaattctatcatttttattttgtcttcatctttgaaggacattttcaatgggtatagaaatctaggttgaattttttaacatttaaaatattctattattttctggccaccattatttctgatgagaaattatccttatcgtgatttccttatatgtattgtgtcttttttttttcttctggatgatttaaaatttttttctgtgtttggttttctgctatctgatgatgatatatctagatctggtttctttttatttattcttcttggggtttgctgagcttttttaatctattggttgatatatgtcagtttgggaaatcgtttttcacctctgatattatatttttaaaaatctaatattttcatttcactcttttttatactttctctctgctaaaatttcccttcaattctaacatattatctaccctttttaattatttgacatctatattattattagagttgttttaaagtccttgtttgataattccaatatctgggccacttctgggactggtgtattgattgtttcctctttttataatgagtcatttcttctggcttttttatatttcacagtagtttttaatgtaatgtcaaatgttgtatataaagagaatggagcctatgataaataatgtttatgtccaaaaaaatacatgcctcttcttttgtcatgatattagtatagttccgttggatctggtctttggcttttattccatacttgagctgtatcttattcttttaaaatttatattaagttcactacaggaccctgtgttttttgagagcaagattaggatctttgtttttgtatggtttgtagtttctgcttagttctcctgatacaccttcagaattccacatgccttgttcacttgtgccttagggaggtatctctcttagtgcttctttctttctaccagacacagattgcccttcctggtactcagtttaaggtttagagtacgcatgagatttcttttcattctcctgcttcgcactcagactttattcgtatctatgggcctgcacttcaccgggggtctttctcatctctccagccttgcttcttgtcattctcatgaacaattgatcgacacctgtggaaaatagatggcaagtgggtgggatcccctgtgtctagagttctcagtgattctaaactatcatgcatcccccaactgggtcttttgacatttttttaaaagtgcagttattttcttcttatcaactttcttctccttatcctactctgccaagaattatagccactattcatttcttctctcctataagagacctttgacttttatagtttttattcattggattcccttaggaactctgctctgatgaaagctgaaaagctttgatagattacatggctcgttgttgctacaatgggatagaattcccttgcaatttcctacatcctacgagaagaggaagtaatgagctaccatacgcacataccatacatgtatgtattgtaccatacatacataagctacaaatcttatgattgatttatactaaatttgacaattcccctagataaagttgctagtagttggcagctcatcactgctcttgcatttcttagtctctgattcccctcttgcctttatacattacctttgtttttgaagtagtgattcttctttcatttatttttcttgttttcttaactgtttagccaaaattatccaaattattcttaaaaaattagagtagcacataatttcttaggagctatacaaatctacaaatttctttactatagctgcttagtagaaaaatagtgagttttaacaacttagatgtaaattaatatgtttgtgtttttttgtctcgttcattggtttaagaaaaaacacaggatactttttcctaatataacttgatatattataggacagtctcattggctggcaagcttctatagctgccaagaggcatgtatgtttaattttaatactgtgcatcttcggtctctaactcttatttcggctctcattcttcagcgtagggtgtaactgcaaatgacagtggcaccctgatttaactaatgggtgaaggctgagaagaatgtggataagtgagccatttgggcagtgaggagagcagtaaaccacacttttctcattagttgtctcccaggctaaaattaaacagaataaaatactgccaaattttagtgatctatggtggatgtggtctgtgtcaactcaatatcaaactaattacccagatatttatatgttagaacttgtgtgctatttttaaaggttggtatcttgtgaattgagtatatgatgaaaatctctctctaaattaaagagaacattatctctaaattgtaatttcaaccaaattgatgttaaatcaatgaattaccctcttttatcatctataacattcgtaaattttaaggctggctgtaagtcatgaggtcgtttttggtataatgtaatcatataacttacataggttggtgaagtatttttaactttttaattataataaaataagaccttcaagtttaattttccatttgaaaatatttattatatttgttttccgttttctctctctaaaatctcaaataaaatggtgtaccaatcacatgttgagaatttgtttgaaaattcattgaacacatttagttttagacatatctgaaaagacttctgtaacaatttgtacaatatggaggttatctgtaatttcttaacatacttgcatcttgtccagtttgcatacatttaaatttatatgccattttgtttactaggttttgaaattttttcatcataattaaaaaatatatagtatataatatggcctgtacttagatgcataatctaaaagaacataatcctgagttatttaaaaaatcaactcaatatcttttttctttctttactgttttttcaatgtaacattaggtatgtataaaaataggtaacatatatgtaagtattgaattaaaattatataatgaatatcatttactgttggctgagaagttggtcataaatttatttgcttttatagattctttccttaggtgatctgtctttttgagtacttttctgatcttctctttatcttcacttgtttacagcttctttttttgcttagtgtagatttattttaattatccagtttagggtttattgggcctcctagatttaaggtttactatctttcaacatttctgtaaaatactcagccattaccttttttaaaaaccatattgtctcttccccattctctattatctctctcgagcccaataagacatatgctatgtcttctcactcagacctctctatctctaacttcattttaaaagtttcattatttttcaatctgggcttacatcctaaactatcttgttatgtatcttccatttccttaattctctcttcaactgcatctaatgtgctttttaacatgtttagtgagttttgtacttcaacaatttgtcatttctgtgattttcatttttctttaaaatctacttgttgctgatgctttctcatagtttatcttcatgatttcataagtgtgtttttaaacattttatacattatcaggggaaccagcccctgataattcaacgtaggttcttttctattttccctaagtgttggctggtcttagaaataaagagaaaggctacaaaagagagaaatattaaagctgggtgtctgggggagacatcacatgttggcaggttctgtgatgccccctgagctgtaaaaccagcaagtctttattagcaattttcaaaggggagggagtgtatgaatagggtgtgggtcacagagatcacatggttcaagggcaacaaaagatcacaaggcagaaggtcagggtgagatcacaaggtcagggtgaaactagaattactaatgaaattccgtgtcccgctgtgcactcattgtcattgataaacatcttaacagggttcaagaggagagaaccagtctgactagaattcgccaggctggaatttcctaatcctagcaagcctgggggcgctgcaggaggccaggacgtgtttcatcccttacctgcaactgcataaggcggacacccccagagcggccattttagagccccccccccccggaatgcattcttttcccaaggctgttaattattaatattccttactggggaaataattcagtgatattcctcttacccgttttcagtaataagagaaatatggctctgtcctgcccggcccacaggcagccagactttaaggctatctctcttgttccctgaaaatcgctgttttcctgttcttaaggtgcccagatttcatattgttcaaacacacatgctttacaaacaatttgtgcagttaaagcaatcatcacagagtcctgaggcgacatacatcctcagcttatgaagatgatgggattaagagattaaagtaaagacaggcataggaaattgtaagtattgattggggaagtgataaatgtccatgaaatcttcacaatttatgttcagagattgcagtaaagacaggcataagaaattataaaagtattaatttggagaactaacaaatgtccatgaaatcttcacaatttatgttcttccatcagggtttcagcaggtccttccatttggggtccctgacttcccgcaacaatacatagctgttttatattctgtattctaataccttcagtgcttgaggatataaatgttttgttcattaatatttttgactcttattaacagtggtttattttctgcacttcttgctgatttttttgttatgggaaacataaatgacagatcataatttatgggtgtcacataacaatgaattggagactttctcaaagtgacaactttttttctgcttttttctcatgtctagagctaaggtcctcaacctctgggccgtggaccagttccattccatggcttgttatgaactgggccacacaaaaggaggtgagcagcaggcaagcaagcattaccacctgagctctgcctactgtcagatcattggcagcattagattctcaaaggaacgcaaaccctattatgaattgtgcatacaagggatctagattgtgcatgcttttatgagaattgaattaatgcctgatcatctgaggtggaatggtttcatcctgaaaccattcctccaccccccaaatccgtggaaaaattgtcttccacaaaaccagttcctggtgccataaagactggggattgttggtcttcacaagaaagtctaaggctcatctatctctctttcctggtgtcccaagtttcagaatcccagttacatttttttttggcggatgggcgggggggcaacagaacttattttttaatgtttccttttctagctgttactagtttcacaaattttcaggaattattttggtgtttatttctgtattttaaaataacatagcttttcttggtttttcctgaatattcattttggagcattatttattgacttcttactgtggaaaataataattggctatctttcactttctccaaccttcatcacatgttcttatttgctcatactcccaatattattatatcctaaatttgattgattacattgtttattcattatttcagaatttatatcattccatttattaacactattcacatctaactgaggatcacttttgtcttctgaatccaaagtcttctttcttcgtgtaattcacttttcttttagtgaatgctttctttattgtattttatgtggtatttatatgatattagttatagaacaaattacagttcaaggggctcatttgacagaaagaaattcatagtaatttaaatctaattttaattttatttatctacgtaggttttagaaagatcttttaacccttgagattgaattatatattcctgaatttaaataaaccttttaaattctctaaatcttgttcagttaattgctttaaaatcaaaaggtcttaataaacaatttttcatattgggggaaaattctctttcttacatagtaactttttcgggagaatgagttgttataaaataagaatacagtgcaaattaaatcttactgtatatatcgtactactttattcttgttagtctgtggagatgacagtctttgctgtagtagagctgccagaattgtttgaaaactggatatcatattgggaaagtcctatttatttctcttaatatagtatttttatacctttattctgtgtataagtgatacttgggaagtagaagaatttaggtccttatgagaaatttgcaatctatgaaagtaagaaatatatgttaaattgtatattatatattaaattggattttcagttgactttaattatgactcccattttgcaatcatcttgtgtttgcttagcttttctgtgtctttcttttctgacatctgcttgagtgaatcattgctcaacagtacacatattggtccttgggagggcacatgcttttgttgtctgagcatgctgcctaaggatttatactggttctgggcccatggaaaaaatagaactacatggtagaataggagtatacatggcaaattttggttatttgaagattctgtggaaagctttgaaaaaaagataaatttctttttctcttactttttctccttcatccttttatctgtctttttatatatcagtttcatagggcttgttattaatagtaattttcccaatttaaataatctataacattatagaacaaatgtactattttcagttatcctgagaaccagctatggtttattctgacatatactttttgtagccccctaccatcaggcagatactttttctttcttttttttttttttaaaaaaaaaagacttttattttaggttcagggatacaagtgcctgtttataatataggtaagcttgtgtcatggggatttattgtgcagattatattaccacccaggtactaaaaaataaaccaatggttatttttatctgatcctctcccttctcccacccttcaccctccaccctctgataggccccaatgtctgtttttctcctctatgtgtccatgtgttctcatcatttagctgccactaataagtgagaacatgtggtattttgttttctgttcctgcattagtttgctaaggataatggcctccagctttatccatgttcctgcaaaggacatgatcttgttcttttttatggctgcatagtattccattgtgtatatgtaacacatttccattatccagtctgccattgatgggcatttaggttgattccatgtctttgctattgtgaatagtgctgtggggaacatacgtttgcatgtgtctttacggtagaatcatttatatggttttgggtatataccttgtaatggggtggctgggttgaattgcagttctgtttttagctctttgaggaatcgccacactgttttccacaatggttgaactaatttacacttccaccaacagtgtataagtattgccttttcaccacaatctcgccaacatctgttattttttgacgttttaataatagctgttctatctggtgtgagatggcatctcattgtggttttgatttgcatttctctaatgatcaatgatgttgagttttttttcatatgcttgttggccatatgtatatcttcttttgaaaattgtctgttcatgtcctttgcccacttttcaatggacttgcttttttttttcttgtagatttctttatgttccttatagatgctggatattagatcttggtcagatgcagagtttgcaaaaattttctcccattctggcattttctcccatgccattcccattatggcattgtcatcatgaaatctttgcctgttcctgtgtccagaatgattatctacattgtcttctaggacttttatagttttgagtttttatttaagtctttgatccatcttgggttgatttttgtatatggtctaaggaagaggtccagtttcaattatttgcttatggttagccaattccagcaccatttattgcgtagggaatccttttccccattgcctgtttttttcaggtttgttgaagataagatagttgtaggtgtgtggtcttttttcttggctgtctattctgttccattggtttatgtgtctgcttttgtaaaggtgtcatgctgttttggttactatagtcttgtagtatagattgaaattgggtaatgtgatgcctccagctttgttcttttagcttaggattgccttgactactcaagctcttttttcatttcatatgaatttttaaatagttttttctagttctgtgaagagtgtcattggtagtttgataggaacagcattgaatctgtaaattgctttggacagaatggcccttttaatgatattgattcgtcctatccatgagcatggaatgtttttccatttgtttctgtcatctctttgagcatgttttatagttctcattgtagggatctttcacctccctggttaactgtcttcctaagaatttgattctttttttggcaaatgtgaatggattgcattcctgatttggctctcaacttgacagttgttagtgtataggaatgctaatgatttttgtatgttgaatttgtatcctaagacttcactgaagttccttatcagcttaaggagtttttaggccaaaactatggtattttctagatacatattttcatgttgtctgcaaagatagtttggctttctctcttcctatctggatagcctttatttctttctctttcctgattgctctggccaggatttccagtactgtgtctgatagcagtggtgagagagggcatcttgttttgtgccagttttcaaggggaatgcatcagcttttccccattcagtatgatggcatatttcctatatgctacgggtttggctgataacaaaattgacaaatatcccttcccttatgtttcatatatcctagtggagctaataatatttgtattaaaatatatgtacaattacagaaacttatttacagatgtatataacccgcacataaattgagaattgtatactctgctttaggtaagttctattcgaactacttttcatcagaaagggacaaaaataggttagttagttggttggaattgcagcctgttacacttccgctttgtgttttatgtcagaatgttggcctgcatttaatctaggctgccctttctctttgcttttgaacattaaaagttgtaatttttaatgattttttgaatgattataataccttctttcaaatcatgaatcaattttttaatataatgaaaaagttatttaggaatattttacctaaagtattccattttcagggccaatataaaaattgttctttgcctaaaaagttgagcttattattatattttatggacaaatgtacttttaatgagatgtaattcactttctatacaattattttatattgtgtgattcaatgttttatagtatattcaccaggttgtacaatcattttctaatttcagaatatttttatcactctcaaaccacatagctcttagcagttatttctactctcccctctcacaggccctggtaaccacaaatctactttttgtctctatgtttttgcctcttctggcaatttcatataagtggaattctaaaatatatgttttctttgtcaggcttatttcacttaatataatgttttcgagattcatcagtgctgtagcatgtatcagtacttcatttctttttatggataaatacttttccattgtttggaaataccacattttgtttattcatcaactcatggaaatttatattgatttcactttttggctgttacgaattatgctgatatgagcatttgaatacaagtttttgtgtgggcataagttttcggtgcccacatttcctcaaaaagacatatagttgcagtatgacccagttatgccatagtattttccaaagtgggtgtaccagtttacattcctaccagcaatgtatcagggtttgcattcctccacatcctttccaacgcttgttactgtttgtctgttatgtcatagctatcctacatggtgtaaagtgacaaatagcttattgttttttatgaggacttatgtaacagtttaaaaatcttgtcttttaggtgctgtacttctttgcagtatacaaggactagcagttaatattgacccaatcttatatacgtggctcatctatcagcctcagaaacgaacaagtagacatatgcaacaggtaagagatttttaaataattttttctgttaacaaatatttttcttattcatttagtagaattatatatgtcttttgatggattcttttttaacaaatgtactagatttcctttgtctccccaccttacccctttcaaacaattccgttcccttatttttgtatgagaaattgcatgtcagtataaagtttctttgattattaaaggggctttctgtacaatggcttacaaaacagaaactagtttaggagtcctatttcaccagtcttcattctttcatagtgtctacatgtccattctcatggtgtgcaatacataagaattgctcagtaaatgaatgttggcttgtttgttttgttttgagacacagtttcactctgcctcccaggctgaagtgcagtggcgtgatctcggcccactccctggttcaagtgattctctcgggactacctcccgagttcaagtgattcttgtgcctcatcctcccaagtagctgggattacaggcatgtgccaccatgcccagctaatttttgtatttttagtagagacagggtttcacctgttggccaggctggtcttgaactcctgacctcaagtgatgtacccacctcagcctcccaaaatgctgggattgcaggtatgagccacagcgtctgaccagcttttatttttatctctacatttccttgtcatatttaggttttttcaacaaacatgcatcgaatacctaatcctgggattgggatggttggtgcaaaaaaggttggaatatgtgtttgtttaaaaaggtataaattagaaagtagtaagtaggcaattatagtttctagaatacttaaacataattctgacagttttattattttcgttttaaagatgaagaaactgatgcttattgagattcatttatgtatagtcacacagctttaagtaaatgacagaactaagaatttttgaggccaaattcgtgctttattgaattataatttcccatcaacttaagtataattttgcaatatcctatttggaatagttttgtatcgtttttctgaagtaacttcaagctagttgatgggagaagaatacacaattttataattatgtaagaattaaaaagtttaacaaaaaagtactaaggagcaccttttaaaggtttttcttcactttgtcctaattttatttgaaacttctgccatacctgtccccatttttccttttaatgagtagttacagaatataaggcagtatgctgtacaccatggccacagaaataaaagtcataggtgagaatatccctccctctgagagtatttagtgtatttgagaatcttaagggatatagtaatgccatttttagtaattaactatgtagatgtatgtccaggattatgtgaaaacaagaggaatagttctcacaaccagggtagtgtgtgaaaaggaggaattaacaactaagctgagtattctaggagtgagacagacagagaaggttgttttagactgaactgtttgagcaaaggcaaagaagatgcaaaagcatgacaagaaagagacttcagtgattccagaatggagtcaagtgtgttcttgtagagactaggagaaattggaaaccaatttctgaaaaaaaattttgaatttgtagtcctaggtatttgagacttcattttgaagggtaaagaggagctataggaaattggtataaacagagctggattttagaaagtttactctagcagaatatagagaatgggtgatacagaagttagactaatggcagtaaccagttgggaataattttcattgtaaattcttgattggttattctctaagtaatacagttatttccagtgtaccatagatatccctgaaggtcaagtagagtgttctagcagcttaagtaaattagacattcatttaattgataccaagcatattaaaatattttgatttttaactttttaaaaaattataacttttaaaatgaacatacaatcacgtgccccttaatgatggggatacattctgagaaatgcatcattaggcaattttgttgttgtgcaaacatcatagagtgtacttatacaaacctagatggtatgacctgctagacatctgggctataatccatctctggtatagcctattgctcctagggtacaaacctgtacagagtattactgtactgaataccttaggcaattgtaacacaaaggtaagtatttgtatatctaaacatagaaaaggtatagtaaaaatatgccattataatcttatggaaccaccatcgtgtatgcaatccattgttgactgaaacattgttatgtggcacataattataggtatatttttcgaattcagaaataatggctttatttagaagctaaactacttgcaataccaatactttgggaggcaaggtgggagaattgcttgagcccaggagttcaagaccagcctggggaacatagcgagactctgtctttacagaaaataaaaattagctctgcgtggtggtgcaggcctatagtcccagctacactggaggctaaagcaggaggattgtttgtgcctgggaggtggaggctgcagtgaacaatgatcacaccactgtactccagcctgggcaaaagggcgagaccccatctctaaaaataataagaataaaaggtaaactaacaaataccataaccccactcattcagagttacaaataatgttggagtatatgtctccatacctaaatctttgcattcatctttattgacttggaatatatttttacaagtgtaattagtagcactaggcaagtattttgcattttagaaacatattttaagacttttgttgtatcaccaaattgcttccaaaatgggtataaaatttgcattttctttttcctttttcttttttttccacacaggttcttgctctgttgcccaggctgaagtgcagtgctgtgatcacaggtcactgcagccttaacttcgtgggctcaagtgatcctcttttctaagcctcctgagtagcagggaccacaggcacccaccaccatgcctggctaattaaaaaacaattttttttgtagaggtggtgtctcactatattgccccggctcgtctaaaactcctaggttcaagtcatctacccacctaagcctcccaaagtgctgagattacaggcatgaaccccatgtccagcccagtttacattttgaacagcagttgatagcattgttattttactacagtttggcatacttaaaaatatactttaaaaaatgttcttaatctactattttactcttgaatgttccccctgccccaccccaccatggaaaatcgagagaattgcatagttgagccatatgtttccatacccaggttcaatatttattaagtcatgaccactcatccttttaaaatctgttaggtgaaaaaaaaatgccgatatacaagtattggtgaaaatgtagagaatgattactattgttgtgagtgaaaatttgataaatttgtcagtatctaataaaattgaaaattagccaacttataaccccaaacttttacttcttgatgtaggtatgctcttagagtgaaattcataaaagtaaggaatactgtgtaagcctgctgttgtgtaatcattacaataatgtgaaaatttgaaaacctaaatgaaaatttgtaagaaggttgataaagtatgaaatattcacaggatataacatttattaaaaattatacaatagaccttagtatggatgtctcaaaaattgtagttgatgcaaaagcaatttcccaatgatgtatgcaatatgagggcacttatatatatttttctaaaactgcccttaatgtgtgtctgtaagtgaatgcaggtgtaaaaattaagttgaagcatttgtactaatatcataataatggttgactctgggaggaaagggcagtaggttggcactcaaaggggattttagttttatctataatatttttttaaaaaagcaaatatgataaactgttaatagccattaattattggtcataataggtatgttgtattctttgtaaccctctagtatttttttaatttgttaaattaataattagtgaaagatggttacgttttataggatgcagctatgaaaagctttaggtattttgggattatgggacatttttgggttaaagatagaacagatctgagactagattgcaactgaaatttgagaagagctacagtaccagaaggaaaaagaatatacacagggtaataggaggttgttaaaaataaatactacttattttgatgtttttgaccaaggtagccatatttctagaatagtggaggaaatcactggtcttactccttatttggtatcacttaatgcctgacatgcagcatctttattagcagtcattcaacaaatataggtattttgtatacagctgtgtacaaggcatacaagagccttactcttgtgttagaaagtggttttgtttggccttggccttttaattcttgcctgtgtgaaaatacactcagagttgactgggcacagtggctcacgcctataatcccagcactttgggaagctgaggcaggtggatcatgaggtcaggagttaaagatcagcctggctaagatggtgaaaccctatctctaataaaaatacaaacgttagctgggcgcagtggcaggtgcctgtaatcccagctactagggaggctgaggcaggagaatcgcttgaacccggagggcagatgttgcagtgaaccaagattgcaccactgcactccagcctgggtgacagagcgagactctgtctcaaaaagaaaaaaaaaagatacactcagagctttagctgcccaaaggtattttttgtttgttgtttagtattgtcagtaccacgaaaatttattggatctataaaattttatatggatttataaaactttgtgctttcattagttgcatctttcagctattgtgcttgaatttacactgtatagcacataaattttctctagttacttattatatagttgaccctagaaacaatgcaagggctagggacaccaactccctgcttggtcaaaaacccgtgtataccttttgagtccccctaaacttagctaatagcctactgttgatcagagaccttaatgataacataaatagttaattaacacatattttatatatgtgctatatatgttattcttacattaaagtagataaaagaaaatgttattaagaaaaccataaggaagacaaaatactatataggacgaaagtagatcattcttgaaggtcttcatgttgaatagtagactgaggaggaggaagaggaggggttcgtcttgtctcagaagtggcagaggtggaagaaaatccacatgtaagtgaacttatgtggttcaaacttatattattcaagggccaagtgtatattaattttaatcctgaacttggttgtacctttttagagtttggattgtattccaggaatataaatggacaaaaattcaaaggattatggagtcactaaatattagagtataagaggttttctagtccaccccccctccttatgttttagatgaggaaatttaaatgcatcaaaacttaacaatataaggagcatatctcatctaggtcttaaaaatggtttccaatttagatttgtgtattatcagtttgactaaataccaaatataaaagcaggcactctatgttatgatgctttcgataatttatttaatcttttctcattttaaatttttttttttttttgagatggagtctcactctgttgcccaggctgtagtgcagtggcatgatctcggctcactgcaagctctgcctcctgggttcaagccattctcctgcctcagcctcccgagtagctgggactacaggcacccgccaccatgcctggctgattttttgtttttgtatttttagtagagacggggtttcaccatgttagccaggatggtctcgatctcctgaccttgtgatccgtccgcctcagcctcccaagtgctgggattacaggcgtgagccaccgcacccagcctctaatttcttttccttttttttactcagtgtgactagcaacttgtaaaataatatgcccttttccatgtttcagaacatgattgattttattacatagttatataataaacatgttttcattgaaatacttttttataatgtacattatattgagtattttaagttgggtgaggcttaaggttggatctataaaactttggttgtggtactgaagataaccttagactacactgcagcctgaccaaccgccaccagattcaccatctgatacagctgtgttacagttatcatctgttgtttccaaagctaaaatttccttctcaaactgtggctaaaacgcaacgtttgatgattgttttccacccacttcagcatttatctttgatcctatggcaaacttaaaactttttttgccaataatatgacaaaattgtattgggcatcatcatcagtaacatcagactttatttcagtgaataaagatgaaacagctgctttattgtccagctcagccctcatgcattcaatagaggatcataatattttccagctttctctaactagttatttttctgtgctttctgaatatgctatggatatcttttgtcagacaaaacgtagagattttcagtattcttcaaaaaagttggactatccatattaacatgtacataatcagtttgtaaaagtatgtttctaaaaacataaggattttttttataaggatccattttataaggataactttataaggatacttttccattttttgaaaacataattttcaaagtgaattttaattttaacttgctctttccatattattttaatacttcttactaaaacttacattttctgggtacttacaggctctttggttttcactcagaattttaatttaaaatttaagtggataagcattgctctgtgtgtgcatgtgtgtctgtgtctgtgtgtgtgtgagagagagagaaaaaaaaaagcggggctgtggggacagatgagggagggagagattgattgatttacaataatgaagtctcagccccaacttgtgaaggactgtcctcagtattgccatgtttaacctttgctgcttaagaaatagtgaaaaactaaaaactaaaaaggttttcattttgtctctttccagcagcctgtggtagctgttcctcttgttatgccagtttgtagaaggaaagaggatgaggtgtctattggaagtgcccccttggcaaagcagcaatcatatcaggcctctgaatatgccagcagccctgtaaaaacaaaaacggtaacaggtatgtgtcaagtactgtaaagggactatgattgtactctacttctaagctagcaagttagcatccacaatttcatggatgctggccaaagacatgagactcattgagtggagacaaagaactttattatccacaacattagcaataatcacagtattagcatttttttgtgttagtgccctgagcccagtttccataaggtggcatgaagagggccaagaattctgaatttagggaacttgaaccttttataatggatagaaagcatgcctgccctattctccagagggaggcgctgtgtctcctttgcaagggtgtgagcccacttgccctttgcacagaagcaggatcgtatttctatcttctgagactgttcgctatgcaaatatccttaaaaacacagtagggaacaatgacaatcaccacctctacttaaaagacccatagagaattatctctcaatagtatgttccttctttaagtgaattcttgaaaacgacagtacaccttaatcatctttcctcccctttctctcatactctctgctagatcttctatgtaaatataaagtataactatccttctataaaataatttatttccttttgtgtaataaaaagaattttacatatataattcatcaatatataattaaaaaaataatttttatgattttattttgtgatttgttttttcttcttaacctctaatttttatgatgattggctacttttctttgggtaattttatgtcttttctttagctttatttcttataacgcagatattcccaaccacattgataaagattttatagtttcagtaaatcagaaccatctatcaagtctgttatgggcaagactctgttctaagtgaaattgagggcagaaatattaagaagatccctacccttaaagaatttaaaatataatcatatatgcaaggaaattcaaattagctattgtagtatttaagtcgtatttaacaaccaaaatgctaaaataaatttgtttatggtattttatacataagtattattattttgtgctttatgatttttcctaaaatatgacattaattatgtttattttgtggaatcattagtcttccacctgtccatagccacaagccttttactttgttgagattttatcaattgacaaaaatgcctgtgcctcattttgtatcacaaaaagattatatagtttgtgttgagttttgattataaaattaaatattctttcctttaaatgtcatgttaagtttaagagttagagtttaggttttacataaaggtttataattgagctgttaatttacataaaggtttataaacatcaccttttagttaagaaaataaatgtccattagtgaaaaaaaaatggtaagaattaccttacatgcatgtaaaccatatatttaaaataatggttaaggataattaacggtgacagaaaatgcttataatgtaaatgaaaatagatgatatagaactatttagaatatgcaatcacagattttgaaatgcatctgtatatgcgtggaaaagtttatatgtaaactcataccaatcacatatcaattcataaatgatatcagttgatctgataattattttgccttctttattatactttatgtttttataagaaattaataattgttagtgagggaaaataagctgaaaacataatttctcatcattaattactttataaaatatgaaaacataaacaacacattttttaaattttaaattattaatctgaactatggttcttttctttagaattaaggataattgcattttatgtctttggtgttcccccacctttagaaccatcagatatcctatagatattcttcttatagataaggacattattatttcaccaaatgtatattcttactcaagcttgcataaaaattaataggcatccaactaatgcttgtgattgccctgtttggtgactgtgagcagtcaccaaaggtaaaaggccttgagtataacatttattgtttatgaattctatttctttccctttgggtgcccactatttttaattctctggggaacttggcagtggtactcttcttgataatactctgtcctaaacattttctttacctagaattatgttttaacactttgttttatttttaattaaaggatacagtcttcttttttagaataaaaatatattttatgatttcttagagtgagtacatacatctaaatgtagttatcaatcactgttttaattattatttatattgcatcataaattataatgagtttgttaaggtattcatagtcttttgcacatctgcctaccttttttggttgttggtttttgtttgttttttaaccatcttagccattttcagtagcattaggtataaatcagtagcattaggtataatcacattgttgtaaaatacacattttattttttaactacatgttacagtggagaaatgttaatgttcattttatttctgagttcttattaaaattattttttaaatttatatcatcacagcctatggtccaatgttgattttaagttcatccccaacaagttatatatagtggttttgacacatgaatacaaagacctgctgatactgcactgggtttgattttgctttttaattattcagttagaagcagaccttttcctcttccaaactcagccaatgttaagtggctggctacagggggacctgtgcttgatggctcggaatgtgttaacagcagaatgccactatttcaatgatatagtcatgtagggcagactgagccagaataaaaacttgctgttccacatgaagataatctattatcacagaattctaaataatcttccagagaatctgtatatccttcaaaacaatgaaacccctaagagctatgccatttgtttaccctaggttttgaaatgttataaaccttaatttggaattcttgatgaaaatgtctgtgatggagatgaaaacttaacaagcagaatactccataaatgatacttaagagatataaaccattttatcttacaagtttatatattacttctcacgtcaacataataaatacagttaaaataatagaagccttttaaatttaagacaccttgactattgctaagatagtaataaatgaagacatgtgataatgatgtagatttggtagataatactataaattcaaaatatagaactttagcttctggccatgatagagtaacagggtttagatttatattcctgctgtaaacaactaacaaactggataaaatatatggggaaaattccccagtttctggacattggacaataggcagtgcaggagtgtgattcctcatagaaaggaaacaaaggtgagtcctaggatttccctagctttctgcctcaaggcaagtttctgaatacagggcagaataggacatctcaaactgagctcagcagtctttctgagttgtagagacaggaactgaagttaagggaggcagagatgactagaaattatggaataaaattccagagatgaagaaagctatgcagagaaagagcccctgggagcaacaatagagttcttgagagtttgctgaatagcaagacatgaatgcatggcgatgagacctcacagggtttggcaaggaataacctcggagctacgatcttaatgattcccatccttacacagggtggaaggcattgaagttcctactgtccatcatatataattctcattggttatttaggacattcagtggagaccagaaggtctaggcctcagtagtggggctaaactatctatagagtaaaggctaccctagactcaccttaaacaagcttgtaaatcagcctctgaaggaaacaaaatagtgagtaactgttactgttaaaaggaatacaatactattgtagcccaacatcattaaaaggaatacaataagatggagacatacaacaacttaaatataacagttgcaaacattcaataaaaaattactagaggtgcaaaggagtgagaactacaaacaggagagaaactagccaatagaaataggctgagaaatgacaccaatgatagaattagcaggtatattaaatacctatatgttaaaacaggtgtcataactacgttgaggtatttacaagaagttggacacattgaggagagaaattgaaaatatataaagagccaaactcaattctacagatgaaaaataaaatatctgaaataaaaaaatttagtggaattagatgttgagtagtagatattgcaagaaaaagaaattaattaacttgaagacatagtgatggaaacatgccaaaatgaagcacaaagagaataaaggaaaataaatgtacagagccttatcgaaccgtgggatgataattaattatggttgtgagggtagggctcactgaaagttcacatttgaccagatacttgaagcaggagagggagtgagccatgtagacatctgtggataaatgatttggaattatctatgtatctgtatctatatgtatacatatatatatatttagaaataaatgatacactgtaaccctttcattttataattaagactattgagtcacaaagaggtcaagcaacttatccaaagttaaaaagatatttattgagactttttaaaaattgaaattgccagactataggaagagatcaagcaacttatccgaggttaaaaagatatttaatgagactttttaaaaattgaaactgccagagtataggcactttgcgattatttccttcttccactctgaatatttcctgctttctttctttcatggcattggcagtcctgcaaatcaggtctgtgcaaattttgtcatctactatttcatctctaatacctaatatatagccagccaacttcagtgtgtttttttttgctaaggaattactctaaatttgcagccctgtcccgtggcactaagatagtgaaagattttgcatcagagttaccaagatagatactactgggaagcaccttttatgatcgtgtttcataatggcattgatggttccacctttctttatttgagtgccacttcactgatgcacagttaagttcctggatgagactcaaaagtgaaacactactgttggtatatattttttggccttgatatatccttaaatatattccagaatactaaggcttctaccaaaatgaaaaaaaaaatgatccttcagatgtttccatttttatcaggcatatggaaaatctatcttttatgcctaggtctccaagagaagtaaatatgaaaaatcttgaaatcttaaaaagtacattgtttatattacagataataaaaggctttagattattgttacttgtttttaaagaatctgtctttggagaatcatctttggttattgagtagaatatttcttctttatttatttatttattttttgagacggagtctcactctgtcgcccaggctggagtgcagtgacgtgatcttggctcactgcaacctccacctcctgagttcaaaagattctcctgcctcagcctcttgagtagctgggactacaggcacgtgccacatgcccagctaatttttgtatttttagtagagacggggtttcaccgtgttggccaggatggtctcgatctcttgacctcgtgatctgcccgcctcggcgttccaaagtgctgggattacaggtgtgagccaccacatctggcctgagtagaatatttctaattacatttttttgctgacctcatttcaaggtgtaatattttaaatttatgccgaagtttaataatatattgtttaggcttaagtttggctgaaaatatcagactactctaaataacagtgctttaaacaagatccaattttgtctctcattagaaagtttaagcacgcaccctaaagctattatgatctttcaagatcaggaagctttttattctactttgagtggccttcattgccaggctttcctcatggttcatgatggtggcttcagcagttaatcaagtctgcatttcagtgagcataaatgagtacagtgaaagaaaaaggtgctttctgcctcattaagcactacccagaagttgtacaccccattttgtttatatactcttgactagaagctagttacatggtcctgtctaactgcataagaggtcttgcaaatgtagtatgtaatctttaaggccatgtacctggctacaacttgtatgttctaactaagaaagaaagggagagtggatagtagagattatttagctgcttccaccatagtaacttaaaatggaaaatcaaaagctgaattttggaaaaaaatagagaataaaaatattttccttttagtatgcacatcacaagacaaagctggttaaaaaaatgtttttagtgttgcttagatatttcacagtaagagatatagacttgggagtcatcaacatatggatcatagtggaagccacagagtggttgagatttctcaggagaccatacagagcaggatgagaagagagtgcaaaattacattcaaaggaactctttaatggtagagtaaggagaaggagccaatggagggagttcagaagcatgattatgagaagtaggcaacaaagctacatgtatatgtgtgacacaattccaaagagttgcaagaagaaggtgcatgacatgctgtagaatcatcaagaacaatgaggctgaaaaataggctgttagtctgtggtcagttggccagaggacctttagttgttaaggaatggatgtgaattgaagaaggagggacaacctatgtacaccaatcattcaagaaatttgattatatagtcacttggggtatgtgtatagcaatagagatgtaaagagacaaggagacaaaattggagataccacaaaggctgaggataatttatacagtgagatcataggtaagcaagatataaaacccatgcacagatgtgagacttaacgatcaggaaaaatcatttcttctttaagacagaggtaagaagataagactatgtatcattatatattcatttagttatttttctttccacaaacaagtatttaggtgggacaagtattttttttttttttgcactgttttagagaatctaagagatcaaaaaatgtataattttctcatgacaagcctcctatttttctcatacagggaaccagtttttcaggttaactttggaatgccctggctgagaagaggggttcattcagatggttagcgggccctaaaattttattttttctttacaaatgtcatttgaaaatattaaagcatgaaggtagacactattatataatatgcaatttattttatcagggataaaagatggttttaaaaaattttactactttggaacagaaaaaggttgaaaataaaataaagtctatctaatgaagtacatctaaagtaaaataacttgaaaatgtaattcagaaagtcgtcagagaatttaatgaaaatatatgtttactaagttgttttgtacattgtaagaaaaattatttttatttctaaatcaaaattcaagggaaaaaagtattagtctgcagagcttaaaatgatatacaaagttaaaattatttcataatttgtttctgcactattctaggtaatcagcataatttataattagacaatatttctaagattaattttctaaaggacttcaacagatgctagatgattatttgatatgttacccatattgtagatgattgtagccgtagacttcatttccttaactctgtttttttaatgtttcatgttttatgaaggtaatagtttatgaagatgataaatatgaattatctctgatgatagctatcactttcataaacatgaagcatccttcggtcatctcatgacaatcttttatagccgtatctatcaaatgcattacttagttgacatttaccacatatttgaatttcttgcattgctagtgttcatatgaaaactcctgaagtgaatcattagctcataaagagatgtaattacactttatttagtatgtctccatgtgtgccgtgcggagtattttatcattggtatttgatgattaattctaacaaagtgttcagtttgttaagcagactgggtttatctatttttatttttaaatatactacactttatttaacatacatataatgtcctatcttgttggatcgttttcttgagagagtagcaattattccatatttaatttttaaaaaattcttggtccttacatctttggctcactttttatttttctaggattgtaaagcagatttatttgtgtatggtttcttctaatgtgttcaagttttgctttctatttttactttgaaggtagagcatagacttcattaaattttctcagaagagaaagctttagaaggtaaattatgttgaaaaattgcttctacttctgtaccctattggagttatttgacttccattactgttagcactacctcactcccgtcccacttttgaacatgctggcccaaacttggaacaaaacaacaaaaagagggagggggaaataagaacccccatccccaccccaaaacatggtttcttggtttccttcagcacagctgaggcaggctaacattttgttaaaagcgttactgaatactaagaaggaataaattagaacaaatacagaaaacataaactatttaaaaatagttaaccctaaaatagtagtcttcaattgtttttcttagtgcacgcctaccagtaattttttgagcaagcatccatagtagttattgatttatacattaactatatgtatcactatttaatgtaataaagcgtgtaaggttattttaattttattattatttaagttgtactattcagatggaattttaatacatcagtaatgtttcagtgggtataatattgcatggtattacttttttttgtttttgtttttgttttgtggcggagtctcgctctgtcatccaggctggagtgcagtgcgcaatctcagctcactacaacctccacatcccgagttcaagcaatcctcctgcctcagcctcccaagtagctgggattacaggtgcccaccaccacacgtggctactttttgtgttttttagtagagacagggtttcaccatgttggccaggctggtctcgaactcctgacctcaagtgatccgtccatctcggcctcccaaagtgcttgtattacaggcgttagccattgtacccagcctgtatggtattactttttaaatatttgtttaatactttgttataacaacttataagtttaatttttaattaagtttattccaattgttggttttaatggctgacataattggaaagctgcctcactgagatacatcatattgaagagatgaaaagggcatcattgactgtactcaggatacttatttttcagtcccatctattttgcaaaggtttgctgacataaggctagtaaattttcatcttccttgtaaaatgagttatttcaatttaatgggatagtattgccttttttattcaaataaattagttttgtctttaatccatatttttgagtgtgttttacaggaatatttttaaagtgtgtatacaggttatgagtattaatttagttaaaataataaaatttttaaacctgattaactgtacatggtaaattgtaatatgccacaattaactgaaaacaaatgaaggattgaagagcccttggcaattctttcttgttgttgagtgttcctgttcctttgtatacttaacatagtgttatctgtggccttctgacatgaggaaggactccaatgatagtctactgtattaaatattaataaactatggctgggcacagtggctcacacctgtaatcccagcactttgggaggccaaggtgggcggatcacctgaggtcaagagtttgagaccagcctggccaacatggtgaaaccctgtctctactaaaagcacaaaaattaactgggtgtggtgacgcgtgcctgcagtcccagctactcgggaggctgaggcaggagaattgcttgaacctgggaggtggaggttgcagtgagccgagatcgcgccactgcacccaacctgggctacagagcgagactccatctctaaatacataaataaataaataaatgtgtttctcatttttagatgaaagttagtataagtggatattctcatgttggccaggctagtctcaaactcctggactcaggccaggaacaccctatgggtgttcttgtagctttgtgcaccacatattttggagaatactgttgtgttggaatgttattatctgaaagtttagcattacctagagaaaacctctcatgtaaagttcagatatgattatcctgtggtgcagattcactgtgcagtggttaccaacttgtccagtgagacagaacacactcacatgcagtgagttacatgaagcagatttatgactatgctcacaggcatcaagggacaatagaagcctaggattcagtgtgatttgtccccttcatgtcccccagactccagaaaggtgctcaggttaaatggtgtctcatctgtgtatgccgcacttgcactacacctgagggtccctggaagacatctctctctgggttttatattccatggtgatatgacttgctggctaaagcattacagtgtactgtttctggtcgggactggaacagaacttgagctgttttggtcagtcccttcctatcttaagatgttgtgttgtacaattattcttaagaactacaagtgaaaaaaggaggagaactgggtggtccaaggccaccagagcactgtcctgcagatcccaaggagccaatttaaactaagaaaggtattggctgagatagtgaaagaagtctttcctccttctgatcagaggagtaaaaagaaaaaaaaaaatcaatagcatcttcaaatctgctggcttaggcagataatcagtgggataatgaccagtgaatatactaatagaaggactgagagtcaggtgagctaggaaggcaatgaagttgaacagctcttgaagaagtaagcctgagaaaggagggaaataagtctcatgatatgcttaaagcattgtgggatctatgcagtctatgcaatgatgttgctagggcagggcacatacaactactaaccaattgcctggtattccccaaattgataggtgatttctttactagcgaataaacattcctaaattaaattagaaaggactcttcaattgcaagagacaggaactatattcaaatgattttcagtttgaaaaccagttgtggcagactacttattgaatcccataaccaaaacggtaaaggcaaagatggatcttttcttcggaatgacttagaaccagagattccacattatcaggatgccatcttttcatgttggtttaaccttctcttactgaacacagatttcttgacagttttgtacatggctggggtacctctgaactcacatacttaattctctatgatcaaagaaaaacaggtcttatccagtgcctattgaaaatgtaattgaagcactttaagaggtcgaggtgggcagatcacctgaggccaggagttcaagaccagcctggccaacatggtgaaaccccgtctctactaaaaatacaaaaattagccaggtgttgtggcacatgcctgtagtcccagctaatcaggaagctgaggcaggagaatcgctcgaacccgggtggcagaggttgtagtgagccgagattgcgtcactgcactccaacctgggtgacagagcaagactctgtctcaaaaaaaaaaaaaaaaaaatgtaattgaagaggattttgcttgactgtcttaaatcatgtgccgacctcttggacagtcactatggtcaggaaggttaggtactatgattggcccagtggcagcccaggttgggtcatgtattcacccctgtgttctggggcatgagatataatgccagaaaaaatgcaagaatagtagaaacatggctcatgaggttaactccagctattccagtttgtacgtactaattttttattttacaattagtcacagcaggtttaaaacacattactgttttgataggaagatggtaaattgattatgaaggtattagtcacatgaactagggaacgggggaaaaatctggaaggaaaagacatgagatgcataagacagattgcagactttacaacaggctttgttttagtttttttaaacacagggtttattcaactgagggaaaggaattacgatatgtttttgttgtgtgcagttttgaacaatacagttttgcttagcacaatgtattaatttttcaacttcatctgtttcattacaaaggttttttcccaaggagccattaatttgaattatcataatatgtgatttgaactgtaatgtcacttaattttaaagttctttgagaacacattgcaatgttaatatgtgaacgtttttcaaatatagagttctttggaaataagtgtaagttattctagtttttacacagactggcaagaattcagcaaaaattcaaccaatttttttttacagtcttttcacccccttttagtagtcagaacaagattatagtttccagatgaaattctgaatgtcacatagtgatgacatacattttcctggttggctcagcatgagatgcaattttgtatgccatgtcacgctgacttgcagaatccaaaagctgttatttcccaaggggctttcaagagtgatagtattaaatgcaggtttattttgatgaaaagtctcatgcattattgcagttctgtggcaagtttcttaaagctttgaatattgtctaacttgtagaaattttaaaaatagtactacataaaggtcactttctcttcaagttatttaaatttatattgccaaatacagttgccaaaaataatgatgagtgtaaaatataaatcaagaattaggaaggtatagtatataaaccagtagcttagggaccaaaacacctaagtttttatcttaccctaccccatgttaagctaacatcacacggtcttgtcttcttcatttataaaatgatgataagtttacccagcaatacctcaagtaaagtaagatatgtgaaagttctttaaaatgataaaacacaattcagaaggtgaagatcatatttttgatgtttgaattttaaagggaaagctgtagacttcaagcatggtgaagcttattttgactaataagtttctagccttgtggtaaaattttattctttcttttttcctttggatcttaatcatctacaagttgccttaaatctcagtgtatcagtacagatgcctacataatgaaatttatttcacactgatgatctgccttcttttttagacttgtctaactgacctgctctgttataccagtcttatttttttttctcttttttaaaggtgcctcatatccaactgcctacacatctctacttaggtattatatggggtgctcaagcctaacatgtcttgtttcatctgccttcctaaatttatacaactgtgtacctttccccgaaccttcattcaccatgatgctcaaggctgagacctaggattcatccttagtgtctccctttcctgtccattccacttccaagttgtatcttgaatctttttgtctgttcgtatgccacaacaaatggagccacatcattttttgtacagagtaatgtaagtatatgctaactagtcttactggtgccatttggtattatattatcctctgatctcagttacctcaattcattgttcacatggcagcaagagtcatcttattaaaaacctaaattagatcatgtctctccctgcttaatcgcagtagttgcttcctattgcacttaagatataacccagacttcttaccatgctctacacagttgaatcttatctaacctccattaggttctcccatggcatctttgtcatttttccttacatggatcctgtttcattttcttatatacttcatccttttttttcttttttttttttccttgagatggagtcttgctctgtcgcccaggctggagtgtagtggcgtgatcttggctcactgcaacttcccacctcccagtttcaagcgattctcctgcctcagcctcctgagtagctgggactacaggcacccaccaccaacaccagttaatttttgtatttttagtagagatggtgtttcaccatattggccaggctggtatcgaactcctgaccttgtaatccacccaactcagcctcccaaagtgcttggattacaggcgtgagccaccatgcccagccgctatatacttttcatactgcaggtcttagtttagatgatcaataaaaaaacttctgtattccctaaaataggtctgtaccactcacccaggattctttaacacccctttctatccttagaacacttatcatgtatcctgttcttgttttttttttttttattctctccttctctagaatatatctcaagggctatatgtgaattgttcatttttgtattcccagagtctaatagccatttctggtattgagcaaatatgtattaaatacttgttgcatgaatgaattaacctttttgtttctcgttatttttattcagagatgtaaaactctcattccttaatcttttaaacccctgttctttaattgatttaagttgatgtcctataacttttcatatctgttctggtttctcacagatatttatcaaatattcagaaggagttagcagctcatggcacaatttcacttcgtgtgcataatcttccagtgtattcctgctacatcagaaatttagatatattttaaaatgttgaattattataagaatgatccaagtacaatgcaggatattaagataaaattttacctctagtcagtgttctccactctgtgctagtgggttggggaattgcaggtaatgtatgacatggcttctgttatgatgaactttaggttatatctggagagagaaaagtaacgtacaaatagtagactttagagaactgaggaaaattgagtggaaggaatcattactatagattttaggaattagaaaagttttcattgagaagaccttaggataggtgttagatagggtttgtaacaatcatgaaggtgctttcatttggatgggaacagcagagagaagacactgattggagtaaagagtctttagtggaaacagtggaaaataaagttgaacagagtttcagagaatcaagaccaacttatacagggctttgaaaaccatatagagaactttgactttctaccagagattcattcttaagtagtatcctatagctgagaattgtctgtaggatggaactaaaggaggaagacccttttcagaactgtgagtaaatctttatagtgatgaacattttcaacaaattggtagccagggaaacaaagaagaaagtacagatttaggttatttctgaaactaaaaattgactttttttcttaccctttaaaaaaggtatatgtaaatttatgtttatttcttttgagagagtcccaagtcatttttaggatcatgaatgataatagcttctttttcatagtcatacatatgtggtttagaataaagtgagaggtcatcagtgcttctacaattattgtacgttctacattatgatacaattttttgctatccatctatttctctccttataatgagagcccctcagagatgtgaccccagtctctttgtttctccatgacctagcacaagtaggcactcagttatacttattgaattgaactaagcgacttttccatagctcataagtcttggaagaggccagcattttcctttatctcattttcttttctttttttttgcctattaattaattagtttatttttttatttttttattatactttaagttctagggtacatgtgcacaacgtgcaggtttgttacatatgtatacatgtgccatgttggtgtgctgcacccattaacttatctcattttcaagtgttttccaagccacatcaacagaatgtaagaatgcaatgtaataagattcagaagttggcatctgtttgactttatttctgctgtgctgctgaaattttaaaaatctttttgtgatcttctaaagacatgaggaaatgggggattgagagaaaggtgatgaggatgagattcccttctgctatgttcttcaacctgtattcttgccaaaattcttctcttcatggactagcaaggaggacaatatggctggtgcagagagagcactgggaagagggatgtaagaggaagtaaaaaaagacaagaggaagccagatcctgtagggacttacaaatcattgtaacgactttgactaataaaagtgagcaagatgggatggcatttaagggttttgagtagaggcatgatataaccttttttggctattttaccaatattaatcttgatgctgtattgagaatgcactgtagggagaaaagtgtagaaggagataagccgggtgccatatggctcttggccatagtgtatatctataatcatggtaactttgccaggtagtattactagaggatgcaaggtcaaattcaggatctattttaagatagagccaacagattatagtaattttcaggatgtatggtgtaacagagaagggtcatggttttgtttgtttgttcgtttgtttttgcagccagaaaggtggattaggtatttattgaaacttggaggactataagatgaagagcataggggcttttgagaaagagactcaagagttttgctttggctatgttaaatttgaaattcctattaactatccaaatggagatgttcagtacgcagttggataaatagtctggagcttacaggatagatccagacaattccctggaaatagaatcctcatagaggatacttaaagccatgacattgagtgagatcctctaagaagaaagtgtttgtagagaagagaaatggcccaagtactgaacccttggacatgccagcattttgtggtctggagaatgaagaattaccaagaaaactgagaaagagctacaactgaggtagaatgggaacatggagatggtagtgttcagaaagaagtgaagactgtgttttaaggatgtggaaatgatcaactttttcagattcctctaatagttcagtgttaaacaatggctctaaaaaactaccacagaaattttagtgactcaacatagcagaattcatttctagttctaggaaagtccattactgagtccacagtatgatagctcttctccaagcagtgaatcagccaccttccatttagccactctgaggatccttagggcctcagattcagaaaagagttttaggaagataaagattttgctgatgacatatcatgagttctagatggcagaatggaggagattgcagtgtgtggagtgagagatgaggtcaggtggggattgcacaggtctgtttagtgatgagaatctgggtgatgaggggtattgttagaattttgggtttttcctgatggctgatgtaaacagaatacaaatggcataaaggaattagtactggggtttctaatgcagaattaggtggcaaggctgtgagtattggggctggagggatgtggtctttaatccctctgggattacaggcatgagccaccatgcccagcctgaaacaagtttgaagatatttaaatcatacattcagtaaatatgtacaattgtatacttagtggattttttaaatatttgcaattagatatgtcaaattaaattaccaaaaaataatcaaatttttaggcctggggtttttctttggattgcaaagacccccacaaaataaccaaggatcataactttctttttccgctctccacttacaggaaaaacaattaaatgcagatcaagtaaacatatttaatggatttatttaagttaacatccggactacatgctggcgtcataatagattcaacttacaattcttgtatcaggaatcaaataagatgagaagagttttgagtattagcaaaacaactcctagttggtctctattttcactctcttcctcttccaattatgtatcctttgtgttaatataagaattttcacttcataactcaggaatggaaaaccaaatactatatattctcacttataagtttgagctaagctatgggtatgcaaaggcatacagagtggtataatggacatgagactaaaaaggtgggatgggggaatacttgggtgacaggtgcactaaaatttcagatttcaccactctaccatttatctctgtaaccaaaaaccaactgtatctctaaagctattgaaaaatttaaaaatttgttaaaaataaaaagaactttcacttctaaaactcaaattttattacacttaattgtttaacagttttcactatctcttggtaccttcaggatgaacttcatgtttctttgcaagatatttaagaccctgcacaagtaggccttatcttgtctttctggccttacctctagtataccagttgcattttttgtgtggtatacttcactcacactaaactacttacaatgcactttgtgaatctgtgcctttgtgcatcttctttctgtctgctagtccttctgtctttgatttaagaattctttctcaaacaaactccatgttacctcctttgtggaatctttcctgccaatatttgagtgaattaattcaatcttgctgtgttaccagaattatttatttatttatttatttatttatttatttatttattattataatttaagttctgggatacatgtgtagaacatgaatgtttgttacataggtatacacgtgccatggtggtttgctgcacccatctacccgtcatctacattaggtatttctcaaaatgttatccctcccctagcctcccaccccacgatgggggccagtgtgtgatgttcccctcccagtgtccatgtgttcttgttgttcaactcccacttacaagtgagatcatgtggtgtttggttttctgttcttgtgttagtttgctgagaatgatggtttccagcttcatccatgtccctgcaaaggacataaactcatccttttttatggctgcatagtaatccatggtgtatatgtgccacattttcttaatccagtctatcattgatgggcgtttgggttggttccaagtctttgctgttgtgaatagtgttgcaataaacatacgtgtgcatgtgtctttatactagaatgatttataatcctttgggtatatacctggtagtgggattgctggatcaaatggtatttctggttctagatccttgaggaattgccacactgtcttccacaacggttgaactaatttgcactcccatcaatggtgtaaagtgttcctattctctgcatcctctccagcatctgttgtttcctgactttttaataatcgccattctaaccggcatgagatggtatctcattgtggttttgatttgcatttctctaatgaccagtgatgatgagcttttattcatatgattgtaggccgcataaatgtcttcttttgagaagtgtctgttcatatcctttgcccactttttgatggggttgtttgttttcttcttgtaaatttgtttaagttctttgtaaattctggatattagccctttgtcatatggatagattgcaaaaagtttctcccattctgcatattgcctgttcactccgatgatagtttcttttgctgtgcagaagctctttagtttatttagatcccatttgtcaattttggtttttgttgccgttgcttttggtgttttagttatgaagtctttgcccatgcctatgtcctgaatggtactgcctccgttttcttctagggtttttatggttttcgtcttacatttaaggttttaatccatcttgagttaatttttgtataaggtgtaaagaagggcccagtttcagttttctgcatatggctagccagttttcccaacactgtttattaaatggggaattctttctccattgcttttttttcaggtttgtcaaagatcagatggttgtagatgtgtggtgttatttctgctctgttccattggtctatatatcagttttggtaccagcaccatgctgtttggttactgtagccttgtaggatagtttgaattcaagtagtgtgatgcctccagctttgttctttttgcttaggattgtcttggctatgcgggctcttttgcagttccatatgaaatttaaagtagtttttttataattctttgaagaaagtcaatggtagcttgatggggatagcactgaatgtataaattactttgggcagttgaccatttttgtgatattgattcctcctatccatgagtatggaatgtttttccatttgtatggaatgtttttccatttgtatgtgtcctctcttatttcgttgagcagtggtttgtagttctccttgaagaggtccttcacatcccttgtaagttgtattcctaggtattttattctcttagtatcaattgtgaatgggaattcccgcatgatttggctctctgtttgtctgttattggtgtataggaatgcttgtgatttttgcacattgattttgtatcctgagactttgttgaagttgcttatcagcttaaggaggtttttggctaagctggtggggttttctaaatatacaatcatgtcatctgcaaacagagacaatttgacttcctgtcttcctacatgaataccctttatttctttctcatgcctgattgccctggccaaaacttccaatactatgtggaataggagtggtaagagtgggcatccttgtcttttgctggttttcaaagggaatgcttccagcttttgcccttccagtatgatattgactgtgggtttgtcataaatagctcttattattttgagatacattccatcaatacctagtttattgagagtttttagcatgaaggggtgttgaattttattgaagtcctttgctgcacctattgagataatcatgtggttttgtcattggttctgtttgtgtgttattgatttgcgtatgttgaaccagccttgcattccaggggtgaagccaacttgaccatggtgtataagctttttgatgtgctgctggatttggtttgccagtattttactgaggatttttgcattgatgttcatcagggatattggcctgaaattttctttttttgttgtgtctctgtaggttttgatatcaggaagatgctggcctcataaaatgagttaggaaggagtccctctttttatattgtttggaatagtttcagaaggaatagtaccagctcctctttgtacctctggtagaattcgtctttgaatccatagggtcctgggtttttttttgttggtaggctattaattactgcctcaatttcagaacttattattggtctattcagggattcaacttcttcctggtttactcttgggagggtgtatatgtccacaaatttgtccatttcttctagattttctagtttatttgcatagaggtgtttatagtattctctgatggtagtttgtatttctgtgggatcagtggtgatctcccctttatcattttttattgtgtctatttgtttcttctctcttagttatttcttgtcttctgctggcttctgaatttgtttgctgttgtttctctagttcttttaattgtgatgttaggatatttattttcgatcttttctgctttctcctgtgggcatttagtgctataaatttccctctaaacactgctttagctgtatccccgagattctggtacattgtgtcttagttctcattggtttcaaagaacttatttatttctgccttaattttattatttacccagtagtcattcaggagcaggttgttcagtttccatatagctgtgtggttgtgagtgactttcttaatcttgagttctaattttattgcactgtggtctgagagactgttatgatttccattcttttgcatttgctgaggagtgttttacacccagttatgtggccaattttagaataagtgtgatgtggtgctgaaaagaatgtatattctgttgatttggggtggagagttctgtcaatgtctattaggtctgcttggtccagagctgagttcaagtcctgaatatccttgttaattttctgtctcattgatctgtctaacattgacaatggggtgttaaagtgtcccactattattgtgtgggagtctaagtctctttgtatgtctctaagaactttgtatgaatctgggtgctcctgtattgggtgcatatatatttaggatagttagcttgatccctttatcattatgtaatgcccttctttgtctttttgatctttgttggtttaaagtctgttttatcagagactaggattgcaacccctgctttttttttttttttgctttccatttgcttggtagatcttcctccatccctttattttgagcttatgtgtgtctttggacatgagatgggtctcttgaatacagcacactgatgggtcttgactctgtatcccatttgccagtctatatcttttaattgtggcatttagcccatttacatttaaggttaatattgttatgtgtgaatttgatcctgtcatcatgatgctagctggttattttgcccattagttgatgcagtttcttcatagtgtcaatggtctttacaatttggtatgtttttgcagtggctggtactggtttttcctttttatgttttatgcttcgttcagaagctcttgtaagtcaggcccagtggtggcaaaatttctcagcatttcctttctgtaaaggattttatttctccttcgcttatgaagtttactttggctggatatgaaattttgggttgaaaattcttttctttgagaatgtcgaatattggcccccattctcttctggcttgtacggtttctgccaagagatccgatgttagtctgatgggtttccctttgtgggtaacccgaactttctctctggcttcccttaacattttttccttcatttcaaccatcattatgtgtcttgggtttgctcttctcaaggagtatctttgtgatgttctctgtatttcctgcatttgaatgttggcttgttttgctaggttgaagaagttctcctggataatatcctgaagactattttccaacttggttccattttccaggtcactttcaggtacaccaatcaaatgtatgtttggtcttttcacatagtcccatatttcttggaggctttattcattccttttcattcttttttctctaatcttgtcttcacactttatttcattaagttgatcttcaatctctgatatcctttcttctgcttgattgatttggctattgacacttgtgtatgcttctcaaagttctcgtgctgtgtttttcatctccatctccatcaggtcatttatgttcttctctaaactggatattctagttagcaattcctctaaccctttttcccggttcttagcttccttgcatttggttagaacatgctcctttagctcggaggagtttgttattacccaccttccgaagcctgcctctatcaatttgtcaaactcattctccatccagttttgtttccttgctgcaaggagttgtgatcctttggataagaggcattctggattttgtaatttacagcctttttaggctggtttttccatagtcttcatggatttatctacctttggtctttgatgttggtgacctttagatggggtttctgtgtcaatgtcctttttgttgatgttcatgctattcctttctgtttgatagttttccttataacagtcaggctgctctgctgcaggtctgctggagtttgctggaggttcactccagaacctgtttgcctgggtatcaccagcagaggctgcagaacagcaaagattgctgcctgttccttcctctggaagcttcatcccagaggggcacccaccagatgccagctggagctctcctgtatgtggtgtctgtcgacccttgctaggaggtgtctcccagtcaggaagcacgggggtcggggacccacttgaggaggcagtctgccccttagcagagctcacacactgttctgggagatccactgctctcttcagagctggcaggcaggaacatttaagcctgctgatgctgcgcccacagccgcaccttcctgcaggtgctctgtcctagggagatgggagttttatctataagcccctgactggggctgctgcctttctttcagagatgctctgcacagagaggaggaatctagagaggtagtctggccacagtggctttgtggtgctgcagtgggctcttcccagttcagacttcccgatggctttgtttacactgtgtggggaaaatcacctattcaagcctcagtaagggtggatgcccccgcccccccaccaagctccagagttccagcttgacttcagactgctgtcctggcagtaagaatttcaagccagtggatcttagcttgctgggctccgtgggggtgggatctgctgagtgagaccacttgcctccctgacttcagtcccctttccaggggagcaaatggtctgtctcgctggcattccagacaccactggcatatgaaaaaaaaactcctgcagctagctcagtgtctgcccaaatggccacccagttttgtgcttgagacccagggccctgttggcataggcccctgagggaatcaccaggtctgcgggttgtgaagaccctgggaaaagcatagtatctgggtcagagtacaccgttcctcatggcacagtccctcatggcttcccttggttaggggagggcattccctgaccctttgtgcttcctgagtgaggcgatgccccaccttgcttcggctcaccctccctgggctgcatccactgcctaaccagtcccagtgagatgagctgggaatctcacttagaaatgcagaagtcacccaccttctgcactgatctcgctgggagctgcagacctgtgctgttcctattcggccatcttgccagccacctgtgttactagaattttatagtgcagtatttgtcaaaccaaatgataatcatagtatttaattaagtttatatcttatcttcatcttgtaagctcttctagggcagggattgtgtcatatttttaagcccttactgcagagccctagtatgtggtaaatggacatttaataagatttgtagttgaggatgaacaaaattactttctacttttccttcctttctggccattttttctcctttttctttccaaaaaagcgtagatgtgaacattcaaattctagtagcaatctgattaaccaaagtattttaatttatatttttataagctccctggattatatttagtttctccccgactccttataaataatgataaaagccaaagagtgggaagggtgctattgaaaggcgaacataaaatattgacaccaatttcataattctacataaaaatcagctttattgctttatagtcacactttgaataatttgttcttcttaatgaatcttagttctgagtataaaatattggaaaacagtgacagcctgttgcagatataagcaaaaaactacctctctcaacctaaaaattcttactgcttcttaaacatctcatgatatgctatctggaagtgctttagctcatttactcccctgttcaaattttttgttgttgtctatgtgatttgttttggaatttaggccaggagaaaggaattttaatggtctcagtggattaatttggtaatctatatataacttgaacattgaattctagagacattcatatctttactttgctatttataacaagacagtgttaatcagtgtgctcactctttctcactcactttctcattatctctctacttcttttctcctctttattccccttaccttactttgtttcttgtttttttttcttgacagatttcagaattcctgccttgccccatgactttccattgagatctaggtagactgtattgtttatatcctgcaaattatggaggagaaacaaacctaaatagttgacgtgattttaagatcacatatcttgaattggtagaataaaaaaagaaacctaggttttctgagtcctcccagtccatgctttcaggaaacttttatttaaatatattaatctcactggtatctgaaattctgtcacaaagagttttttgattttttgtttctattttaaatctcaaagcttcttcaaataagcataagcttcatgaggactgggattgtgtttgttttgctcaccacagaatttccagttcttaatctaagccttaagaagataataggtactccataagtagtttttgaatgatgttttttgacatgttgaaattaggggatagtttaattttccatccctccctcctttcttcttttcttcttattttttggtgagctacattttctgatttttctcctattagcccatattatttatctaataaaagtattttaaaaactataccatatagcaatagatatattgtattttaaaaactataccatatagcaatagatatatgaacagttaacactttatcatagttttctttctttctttctttctttctttctttctttctttctttctttctttctttctttcctttctttctttctctttcttttcttttcttttcttttctttcatttttttgacatggatttttgctctgtaacccaggctggagtgcattggtcccatctcagctcactgcaatctccacctcccaggttcaagtggttctcctgcctcagcctccagagtagctgggattgcaggtgtgtgccaccatgcatggctaataacactttatcttagtttttcatgaaattttcggaataaaggatgacgaaatgtgatagtgtgtatcactcttttgtcaaggcctggtttctcttctgaggaatttatccttcttccttcaaattattgcctagaaatctagagcttgcgctcttctagatggcttggtgttcaccagttagtcttaagctttctgcaaacttgtaaataaataactctgtcatcttccttcaggtcctactgaaccatttctctcgcaaaggccttgccacttttttctcattatctcagggaaccttgacttctgatatggtctggctatgtgtcttcacccaaatctcatgtggaattgtaatccccacgtgttgaaggtggggactggtgggcagtgattagatcatgggggtagtttctaaaggtttaacaacatccccctagtgctgtctcctggtagagttctcaagaaatctgatggtttaaaagtttgtggcacttcctcactccctatctctttcctgccaccatgtgaagaaggtccttgcttccccttcaccttccaccatgattgttttcctgaggcctcctagtcatgcttcctgttaatcctgtggaactgtgagtcaattaaacctcttgtctttataaattacccagtctcagttagttctttatagcagtgtgaaaacagactaacacaatttcccttatgggttatttttcatagtcatcttctctgtctgcctttgactctttaaaaaatgctgcctctccattatgatctatgatctgagtttgcaaggcttattttctagaggtttttaatttttatatttttatcttttaggtaattgaactgtggttaaggcagttgccccctagtataatactggcttggctatcagtttgatttcccatgaacagaaaggaaaaataaaaattgacaatgattttcttcttgatgactattaaaatttcaaataaaaatgaaaccacaaattataaataggtaccttacacaaaggtgatacagaatatcaaataatatgctgatagaaaaggttttaagaaggtacacatatgatttgttctctattttaaaagatatcaattgattgtttgatcgagtatttactatgcaaggcattatactactgctacatgaaataaatagataaaagaaacatgaattctcctttcagcaaaacaaacactctgttggtgtcagcactgtactgaataaagtccataaacataagttgatggttgcaagttttatgtttaaagggaaaattttaaagtaagtatcctattagaagtcatccttctttattgatttaagtactaaacctaacctactttagtgaaagcacttctttctttaaggcttttacttagcagatgatgaaaacctagaacagaaagggcttaattctaagaagtgcttactatgaaaactgaattattacagctgaacaaatgtatcttgactttttgatatgatgaagtaacgtggttactgtgagaatcttaaacttcagaatataagccatttgatatcaagtgtcagtatttggtgccattggcttatacatgttactagatatttagagttaccatttaatcattgacatcattattcagtctcccagaataagaacagagattttgatgtactgattttgagtaattttatcaggttccagttcgacttgaagaaggtaaagagatgttttcgtataaatcattgattaaaatatagatgcaaaacagtaatttaatgctgtggcttggaatttctacgtttatgatttttcatccaattctatctaattggtggcatgttaataaatatgtatataaagattatttctcattggaagaataagagtaagagaggacataaagagaatgtgtcttcagtgtctagccattagccactactctttcttgctacaccatatcactatgctcagctcctcctttggagagacacacattcaaatatttaaagttataccatgaagaatgttacgttatacagaattaagtcagaattctgccaggctctagaagaaggaccaaatctttttgggaaatcagttaccatttctcagaggaaatgacatttaaggtagaactaaaacaatgagttgattttgatagaaaaggagtacagttgtgtttcagatatagttgtcttcaggttctttacataatcaatgattagttaagttttatatctttattccttatatttatagtattttcataaactgttttcgtatacattacaacatttaaattgagtagtattcttgatactacacatatttttaactttaaggtggaagtcggaaacctgacacttagattaaattcattttccttaatcatgtgtcttgtggcacaactaaaacacaagctgactccaagtgtagtactttttccatgggacagaaatgaaggaatcatattgtaccaagttgaatggttcatccccaagatataattgttgatatgttattttaaccactgaaatttgggtctgaaaattatttatttattgtagaaaactaaaagtgtaatagatacatttgaaatgagattgcgatgttaaatttaggctttatgtagctctagtgggaatgagtaaatctgatgttttctgaactatttattatccatgatccatagtagaaattttatacatttgttgtacatttgataaaactaggagtcattgtatggggattgaataatagaaaaggcagcataacatagtggttacaaggatggaccctggaaccagtctgcttagatttacatccttgttttgccacttactagctgggtgacttgggataagttacttaacctctttgtcatcagtttccctatctaaaaatggtgataataagagtctgaaaatagtatatttcctgtcaggttgttacaagggctaaacagggtattattattattattttttgagactccatcacccaggctggagtgccgtgccattaactcagcttactgcaacctccacctcccaggctgaagagatcctcctgtctcagcctcccgagcaactgggactacaggcatgcaccaccatgcccagctaagttttgtaatattttttggtagagacaaggttttaccatgttgtccaggatgatcttgaacccctgggttcaagcaatttgcctgcctcagcctcccaaggtgctgggattacaggtgtaagccaccgtgcctggacaaacaggttaataaatttgtaaagcacttgcagcagtgcctggcttgtagtaggtgctatagaggttttgattaaataagatagatgggcgtgaagcttgacagagttttatgtagtagacctgtcttgcctttccctagctgcagaaaatattgtcttttcttttttacaaacttgactatcatcatttagaaatataatgaattgaaaactggtatatccaaaatagtgtacttttactgattatgtttttcatagctatttgaacaacacttttaagccacatgtagatttcaaagtctctaaattttttcattagatcattatatcagagaacatagtatttacaaaaaacatgtagctgttttggttagtggcgactggaaatattgcttgacggtggtttaatagtgcccatactgcttggaaatattagcatttattagatagattcattttcaaatggtaataatagtactcatatagtactaatatttttcatcggtaggtttttaaattttgaccgtgaggcttttgtgcaaacctttgctattcatggtttcaagtaattttaaaatttggtctgtattttaagctaattatttagattcctagagctatacagtaatattaggtaaccattttcttctaataattactaatgtacagaagaaaagcaagaagtccaaataagtacaaagttaattaatatacatgttttaaaaaatacaataagtaattcatttttataaaacaattctgaaacatatatagtaaagagttaaatacttaccacttccttacccatcatcatttccatttttccctcctcagaggtactctctcacaggcttacgtttttacacttctataactttttctatgtgtgggaagataaatacgtattcaaatttagtacactgtttaaaaacatatttggatgataccacacatatgtttgagttttttcacttcgtaagataccaaaaatatgcctttagtcatacctgtaattgtacctcatccttaaatggtttaattatactctttattgcaaatatttccaaattagctgtttcttttttgatggacagataaattgtttagcattttctttcctctcgtcttctctcctttcctttctttcttttttgctgttacagaaattaccactgatgctgaatatcttttataaattgtttgcatgcaccctcacaacttttactatttccatagcatattcttagaaatcggattattttatagaaaaagtatgtgtgaatttttttttttttgaaacagtctcactctgttgcccaggctggaatgcagtggggcaaacttgactcactgcagccttgacctcctgagcttaagcaattctcctgcctcagctacctgagtagctgggattacaggtgtgtgtcacaacatctagctaattttttttttttttttgtatttttagtagagaggtggttttaccatgttagccaggctggtttcgaactcctgacctacagtgatccacccacttcagcctcccaaagtgctgggattatagatgtgagccacccaccatggccggcatgtttaaatttgtagcagatataaattgccctctgttgcagttccattctatagagcatacctattttccccatatataaaacattctcacaagaggcttcaacaatgacaaatttcataggtatacaacttaactctttaacatgtttccagtataacagatgaaaagtatgtctggtttgattgcactgtggtctgagagacagtttgttataatttctgtccttttacatttgttgaggagtgctttacttccaactatgtggtcagttttggaataggtgtggtgtggtgttgaaaagaatgcatatacgttgatttggggtggagagttccttagatgtttattaggtccgcttggtgcacagctgagttcaattcctggatagctttgttaactttctgtctcgttgatctgtctaatgttgacagtggggtgttaagtcgcccattattattgtgtgggagtctaagtctctttgtaggtctctaaggacttgctttatgaatctgtgtgctcctgtattgggtgcatatatatttaggatagttagctcttattgttgaattgatccctttaccattatgtaatggccttctttgtctcttttgatctttgttggtttaaagtctgttttatcagagactaggattacaacccctgcttttttttttgttttccatttgcttggtagatcttcctccatccctttattttgagcctatgtatgtctctgcacgtgagatgggtttcctgaatacagcacactgatgggtcttgactgtttatccaatttgccagccagtcaaactagaacccaggattaagaaactcactcaaaaccactcaactacatggaaactgaacaacctgctcctgaatgattactgggtagataatgaaatgaaggcagaaataaagatgttctttgaaattaacgagaacaaagacacaacataccagaatctctgggacacattcaaagcagtgtgtacagggaaattgatagcactaaatgctcacaagagaaagcaggaaagatctaaaattgacaccctaacatcacaattaaaagaactagagaagcaagagcaaacacattcaaaagctagtagaaggcaagaaataactaagatcagagcagaattgaaggaaatagagacatttcccttcaaaacgcttcaaaaaaatcaatgaatccaggagctggttttttgaaaagatcaacaaaattgatagaccaaagcaagactaatgaagaagaaaagagagaagaatcaaatagacgcaataaaaaatgacaaaggggtatcaccaccgatcccacagaaatacacactaccatcagagaataccataaacacctctatgcaaataaactagaaaatctagaagaaatggatatattcctcaacacatacacccttccaagtctaaaccaggaagaagttgcatctctgaatagaccaataacaggctctaaaattgaggcaataattaatagcttaccaaccaaaaaaagtccaggaccaggtggattcacagccaaattctacgagaggtacaaggatgagctggtaccattccttctgaaactattccaatcaatagaaaaagagggaatcctccctaactcattttgtgagtccagcatcatcctgataccaaagcctggcagagacccaacaaaaaaagagaattttagaccaatatccctgatgaacatcgatgcaaaaatcctcaataaaatactgacaaaccaaatccagcagcacatcacaaagcttatccaccatgatcaagtgggcttcatccctgggatgcaaggctggttcaacatatgcaagtcaataaacataatccagcatataaacagaaccaaagacaaaaaccacatgattatctcaatagatgcagaaaaggcctttgacaaaattcaacagcccttcatactaaaaactctcaataaattaggtattcatgggatgtatctcaaaataataagagctatttatgacaaacccacagccaatatcatactgaatgggcaaaaactggaagcattccctttgaaaactggcacaagacagggatgccctctctcaccactcctgttcaacatagtgttgggcaatcaggcaggagaaggaaataaagggtattcaattaggaaaagaggaagtcaaattgtccctgtttgcagatgacatgattggatatctagaaaaccccatcatctcagcccaaaatctccttaagctgataggcaacttcagcaaagtctcaggatacaaaataaatgtgcaaaaatcacaagcattctgttttttgttttttgtttttaattttttattatactttaagttttagggtacttgtgcacattgtgcaggttagttacatatgtatacatgtgccatgctggtgcgctgcacccactaactcgtcatctagcattaggtatatctaccaatgctatccctccccccctccccccaccccaccacagtccccagagtgtgatattccccttcctgtgtccatgtgatctcattgttcaattcccacctatgagtgagaatatcctgtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggagttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtcatgcctaggttttcttctagggtttttatggttttaggtctaacgtttaaatctttaatccatcttgaattgatttttgtataaggtgtaaggaagggatccagtttcagcttcctacatatggctagccagttttcccagcaccatttattaaatagggaatcctttccccattgcttgtttttctcaggtttgtcaaagatcagatagttgtaggtatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggattcttatacaccaataacagacaaacagagagtcaaatcctgaatgcactcccattcacaattgcttcaaagagaataaaatacctgggaatccaacttacaagggacgtgaaggacctcttcaaggagaactacaaaccactgctcaatgaaataaaagaggatacaaacaaatggaagaacattccatgctcatgggtaggaagaatcaaaatcgtgaaaatggccatactgcccaaggtaatttatagattcaatgccatccccatcaagctaccaatgactttcttcacagaattggaaaaaactactttaaagttcatatggaaccaaaaaagagcccgcattgccaagtcaatcctaagccaaaagaacaaagctggaggtatcaggctacctgacttcaaacggtactacaaggctacagtaaccaaaacagcatggtactggtaccaaaacagagatatagagcaatggaacagaacagagccctcagaaataatgcagtgtatctacaaccatctgatctttgacaaacctgacaaaaacaagaaatggggaaacaattccccatttaataaatggtgctgggaatactggctagccatatgtagaaagctgaaactggatcccttccttacaccttatacaaaaattaattcaagatggattaaagacttacatgttagacctaaaagtataaaaaccctagaagaaatcctaggcagtaccattcaggacataggcatgggcaaggtctttatgtctaaaacaccaaaagcaatggcaacagaagccaaaagtgacaaatgggatctaattaaactaaagagcttctgcacagcaaaagaaactaccatcagagtgaacaggcaacctatagaatggaagaaaatttttgcaatctacccatctgacaaagggctaatatccagaatctacaatgaactcaaacaaatttacaagaaaaaaacaaccccatcaaaaagtgggcgaaggatatgagcagacacttctcaagagaagacatttttgcagccaaaagacacatgaaaaaatgctcatcatcactggccatcagagaaatgcaaatcaaaaccacagtgagataccatctcacaccagttagaatggtgatcattaaaaagtcaggaaacaacaggtgctggagaggatgtggagaaataacacttttacactgttggtgggagtgtaaactggttcaaccattgtggaagtcagtgtggtgattcctcagggatcaagaactagaaataccatttgacccagccatccattacttggtatatgcccaaagtattataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactaacgcaaggacaaaaaaccaaacacagcatattctcactcataggtgggaattgaacaatgagaacacatggacacaggaaggggaacatcacacaccggggcctgttgtggggtgtggggagtggggagggatagcatttggagatatacctaatgttaaatgaagagttaatgggtgcagcccaccaacatggcacatatatacatatgtaacaaacctgcacgttgtgcacatgtaccctaaaacttaaagtataataaccaaaaaaaaaaaaaagaaaaagtatgtctgattgttggatatctgatgaaaaggatatctgatatcttaatttttatttctttgttagcaatgttgagcattttaaaaataagttactagccaaataactttttttctgtaaataatctattcttatcttgtctatttttttatagtcgtttatctatttgccaccttatatctttacttggatgtctaatggaaatctcagtttaagacatcccaaactaagtttcctttcttctcaaatgtgcttttcctacagctccattcttccagtctctcagtcctaataccttggaatcatctttgctttctcttgtactatacatctaatccatcagtaagtcttattggttatgtctttgaaatggatacagcattttaccacttcttgccacctcgttgcttctgctgtctcttacaacctgtcttcctttttcaacactggatacatgtagtaaatgttttgcacagtagccagagaagttctttcaaaacacatattcaacaatgtcatgactatattcagaatctgttattctgtcccagttccctcaagtaaaaaccatctccttactatgacctacatgagccctgtatgacctggtccctatatatagctctaacctcatgtcctacttttctcacccttgctcactctgctgaagccatctttgcctccatactttgcttgaaaatcccatgcatacctttaacttcagacattcgttgtttttgtttcatctgactactataatgctctgcccactgagatctgcatggatctcttccaaactggtttgctttaataaactttatttacaatttctgatattgacaatgtcataatatatgacaatataactatgagaaagaaaaagtccgttcttcatgcccttaaggtattttaaatatggtatcaatgctcatatattaaccaagttagggggagaggggaagtatgagtggatatggcaactagtcatatatcaccacattctcatagtagtgatatggtactacttattttggagagcatcctaggttcttcaaacttaatttatttaggtctgatttatttattttatgctactttataagtacctaaaatactacatataaattatgtatttgaattaacataagctgtattatataaatgtatccagttttaaatgaaactgtttagttataatacattactataaattactcaattgtttaaaataattcctgaaatctttcattatgaaaacatggttgaaatcctctaatttctttacttggaagaacaaaattttaaataatatagggagtggaatattacatttcattttattaagaaatcttccttttatgtaatcacatacctcttttggttatcatcaaaatccaccccccccccaactttttttttgttgttgttgagacagtgtctcactctgttgcccaggctgtagtgcagtggcgcaatctcagctcattgcagcaacctctgcctcccgggttcaagtgattcccctgcctcaggctcccgagtagctgggattacaggtgcctgccaccatgtctggctacttttgtagttttagtagagacggggtttcaccatgttagccaggcttgtcttgaactcctgacctcaagtgatctgcctgactcggcctcccaaagtgttaggattacaggcgtgagccaacgtgcctggccaaaatcactttttaaaattgagagattttattggtaagtttttgttatcaggaacatttacatatgggaaggataattttctatcaattttggatgaatcaagtgctttttagttgaatttctctttttcttccaagaaaagattttattgatgtattgcctttatactgaaaattggacaagttgttaagttactgcttaatgaattcttacaaagtgaatacttgcatgtaattaataaatagaacgttactatcacttcacaagtctaccttctagtcactaatccctgacaagggtgaatgctctcctgacttctaacaaattaggcctgcttatttttgaatacttgcaaaaatcagttctataagagaaaatgatgtaaaatgacaattcataatctcatataaaaattataattttaagcaaggaaagaaacaatcttgaaaatacgtttggtatgttctgtgaaattgtaagttatgtttctattaaataattagctattctcgtactcagaatcccgcccattgtcagttcctgttaaagccatgttgaatatatctgaaagctgtagaagtcctgaagaaagaatgaaggaatttattggaattgtttggaatgcagtgaagcatctcacactacaggtaaaataaaagttagaaatattatggatataatttctataatcctttttaattcccagcattgttaatattggtaagacttttctcacatgtaacaattatgtataccatctcattttcttaatttagttgaaaataattggtgtacttcacttatcctaaacataattttatgaaactcatatgaacttccttatagttataaaaatttacacattttgacatgtttcttgacttaaaaaattttagttcattctactttttgtttaagcattattttcacaattttaaattcttagtgttcatatagttccattcttatctcagaactgagataaagtctgagttggaattaaattaacatgaaagggttatctaattattttttctacataattataagttaaatatgaaaattataatagctatttccttattgttattttcctctcattgatttttactttaaaatgcacaattttatcttattgaattactttctttcaagatcatgtttaacctgactaaaatatacaattagatgcttatttgataagctaacagttataaattttagtttttgcataggattttttctctgtgataccagagacatccttatagaattttgtatgtaccagagtgtaatatcaaaggcttaagtcaaagcttttcaccttgacttaagatataaaagttgcaatagaaccttgttcccaccttactatgagaacaaggttttgtgatctgcaaaattacagctatattaagcccatagagatctgaggtcttaaattgacattaccataacagcagggtgctaaaatccaaaaaagtgacaagcaactcactttttgaaactcaacaatctcagaaaactccaagaagaatatataaaaaggaaaacatagctaagtacctagtagtcaaactactgaaaacttacggagaacgttttattttattttactttatttaaagtgggaagatctttatttatcaatattcttgtttacctgaagactatactggaagaagctgaaattataagtaaggcagacctagatatgtatttcttagcaatgtaatattggagagttttttcttgtttctgtatccacaagttggagattataatatcttcttcatgaagagggtcgaaaatatagagtgataaagtatataaaagcaactgacaaaatttattcatttattgattcattttgcaaaagttaccatactgtattcagagaacatactgaagaaaactaatgcagtcctgtcctcatgaagatcatagtttggcaaggagagatattcattaaatgattgtacttaaaataatttgactataatggtgatgatcctgcttcatgaacatacgtgtcaattaagctaaccctagaagaatcaggaaacatttgggtactcaataacacttgtgttttctttctctattccatctttctctcctgtagctgtagcttttttctaaagcagctgaaggctgcactgcccttcagcaggcagacaagaagtgatggagataacacccctgggattatcttcacccaccatgggaaatgattctgtggcattccttgtctgtcagtgtgtcctcagtagaattaagctccaggtgtccagggcttaccagcacacccattttggttactgtccttttgagaaaattttagaagtgggtagacagtaaaggcctgttatatacagattaaaaacattaagaatgactccttacatcttattagaaacaatggaggccagaagacaatagaataacacttttatgtgctgaggaaaatcagcacataacatagaattaacatagaattctctagtcagcaaagtattcataaaaatgttggccaataaatacataaagacagaacttttctctaatagaaatttactgcaagatattctgatagaagttatttaggctgaaaggaaattataacagaatcttggtttttcagaaagtaatgaagtatatcagaaagtataaatagttgtaaaacaactgaatattgaaaaaaatagtattcaaggagaaagctttagtgtgttttagtcttttggctgttagcttctttcctcttcattttccagttaactttttgtttgtttcttttttgtttttggacagaatcttactctgtcgcccaggctggagtgcagtgatgcgatctcaactcattgcaccttcgcctcccaggttcaagcaattcttctgcctcagcctccccagtagctggaattacaggcgcccaccaccacgcccagctaattattttgtatttttagtagagatggggtttcaccatgttggccaggctggtctagaatttctgacctcaggcgatctgcctgtcttgtcctcccaaaatgctgagattacaggtgtgagccactgcactcagccctagttaaatttaacattaaaaaatatatgacacttaacaaagtaaaggagttttgattaagatcaaaattcagcagttaaatgaaatttcagtaatttattcagaaaatatttatgaagtccctggtctgtcctacactccagccagcccttagtcctacagatgtgaggaaattgtctctgtgagcaactagagtgagtttggaagtgtattctttcccaggtgagcctgtggatgaaaacacagatggtcaacacttttattgcggctttttgagaccataattcaagtatttaactaagccataccaagattattgacccacagaaactgcaacaaatgtctgttgttttaggctgttacatttgtggtgatttcttatatagcatagaaaattaatatagacagatacagacacattatgcatagctatagtgtagtctgattaatcactataagaaatacatacctgccataaaaactttttagaaattcatccaaaaatatctccagtgcataaaaatactagttaatataggagccaataatcttgattttagcattcctttacatgtttcttttctgagcatgcctcttataagaaaattaagagaagaatggggggaagaaagtatggcttgtcgttcttgtgtaattaactcttagcttgcagagttatgactcttttagggatatcagctatatttcaccagtctcagctgtcatgattccttgtaatgaatatcctaataactccttgcattgacttacctgtccttctcccttagaggtaccctttgtacagtggtaacatccagcacttaatttttgttatatgttgggctatatgctgagaaaaaaaaagagacataatagttgtcatggtctagctgggaaaaggctaagtgccatggtatggagtatactgtagggagccccttagaaaacttaacgatgaaagaagagaaatgggaatgtcaagaggaatgttacttattgaaaggatgcctagggcatgtacttcctggtttgtgatgaatttagatattatcctaggtaagtatttattgctttgtagaagatctagttgacaccattgtgtggtttagaatatgatagctaccaataatatttagttgtttaaagtttactatagatctaaatgctatttcatgataatagaagtagttatattaaaaataacctcattccctcttatctaatgattgaataatgtggtataattatccttttattgatatcattttgagtagttctgtaatagggaacatgaaagatagtattggattacatgattatttgacaactctgggaaaatattccaatttaagattccaagtaatatcagaaatctttgcactatcgataaacaagtaggtacatcaatattccacaatgtaggatatactggagaatgtccttctctggccaggattaaataacaggaataagatttatttcactgcctgaaataaccaaaaaattattgaaatatataacacaaagatttcaaaccactaggcaataagccaagtagacagtgattcctcagagacttaagataaaatcagcaggacttagtaattaattgatttggggaatcaaggaacagagtctaagagatcttctagattcttgttttggtgtttgggtggtagtgatgctattaaatgaagtagcttttccaggttaggggcaaatagggattttgaatttacacatgtatttgaaatgtatgtgagacatccaggtatgtattagatatttacatctggagtttaaaaaacaggttaagagaagagatataattttaggagttatctgcagatggttttcaaaccaggagaatgggtcattcaagaaagtatgtacagttgaaagagcaatgggccaagggaataccgttttaaaagttgttagtagaagagagaatgtccttgaagaaaattatgttagtgatcagaaatggaggaggagaaaccagagagttcatgaaagcaaaaaatgcttagaattttgaggagctactggtcagcaatgtcaaattctagatgttaactatgtgctttacttgcttatttgtagtataaaatggatacattaaataatatttaaggttacttccaactctaacattattgtatgattcttttgcttattttataatgttgcagtaccttttagcttcatcactaacaaacttaatcttatatatcactttgaattaattgtaagttatgatagtgattttcctcatttttccttttttaatctctaattatggtaaaatacatataacataaaatttaccttccttactatttggaataaactatatggtttattttgtggttcctcaatttgagtaagcttattgagtatcagttaacataatcattgcagtaccaaataatacatctttatataggttatcttatatatgacctaggtacttggcttgcctcaccctagtcctggccctgtgttaaacatactatatatttaaacatttccagatgttaatgtatcatcaacactttaaaagataaaattagattctcattaaatgattacaatttagactgtgaaaatctgagttttatttattttatcttattttatttttttgagacagagtcttagttgtcgcccaggctggagtgcagtggtgtgatctcggctcactgcaagctccgcctcccaggtttatgccattctcctgcctcagcctcccgagtagctgggactacaggtgcccgccaccatgcccagctaatttttttgtatttttagtagagacggagtttcaccgtgttagccagggtggtctccatctcctgacctcgtgatccacccgcctcggcctcctaaagtgctgggattacaggcgtgagcttttatttttaaaaacgttgtccattttttaagatgttttatgagccaaaatataaaacagaaaaccctgcaagttatcatcagataaaacaggacatcataacttaaaggtttcgaatgattattcttttagtggaagtttgtgcaggtaattatgtttggaaccagaatttctgcaaagttgatgttggagccaaagttggtatttgctaaacccatattattttttacttagaatagaaacatgtatattacataaaatcattaacaatatttgctgtaacctatttgtttttcagtgtggaagaaggagtttccatacttaattataatggattattttataatattccatgtagtcttggacagtctttttttttaaaaaaaaatatatatatatatgaactttggggccaggcacggtggctcacatctgtaatcccagcactttggaagtcctcggcaggcagacgacttgaggttaggagttcaagaccagcatggctaacatggtgaaatcccgtgtctactaaaaatacaaaaattagctgggcttggtggtgcccacctgtagtcccacctagtctggaggccgaagcaggagaatcgcttgaacctgggtggtggaggttgcagggagccgagattgcgccactgcactccagcctgggtgacagagcaaaactctgtctcaaaaataaaaattaaaagaataaaaatatataaactttgggggccttttaacaatagattagcataagttcaccggttctttccaagttttctatacctgctcattaacaaagattctattaaagctatgtttttattccagaagcacataattggcaatagtatgtagctgataaaatagaaatgtgctggctagaatttactcctttctaggagaacatttctctgcttattgccagacttagctttttttttggtcatttacatcgaagttcatcttgctgtcctatgacatgtactagcattttcttttcctctttttttttttttttttttgtactctctgagtttttctgagtggactgaagtcttctgagtttaatggcatttttaatttcaataccaagcattctggtctctttcttttggtaataatgctgttattcctttagggaactacttcccacattctgtgttattttgatgagagtgtcagtcagggtgtctcaagcagcatgagccagttaagctgggccagttgaattctgtcttctaggaagttaaatctagagcatgactagtgatgaaaaaagtcatactgcttgatgtcctgatgtccagtaaactccttggcctttattttcaggattaaatgggagtagacattttaggccagagagatcaactatcaatcatgctaattataaaagtaagattttatatttaatccttacaaattttgcacacaggcccacattcttacttataggcattgaacaagtgacagccattgcatggcagttaggaggaagtctggaattcaaatctaggaatttttaatgtcttctcttgacaagatttttatggaaaaagtgtgaagatttataacacttactctggaaaggatgacaaccaagacaaccaactgtaggcttttaatctatggccccaaatcagggatatttaaatttctactacatatgatgatatccaaaatattttcatgatgcactgaaaatttatcaaataggaaaactgtgatttgggtgatagtttatatatttgttgtagtgcaaatggaatactaattttaatggcccctatatacagagatagtgaaaccgtaagcaacagcatttgaaaataaatgcactgtgaacaggttttataaatctatgaggctaataatatatgggatctcgcctataggagagacttggtgttgtttgttgactatctttctttagcaaacgtttaggtaacacttactgtgttaaatatatatatcaatgctataatttcccccattaacagatgaggaaactgaagtcatggagagatgaaatagcttgtcaaatatcccacagctgtgttgaattcatctcattaacaaatcagttttattaatcaccttagaggttgcctctggaatgaaatgatgaacaacgtgcatgaagcaattattttcattaccatatctgatgaaaataattgtttaattgtttctacttgttgaacaattatttattgagtacatagtacatgcaccactgcacaatgtacagaaactatatagtgtacaaaataggcaaatgtttgacttcataaagtttatgttctcgtgagaattctgtaaggatattaatacttgaaagtgatcttgttttaagcttttttagggctggcactatgtcttttgtctctgtattcctgacttccaggtcagttcatgatagatattagagagtacatgaataaaggagagaaaaagtaatgaaatgcaacatacaatgttcctttatttttgttttttatttgaaactctttcctgaagagtaacatacacttatatagagaacatttggtactgtagaaattatgcaaaatataattatcactacattttcaagttgtaaataaaaataaatatattatttgggaataggaaatagttatgttattgaaaagggaagaaaatgtggcacaacatttcaaagcttttatctataaagtgctttatatgatgggcagtggctaattaagattttcagattaatgggtaaataaaacctatcttagtctcttctttttagctgaattgggatcacaattatagagcactaaaagagaaaaatctaagtttctcaaacctcacatatagggccaaggacttacagaggcatatatctttcaaatagcacataaactagaaacttcagggaaaaatgcattgcagtcatttcatttattaaaataagaataacaaataatttttactttattggtttatcttcagtatatgatacttagatatgtagcccttgacctagtaggaatcaaaatagaggtggttccacttcaagaatttgtaataatcccttcactttaacacatgaatgtgttcagtattggcaaaagaacacgttgctaccaaaactgaaacaagatccttgaaacagaaaggatgttgccatggaaaaatgaagtaacactcagtgcagctgtgatgcattcatgaataggatatttttttaaaagatcatttgtgtttggtgtggctcagagggtcccaaccagatggtttccatgaacatgatctgacccccagcttgaggacttcttactggcagattacttcattttctttcccttggattgtcagatccttacattaattcagaatttactgctgcagatttatattcagtaatataaatcactcaacattttacattaaaaccacaattttatacatacagtttaacagttattttaaaagtgtaaaaagatttatgtgatagctttagtatatataatagataaaacataataattttgagtaattttaattatatgattcttatcattaaaggaactctcacaacatatattttagaaagtttattttagagttgttatgtatctgatgctactatactgttgattctgtttatgttgctcacattgtttacacttgatgaaataattgatttttaaattagtgaaattaatgtttttgattttggaaattttggcatgatttgaattttttcctaaggatatgtatgcatgtggttgtgtatggtagcatactaaactaattacctcacaatattgaaagcatttttcaaggtagtatcaatacctacatgaagtgttaaatactgacacttcatattttgaccttttaacctgaattaataaaggctatgctcttaatgtgccattttaaattgtgcaactgaaaattactaatgaattatgttaaatattttaaagcataattctaagttacctgagacaatatagacttctatttcagaataaactacatcatgatcttaaatcaataaactacttaacacacatgtactttatctaatctgcagtataagattttagaactaaaatgagctcatgcttcacaaaccaatgcgtttatttttgcaaaattttacctgtatttttcatcactgaattcatcagtttggccatgccccaaaatgtgaagcaaagacaaacaggtttgtttatttataggttgacaaattatttatcctatcaaggaattccaaacctgttaaatataatcatgttctcaccagaatagtatattaggcccaagagaagagatgttgctattatcttttaaaaatgtagtctttttgctaacatagtttctttgaatatccaagaatgtatgaattaaaaaaattattttgtatcacacctccagataacatatttttatgtgaaatattttgtaggaaatcaaccaatcatagtttgtattttctcaataacttaagtatcgtaggctgttggagcaatttgataatgagatacacagtattactttataagcaccgctaagacaaatagactttacattgcttctgaattaagaagtcacgatgaattcagttttggggttgggcttactttgtctccttatcttaacctctgaggtcctggcaacttaatgtaactctactggggataggagaacattaagataatacatgaaattacaatttaggtaatttgaagaatgaaaaaagcaagaaataatgctctgatttttaagtcttctgatttttcctattatgatgtatttatgtataataaatctgatacatgtatgtatacttgaatcattgtatataaaagtgaaagtatgtgatataaacatgttctttaatggttgtctagtgttataaattgaatgttttaaacaatgttttcttatattctagtctgtaaagtaaaaatggaaggactaaattcacgtaaaaatagccctttttaaaaaaagtaacagcaataaaatgctaggtagttctaggccttatctggtgttaacaaaattttctaataaactgcaaaagaaagagtgttttctgatcttcttttgccagcacactttctaactcaatcttgtgtcttggaaaagactgtggaagggcagatcatctcttgtcactaggcattttgtatcaagtttataacaagagtaaacaataccttttcaagtttttaaaatattcattagtgaaaataagtcataaagacataaatatggaacatttactttttttggttgtttattctggcgaagatgttaggtgtttgaaggcatatttagtctaatccgaatattttaattctgcttttcttttctagcttgaagtacaatcttgttgtgtgtttattccaaatgatagcctgccttccccaagtacaattgtatctggtgacattcctggaacagtaagaagttggtaccatggacaaaccagcatgccgggaacacttgtcctctgtttgcctcaaataaagattattagtgctgggcacaagtatatggaacctctgcaggagattccatttgttatcccacgacccatccttgaagaaggtatatgttaacatttttttcctatggttaatgttttatatggacatttttagatttgttggtgtttttaaatgtgtcagtgtataagcaaatcagtcttctcattgaaagatttttcctgaccaaagtaagtgaactaagtgatgccatttattgccttccataccttttaatcttagtcatatattcacatatgttatctgtaaaagatcatatgcaatataatataatcattaaaatgtaaacgtaggaaaaattaacttgggaagaaaattgcttttggatattatcattaggctgaactaagaatgataagtagattgatcttaatttaagttacttgatttatgaatgaatgtattttaaatatataaataattgcgtgaatatattatttagcaagcataatgtatttttagattcctcatttgtttatacaaagtaattatatgatgattagagtcatgatcctttctccaatatatatatacttaatttctcatattgctgtgttttcagttatgaattcataaccttttgaactttggcatattcatttcaaacaaaatgtgaacctggaaagattttgagtcataaagtaatctgaatatatattataataacaaggctcaaatttttgacagtgctaaacaggtcaacaccttgttcatattattatggtgtaagtgtatgaatcctgatatcactgaaatttctacatactgtcactgaaaagcagacatagcctgtgtaatttttgatctctactttgatgttgatttctctctccttttctctatactgaaatttctattgaaatctacttttcttatattcattaaaagaaaacatgatttcactgagagacatttttggtccttaataacatgaatactattatcatacaattatagaattttaaggttaaagggaatgtttttagagtatatggtctttttgtgactggtttctttcatttaatatttttaagattgattcatgttgtagcagtctttgttgtttttatggctgaatagtattccatcttatggatatatcaaatttttttgattcattcatcagttgatggacagttgaagttgttttcactttttggcttttatgagaaatcctggtataaacattcctttacaggatttttgtgtggatttgttttaatttcttttagctatatgctgaggagtaaaattgttgtgtcgtatagtaactatgtttgagcttctcaggaattgccagactgtcatccaaactgtctgcaccattttataataccacattatgtacaaaggttctaattttttcacatctgtgtcactatttgttattatccgctttgtttctttttcttttctttttttttttattttgttctagccatcctagacaataacctcttaaactggagagagcaattaattttaagtggtttgtttcttttttttcttttttttcttttttttgagatggagtcttgctctgtcgcctgggctggagtacagtggcacaatcccggctcactgcagcctccgcctcccaggttcaaacaattctcctgcctcagcctcccgagcagctgggactacaggcacttgccaccacacccaggtaatttttgtatttttagtagagtcagggtttcaccatattggccaggctggtttcaaactcctgacctcgtgatccacccgccttggtctcccaaagtgttgggattacaggcgtgagccactgcgcctggccaaattaaagtgtttttaagaactgtgttggtcaggcagagagtaaatagattgatttaatacatcatttaatatactaaatacacatcttaatatttataaaactgaagcttacattatgaaactggtgtttatttttactataaaaatagtaaaagtggtgtgaagtggaatctcattgtggttttggtttgcatttccctaatgactaataatgttgaacttattttcgtgctggttggccatttgtatatcttctttaatattttatttctttttatttatttatttttttggatcaggtttcattcttgctgaggctgaagtgcagtggtgcaatcacggctcactgccgccttgaccgccggagctcaattgatcctcccacctcctgagtagctgggactacaggcacacactaccatgcctgtctaattttttaatttttgtagaggtggggtttcaccatgtttcacaggttggtatcgaactcctgggctgcctcagcttccaaaagcactgggattataggtattagtcaccctgcccaacctaatattttcttctattcaaatcttttgcctactttttagttgtatttttagtagagtcagggtttcaccatattggccaggctggtctcgaactcctgaccttgtgacttcttacagttgagttgtaagagttctttattatattctagatacgatacccttacacatgatttgcaagtattttctcctgttctatacattgtcttttcacttccttgatggctttctttgtcatataaacatttgtaatatgaaatttttataatatgaatatttatattataaatttatataatataaattgatattataaattttgtagtataaacatttggcaagacttcatctctacaaaaaatttaaaaattacccggttgtggtggcttgagcctatagtcctagctccatgggaggttgaggtgggaggattgctggagtccaggagttccaggatgcagcaagctatgatcgcaccactgcactccagcctaggcaacagagcaagaccctgactctgtaaattaattaactaagtatatataatacatgatatataatatgtaatatatactttttttaataattataaattgtataaatatatgtaaatataaacataatctaaaaagttttcctgtgctatgttggaaattattttctcactattcttttttttaatattagaaattaacaccatttccacaaagtatgttttagttttagaaatattaagatgcatatttaatttatttaatgatgtagtaaatcagtctatttactctccatctgaacaatacagttcttaaaacactttaatccttctctccagattgaggttattgtcataaattttcttttatttttaaaacttgatatcattattttgtaatataattgcttagatttggcatatatagaataaggcagaggttggaaaactttctcaacaaagtgccagatagtaaatattttgtttcattagctatatggtttctgttttcactacccaaccatgctttatagtgcagagacagccatagacaatatgtcaatacattggtatgactgtgttccaataaaactttatttacagaatctggtggttggctgcatttggccatgagccacatttgcctacctatatgctagtgctttagtagtcattccttttcacagcttagcccttccttctttctcagttcatttacttctgcctaaagtacatcctttagaagctgtttttgtgatggcctgatgttagcaaactctcaattttgtttctttgcctttttttttgaaatatattttctgggtatataaatccttgtttatagttattttctcccagctcattaaagatactgttgtgctgactcttgcttttcattggccttttaggaggtacaatgtcatttcatgtttccttggaagtcgtttgtccttttcctctgggttctttaaggatcttctcagtctttgtgttttaaagttttaatattcgaatcttatgagtcctgcaagttttctggcataatctattcagatattgcctttactttttttctttccatacatatgttggacttttttgattttttactgtattttccatgttgtttcttcactctttgatattttttctctttgatttgctgacctgcattccagttaatttctttaatctagttcattaattttcttttcaattgtgtctaatattttgttaaagttgttctttgaatttttcaatgtcaactgtatgaaagtctaacatacagaaaatggtacaacgctaagtatacaactggatacatttttgtcagataaatccatacatgttactagtacctgaatagagatcaagaatattcccagtactcagaagatcttctcttggaggcaaattgtgtttaacatctaaaaccgcaaattagttttcctgtttttgaacttcatagcacttattgaatagcacttttattgaatttaaaattttacataggatattctttttatcttgattctatttaaaactctttattaatattttcaaggcttccttttatctctttctgcatgaaacttttaacttacgtgattgcctaattcctgctgactcttgcctactatacctaatattccttgtttatacttttcttttctgtgctacttattttccttagaaatttctctgtagaaatgttttgaagcctggcctgaaagattcctcctatacaggcttgaatttacttccaacatgttggtggcactatgagttcagaaccatttgaaactaaattcttgataaaaggtttttatgccacttagataataaaaatttaagctacagccttgtggttgtgggttttccccccacccatctattgaaggtttcattttctggcagcgtttgtgagaggatcatataaagaagggaagagcagaaaactttatttctagtttacctgtacatgaatattctagccatttgcatgccagctttatcttttattattttctgcactgtgagttagcttcaggctttatcttcagtcagacttaacttgacttcagttcagtggtaaacacggatgctcaattttaaccaactttgaagtgcctcgggcatttactttgcatacctctgtgtttctggtttccctcagcccctggctttaattatctttactctttttggaaattcattaataagtttaagaagatatcatttggtgtgtgtgtgcatgcatgtgtatatgtgtaaaacattatataaattttatagtatgtgtcacatattgttaaaatacagtatagtcatttttatttttttaggagagggatcattcaacatatttatcgtgttgctgtaaatagaattcctcagttatgttttttaaagatgatgtgacactattatactctgtcttttcaaatgattttataaaaggaccgatatatagtgcccatcattctttataccttcaatactcatttaaaatctctcttatttctacaaaactcctgccaacatctactgcttgtctttttcatattaaaaaattattttattttcatcttgtttttcaagtacatcaagaatgacttaggaactgcggaagtctccatctttaaagcataaggtgctattatattctcaggtggttttatttttatttatttatttatttatttatttatttatttatttattgcaagaactgagatggcaacttaatttattttgaacttaaaaaaaatcacataccagatggagagggcttgaatcaaattgaaatttccagtctatttttcatactccctaagagaatatagagtgactgcataatcaacattgaaacatgaagtagaaacaactttttaaccacatggttattctcattgaccaaacctactctgaggaaaagagattatttcaagatatttaaattctcttttggtcttaaaaaactatagaaattaacttcttatgaataaccagaaatctatccctttttctgcatttaaaatggtgtttataaaaatattataagcctttgatgcatacgtgttaaaagtaatttactctttgtctttacacatgtacccagatagaaaactgatttggaggtttacttactcatttccagttttcacacagcccttctggtttcagtgtcatgcctgtattctctttttcaatctttcttgagtattgggactgatggcatgaattagactgctcttttatagcttccttctctggtcctcagtcatttgctatttacacacattccagctttaaaaaatttgtgatatatttcatcttcagtcatttcctctcttgttcttattagtcctttttgatttataatgctttttccatttcattgtcattttgttggtttcaaaatgtagataactttcaatcatttatgttcaagcagatacaggatgtctgaatccattccacctcctattatacccctttccattctacttctctgatactattgttttatgtttagctcatttttgttcagtaaatgtttcttagtaagtatagaggatggattgggggtaattggataaagtaggaaacctggagtcaagattagttaaatattccagatagccattatagcttagaagaaatgattgtcagaaccagggcagtggtaatagatactgggacagaatagagagaaatatttaaaaggttgacaaaaactgtccaaacttaatgactggattagttatggatagggaaggagagaaaaaaatctgtagaataactccgtggttcttagcttagatgtcaatatacattatttacatagttaatattatggttaggaacaaagaaagagggccagtttttggtgtgcatggtgggatggatgaatttagtttggtccatatggtgaagtatccatgggacatttaagtaaataaatctgatgagctgctgcatatatggatctagagctctaaagagggatcatagagacacaaaatgaccacagggaaaacatgaaaaaagataggattatccgaagtcatttatagagtgacaaatgaagtgggatctgcatataacaaggcagggaacgtaatgttatgggatgagaaaggaaggaataatttgtgatggaagctaccaatagaaggtcaggtaagtaaggaaaactgtgaggaaaaactgtgaggcactagtcttatggcttaagacgtaagattggatcatgtataaatgattagatcatttataaatgtagccaataagataaggactaaaaactataaggtttcacaattttaggtaactggtttcttttatcacagtattttcagaagaatgatttttttttttctttgagatggagtctcacactgtcaccaggctggagtgaagtggcacgctcactaactgcaacttctgcctcttgggttcaagcaattctcctgcctcagcctcttgaatagctgagactgtaggttcgtgccaccatgcccagctaatttttgtatttttagtagagacggggtttcatcatgttggccaggatgatcttgatttcttgacctcgtgatccacccctcttggcctcccaaagtgctgggattacaggcataagccaacgtgcccagcaagaatgattttaatgacagtcagtgatggtggcttgagaactgaaaaggaaatgaagaactaatttaataaataatttgtttaaaaatattatttgagaaatgacaggagaaaaaggatggttcctgaatgtatatataccttgatattgtttgggtgcaggaaacagaaaccaagtcaggataactaaagcaaaaatgaaacttaatgattcattgtctatattctattatagaaaacaactttgacttttagttaaaattttaatattactcccaccatctgactctggtggttatgaagaccatatgttcaattaaaaatttcttttctgccacgtgtggtggctcattcctgtaatcccagcatttgggaggccaaggtgggcagatcacaaggttaggagatcaagaccatcctagccaacgtggtgaaaccctgtctctactaaaatacaaaaaattagccgggcatggtggcgtgcgcctgtagtcccagctactcaggaggctgatgcaggagaatcgcttgaacctgggaggcagaggttgcagtgagccaagattgtgccaccacactccagcctggtgacagagcaagactctgtcttaaaaagaaaaaaaaatttttttctttatcttttttttacttgtcctcataacccctgagaaattatttttctctatctttagaattgcttgtttatcattctgggattccaaatttctattaaatttgcaattctttgaaaccaattatttagattcatgatggaatagaccaaaaagaacacattcgtatgtaactaagattatatactcaaaccttttattttttatggaaatattttggtatattgcatctgttaatatctgactttataagcagaaaatatggtacaaaatttaataatttaaaaaattactcaggattatcattgtgaatgcaaccagaataataaatgagacctctttatttataccttcaaatttttttagtatactgaggaatgtaaaaatgacataaatttgattccagtacaccttgaaacataatctacaactttacaggtaagggagttagttggcacagcattctaagggtgtctgtttttttcttttaattcctaaaacctaggctgatacttccttcaaccatctgtcctctctatcccactcaatcctccagcctttttttgtatttctttattttcctaaatttcccttatttgtcccattcattcaacaaatacatattgagcacctaccatgtggcagtcacatagagaatacagatttgaacaagacagatatggtgcttgcttgttgatatcttacaagctattgggaagagtagtgcaataaatagtccttggttgaatcttatgtattgctggctattgatatcttttcctagggtaactaaagattaaatgagatatacattactttgaacagtgtctggtaagtgctcggtaaaaaccattatggttctcaacatccatgtaggatttccaaattccatggcctggttttcaatctttgctgtttcccagatacattttctttccttggtctcttctgctgccatgttcctggaaccctgtatggaactctatctccgtaataggcttataactcttcacttcctttaattcacttatagaatccactcacaaagaagtattaaagaatgaagtagagtttgctgaagatgtcctaccatagggaagaggtggtactggtgtaccctgtatcaaacggtgtttaaagtggctgttagtctcttagacatgtttgtacaacacagtgcttatttggcccttttctcttcctctttaatctcttgaccaaagtaatttgaaattcctctccttttgtcatgcagagtaatttagttatttttgcgtgcaatccttttgatggcttcctttcagtcttagggtacatttaaaagtccttaacatgaccaagaccccatacgaattggccctgcccacctctccagttgtattttctgctacactccctgctgcttgctttgcccacctccagccctagtaacctttctgtgttcttggaataagcacagcgctgtcctatcacagtgccttagcatatgctacaaacatgacttcatccttcccaatctgtcctctaggcatctttctccttctcctccttcaggcttcagggcatttcatttatcaggtccctccaactctgtgctgtctttgtactccagtcatcacttttacaaactttatcctaattttaactatttttcttcagtatctgattcccctactagggtgaaaagagcaggagccatacctctcttgctcgttgctgtattaccattatttagcacaacacatgccacaaaaggggagctcactgtacattctcaggccacatgaaattttcaagttattcatggtaaatcgtggttggttactctaagggaggaagaacttaagaaattaaaaagttaccttctaacttatcttaagatccataaacaattgaaaaataattcctggtctttacgaaatgaaaaaaaggggggaaaaagcattacatagatgattaataggatgaacaaaaagttctctgtagatttgaggctctgtctatgctgaacttggacttctaaagttcaaaatgaggaactgtttgctgaaatgtgtcatctgatttcaattgctgtggaaagggagagatgatctctaatatagccagctccaatctgtgtagggtgtttgggtcaaaatcaacatcttgagtttcattagggagcacttgcagtgagccttgcagatgtaatttgctacatccagccaacacctctgagcagatggatttctacactgtgcctaagagaggtttgttttttcttctttgaatgagttgcctgtgacttttataaaatattttgacagaaatggaatattgagatcatttataaattaaaactttgctgttgttggatttagtgagttttaatagaaactgatgtgaaaattatttagcatctatgaaaaacacaggggctgcttttctatgtaattcttgttcaccttagtggtttatatgtattgttctattttaggttttttaagtcatagttttataatcataatttccacttgttctgaaagatggtgatgtactgttacaattattttctttccagtttcacttagtgtgtttgactttaatcctcaaaccgtgtatgcaaataggattccttggggagaaaaggaagctcagaaactaacttccaatttgtttttgatgatgttgtttttaaataaatttgttgggaacaatcgtgtatgtattactagtaaaattaagctgttgcactacctaaatgtacttaatataattgctgtagacattattcttctctaagtagctcacattcagccttctttatcatttatttagttaagggttctatagcttttaaaggctgaaaaggaaacttaccctatttattccttgcttatcaattttgcatttcccaatctcctccctctccccaccacacttattttaaaaaccaaaccaatatggcagccctaatatgctgtcatatttttcctgatcacatttttagactatttttttaaagcagtttgagtttcatagcaaaattgagaggaggagacagaaatagttcatatatcccctgctcctaaacctgcgcagcctctccaattcagtacatttgttataactgatgaacctacagggatacgtaattgtcacccaaaatctgcagtttactagaggactcactctgggtgttttgcattctgtggacttggagaaatatataatgacatgtatctgtcatcgtagtatcatgcataatatttttactgcccccaaaaccttctgtgctcaacatactcatttctcagcccttgcaaacactgatattttccctgtctccatagctttgcctttttaagaatgtcatataattggcatcaaacagtatataactttttcatatgggattctttgacatagtaatatgcatttttgcttcttccatgtctttccatggcttgatagcttttatttttttgagacagggtctcattctgtcacccaggctagagtgtagtggcacaatcatagctcactgcagcctcaaactcctgttctcaagtaatcctcctgaggaggactatttgccacctcacctggctaaatttttttgtttttaaatttttgtagagacagggtcttgctgtgttgcaaagggtggtctctaactcctggtcttaggtgatcctcccaccttggcctcctaaaacactgggattacaggtgtgagcagctgcacctggctgatagctcatttctgttgtgctaatatttaattgtctggatgtactagagtttatccattcatgtgtaaataggcatcttggttgcttccaagtgttggcaattttaaataaagccgctatatacctccatctgcaggtttttgtgtgaacctatgtttttggcttctttcgataaatactaaggtacatgcatgactgccagatcgtatggtaaaaatgtttagttcggtaatataccaccagactgtcttcaaagtggccatacaattttgcattcccaccaacaatgagtgggaatccctgttgttccacatactcactagcatttggtgttctgaattttggccattctgataggtatgtagtggtatctaaatgctgtttaaatttagtttcctgatgacatgttctgtgaagcatctttttatacgcttatttgccatctgtatgtctttgattgaggggtctgttaaggtctttggcccatttttaaaaataggctttttaaattgttgagttttctttgtatattttggataacagtcccctatcagatgttttgtcagatattttctcccagttttgcttttctttttgttctcttgagtgtttttgtttgcagaaatttttaattttagtaaagtccagcttatcagttctttctttaatggatcaagcatttggtgttaggtgtaaaaagtcatcaaaaagtcagggttatctagatttcctcctgttatcttttaggagttttatagttttgtgttttgcattaggtcttgtattagtttgttcttgcattgctataaagaaatacctgagactgggtaatttataaagaaaagaggtttaatttgctcacagttctgcaggctgtacaggaagcgtggtggcatctgcttggcttctggggaggcctcaggaaacttacaattatggcagaagacaaagggagagccagcacttcacatggctggagcaagaggaagagagggagggttggggaggtttcacacacttaaacagccagctcttactgaagtataatttatataatgtaacattaaatttattaagatgtataaccatcatcataataaagttttagaacatttccattatcccaaaagttttcttgtgtccatttgtagttgatccctgctcctacctacagccctaggcaaccctgatctgctttctgtccctataaatttgccttttctggacattttaatacactggaatcatacaatatatagtcttttgcatctggcttctttcacttggtgtaacattttggtgttcttccatgatgtagcatatatcagtagtgttcctttttattgctgaggagcattccattgtatgattatgctacattttatcaattcaccagttgatatgtacttctactttttgcctacagtgaataatgctgttatgtacatttaggtacatgtatttgtatggacagatgttgtaactgatcattgatagagtctttagagtggaatttttgggttgaatggtaaatttatgttgaacagttcaagaaactcccaaatcactttctaagtggttataccgttttacattcttgtgatcgatttgttagggttagcgtagctgtgggtttttcagagatgcccatcatcattttgagaatgatccattttattcctagtttactgagaccttgaatttatttatttttttgaggcagagtctcactctgtctcccagactggagtgtagtggcacaatctcggctcactgcaacctctgcctcctgggttcaagtgattctcgtgcctcagcctcctgagtagctgggattacaggcgtgcaccactatgcccagctaatttttgtatttttattagagacagcgtttcaccatcttggccaggtttgttttgaactcctgacctcaagtgatctgcccaccttggcctcctcaagtgctgggattacaggtgtgagccaccgcaccagccattttattgaaaccttttaaaaaatcatgaattgcttgttgattttatgaaatagttttttgaatatattgacatcatgtggtttctatactttatgctgttactattgtgtattaaacaattctatataattcttatgtataattaataatcatgtgaacctagtatttctcaaatgtatcccatttggtcatagggtgttatcctctttatatggtgctggatatgatttgctaaatttttaaaggatttctgtatccatgcttattgaggggttttagtctgtagatttcttgtagtgactttgtctgcttttcatatcaagttaatgctagcctcaaagaatgagttgggaagtctttcattctgtcctgtttttgtaagtgtgtattagggattgacattctttccttaaatgtttgatacagtttaccagtgaagccatgtggaattggtagaacttttttgatggaaagtttttaaattaataatttaatttctttgttataggtctatacagattttcttccttctttagtcagttatggtaagttgtatctttcttttttttttttttcttttgagacagaatctcactctgtcgcccaggctggagtgcagtggtgtgatttcagctcactgcaatctctgcctcccgggttcaagccattctcccgcctcagcctcctgagtagccacgatcacaggcgcccaccaacatgcccggctaacatttttatttttagtagagttggggtttcaccttattgaccaggctggtcttgaactcctgactacagatggtccgcccgctttggcctccctaagtgctgggattacaggcatgagccactgcgcccagccagtaatttgtatctttctagacagttatgtattcatcttgagttatctaatttgttggcataaagctgttcttaacattcccttttaatctcttttatttttggtgagttaatagtgatattctctcattcctcattctggtaattgtgacttatcccttttttctgggttaagctaaaggattgtcagtttgataatctgttagaaataatttttaatttcgttgatttttttctatcttttttttcatttcattgatttcagctccaatctttactattttctttttttaatagctttgtgtttagttttatcttattatttctcatcttaacgctaaaacttagattattgatttgagaaatttattcctgtatgatgtgggcatttaatgctataaatgtctttttaaccactactgaagctgcatcccagaaattgtgatatgtttacattttttattttctttaaagtgttctgttattttccttatgatttcttctttgggccctgggttatttagaaatatgttgtttaacttccaaatattttacaatttcatagatttctttttgttgctgatttcttttttttatatatatactttaagttttagggtacatgtgcacaacgtgcaggtttgttacatatgtatacatgtgccatgttggtgtgctgcacccattaactggtcatttaacattagttatatctcccaatgctatcccccccccctccccccaaccccacaacaggccccggtgtgtgatgttccccttcctgtgtccatgtgttctcattgttcaattcccacctatgagtgagaacatgcggtgtttggttttttgtccttgtgatagtttgctgagaatgatggtttccagcttcatccatgtccctgcaaaggacatgaactcatcattttttatggctgcatagtattccatggtgtatatgtgccacattttcttaatccagtctatcgttgttggacatttcgtttggttccaagtctttgctattgcgaatagtgccgctataaacatacgtgtggcctgtgtctttatagcagcatgatttataatcctttgggtatatacccagtaatgggatggctgggtcaaatggtatttctagttcttgatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcacttctctgatggccagtgatgatgagcatgttttcatgtgtcttttggctgcataaatgtcttcttttgagaagtgtctgttcatatccttcgcccactttttgatggggttgtttgtttttttattgtaaatttgtttgagttcattgtagattctggatattagccctttgtcagatgagtagattgcaaaaattttctcccatgttgtaggttgcctgttcactctgatggtagtttcttttgcagtgcagaagctctttagtttaattagatcccatttgtcaattttggcttttgttgccattgcttttggtgttttagtcatgaagtccttgcccatgcccatgtcctgaatggtattgcctaggttttcttctagggtttttatggttttaggtctaacatttaagtccattgtggtcagataatatactttgtatgatggtcattcttttaaatttattaagactttttttaacgtctagcatatggtctgtttgggagattgttgcgtaggcacttgaacgtgtattctgcaattcttggctgcagcattctattaatatatatgccagttacgttgagttggttgataatcctgttcatttcttctatcaccttattgagtttctgtctaattattctatcaattatggagagcagggtattgaaatcttcaagtgttattttttagttgtctattttagcatttaaattctgtcagtttttggttcatgtacagtcatgagtcacttaacaatatgttctgagaaatgcatcattatgcaatttccttgttgtgcaaacatcatagaatatacatatacaaagctagataacatagcctactctacatttaggctatagcccatctgtggtataacatattgctcttaggctacaaacctgtacagaatggaactgtactgaatactgtaggcaattgtaagttttggtaagtattaattgttaataatggtaagtattttttattttatctcaaacatatctaaacatagaaaaggcacaatagaagtatggtattagaatcatatgggaccaccattgtgtatgcagtctgtcattaagtgaaacattgttatgtagctcatgatgtattttgagattctgttgttagatgtatatgtacctatagttgttaggttttactaaaaagttgaccctgtttattattatgcaatatctgtctctgtaatatttcttgtcttaaatcagtttttatctgttattaattatagctacttcagctttcttatggttgtggtttaatagtatacctttttccagctttttacgttaaacttacttttggttttgaatgaaagtgtttctagtttaaacagtattttgttaatcttgctatttaatgcagtctgacaatctctgatttttaaatggggcttttaacatttccatttagtgtaataataatatatttgaactcacttggtaatttgctatttgttgtctgttgttcctgtcttttttgttactctgttccccttttactactttatgtgctttatatctgtattttagtgtaccatttaattttctctattcatttttgtactatgtatattttcaatggtggctctcggagctgtattatgatttgaatttacattctacctcagttaagctcctaaattaattctggtaaattatggaaaatttgttctaatttatatctaatctttatcccccttattgacacatatatctacatataatataacccaatgttacagttacagtgttataattattgttgtatatattcagtagcattttcaagtacttaagagaagaaatgatgaatactatatctgtagagtctttcatataacccacatatttgtcatacccagtgctcttcatttctttctgtacattggagttaacacctgaaagattgcaggacaaggtatttctggtaaggaaggtctgccaccattgaataatctgagtgcctgtttacgagagaacatctttgtttcacttttagttttgaaggatagttttgctgggtataaaattattggttgactgttttgttttttttttcttccttggtagtgttatcagtttccactgatagtgttgctgagtgtggacattgttcaccactccaaatcaagtgacctctctttgatcatggcagcaatgccaccagtcctcatagttgtgctagtggaacctcctctgtggtagagatagaaatgacttcatgcaagaacatcacagattctcactcttcgtatcctaagttcaacagttcttcaagcataaatgcttttctcattctttcaatcccagagtgctgaaatggttgtgttttttgttaaatgttgtatcaactgtatctagctttgcagtttatttttggaaagaggattttaaaaaacctccttatttggccataactgcaagtctaacccaaatcctcttcttttctcaagctacttcatgtattactagtttttttttttaaatatttagcctggaaatgattgcatttcactatctccttagattggccccattacgagtaaggaaatgcaatgcattatgacctatgcagaaagaattactggtgactgctttatacttaagacaactgtgagtgtggtagacagtttgtgcaataaatagcacaaatgtatgattacatactctctcagattttcattttcatgaaatgaagttcagctttgaatcattccagctctttgacatctgagcttttcttcttacattcctgacaatatttaggaaaattacttgtgactttcattaatgatcttgcaagcttttctaacttatttaatgtctttgcattccttatagtagctagataaatttttttttaccgatttctttaaggttatctaattgttttccctacttaacaggcaacattcatattactttaatggaagtcagtgaaagcattgacaatttctcatccagacccatcacattcctaataaagagcctttgcaattctcctagaatgtttctcttccaaatagtcccacagctcactctctgaagaattacactttttcagaaaggccttactggagtatcctattttaaaatgacaccaccatcagctagtgtcccattactctgctaattgttctccagagcttttatcaacattgacataaactaaatatcagttaatagttggttatctttctttctaccactagaatgcaagctctatgaaaacaatgagtacgtattgctcagtgctctgtccctagatcctagaatgaggtcacataattttagctcagaatattggttcaacaaaagaatctgccttactagaagcaatctttatactgctgccaatgcttaagacccagccgtttttactcattcattcccctccctcccttccttccttcctttcttccttccttccttccaacttccttccttcctttcctaactctcccttcctccctccctttctccctccctccctccctccatctcttccttttgtgtactgtatgctatgcactgtgtttttagagaacttgcttataaactctttattttctccatggtggcatgtaagaatatcaagatatcttttcatcttgtccaatcaagataacaaactttttggttgtcaaatcgattagaactttttttttattcttgacatcattggttgattccttcttaaatacctttctaacttctggataaccactctcttttggttttctgtggatcttggccattctttctgaacgttcttcatgggctgtttttccctttcctctacctttctcttaaatacaggtattcttcctatgtacagctttcctaaactttagctatcatctttcactgatagtttacagatctctaagattttcacatacctgacttctttgttcctttcttatatgcccagatacccattttagctatacctatattaatgttaaggattgaatatttgtgttccctcaaattcatatgttgagcccttaacatccaatgtgatgtttatgaggtggggcatttaggaggtaattaggtttctgtgacatcatgaggttggagccagtgggattagtaccttaagatgaagaggaagaaataccagagcttcctctctcttggtcgtgtgagaacatggcaagaaggttatctaattgttttccagcctcaaagagtgttcttaccaggaaccagatctgccagcaccttgatactagaactcccagagctcttagagatggatgtctattgtttaagccactagtctatggtattgtgttataacagcctatgctgaccaagacagctatccattccatggcactgatgttaccgataggatcttgtcttatagagagtagtaggagtcttcaataccaatttaccctaagtcacacactgttataatattcacatttttagcaaaactatagggtaactactaatacctttgttgttggaagggcaatgctattcttttcagtcccttcttcttttaaaagcagtgattattctagttttgcattgtttacaattgaaataatgttttagagaatcttagagtattatatttctttatgaataatgaaatgttgacaaacaagtcacgattaatccagtagtgactttcagaagtaaataatagttttattagtaacatagatttctatatgtaaaatgtttttcacaaatttgaaatcaattatctcttaatactattatcattattattacattttgtacatgcagttcatttcacatttcctaacacaaaacagtattccaaatgtagaattttagttacagagcaaataaaactgaaggttgctcattttcatttcctttctttctatgcctttcaactgtcttcctcttctatgaagatggactagatatcatttataatgtcttgattttctttaaagtacctattacttaaattaacatcacttagaattaataaacactttatctttaactgtctattttattttattttaagatggagtttcgctcttgttgcccaggctggagtgcagtggcatgatctcggttcactggagcctccgcctcccgagtttaagcaattctcctgcctcagcctcccaagtagctgggattacaggcgtgcaccaccatgtctggctaatttttttgtatttttagtagagacagggtttctccatgttggtcaggctggtcttgaactctcgacctcaggtgatctgcccacttcggcctcccaaagtgttggtattacaagcatgagccaccgctccaggccttaactgtctttaaataagttaaatgctaactagtttggagtaataaacactctcagcaattttggcctatttatgtttgtagtacatctttctctcgagtgttatactcacaataggtggtagaatgttcctggttatactggttcatatttgaaatacagacctgcctgagtcatactggttttttgaatgtaagagaaaaaactgggagaagaggaaggcatttttgttgttgtttcttttgacaaacattcagtgactaaggtaatgaaaacaaagaaaactgaggaaagtatctccaatattgaccagcattctttccacatttgctaaatagatatttgtaaggtgattcaaactggcctcaagtacatacactttttcctgtagtgtagtagagtgttttttgaaaggaaaagactgattatctttccagaatattgattcctacccaaaaagattcagggtcataaattatatttctgtgataaggatttgtataaatagtcattgttcactaaccgcaacattgacaaaaacgttttttatatctatattattaaaattatttttgtgtcatgtaaaccataatcttttgattatagcatggtatgatatcagcaacatgtgatacaatataaagaaatcccctgtaattttctttttaagtttcactcatttgtaagtttaatatgttcctttggggacctcctccctgctccaccccttggcgttgacacatgtaacgcatagtctcactggttgttctttatttattcattttgtcccaaagctttctgtcatattcactttctttcacattatttggtctgaattacatcagtgtttggtcatcattttcttgagaattgttttgtttgtattcttttctctaatgataatatagaggggtaacaaattcacatacaaagagattctcaatcttcctgccttgttctttttttcttattctttagacattttgcttgaaaattttttaattctgccggcaatattttctctaaaatgaaagacttagattatagcattacaactttccaagtaaaataaaaatcttaatcttgaaggtcagcccagattgatagaaagctatatgaagttctcagaatagtatgtggttctggccagtcatggatgtctgaacatattttatggagtgcccagaacattattttgccagtattataagtagataaggtgttttcattctggtgtgtgtgtgtgaaaggaatacttgtgcagttaatgtgttttgtgaatttttctcacagtgggaaattgtggaatttttgtcattgcatgttaaaatttcatcttctaggtatagtgtgctttttaaaacaatctgtatgctaaataaatggacatgaagtgtagtaccttgaaaggttttttttttttttttaggagttagggtatgatatgctcaatttcaatttcctaatctgattccaaagaagacgcagaaatataactgtgatagtaccaatgttatttgggatttttaaaaatttaacaaattttaatctggtccccttccatccagcataaccaccatttagcatttcttggatacaataggatttgaaaaaatatatatagctcactaccagctttaaaatatataatccgaactcagtccaaaatattttaagacaaatttggcagagcctttattttttaaatagcatggaatttgatgtaggttttaaaataattttagaattagttacagatgatttagtttgtcattcttcctagggggaaaaatattttaaatcttaagacagacaaagtaccatagtgctgaccacatattattatgcagttatcattgtttccagtcaagttattgtgaactatgttgctaggtttattttattatgcaagtctcactttcaaagtttctaattttataataattttattaactatatttggtcaagacatttttaatgttcaaacttataagaatgtatcttctggtacctactgaatattgaatatatatttagactcctctaaaatatttgtagtatgatctacctagtaattcacttggtattttttcttcagtgaaaaaacaagggaagaccatgagtgcagtgtgatctctgatctcatctctgcctgggcacatccatcacccataggggaaaaaatatatatgaaggaaatataactaagtgttaatattatttattattgggggtggcaaaatagaaggtaaattatgaatggttttgatattttcttctttatatgtttcccaatttatctgcagtatggcatctattacctctctaattagaaaataaatgtcctcaatttgttctaaaataattgaattactaaaaatgatgttcgtgttatactctctgtactgacaagcactagtagaattgtaaagtccaaaatacaaatgatataaaattgatatcaccataataaatgtttaaaaatattctaatactaaatggactttttaagagttcaaaaattactttcctatatttacaagaaataaatggctttatctcaaatgtttatattaataaattaattttacctgagataagtcagtaaaagctcaaagtataaaaagggaattttgcttttaatcctgaaatttatgaatgccaattttttatcaagtgcattttatttaaaaataactcaaatgtaagaataatctagggaacatatcaaaattcatgctgggtcgtaccatcagagattttgattaagaaggtctaaagtcctaggaacctgtgttttaaaccagcatcccacatgaattctgaggcaggtgatccaacagaccatattagattgtttattcttttcctgtctcattccatggcaagatctatggtcattttcagtaccatagataaaatcaggattcaagttgaatctgttcctctacattctatcaggcagagctgccataacaaagtaccataaactgggtggcttaaagcaacagaaacatattgtctcaaagttcttggaggctacagtccaaaatcaaggtatcagatcacatttatgtaatgtgatctgttttctctggcctccagggtttgcatacgtccccaacagtttcacaatacaaccaactagggtaagggaagaagaagttagaacttttatttttatttttatcccatatatttaatttctgttaatgtacggtttatagtgtatataattactgacagaattttcagtagcatgtaaattgtttagcaccgtggtctcaggaatactatattcactttttatgatgcagtattagtcataaatgttaaatgttttacattttactatcaagtgaaaattaattgtctttttgtttgtgtgcttccctattcccttttatcccctatatcaggtgatgcttttccttggacgatcagcttgcataatttcagcatatatacccttcttggaaaacaagtgacactttgcctagtggaacctatgggttgcacctccactctagctgtcacgtctcaaaaactgcttgctacgggacctgatacacgacattcatttgttgtctgtctccatgttgacctagagtcactagagataaaatgctctaatccccaggttggtacatttgatttatgaaaggaaatttaaagtaatgtgatttaaaagcaattgttatccattttgttgaagggtttctcttctcttgagtatcctaaattatttttaacttggccatcaagatcagggtggttagattaagaattgctttgaagctctctcaagttgtgtaatttaaactcttctgaaaatgtaatggtggcagtacaaatgtatcttttggctgatggaatgaaatcagttgcagatgtaatgtttttaaacactgaagaactattttactgtaagactggaagagtctgttgaactgatcgagtgtaattttcattcagattctcactcagaacttctttgcttatcatgcaatttttttattattatactttaacttctaggatacatgtgcacaacgtgcagatttgtcacatatgtatacatgtgccttgttggcgtgctgcacccgttaactcatcatttacattaggtatatctcctaatgctatcccccgaccccccagcccacgacaggcctgagtgtgtgatgttccccaccctgtgtccaagtgttctcattgttcaattcccacctgtgagtgagaacatgcagtgtttggttttctgtccttgcaataatttgctcagaatgatggttagtctatttgagggtaaataaacaagggttaaattgtatgcaactaattatttgtgcaaacccaggtgatgtgaattcatattaaactgtaaaattacaagatacagcatgattggtctatgacacctgaaatctttttctttttaaaaatattatttttaaaaagaaatattaaaaaaaatttaaatattattttttaaaaacattatttgttatatttgttatattaattgttataagccaatttttaagagtacttttttaagtaggttcaagttagttgagcttgatggcacatgcctatagtcccagctactcaggaggctgaggcaggaggatccttgagcccagaagttagaggctgtagtgtgctatgattgcacccgggaatagccactgcactccagcctgggcaataaagcaagactctttctcttaaaattttttgttttgttttaattcactttttatgaagcagtattaatcataaatgttaaatgttttacattttactatcacgtgacaattaactgtatttttgtttgtgtgcttccctactccatttcctcccctatatcaagtgatacttctctttggactatcagcttgcattccatattttatagagcgtcttttttgaaaccatcctcatcctttcttttcttcttgcctccttctccctactatatactatactgtttgatttaacttttatatttgaaaagattagacctaataatatattggtaagagtcttattataaaaatgcatttaattggaattatgacaaggcagctttattaaaagaacactgtcataaaaacttaagaactcatcttccactacagtaaacattatttcatgttttctttctttcctttttttttttttttttttgacacagggtcttacttggtcccccaggctgaagtgcagtggtgcaatcacagctcatgcagcctcaaactcctaggttcaagcagtcatcccatttgaaccttctgagtagctgggactatagacacatgccaccatgaccagctaatttatttcatttttatttttttgtagaacagggtctcgctttgttgtctgggatgatcttgaactcctggcttcaagcgatccttctgcttcagcctctcaaagtgccgggattacatggtgtgagcaccatgccataaggtcatttattttagaatcagtagtgaatacttttgaatgacactaaatatttcagtttaatggctatttgcctttctattatacccatagtgatatagaagaaaataattatgaaatgactatcttctttgagattactctttgagtgctgctgctaatggttgctttaaagtgtttttaaaaggaaaggaaactgttatggattgaattgtgtccccgcaaaaatatatgttgaagttctaaccttgtgtatctcagatataaccttatttggttataggtttgtaacagaagtaagttaaaatgaagtcattagggtgacccaatgtgactggtatccttataaaatagaaaaatttggacatagacacatacaaagggaagatgatgtaaagatacacatggagattgtcatgtgaacatggaagcaaagattgaactagtggagctgtaagccaaggagcacccaagatggatagttcccaccagaagaagctaggcagagagccaaggaaggattgtactcagaatctcagaggttgcatggccctactgataccttgattttggactgtagcctccaagaactttgagacaatatgtttctgttgttttaagccaccgagtttatggtactttgttatggcggctctgcctgatagaatgtagaggaacagattcagcttctttagacactttatcacagaagttgttaaaaaggaaaacataagatatctcttagcatggcagtataagctccctcagcctatctttcctactgattattcctatatactctaggaaaaattcaaaaacaaacaattgactacccccacataaatgcatgttctcaacttgttttaaaataattgaattgcaaaatgactttaaggcagcttttagaaatttttatgaggtgcaaaggaaagcatactaaatgaaaaggcaataaatctcaattgaggaataaaaagtataaaaagagtcaaatggaattttagaactaaaaaatacagtacctgaaggaagaaaaccatattatgtgggcttaaaggtagcttggagatgatagaagaaagagttactaaacttgaacatagatcagtagaaattactgaatttgaaaaagaaaggaaaaaagtttttttaaaaagtgaacagagcttcaatgattgtagaatagaaaagtcgaatattgtgtactacttggagtttcagaaggagaggataaaaggattgggatagaaaaaaaaaaaagaggaaataactacagaaaactttgcaaatttggggaaagagatagtctttacgcatccaagaagttcacctaatcccaaacaggataaacccaaagtaacaaacatttggacacattgtgattaaaatattgaaaacgaaaaataaattttttaaaattttgacaattttgacagcagatataggaaaagacacattccatataagcaaataatgatttgaattagagtagatttctcattagaaaccacaggagacagaagacattggaacaatattttggaagtgctaacataaaagaactgttaacctagtgaagataccccacagaaatgaaagagaaataaacccatttttagatgaagaaaagctaagaaagtttgtcaccagctgctctattctacaagaaatgctaaaggaaattctgcaggatgaaggaaaatgatactggatgaaaaattagatctttaggaatgaaggaaaaccaacagaagggataaatggctgggtaaatatattttttaaaaaactacttaaaaatatgtgtgactcttgaaatcaaaaagcataacattgtctgctggttttttcagtgtatgtagatgtagcatacaagacaactatagcattaaggctagtggaagatggagtaaaagaatctatggttgccaagtttctacatatcatatgaagtggtacaatataaactcttaagtagaccgaaagttttggtgcatatgttttactctcttaggacaactaataagaaaatgcaaaaatacaaaaggataaagccaaaaagtcaatagagaaattaaaattaaatactaaaaaatattcaaagaagccaaaagaagatgggaaaaagtaacaaaggaacaaaaaatggagggtaaaacagtacaaaaaataaaatgctggagctaagccagctatattaataattacatgaaatatttatggtctcaattaggaatctgcaaactaatgcccataggccaaatttgcccacactccttttttacatattgtctatggtttctgccatgctacacctgcagaattgaataacggaacagtatggcccacaaagcctagagtatttactctctggcccttcacagagaaagttcacaaattattggtgaaacactccaagtaaaaggcaaagatctacagtgggaagtaaaacaagatgctaccgtataatacctaagattgtattttacttaaatataaagaaacgttataaatagatgcatagtaaaagatacaccatacaaacagtcagcataaaaaggctggacttacttattttaatcttagatagaacaaataaaaagtgtgttaccatagatagagtgacatgaaacaaaaattaacagaattaagggaaaaagatagagaattctagaatcgtagtaggaaatttttataacacctctttcagcaatggataaaacaactggattaaaaataaataattgaagatatagaagatatgaaaatactatgcactcaccttgatctaattggcatttatagaacagtatatccaacaaccgtagaatgtgcttttttacagatatacatggtctcatttttaagaggatcaaaaatcacatgaaagtattatttgaccacagtcaaattagaaattaataataataaaatagctagaaaaactttaaatatgtggacattaaacaacatgcttctaaataatttatggaacaaagacataattatttgggaaattagaaaatattgaatgacactaaaaaaaaactggataagctaaggcaatgtttagagggaaatataactttaaagacatattagaaaggaagaaagatcttaaatcagccatttaaggttcaattttagaaagctaagaaaagaacaagagaaacccaaagtaagtaaaaagaagaagataataaagatatgagcagagatgaatggaacagttaacaaaaaagtgagcaagagatagaaaattaataaactgattcttttaaaagatcaacaaaattgacagttccttagctagactgaaataatagagagggagaaaaaaatgcaaactactaatatcatgaataaaggggagttgataacattaaaagcataataagaaaataatgaacaactttatgccaacaaatgcaacaacttagatgaaatggaaattttcattggaaaagaattccatcaaagttgacacaagaagaaaagagcaaaaccaaatagctctatatcttttaagaaaattgaatgtgatgtcaaaaactttcccatggagaaaacttccaatctagatggatgaattctatcaaatattctggaaaaaataacataaatttttcacaaatgttttcccagaaatgaagcctgaagcatccctgcccaactggttttatgaagctagcataactctaataacaaaacttcaaaaagactttacaaaagaaggaaactaggtattaatatccctcatgaaaatgatatataagttcttaaccaaatgttaacaaatcaaagataacaatatctaaaaggcataatatatatattatacgtaatggccaactaggaattatcttaaaaatgcaagtttggtttaacattcaaaaatcattcaatataatttaccataataacaaaacaaaggagaaaaatcatatgatcatctcaataaattcaagtgagacatttgacagaattcaacatgcattcatgatgaaaagtctcagcaaattacaagtaggaggtaacattctcaaactgatagagatcatataagggaaaacaatggtaaatatcatacgtaatggtaaaatattgaattgtttcccactaagatcaggaaaaagtccaggatttctgctttcaattctattctgtatcatactagagttcctaaccattacaataaaccaagaagaattaataaaagatataaagataagaaatgaagaagtaaaactgtttgcatgtaacatattttatagaaaaccccaaaggagtctaataaactattactaaaactaacaaaactcaccaagcttttatgagacaaagttaatgtattaaaaccatttgtatttttatgtactagcagcaaacaaccggaaaatggaatgaaatcaacttcactctttactaacatccaagaaacataaatgaataaatctaacaaaagatatctaagacctctatcctgaaaaccataaagcgttgctgagaaaacttaacacctgaaagaagtaaagagatatatctcctcatagtttggaagactcaaattgttgatggcttattgatcttgatattgggcgtaatcaagtttaaaaaaatactttttgaatgacacattgagatagcagaaagcccgacatttggagaaggtgtttacaagacattcttcaaacaatggactgttatccaattttttttttttttttttttgtggagacagagtctccctctgttgcccagggtggagtgcagtgatgtgatctcggctcactgcaacctcctcctcgcaggttcaagcgattctcctgccttagcttcctgagtagctgggatcacaggtgtgtgccaccacacctggctaatttttgtatttttgtagagacagggtttcacctgttgaccaggctggtctcaaactcccaatttcaagcaatccacctgcctcggcctcccaaagtgctgggattacaggcatgagccactgcacccggactaaaaattttttctactcaataacatgaagatgaacaataaatgataaacataaagacaaataatggggaaaagacttgagcagatacttcacaaaatacttatttgaatagtcaataagcatatgaaaatatgcccaatatcattatcaggggaaaaacgtcatgaagaaatagaaatacacacctattagactggctaaaataaatgatagactcaatatgtggaccaactggaactcatcatacaccgcttgtgagaatgtaaaaatgatgtaacaacattggaaaccccttgacaatttctgaaaaagttcagcacacacttatcatacaacccagcgatttctccctatgtatttcctctgagaaacaaaaatatatatccacaaaaggtcttttacacagatgtatatagcagctttatttgtatagccccaaactggacacaactcacatgtttatcatcaggtgaattagtaaaaaaattatggcctactcataccaaggtaatactaatcagccattaaagggctgaattattgataaaatgcaaaatcattgacgaatcttgaaatcattatgctgactgaaagaagccaagtggaaaaagagttcttactccataattccatttacataaaatgttaaaatatgcagattactattaatatatagtgatagaaagtaggttacttgttgcctggaagtagaacagcgagagagaataaagagggggtgataggaagaggacatattacaaagggatatgaagatatttttggaagatacagaactgttgtttttctaaagtcatagtttatacttagtggtagctcagtctctctctaaagctacatataatagacagccccctgctacttggagttatctaccaaagttcttataatttaggaaagataattgtagctgtgagaggatagtcctactccacatgttctagttatccatagctgtcctagctaacacaaaaaatattcttagactccactattattcatatttttaaaattttctttactttgagatacttaatagttttgtgatttttatggtgttactaaatgtaatactttggctcaaaactagagtacttggtatattctctagctatccacattgtttggagctaagctcagattttgttgttgtttaaatgtaaaccagctctaagcaaagtcatcagctagatggggcttgtgtttggccttgtatttccttcctatgtctgttccttccctgttgtcctttcttcagttatctggcttccagagtcacctggttcccagtgccacctttctcctgttctcctgatgccaagaacctttttttctagaattactccaaggatgaatgaaccttatgcactgagagttcatttttactcgaaatgtagtaactcttatctctttatgtaattctactttataaatctcataaaatccttggagttactcaataaatcctcataaacaaaattgtgttaaactgtcaccacctggtgtaaccaacattgatcacaaggttgttgggaagtctgaaatatttatgaaaatattttgtaaacactgaaatgttatatgaatatcattttattagtgtagactgactctgattaaaatgtgagaccatctttgcaaattggtatgaacatccctggtgaaatgtagcaacattcctgaagagatgtgaaaccacaaaataacagcactgaagaatctatataaactaaaagacttggagagggattaatactctttgatatcttcaagtgagagattaacctaaattttaatgacaaaacatgagactctaaataaacctctttgttttgagtgattgctttagcttatgcttccagactctctttggatgctttcaaaattccaaaggatggcttgattttttttttttttttccatatgcagtaagcaaattcttattgagtgctacatgtaaggcagacatgaagatgaataaaacaaacacgcaaagaacgccatatctacatacctcataatccaactattgaaagccacaagtaaagaacaaatattgaatatatcacaagaaaatacatgtatgataccttacgttcaggggaaccaagatttgattaacagcttacttctcgtaagaaaccacgaaggccagaagaacatctttaaattaggaaaataaaaaataaaacgttgcaatcaatttagaagttcttaattaagcaaaaataacttttataaatgaaaactaaagaaaaacattttcagagaaaagactctatcaccagtaggaactgcatacaggaagtactaaggaacatttttcatgctgaaaggaaatgacaccagatggctgagcatctcttcaaatgtttattggccattgagtttgctcattcgtgaattgacagtttacattaatttatatttttctaattactaataagattgagcttttttcacatgtttattttccagtgaatttgctcttttgtgatttgttaattcatatcatttagccagtcttctattaaattcatttttcttagcaatttgtaaaagctttctttaggctctataaatacaaaccccataactgtaatgcagttcatttgcttttaaactttttgacatcttctgccagaaatttaatctttcatggtcaaagatacctatatattcctttttattttctgggtatcctgtcttaaaaggagtatcatggacccctaaaatgcacgcagacatacacatgacctaaaaatgtcttttactgttttttcttttaaaattaatgtctcagaatttctttcttgtgctttctcatttatccatctgtttttgttgtttgctttttgtttttaaaatatatttgttgtaaggaagaggagcaaatcaatacttcttgtcctttttataccattggctaaaagccgtgagccaattctcagaatattatatagacccattaagattgcatactgaggtatactgtcagaaggtttgtgagcttttgactgtagccagtgtgtacgtttcttgattacattttatggaaataattcctacttaaatacctttctttgacttatccattaggatgacatcagaattgtgacccttgtacactattgaatctatttcattgttgcctagatagagtaccttcatgtagttaatgtactttaaaaatagagaaggctatgtatgtaaggtaggctgagagcaaatttattactgtatcagacattactgtctgtctatgttattcctggaactttcattgccattcagtgttcttagacactgtgtatatttatctgggttgaatatttggtgctttcgtgactagaagagatttctgttatccattcccttcatcttaactatgtgaccaaagttaccctgtttcctttaatgtctttagacaccagtatctcagaccctaaatactatgcttattccaaagttaaatgagcctgtcctgtaatcccagcgacttggtaggctaaggtgggaggatcacttgagctcaggagtttgagaccacttgagcaacataacaacatgctgtctttatttaaaaaaaaaaaagaaaaaagaagcccatagaatcttttttttttttaatgtgatgaaacttctgtttacctttggccaacaaactgatacattgttttcttataggcattcacaggaacataacactttcttagcattttggggtttatatatgtggaactgagaaagaacagatttatgccagttttctattcatttatttatcgtttttattgctgttatgttgatcagtttgctgtataagaacacaggctttgagtttagacaaaactggatttgtatccttgcaccactcacccattttttatttctctgagctcttgattttttttttttttgagacagttgtttttttgttttgttttttttttttttttttgttttttgtttttttttttttgccgaggcaggtgtgcaatggtgtggtctcggctaactgcagcctccgcctcctgggttcaagcaattctcctgcctcagcctcccaagtagctgggattacaggcacccaccaccacacccggctaattttttgtatttttagtacagacggcgtttcaccatgttggccaggctggtgttgaactcctgacctcaggtgatccgcctgccttggcctcccaaagtgctgggattacaggcatgagccaccacacctggcgcgagctcttgatttttgttttaacttttaaacgaaattaaactggacaagtgtaatcttttatgtgaaaagttgtttttgtgtaaaaaaaaaaaaaaaacaagtttctgaaactgagttttaatgattagtaacaacctacatgccaaatgaaatagtttttctaagattgtattaacttagagctctctgcattgttcaacccagatcactaaattgattggtgaaattccgtttctccttgatttctgttgacattgtatatccatgttttttcttcttcctctctacctttagtgattctattctgacactatctcctgatactctgcaaaatgggcccttcctctctagccacctagggactcttcatcagccctgtatcttgtcttgatcatcccctgcgcttggcttttgttcattctgtatttctgagtagaatgactttgtactcatctaaatcctgtctctccttcaggaatataccttgaggcttttctcagcctctccagtgaaattgaatcttttttatgaacagctatagattaaatgaaaaaagtgtgtgaataaattttttaaacataatgttacatatttatattcagtcagcattcaatacacaagacattgttgatattcagacaccttcatacagaactcatgtaaagccacctcacatggtatttattttttagggatttttaaaaaatgttttattgaggtttacttaacatacaataaactgcatgtttaaattagctaatttgttaagatttggcatacatacacacatgaaactacgcccacaatctaacatcttcaagtttctttatgttcttatgcagtcctccctcccattcctccccatcacaggtaccattgtttctgtcattatagactaatttttgtttgtttttcttagcctagcttctttcattctgcataattattttcagattaattcacattgttgcatgcatcaatagtttatttctttttatggctaaacagcatcctgtcatgtgaatgtacttcaatttgttaactacctgtcaatgtatatttgggattttctccaatttttgcctattacaaataatgctgccatgaacatttgtgtacacatctttgtatggacataggcttcatttttcttaggaaactacttaggagtggaatagctggatcatatacggtaggtatatgctctttttaaaaactgtcaaatcgtattctaaattttacattcctaccagcagaaaatgagagcgttagttactctacatccttactaatacttgatgtagttaggctttttaattttagacattctaaacatgggaagtggtagttcattgtggctttacttggcatagtgttttagcacaacttgaaggataaaagttgaacatttatcctacatgtttttgccttatttctttaaacctctgaatttggaaagtctgagttctgttagcaactttcttctttgaaaataaaaatacgtttaaagtgtgtgtcatggtttgcatggcactttaaacacacagtgtactcgttgccattcaggcacagtattttctaacacttaaaggaatcagaagtagtgacaataaaagcagcatcatttctcttaaataaatacccttagaaatacttagaacctgttttggctttttgttattgttgtttgcactctctttatttatcagttctaattatttaagaaaaagcaaaataatctttttaaaaactggtttgcaacaaaattgtttctctatagagagaaacattcataattatgaaggacaaaagaatttgaacaaatatttttctaagacctttttaataagatttttagctactagattacttttaaacaaaaatagctgtaacctgagatttgaaacttcattacacaaaaaacaggagaaaattgtacacccaagtactgttttatatcaaatgaggattgacaatagtgtttttatgcatctgttctgcccacataagaagccagcttcatcatctggatgtgtcctggggctgaaactttttataaatacgagaatttcacttttttaaaatggcaagcagaatatggtgtccagctgtggatttgcttacatattgtgcttgcattttttcttcctgggcttgttttatacagtatatggcactacgttgtcatacaaatttcatgattaatgcttatttatgaaatcttgtgtaaatatcttaggactcagtcaaacaatgtgcaaattaaacagttttttctccgaatattggaatgacatctcctttgggaatagtaggttggatatgttctttatctattaaaaaaaagtctcatatgtaacatttgccttttactgttcaatgttatatcattctttttaaatttgttttgtgggacaagaaatccagtttcaagaaatcacagagaaaattagatgtggaaattaagatggtagttatttcatattatgctaaataattacatttactagaacgcctttgttttttaattttgattctgtcctctggttgagaggcatttgtatgtgttctattgttcacatattgaaatcaatctactgtttgctaataagctgtgcttacattactgtggttttaatccacaggaatgctaggttgatgaaaatatcacagagtgagtatgaagcaaatttcaagtgtaagttaaagtgatcagtgatgcattggtagagtttgttttataaattttatttctctggaatagttaattttctcatattattattttagtggattgaaactggaagttgaaagacttgttttcttttcttttttcttatgctctcaggtccagctcttctatgaactaactgatatcatgaataaggtctggaacaagattcagaagagaggcaatctcaacctatctccaacctctccagagaccatggcagggcctgttcctacttctccagttagaagcagtataggcacagctcctccagataccagcacatgcagcccatctgctgacattgggactactactgaggtaagtgtttttgaaaatcctgttacaaaatgaaggttaatatataacacagatttccagatcatggtttaaaatgaagataacctcactactgtgaaaactgatagattctgaaggttcaagaggagctgtggcagcagtgactgtctattccttttagctacaagaatttctgtttttaatcacttttagcagcttatggggtagttcaggatagtgcaggttctgtgaaatggtgaaaactgagacacagtaaaggtatgtttcctcggaagtatggaaatgtagaaactgagtgaaaaagagactcatgcttcccctttccctacctctgttccgctacaccttttttgaaccaggtgactattattatctagtcacctggtttagattagtggttttcaaccctatcagacccaatgccctctcctcttcctcccaattataaaagcttttctttttatttttaacgtcctaacctagcatgccagtacctcttttgtataagaaatattttataatgcctcctttactatcctgatatgaaaataaaaatataaccagaaatgaaaatgaaaaataatgtaacttacatatacatataatttcaaaaatatataatgtcttaaataaaaggaaagtaatttaagatacagtattatgtacttcaatatataaatgcctgggcatgactacattagaagacataacggaatagtcacatgcaattactgtgaatatgatggctgcaaatagacttgtacaggtctgtatttagtaccacaagtggtattgctgttggtgacatgattttctaaactagtgacaaactcttggtaaagtttcaaacacaacacagttcaatctttcattatagtagttgaattttggaacttctagtgtatattgaaatcatgcaaaaatgaagaaaaaagtgtttagatttgaaacattttataaacaggatttttatctatgtgaatatgtatgagacagtcttcatttttcaggactgccctattctacacaggatctcttgaacccctaactcctaacctttaaatcccaataatgatacacaaacattgagtcaacaaaaaatacccccattcatttccaaaacattgcttagagaacagaactttccccaacgagagcaactgttctatagtagatggaggtagaagttaacgtttttttgtttctgcataaagacaccatttcctctgggaataaagctattggcaaaatacagaatgggataagaatcaagtaaacgggatgttaatgtctttcatcttacaaatcagtaaaagcaaacaaactcagttaaaagggcaaatttcagctgctataaagcatttaacactttagagtacatctatttaaccccctgtacaagcaacttttctatcttgcccattccaaatcttaagaatcacagtaacctaggtgataagattattctttctcttttttcttttttcttcccaaatgaggaagcgataggaagtctagaaatgagcctgtatcaagttaatgggacgtatcgtttctagagtaaaagcagtgaattctttcttgaagagttccaatattattagcatacaaaatcttttagaattcctgcagtaaaaaaagctatttaactttattgaatacagcagtttccacacttacttaaccaaaagttcatctttctcagtctgcctattaacactttacaaaatatattttgtgaaatcctttggtagagtaatcaaagtttaaggtaatcagttgctagacaaagataatacaagtgaaaatgataaatacagttaaatcttagagacattttagtggctgaaaggagagtgttccattaaacagttgttttctaagtactgtgtgtacaggaatgtctagaaaaacatgacatccattttggagtgctcactcaactcttttggaaatgtgtttttttgaaagaaacatttaaaagacatttcaagtccaggaaagacagggctcacatgaaatggtgacagcttttggtcatacatctagagactgccgttcatacaaggtatagtgtgaatcctacactctagcattgtgcagtgtacaaacaacacaaaaggacatgatggccctgatgtgaaatgtaataaaaataaaataaaataaaaacatgccctacatttatagaggaaggattaataaattcattctaagaggtctgtggctattttgtggagaaaataatatttgagatgatggatatttaaaaatgagtaagacatgaataacaattttgttttactagatgtataataatacatactagaagaatagtatcttcatcagccaaagtgaagaagttaagaaaggggaaaattttgctaaattgcttaaaaagaattaattctgattttaataatacccttatatgactgaaattcatttcaaattagaaagttgaggattttttctgattgggttataaagacaagtaatgaaaatgctcatagtagatttgtttgttttgtactatctatagatttaatctgatctgtatcagatttgaaagatctgaaaatgacaaaattttcaaaatgtaccctcttctcttatttatatagtgtggtcaagaaaagaggtgattactactagtccaatatcaatttgaaatccacttaggaagattatttgctgagaagtaccttaaaacaatttagctgatttgtttttcataaagggcaggaagatttttatgaagatggttattcactattgaagctactgaatgaaaacaatgactatgttttcttatgtcatcatttactggctaattttgaaagaggtaaatttaaacccagatgcacacatagttaatcttaatctacctgtaaatattttttgagagcaagaatagaaattaaacatgaaatattcgatagacaaacacctccttataggttgcaaggtaaagttagatcaatgccttaaaattgatcatcatatcataaccatctgggtgacagagtgagactgtgtcctgtctcaaaaaaaaaaaaaaagagataatgcttgtaaaatacttagtttagtgagtactccaaaagggaaagctaatgtaaatctccttcataaaatttttgcattaggccttgagtacacgcaaatttctatatacacagggtaccatttaaacattttcaatttagtgagtcttcattttatgttcccagctcttgtaaagtcaggaacaacactaggatttactcacaacagagcaggcaagttgacagtcagtgatatgcttcatgtaacttgttaacagatttttgaaaccctactagggttaactaattatgtcatttcaattcaacttttaattttctccttagccctaggcagaagattctgccacactaatcaaatgcttgctgtaccatagtagccctatgctgttatttgttatatcattttgttataacaagagaggaaggagctataattataaaattatttcagtgtaacaatgttatttaaattcattaacaccttattaataaggcaataaaaaatattaagaacatatttatgaaagatgaattataactcagagcttgctaacgagtgcgctgaaacaccatgagatgtgtcacagctatgctgagacatggattaccttggcctttagagtctttggatgggactagggtgaatgaagctttcaatgctgtggagatttttctgcttaccacagatacaaataacatttcctacatatgcaatgatatgaaaaaggttgggaagtactactataactatccacaacacatatattctatatttaaatctgtatacagatagttatgttgttgacatgatagtgtggctaatagaaaatattcttataatcaacagattatcaggacaatgattattactaggaggagagaaggacttctagagctttccaggaatgctatgttcaaagaagcataaaggcttttgaatagattaaaacaaacaaaaaagtatttatatagtctcctcttcatattgttcattcttttatttcttaacattttaaaataattggtttatagtccttttagatttcttaactccatttattggagatgctaagtttttgttatatctgctgactctccctttttctggttcattttctcatgtggtttgtaatatcttattgtgaactcatcttcaacagtttaatttttctgtgtgattcctatgagccctctgttgcagaattgtccctacagagcattttgactgcttttgccagggtgctagagatttcagggaaccttgggcagtttttaggtttctttatcaacaagggtttgtcttatcatataagtagtatgcacgacgtcccacacaagcaaataatagcatttagtttctcatgtttgttttggtttttttttttactatagttgtccaggctggagtgcagtggcgcgatctcggctcagtgcaacctctgccttccagtttcaagcgattctcctgcctcagcctcctgagtagctgggattacaggcgcctgccaccactcctggctgatttttgtacttttactagagatggggtttcaccatgttggccaggctggtctggaactcctgacctcaggtgttctgcctcccaaagtgctgggattacaggcgtgagccatcctgcccaggcatgaatgattttatcatgccaccactttcacctcttctctgtcctaggaatctgaaaaacatccatggcatttcttagcctgctgaagcctagtgtctagtgtatcttttgcttaaaaagcagctctgtttgcctccaggctttatgcaaagaactccccagttcagactctacactatgtctgcagtccctgaatgagtgtttaaacaccattgctcaacccctcgacccttatctgagtttgatacttctacatactcccaaggactgtttccacttgttaccctgactttgtgtttcctcttcgtttctgacaccatagtatttgtctttatttcaagttttgctatcgtattagaaaaagatggtagtctgaaattggagtttatgagaatttagtaaaaggtcaaagatgttaactgggaagggaaatctcagttaacaggagatgattgagtatgctggagcagttggtgacaccagtaggcttaaagggcaggagagagagtttatcagaacagggaataaatacccagacttcattctccacttcctctgtctcctgccactgtttctcattgaccgaaaccaagaaaaaaaaaaaaaaaacagaggaccaggaaatccattcatattgttcacatagattaacttcccaagcacagagggtagtgaagggtagagagtagatctagagggccaaagaaaagatatgtagcacttttcggtattaaattcacctggcattttatccagaatatctgtgctgtggtagtacaaatggtaaatgttcatttcagcttagtctccatattgttagtattaaaatttcttactaagaactagtctttttaatctcactctccttgtacatattaacttctcaatcctatcaattaacttctttggtgatttttttaaattgtggtaaaaaaatatacatggtaaaatttaccattttaaccattttaaaatgtacaatttagtggcattaggcacactcacagtgcgtagcataaccactatctatttctagaaattttcatcatcccagacagaatctctatccccatcgaacaactctatcttctcctctccctccatccatggtaacctctattctactttctgtctctatcgatttgcctattctaggtacttcatataagaagaatcgtatggtatttgtccttttgtgtctggcttattctactttgtgtaatatatttaaggctcattcctttctttgtgtgtatcagaattccactcctttttatggctgagtaatatttcattgtatgtatataacacatttaatttatctgtttctttgttgctggacatctgggttatttctacccttttgtctgttgtggataatactgctttgaacactggtgcacaagggttgatgaatttttaatgaaatagttttgccttgaagtaattgtatgcatgttatatgacttgcacctgaaaaaccattttaaaactcatgtagtactagaaatagtatttaattttttaactgttgaatatgttgataactgatgtatttggtttaaaatgcagagggaggggaaagaaagtaaattgaagtatttttaaagatactttattcggtgctgattttctgatttagaagagcacatttctgtcatcttaatatcatttgcttagtactatcctgaatggtccagaattatagtagcacttaatattatcccttactgtgttcaagtatatttcaaaattttggcagaaaatatgggtcccaaagaggaaaaaagggaaaattcgagtagtctgtttagtttctatagtaacccttcaaacaaaaaaagaatgttagtaattgcttttctctaaggtgtatgttttttttttcctcctggggaaaactagctaaactgtctactactttcctactctttgttgttatgaagtctctcttttctccttttctcagtcttaacaattggcttcctctgactttggtgtaatagttttgtggaacttgataagtgagcaaagatctttgtcttaattctgtcaacttacagttgtattttcgaaaaagattgtcagacggatactttagaccagcatttttattttatatactagaaaattgaaacccagagaattaaaatttgtgttactgtgtagggactgggctgactgatattagcttgattctaagttagtggaacctctggaagagactttgtaaatttgtttaagttctttgtagattctggatataagccctttgtcagatgggtagattgcagaaattttctcccattctgtaggttgcctgttcactctgatgagagtttcttttgctgtgcagaagatctttagtttaattagatctcatttgtctattttggcttttgttgccattgcttttggtgttttagtcatgaagtctttgcccattcctatgtcctcaatggtattgcctaggttttcctctaggatttttatggttttaggtcttacatttaagtctttaatccatcttgagttactttctgtataaggtttaaggaagggatccagtttcagctttctacatatggctagccagttttcccagcactatttattaaatagggagtcctttccctgttacttgtttttgtcaggtttgtcaaagatcagattgttgtagatgtgtggtgttatttctgaggcctctgtgctgttccattggtctgtatctctgttttagtaccagtaccatgctgttttggttactgtagccttgtagtatagtttgaagtcaggtagcgtgatgccatctcctttgggttttttgttttgtttttttttttctgcttaggattgtcttggcaatgcgggctcttttttggttccatatgaactttaaagtagttttttccaatgctgtgaagaaagtcattggtagcttgatggggatggcattgaacttacaaattaccttgggcagtatggccattttcacgatattgattcttcctatccatgaatatagaacgcttttccatttgtttgtgtcctcttttattttgttgagcagtggtttgtagttctcattgaagaggtccttcccatcccttgtaagttgaattcctaggtattttattctctttgaagcaattgtgaatgggagttcactcatgatttggctctctgtttgtctgttattggtggataagaatgcttgtgatttttgcacattgattttgtatcctgagactttgccaaagttgcttatcagcttaaggagatttggggctgagacaatggggttttctaaatatacagtcatgtcatctgcaaacaaggacaatttgacttcctcttttcctgcttgaataccctttatttctttctcctgcctgattgccctggttggaacttccaacactatattgattaggagtggtgagagagggcatccttgtcttgtgccagttttcaaagggaatgcttccagtttttgcctgttcaatatgatattggctgtgggtttgtcataaatagctcttattttgagatagcttccatcaatacctagtttattgagagtttttagcatgaagggctgttgaattttgttgaaggccttttctgcatcttttgagatactcatgtggtttttgtcgttggttctgtttatgtgatggaatatgtttattgatttgcatatgttgaaccagccttgcatcccagggatgaagccaaagtgattgtggtggataagctttttggtgtgctgctggattcggtttgccagtattttattgatgattttcgcgttgatgttcatcagggatattggtctaaaattctctttctttgttgtgtctctgccaggctttggtatcaggctgatgctggccttataaaatgagttagggaggattccctcttcttctattgattggaatagtttcagaaggaatggaaccaggtcctctttgtacctctggtagaattcggctgtgtatccatctggtcctggactttttttggttggtaggctattaatttttgcctcaatttcagagcctgttattggtctattcagagattcgacttcttcctggtttagtcttgggagggtgtatatgtccaagaacttatccattccttctagattttctaatttatttgcatagaggtgtttataatattctctgatggtagtttgtatttctctgggatcggtggtgatatcccctttattattttttattgtgtctatttgattcttctctcttttcttctttattagtcttgctagtggtctatctactctgttgatcttttcaaaaaacgagctcttggattcactgattttttgaagggttttttgtgtctctatctccttcagttctgctctttgatcttagttatttcttgtcttctgctacattttgaatttgtttgctgttgcttctctagttcttttcattttgattttagggtgtcgattttagatctttcctgctttctcttgtgggcatttagtgctataaatttccctctacacacggctttaaatgtgtcctagagattctggtactttgtgttttcgttcttactggtttcaaagaacatctttatttctgccttcatttcgttatttacctagtagtcattcacgagcaggttgttcagtttccatgtagttgtgtggttttgagctgagacatccgctgttagtctgatgggcttccctttgtgggtaacctgatctttctgtctggctgcccttaacattttttccttcatttcaaccttggtgaatctgacaattacgtgtcttggggttgttcttctcaaggagtatctttgtggtgttctctccatttcctggatttgaatgttggcctgctttgctagactggggaagttctcctggataatatcctgaagagtattttctaacttgattccattttccccatacctttcaggttcaccaatcaaacatagatttggtcttttcacatagtcctatatttcttggaggctttgttcctttcttttcactcttttttctcttatcttgtcttctcactttatttcattaatttgatcttcaatcactgatatcctttcttccacttgattgaaacgactattgaagcttgtgcatgcatcacgtagttctcgtgctgtggttttcagctccatcaggtcatttaaggtcttgtctacactgtttattctagttagccattcatctaaccatttttcaaggtttttagcttccttgcgatgggttcgaacatgctcgttttgctcggagaagtttgttattaccgaccttctgaagcctacttctgtcaattcgtcaaagtcattctccatccagttttgttccattgctggcgaggacctgcaattcttggaggagaagaggcgctctggtttttggaattttcagcttttctgctctggtttctcccctctttgtggttctatctacctttgttctttgatgttggtgacctacagatggggttttggtgtggatgtccttcttgttgatgttgatgctattcctttctgtttgttagttttccttccagcagtcaggctcctcagctgcaggtctgttggaatttacaggagttctactccagaccctgtttgcctgggtatcaactgcaaatattgcagaacagcaaatattgctgcctgattcttcctctggaagcttcatcccagaggggcatccgcctgtatgaggtgtctgtcggcccctactgggaggtgtctcttggtcaggctacacgggcgtcagggacccacttgaagaggcagtctgtccgttctcagagcttgaatgacatgctgagagaaccaccactctctttagagctgtcagacagggacgtttaagcctgcagaagttgtctgctgccttttgttcagtatgccctgcccacagaggtggagtctagagaggcagtaggtctagctgagttgcggtgggctctgcccagtttgagcttccctgtcacttagtttacttactgaagcctcagcaatggtggacacccctctccccgccaggctcctgcctcgcaggttgatctcagactgctgcgctagcagtgagcaagcctccctgggagtgggacccatggagccaggcacagggtggaatcccctcgtctgctggttgctaagactgtgggagaagtgcagtatttgggcgagagtgtaccgttcctccaggtacagtctgtcatggcttcctttggcaggaaagggaaatcccccaaccccttgcgcttaccaggtgaggagacaccccagcatgctttggctcaccctccatgggctgcacccactctccaaccagtcccaatgagaagaatcaggtacctcaattggaaatgcagaaatcacccatcttctgcgtcgatctcactgggagctgtaggctagagctgttcctattctgtcatcttggaagcgacttcgaaattattatatacgtaatttatctcctttattctcttaatgtgactaattatatcgattgattttcacatgttcaactgaccatgcatttctagaaaaatcccagtttagttgtgatagatattgctagattgaggttgctaattgtttaggattttggtatctatagtcatgagtgatactgaccatttttaccattttaagtatataattctgttgaattctatatttttttcttataatagccttgtcatcttttggtattagattagaagtttatactctctttataaatgagttagcaagtgttccctcttgtcctactctctagaaaactgttttcatttgaaatttctcctaatcactgtatatttccatgttaaaaaagtaatcttaattgaaaaggtacttggctataacacatatctgatctaaatttgaaagtcttagtttagatgtcatttagaaaattatttgaagagagagagaatgggttgggcgtggtggctcacacctgtcgtctgagcactttgggaggccgaggcaggcagatcagctgagatcaggagttcgagatcatcctggccaacatggcaaaaccccttctgtactccaaatacaaaacttaactgggtgtggtggcgtgtgcctgtaatcccgattcgggaggctgcaacaggagaatcacttgaacctgggaggcggaggttgcagtgagctgagatcgtgccactgtactccagcctgggcgacagagcaagactctatctaaaaaaaaaaaaaaaaaaaaagaaaagaaaaagaaaaagaaagaaagagaatgaaatggtaaggaccatatggacaaaggaccctaatttaataattttaaagagaacacagagaagcatcttgatcctttttccatctccaacactgatatagctttgttcctagaaattaaacttcatactatgtattgataaaataatacttaatgataagataaatatttctatcccactccagtggcccaatttatgtcaagtaaaactaatgaacatatagatgctaaacacatgtaatgtgtttttgttactgtacaatcatgattttatattactataagttttttggcttaatttttttgttgtggtacaatatacacaacataaaatgtactgtttttaccattttatgtatacagttctgtggtattaagtacattcacattgttatacaaccttcacaacagtctccagtattttttcatcttccccaactgaaattctgtatccgttaaaaaataactcaccatcttaatattaaatcttccaatgtatgaacactggatgtctttccatttatttgtgtcatcttaattttttttaaagatatttcatagttttcattatgtcttttacttcctcagttatgtttattcttaagcattttattattttagatgctattgtaaagggaattattctgttaatttctttattgtttgcttttaatgcatagaaacacaactgatttgtgtatgttggtgttgtatcccacaactttgtggaattcattgattagttctaaaagttttcttggaatctttagttttatacatatatgatcatgtcatgtgctaaaagacataattttactttttcctttccaatttggttgccttttatttcattttgtctcctaatttctctggtgaggactttagtagtttttgaataaattttccaatttattttgaaaatattagacaatattttgaagtttaccataattatctctttttataattttcttctcaagggaaacctctaacattcttttggctgtaagtaaattctgtacagatagccaaagacatattgacaaactggccctttattgcttttactttttccatgttagttgtactttttatactgttttttttttctatcttaaatatttgttaagtcaaacactatagattacaaataaaatgattcagactgggagacttccactgacacagaagtaaagatgtcaaatagtgattatattgtttcagtgccatactggatgtgaaatataaactttccatcaccattcatcactcattatctttattaaaggataaccccaatttatcttaagtatggttcaaagtaggttctaaacatagtcttcttcataatatagatgttgaataattttggaatactaactcacattatgattaatttaaatcacatttattgtggtacatggcatagacatgcatatgttcattaagtcactacacatatttttatgtaaatacgtaaaactatatttacaatatgagtttgtattttcagtttgttttttgtccttaatcattttaaacataattattttcttttattttttatcagatctggtatctgaacttctttagagttgaatctgaccacttgttgttttcttaaatcttgttcatgttggattgttttctttggcactgtgtaatttagtgttgggtgattctcatcaatggaacttcttctatgaagcccttacatggtggttgagggcctgtcctctgacaaagacattttatgtgtttgcttctctaagggacttcagcagctgcctctagcctgggacccctatactgttaatcttacagctagaagttttttgaaacatttaggcagtatgaaatcaagtccttaaacctacttgcactttagagttgtttttaaaaattttctggggtaactttgttgccctacttaggctgagatagatattgcttttttattgggtttattctgttgttttttgaatttcttaaattttattcttagcttattaatattcagtattttctttaaaattgattgatgaaaaggcggttgaggcgtctggtgagtagtgcatggctaggaatagccctgtggtgatttggaggatcaggcaggcaaacctaagttattaagacatagtcctttatcatttgaggaatttataatattagtgatggggcatggatgtgcgtataaacataattccaaagtgggctgggaaatttagcccatagttggattaccgttactcacagacaactttgtattatagaagggagagcaaaatttgggaatacagccacctgtttctgccacactcactgttgcattggttttaaagataaataaaactttatattttatgaagaacatactgcactgtacttcagctaggtgaagttgtcaaatttttgttgaggtcagtggtctagaaagtggaacattatataattatactcattaaaatttttatgctattttgcttataggacaatacaacaataaaaactgccattaaaagcactaacattagactgggcatgttggctcacgcctgtaatcccagcactttgggaggctgaggcgggtagatcacgaggtcaggagatcgagaccatcctggctaacacagtgaaaccccgtttctactaaaaatataaaaacttacccaggcgtggtggcaggcacctgtagtcccagctacttcggaggctgaggcaggagaatggcgtgaacccgggaggcggagcttgcagtgagccaagatctcgccactgcactccaccctgggcgacacagcaagactccatctcaggaaaaaaaaaagcactaacattttgatgattcctcttcatgacaagtaaacaaagcaaacacatacatacgtacacaagtacacacacatccttcccttacaggatactttcataacctgtatgtctttgggaaactgttataacaacataaaatcatattttggatctctgggttttcagtagtttcaataaatgtgattttaaaggattatattctgttgacaaaattaaattcctctgagttgtgattttaggcaaattatttagtgtttttttcattttaactttttctgtgtatataaaatgtttttggtaacgtcttccttaatcacagcagtagtataggaagtaatttcaaagctgtagaataatctaaaattctgagtgaatactagaatatttatttacaaataatttatttgtaatatatataaatatatatatttatgtaatataaaaatatatttatatatttcatatataaatatatatatttatgtaatataaaaatatatttatatatttaatatataaatacatgtatttatatatttaatatatataaatacatgtatttatatatacatatatgtatgtatttatgtatcatatatgtatatatttatatatacataaaaatgcatatatacataaaataatatgtatatatttatatacacataaaatacatatatacataaaataatatgtatatattttatatttaaatataaaaatatatttatgtaatataaaaaattattacaaatatttactctacctaaagtaagaattgatatattaactactcaatgtttggaagcttagggtcatggcaaagtgtgacaagcattgtttattgattcaagaattaaaattgctttattatcagcgttgttaaaaaaattaagcatgaagtggttccttttttaatgtccagtaactgttgaacatacattgataattgaaaagtgaatattggactgagagattgtttggcatcaacttcagagttgttgacagagtttgctgtagtagcaaaactcttgtcagtttttcagttattcaagtgcaattaacctatgcagtaatctacctcaaattattatgcaaacaaccgtttagatagtatatttagtttgaatttactcaattgctatttttaaaatttcttgtaattgttttaaaactcctgaaaatacttatgtcatttcatatttttccttaaatggttttgttcttaacatttagagagaaacttttattcagaatgtagaaatcataacatttaaactatcatcttatttgaatatctatgaaaaaaataaatatatcaaaacaggttagaaaaatgaaggttattgtttagccatcacataccattcaacacaatattttgtgtatgaagcctttcctatttcaaaatattcatataaaaatgtctttaaattattggctacttgatttttaaaagctcagatagttttatcatgtaaatataagctaataatctgaggttagcttacatttcttgtgttacttgtattaattatgtatctggggaacactttgaaattgcaggtttgatttttttaaattacaatttgcattcaaaaacaatcattaaaatttttaaacattttactattaaaacattgtttttcttgcttagttgggtcaaaactattgaatatagagaacttactgtaaatgaatctagtttaagaaaacacattctagggaaagcattaggagatatacctaatgtaaatgatgagttaatgagttaatgggtgcagcacaccaacatggcacatgtatacatatgtaacaaacctgcatgttgtgcacaagtaccctagaacttaaagtataataataaaaaaaacaataaaaaagaaaataagctcatgaaaataaaaaaaagaaaacacattctaacaattgtttgtattaaatggaaatatttgtttatatgatccttagatgatttatactttaaactatgagtaattcttttcatgctgacatgttgatggggagcactgtacttttgtgcacatatagctgcagcttcctgtgtttcagtctgagtcatggtaaagtgggaaatatgagtttgaagcttaagtactgagcttaaaacacttaatcattttttcccactcttgcattgaaatagtgggagcaaaggtagttgagaccacagcaggccacttgttactgttgacttaagtacaaacagtggtcgaagtgtttagccctttgggaagttttgtaattgaacaagaatgcaggagttattttgataagatagagtagcaatggggccaaaactatgatcatccttaagctctgaagcaggccaaggatgaagggatataaagtgtttgctcttccaaataaacaaagataaattcacctaggaaaataaacttagcatttggtcaatttgcaacaaaatggtaaaagaattgaactgtttattttagaacttggcctaaggatgtatgggaaaatagttcagcatctccatttccggcctgattttcacaacagatttggaaacagagcagaaaattaatgcacaaacatgtttaacaataccaaacaaaatgctgtaaatccaaaatgaaaactgaaactgcatgaggaagtacagcaaagcttttactgaggagtgcttactaaatttgcagccacagttttcttagcattcttaccaagtataccaagtagtgttaaaaattgaagtcttagtgattcgagatgttattttctctcagttctccatccttggaatatgatattcttctgtctgttggaaggagggtttaatttaagcatacttctactctataaacctatacataaagaaaggctatatatattgccttttatttaataagcatccttatctggaattagtttatgctttttattagatgttgtgttgcattagacagctaaccaaaaacctgatttttttatagcttctcaagttgtaggaatttctattgtagcagatttagaactacttattttgtaaaagcatttatatgaaaactgcacaaacagtgagatatttgctttgcttggtgtatttgggacaaagagtaactatactgtcttcaggtttaactctataattttctctaatagtaaatcccagaacactgttactttgctatgcttggtgcctaagtgttcttgcagtaaacacttgcctgtcattctatgaaaatcttccccattgggcctccttctgaggttgcagggaaattgaattttcttctgactgaaagatgttataaaacaatgaggttaaaataaaagcctcatgtaggagctgaatatacctgtgtttagatggcatgtctgtggtaatgagagccgggactttggtttgttttgtacaggattttaattatcattcctgcttttaagtgtttagagattagtggcttctgctctgacaacctgtctataaaaaatggaatactgaccatattatattgtctttgtttaaattttaaggggtattttgttctgacagttaactactggttatgactcgttagcacaggaaattaatatttttgtttgagacattcaaagcaataaactattggaggttgaggatatacggcaaaacaaaacgtgtctgaagttagaaagatgagaaaatgagaattctataagaatgtgagtgaaaaatttcttaagcattagttcaacttgataatgataattataactacaatttatgaactattttctatgtgtatattcttcattcacattcatatttctatttaatcttaactgtatgagataaatatcactataataaccattttacagaggagtgtacagttaaactacttgcctcaaatcacttgactggcatctgacttcgttaacccagtacaccatactgcctgccagactaagcttaactaagtatctgtaactgatatgtaaatatatatacatcttttaaacaaataagaatgttatattgtgtttgatcagttttcagagtatatgggtttaagctcgcaagttttgtttgcaaggtttaaacggacagcaaagtttgggattttaggaacccaatacttcatagctaatcctaaaagaactcaacatatcaatgattgcagcatctcttctgcatttgagactgaagctgttcaactttaaataaaagggtttattttattctggcctgctaaaagctgctgaaaagaccaaaaacaaacaaacaagactttgacagcaagttcgttagcactgactttaggaccttatacatattcagagttcagtatgtatttgttgaatcggataagcttatgctctattccactaagaaagctttaaccatataagacacttaaaaaaatctattgtcaaatctactaatttttaatgtctccttaattaacatgcaaggcatgattaatattttgctgtttcttaaactgataatcactttgctatagttattctagattccattataaatactctatagaaggggtagacaaatatttttctgtaaagggctggttagtaaatacctttggactttgtggattgtagcttctctgtagcaactactcaactctgctgaaaagaagtcatatgcagtcagtacatgaacggatttggctgtgatctagtaaaaatttattccccaatacagacagattagccccttcactgtagcttgcagactctactctataggaacatactcattggtttaatcttaaccttttctagatcttaactacttttagaggaagctggaaacatgcatgtgctttctaacaataaaaatcatttgagaagtgtatgtttatacattagcattatgtattggtattaacatttatatgattatcatttgcatgtaagatgtgaaaaagttacaaataataatttctgattttaatttataatttgtattttctgttatttttgtttatgttacaaagtaagatttttttttctcctcatcccagggagattctatacaagcaggtgaggaatcaccattctcagattctgtgaccttggaacaaactacaagtaatattggaggaaccagtggacgtgttagtttatggatgcagtgggtgcttcccaaaattactataaagctctttgctccagatcctgaaaataaaggcacaggtacaggattccttttctttcttccctccctccctctgtccctccctccctccctccctccctccctcccttccttccttcctttcttttctgtctgtctgtctgtctgtctgtctttccgtctgtctgtctgtctttcctttctgacagagttttgctcttgttgcccaggctgaagtgcactggcgtgaccttgcctcactgcaacctcttccttctgggttcaagtgattctcctgcctcagcctcccgaatagctgagattacaggcgtgcaccacgacacccagctaattttgtatttttagtagagacagggtttctccatgttggtgaggctggtcttgaactcctgacctcaggtggtccgcccacgttggccgcccaaagtgttgggattacaggcatgagccaccatgcccggcctggattgcttttcttctttactgaaaagtgcaaatattaaacgctattttggaagaaatattaaatgtaatttattattgtcatttataattaaataattattattagctctaattcaagtaatttctagttgcagtgctaaaatgttgaatcttattaacattaaaggtttacgtgtacatattttccttgactttgtaatacataaattttgtcctgtttgtattaaaattcatctaaaagaccatgaggaattttcctcaatggtcatattgatacattatagtattgtcactaaaagtattgggaaaatccttgactgatatcaaatataacactccagacattaactgggctttcccctttcttgaaataaatgtcttatcttaataaacaggcctatgctgatttgcttattattctagaagcttttgtgatctcagcgcctctgtacatatccagcatgcatttgtcaatgtgaaatgtaaaatagaaagttttaatattaattgtgaagactgtgttgatattactgcttgtttcttattgcagaggtttgtatggtcagtgaactagaagatctcagtgcttccatagatgtccaggatgtatataccaaagtgaaatgtaaaatagagagtttcaatattgatcactatagaagcaggtaaataatgaataatgaatataagaaaatctgtatttttctttgaacaaagttaccataagactttttctattttaatttggctggttattaaaataaatactatacaggcatacctcggacatattgagagtttggctccagactattccaataaagtgaatatttcaataaaggaagtgacagaaattgtttggtttctcagtgtatataaagttgtgtttacactatactgcagtctgtgaagtgtacaatagcattatgtattttaaaatgtacataccttaatttaaaaatactttattgctaaaatgtgctaatgatcatctgagcattcaatgagtcataatcttgttgctgatggaaggtcttgtcttgatgttgatggctgctgactgatcggggtggtggttgctgaaggttagggtagctgtggcaatttttaaaaataagtcaatgatgtcatttgccacatggattgaatctttctttatgaaagatttctctgtagcatgtgatgctgtttagtggcattttacccacaacagaacttctttcaaaattagagtcagtcctctcaaactttgctgctgctgtaaaaaatgagattatggaatattctgaatcctttgttgtcatttcaacaatgttcccagcatcttccccaggagtattttgcatctccagaaaccactttctttgctcattcataagaagcaactcctcatccattcaagtttcatcatgagattatagcaattcagccccatctttaggctccactcctaattcttggtctcacattgttttcaccacatctaccattacttcctccagtgaggtcttgaaaccctgaaagtcacccatcggggctggaatcaacttcttacaaacatctgttaatgttgatatttttacctcctcccatgaatcatgaatgttcttaatggtgtctacagtggtgaatcttttacagaaggtgtttccatttactttgcctagaaccttcggaagaatcactatctgatacagtttggatatatgtcccttccaaatctcatgtggaaatgtgatccccagtgttggaggttgggcctagtgggagatatttgggtcataggggaggatctctcatgaatggcttggtgcctccccatggtgacaagtgaagctcttgatttcttagttcatgcaagagctggttatttaaaaagagcatagcatctccctgctctctcttgcttactctcttaccatgtgacacacctgttctgctttgccttcttccatgagtaaaagcttcccaaggcctcaccagaagccaagtagatgatagtgccatgcttgtacagcctgcagaaccacgagccaaataaacctctttcctttataaattacccagtctcaggtattcctttatagcaatgcaaaatggactaacacactgtagccttacagaatgtatttcttaagtaataagtcttgaaagacagaattactgcttgatccatgagctgaagagtggatgttagcagatgtgaagacaacattcatctccttgtatatctccattggaactcttcagtgaccaggtgcattgtcaatgagctactgctcatttacaaaggattttttttttctacacaagcagtcgttctcaacaaagagcttaaaatattcaggagaccatgctgtaaacagatgtgctatcatccaagcttagttgttcccatgtatagagcacaggagaagagtagatttaacaaaattcttaagggccctaggattttcagaatggtaaatgagcattatcttcaacttcaccagctgcattcacctttaacaagagagtcagcctgtcctttgaagctttaaacccaggcattgacttctcctctctagctatcagtctgagatggcatcttcttccaagagaaggctgttttgtctacactgaaaatctattagtgtagccaccttcatcagtgaactgagctacatcttttgtataacttgctgccacttatccttcagcacttgttgcttcatgttgcacattaatgttatagagatgccttctttccttaagcctcctgaactaacttctgctagcttcaaacttaacttctgcagctttcttacttctctcaatttatagaattgaagagagttagggtcttgctctggatttaacagaatggtgtgtctggtttgatcctctacccagaccactcagactttctgcctatcagcaataaggctgtttcactttcttgtcatttgcaagttctctggagcagcactttcaattttcttcaagaaccttccttttcattcacaacttggcacaagaagctttgttttctgcctatctcagcttttgatatgccttcctcactaagcttaatcatttttagatttttatttaaagtgagagatttgcaactcttctttcactggaacacttaggggccattgtagggttattaattggcttcatttcaatattgttatgtttcagggaataggaagacctgaggtgagggagaaagatgggaaatagtggggtcagtggagcaatcagaaaacacacagcaatgatcaattaagtttgtgtcttcaggacatcactgttcatgatgtcctgaaataattatgataatgtcaaaaatcactgatcacagatcaccataacagatataataataatgaaaaagtttgaaatattataagaattaccaatatgtgacacagagactggaagtcagcatatattgttggaaaaaacgctgctgatggatttactcaatgtaaggctgccacagaccttcaatttgggtaaaacataatatctgcactatgcaataaagcaaagcccataaaaccgaggtatgcctgtacttattctcaaagagggttcttaacagatacattgattaattttacttagtaattgttcatgtatggagtataataaaattttgttttataagatgacaaatctgttcataaatatatacattgccatattaaatgaaataagctacttttactaataatcttacataatttattttctatattttatatttgttaagatgcctgcaacccagttgatggctctgatttttgctgtatacgtcccatccattctctataccaatataatcattggtatagagatatacaatacaatcattggtatagagatataatcactgagatggagcaatagctcatttcctaagcactttgatgactctcatctcacagatgattattatgtatatggatatgataattatttttgtcatattaaacagtgacttattaattggcttttgataatagaatgttcaactctttagttcctttgaaatggtatgtgtctgtatcaaaatgatctttgcaagtgataatacaatattttggctgaagtaatttttaatgtcatgaatattacgtattatgttgtactttatccctgactgtaccgctaaatttatataaattatagatattcagataatttattaatttattaaaaacatacatttcttgtgtatgtggtatgcaccaagtgctatgctaaatgagtactggggatgtagtgtttaagaaaaatagcctggcatggtggctcacacctgtgatcccagcactttgggaggccaaggcagggggattacttgagcccaggagtttgagaccagctgggacaagatggcaagaccccatcaccacatacacacaaaaaggagctgggcatggtggtgtatgcctgtagttccagctgctggggaggctaaggtgggtggattgcttgagcccaggagttcaaggttacagtgagctatgattgtgccattgcactccagcctgggcgacagagcaaggctctatctttaaaaaagaaaaatagacatagatgttactcttatcgaggagatggaagtaaataatcagccaaataaatacataatttaccatgaagacaaatgttcttatgcagaactgtcagagtgcggtgctaatgtaaattgttctattgattgcattgtcagatttatgttttagttcagtgcagtgttgtgaactttagacttatttgaaatagttatgtatgttcaatttcttaactcagaaaaattgaagagaacagataaggtgaacttatgttttccaggccaggggaaggttggcagtcaggacattttgaaggagtatttctacaatgcaaagaaaaatctgtggtgagacccatttagttactatgatttttgaaaatgtactttaaactgtttatcttgttatttcataaaataggactaatggttacaagaatttgagttcagaataaattcttattagcctgtttcttcaaaattacatataaatttaaagctatttattctttgaaactgctcctgttttgtaaccatcttcctgttataacaattaagtaaatttatcaaagaggcaaaggtaggcttgcttttgttaatatactttatctttaatgtactattgtgttgactttttggaattgtttcccaattcttatgtgagtttatgctggattgttctttaccataaactggaagtagtaattttatactaaaagcaattattttttgtttactttcattaacattgcttttgcagaagatggtccaggcagaggccatacctagcggttgctcaaacctaaatttatacaaacttgaggagaatttaaaactatccagatatttttttgcttatggcttttattgctttttgtcttttcaccttctttgctcctgtccatcacttcaagccttggggaagagtgttggtctttggggcaatgtggaggtgtcttcctttcctgtactgacaagctgaacagacgcaccttgttggttcgacccatcagcaagcaggaccctttcagtaattgctctggcttctttccttctgtaagaaattactttaaattatgctacacaactcccattaacaggaacccagagaaggaattgaatgattcatagagtcaactcttgatttgtgttttcctccatatcataaactttataaatgaagtataatgtaatttaaaatcataaaactgcttttccactaaaacctgtttctgggtcacttgcatgagtacagactaattttacctcaatataaggaaatcaaagtaggacattcattatatttttttaaattgtgcatgtattgaatgatcaagagttgaccaatactgcttttgtcattcctcttacgattcttaataagattgcctttaaaaattttttttctattattatgccattgttttcttacaactaattcaaagtaacttgtgtggtaccttcttgaatctgaacaagtttgcatttctgtcattgattaggtagatgaacacaaggctgtatcagtgacttttagacgtttagaaccttgacttttttaatggtacaacatctggatatgttcttaagctaattcttttaactgatattcttaaagttaactttgttcttaaatttaatttttaatagtgtatttgcatagcaagtgttatgttctgattttattttgagcttttactagcaatagtctttaatctttagtgcaggaaaaaaatgtgacttttgtgttggaggaagtgtttagatttattttcctctctttgaatgttcattagtgtctgtgaaaaacattcttaataattttaacaaatattcataaagaaaccgtaaatttatcgttaatgttcttcagaaattttttctaaatttataaattaaatgccatttaaaaagtttctttacttagtgttttttaacattttattttaaatagtataaagtattattactgtatgaaaaaatgatatttatattacctcaactagtattcactttttgccttatgttaagggagttaaggatgcagcaattaaaaaaaaaacaccctttcttcatgtggcttacctttcaagtatgcttacattccacgtttaaaatatttttccaaattaaaacatttatacattgaaataccttttatactctttacaggattcaaatgttgctattaataaagatttattatgagttagatttttttagattagtggtcagtagtaaccctctccccagtttagacacttagaacagacaacatcactgtgatcactgtggcctcttccactgggggtataccttaacaatccttctccatctgttattgctcattgtccagcaacatgctaataaaactggtagcacttttcttgctttactatacatctttttgtttttgagtgcagaaataaaaaagaaggggaatcaaaagagaaacagtgaaaatgttgggaacagtgaaaaatgctttgagagcaggctattattgggaaagatgattatactgcacaaccatttaatgcttactttccagggtttttttaatggtcaattaaaaaatacaaaaataatttattttcttatcttccttcattataaagtctaaattaaaagcaaaattagcagtgataactgaattgcatattttttcctctcaccatgtcagtgggtgataggcaacaaaatgagaggaagaaaatggaagcaattgaaatgtaggagtgatgggataatatagctcagactcattactgctttcctatttctcttttttttctgtttatgtgaatatattttcttctttttgctttgttccagttcacttctcctcttaaaaatctcctctttggaccctactaactttttcaggtgttggaaagaggggcagggaatgtggaatataacagttctcctctaattctatgctgagcaatttccaaaacaatattttatgtctattaattggttgaggaagatttttttcaagtgacattctttttgtacgttgaggaatacaaaagtatatgttttactttactcttttaaaagcatgctgttttactctaacttgtttatagtgtgcaatttggataggagagctaattgagatagttttaacaaaaatattgaagttatgataatttttttactctgttaaatgttatatgtgtactaatatagtagtatacccaaagattatgatttacaggatagtgataattagattttataaaaaatgcgttagctattgataataggcaagttctgaaagacaaatgttatattgttacatcacattactgtttaaatatgcagtaactgtttatttagttcagttatcaaagcatggtatcgatgaggcttcttttgtaggctctgtctttgtataaattagccaaattattgaaggaaaaactccattttcacaaatgttatatcctatctagtgaaggtaatcatctggcctattcagatttggtctcaaataaaaatatgtaatgtggttatttcaatttcacctgagtaaacaacccttctgtgacctgtgatactttttatgacagcctcttagtactcataatgaaaaattatcacgaaatgaaaagataaaatcaagatagtcttttccaacctatgtttttttgtttgagacagagcctcactttgttgcccaggttggagagccgtggctcaatctcggctcactgcagcctctgcctcccgggttgaagcgattcttgtgcctcagcctcccaagcaactgggattataggcatgtactaccatgccaccacatctggctaattttttgtattttgagtagagacgggatttcaccatgttggccaggctggtctcaaactcctggcctcaagttatctgcccaccttagcctcccaaagtgttgggattacaggcatgagctaccccagcctcaaattcttaatgttacagaaaatgcagaagtcacagaaatagccacaaaaagattaataacctccctcaagatctagaactggaactcaggattcccatctttagttcagtcattctaaccatcttagaagctttttgcccacatctgcagaattgatcagtcatgtgtttattaagaagtgtagggtaagaccaagaggtaaaaatactcactgaggtcattttcttctttccaatttttaaaaaaaatctttttaatgaactgtgtattgtgatttcctttttttggaacagacaactacaaaacttctagatggcactcatcagcagcatggattcctctctctgacatacacaaaagctgtaacaaaaaatgtccgccacaagttaacatcaagaaatgagcgaagaagttttcataagttatctgaaggcctaatggatggttctcctcattttcttcatgaaattcttctttcagcacaagcttttgatattgttctttattttcctttacttaatgccattgcaagtatatttcaagcaaaactaccaaagacccaaaaagagaaaagaaaatctcctggtcagcccatgaggacccatacactgacatcccgcaatttacctttgatttatgtcaacacaagtgtaatcagaatttttattccaaaaacagaagaaatgcagccaactgttgaaggtattgtcttctgattttttttgtctgattttaaataattttcttctagagaccttagttttctgggtttttttgtttcttttaaaaaatatgagcagttggttgtgctttgtggtttggtatattttatagagaggaaatatagatattctacaaatcattaggaaatacatcagaatactatgtaactatctgacttcgttagtaggataagaaattgaggaaattttttcttcagggcttttgccagtaaagcatatatatactttgtgttaattgttttactaaactcaaatgttgtgttctgtgtatctaagagaactaaaattttttttaaaaacaaggtcaagcacagtggctcacatctgtaatcctaacactttgggaagccaagataggaggaccactggagcccaggagtttcagaccagcctgggcaacatagtgagaccccatctgtacagaaataagatattagcccaacatggtggtgcacacctgtagccccagcttcttagcatatcatttttgtaataaaatatttgtatacgaaccttatagtgcttaattaccaagctagaactaaattcaatgtattatacttaacagattcttaatacaagccagtttctactttttatgtctaacttttcttagaagctatcttaaaattaattactttgagatgtgaaattactattctctgaatatcctatattctgacagtggtatacagttgctttcatctgttcagatagtttgtagaaacacatgaatggttaagaataaagagttagtctttatttaccaattacaagtgataaacaactcgctaaccagaaaagtaagaagcagtatattcattgcaaaggtaatgacctttatgctttttccttattatataggagcacctaatgaaattttagagaatgtaatttacattaagtttacataggttagaaaacagaaatctacgtttttatacagataattccctgaggactgtagtttcagttataataacatttttccacaaccttggaagagacacagacataaaagattggggagattgtcaaactgtttttggcattacaactgagaatgggaggaaaacaccatggaaacaaaagtagattgtctttattacacaaaatttatcagtgttttgggagaagaatttggggtaggtcattacatttaataaagaccatgggctgggcacggtggctcacgcctgtaatcccaacactttgggaggccgagtcgggcagatcatgaggtcaggagtttgagaccagcctggccaacatggtgaaaccccagctctactaaaaatacaaaaaattagccaggcgtggtggcacgtgcctgtaatcccagctacttgggaggctgaggtgggataattgcttgaacccaggaggtgtaggttgcagtgagccaagatagtgccattgcactccagcttgggtgacagagcaagacgccatctcaagtgggaaaaaaaaaaaaaaaaccataatgttgcagtatctgtaactattttattaaaataaaattacagaagttttatatctagataaaaataagaataaagttttatactatataatataaaaaattctaggtatagtttttatacaaggatattgttttccacaaatacctctctgattgttataaaacattcatttttctaacttgagttcctgtatttcatttaaaatatgttagtaggcttttatgatttcctgaatatttcctgaagtgtttgttttatgttccccattccttaattgtaaaattattttcagtttaatgcaaacaattaggaaggccaaaatttcattgaaacataagaaaaaatgtgatattagaggtgagagggtgggatgaggtatagaaaaatacagggagaatctctatgaaaaaagctgaggaaatagtgagaggctatagagacagaaaaggaagtaaagcaacttatctaattggtagacttttttactaataaagaaatgttgacgatttataaatgattctcaaattttatgatgtaattgtgtctgaataataattgtataatggacactaaatttagtcatttatcacatattattccctacactgttttaatttagggtttccttcttgaaaacccatttcacaccacaaaatatcaatttcagtaacaaatttaaattttagaagacgaaccaaatgtgtatgattcattgcctatttattaagttttaaaacttgaccaagaatatgatacaatatcagtgtgttgtttttttctgcatctttggcagccaggctgagacttttaaaatgggtatctaataatgtatacactggtaaatctttctgagtcagacatagcggctcctcaatgtgggcatttgatctgtattcaaaatttgctcatttgtcttaaaatatcttatctatctgatgtcctgaaagcttctgaaagtctttggtatttgttagtgaggaatattttcacaataaattgctttttcattgcaattagatcttcattgcagagcttctttgactcaaatttttgtggcaatacctgtgagagaaacctacatgactgacttgttttcaccatccatgtcagtgttcgtcatagcccttaggtgttcttcactggataggtcttatttatagtgataaatgtttccttctaaggcaaaatttgcctataaatgtaaatagttttcattgttaatttggaaaccttgttttttctcttttttattgtggtaaaatatatataacaaattttctactttaatcattttaagtatataattcagtggcaataattacattcataatgttgtgcaaccatcaccactatttccaaatgtatttgtcaccccaaacaaaagctctgtagccattaagtaatagctaccttcatcttctggtaacctctaatctattttctgtctgtatgaattttactactctagaaatttcatgtaagtggaatcatacaatgtttatccttttgtgtctgtcttactttacttagcataatgttttcaaggctcatccaagttgctgcatgtatcagaacttcattccttgctatagctgaataatattgttttgtatggatataccacattttgtttattaattaatctgttgggcagttgggtcatttccacccttttttggtttaatgtgagtaatgctgctatgaacactggcatggaagtttctgttagaggccctgttttcagtttttttggggtgtacacctaagagtggaatttttaggtcccgtggtaattctgtttggaattctgtttttgaggaaccaccaaacttcttggaagcccttgtggattagagcacgatttgtggtattttctgaacaatgccaatgtgcaggcatagttcagtcaacaagaagagcaaagggagctcacgcttagcatagcagcacctgtgtgccgagcacctgagcagctctgtggtgaggcagaggtctgaagttcattgtttaactctagctttattttctgtgatacttaccaatggtttattgaaacaagttatgtttcactgatatgtttgtgacaaaaagattacaaatcaggctatttaagaaagaagaggaaaaaaaagaacaactttattttctgtggggcttttttagtttgtttatatgtttttgttttgggcttattgtgttataaacattaatactacatatcacacagttttattgtttcccattgagttgcttcaactaggaaaatccctcaactaattgtaattgcagaaatatttccagacttctgccatcttatttttaaagctgctgctgctgctgctgctgctgctgctgcttctgcttcctcctcctcctcctcctcctcctcctgctgctgctgctgctgctttttcttctttttttggtggtggctgtggtgggtttttaacatataatttcagaattcaggtgcctaggtacttcctaaggtcaccttgaataagagtatgtgagattggggaaggtttttatagttgtctttggaaaacataatttcttttgtttttctgtggactttaagtggaatcctttgcaaatatgcatatttttagcaacaaacaactttttagtggtgtttttttttgtggcttggatgtatgtatctgtagaataaattaccagcaaaaggattgctaggtcaaaggattccatacctttaaaatagtaagcgatgtctaattgccttcctaaatggctgctatttcttactcttaccctaacagaagtttatttttagccttttgtacaaaggtctcattagtgaaaagtacgctactttttaaggagttgcttatcttttccttattaattaatacattttttgtgtattaatccttctgtctggcatatgtattgctcatatctttacttttttgtgttcagcctttgcatctctgtatctgtgcatgtatctgtatctttacttataattgtacttgcatctctatctgaggtgttataaatagccagactgtgtgcctaagctaagaatgcaaatacaaaaatgcatgccaaagtttcagattttgacacattatgttagtattttttatactttatctttcttctttgctactcttaatttaaataatcataattcacccatgaaaaggtcagaaaacaaatttttattgaggtaaaattcatataacaaattcaccattttaaagtgtagataattcttacattatattttatatgggagattggatgtgtccatttaatacatgttaaaagctataatgtggactgtggaaatcatgattgaaggagcaatttcattagaaataaatgtcattaatgactctagtaagttggagtcaagagtatactattcattttattttagaaagcctttacaagaaagtttgaataagatgattatcagattaattaaattaaaaatgtaggccaggcatggtggctcatgcctgtaataccagcactttgggaggccaaagcaggcatatagcttgagcctaggagtttgagactagcctgggctacatggcgaaaccccatcctacaaaaaatacacaaattttctgggcatggtggcccgggcttgtagtcccagctactcaggaggctgaggtgggagaattaattgagtccaggaggtcagggcttcagtgagttgtggtcacaccaccaaactccagcctgggtgacaggaggagaccgtgtctcaaaaaaaaaaaaaaaaaaaaaaaaaaaaaaagtatatgtaagttgttttaataagtgtgaaagaataactaaatcttgctacatcatacttttcagcagaaactttattataaaaatatcacagagcaatctgtgcttgtcacagagtaagtaatctgtgtcaaagatgagtggtaaaccaaatgcaactaaactttctattaatatgcataatggtcattgattatatgtttattgaaacgtttgtcttcaactgccagtatggcaataactgattaaaaacttttgttgaaagctgtcacaacagttttggctttatgaaagcataacattaaacagtggcaacttcaaatactcttgagacttcagatgttttactaaattgagtttattttgagaatcttaaaggaaagttgaagtctccaaaacacttttattcaggttggaattaagaaaagtttgttgtaagcaacattcttatattatctgacagttgcatgaaaattctggtctttattcaagctattggttactgatacaaactcctgatttcagagttgtttatagccttttcatatgccatacacaaatgtacattcatgcatctgtacacacacgtatacacactctcttgccccaagaaaagatgaaatctttcaggcttataatatacgctacattaatgtaagactctttaatcatatctaaatttcagttaatgataaaaaaattgaacattctactattttatttagaaaaatgatattgaaagtctgcttttcaacctggatattatttacattatgtgcagttactatcaggattctaaatctacaagtctttgacttccagcttaatctttttatttcacaatagatgacttttaaaaatctagcatgtctagaatgagtagttcctcatgaggctcaattttaaaaaatagagttaaagcaaggaaggaaggcattcattttcatgttgaaaatatttctagaaggaacatttcctcatatggtccaactattaaatacaggtgaaataacccaaaaaagagaagctgatttttttttgcggtgataaagtaactgaagaaatgactcaaggcactttcatgtataaatacatatttttattatttttttttacatctcggtgatatattttgataagttgaatactttctataataaaattaattattttaatctagtttatgaatgatctgcattaagtgctcttttttttaattataacttcatagtcagtataatctactgagaacacttttggccctaacagaaacagaattctgttcttggatctggctttgtatgtaacaccaagtacgtcatttctcctccatatttacctcatttactgcaatgtttctattacatttcagactttcatatggtgagtagtatctgtagcctggaagaacagttagcaaatatactaattgcacctttgtggtacggtttattctccaggcttactacgtaattgaggactgctgcttaatcagaggttttacccacatggaactatttgataaggttggcataaaatgcaagacctgtaaaatgtaaacaatgttcatattataaggacccataatcaaaccaaacctctaagtcatttgaaaatagtgcagctgcatgagaagtagttttctatttgatcttttgctatggatgtaaaaatactgtctttactgtgacatccgtatgctaatatttgttatgatagttcatctctttttttctccttttgctgtcccttctcccaccttcctactattttgcctttccctcctcccttcatggttatcttattctggttccttatttctctcactgaatatcttattcttcttatgtttttctgattttcttaattctgacgttctttccttggactaatctgaattagaccataccaagtatgtgaaaatatactgaaatatactgaatatactgaaaacaatacactgaaataatatactggaaatacagctggaaataatctcgtagcttttgcattctttgggcaccacagtttgggaaatatggattgtatgcctttgtaggcaggttctgttcaggatatttcttaggtcttgcagccagtcattttctgttctatttttggcagatggtagttccttgagagaaattataagttttaatatacgtttattttaagacctagaaagttgtatattgttaacattttttaaacagggtttatacagctactatagtagaatcatctgttggagaatagagagtaaaatgtaaatgtatttttttcatgtgtctgttggctgcataaatgtcttcttttgagaagtgtctgttcatatccttcacccactttttgatggggttgtttttttcttgtaaatttgtttgagttcttcatcactggccatcagagaaatgcaaatcaaaactgcaatgagataccatctcacaccagttagaatggtgatcattaaaaagtcaggaaacaacaggtgctggagaggatgtggagaaataggaacacttttacactgttggcgggactgtaaactagttctaccattgtggaagtcagtgtggcaattcctcagggatctagaactagaaataccatttgacccagccgtcccattactggggatgtacccaaaggattataaattatgctgctataaagacacatgcacatgtatgtttgttgcggcactattcacaatagcaaagacttggaaccaacccaaatgtccatcattgatagactggattaagaaaatgtgacacatatataccatggaagactatgcagccataaaaaatgatgagttcacgtcctttgtagggacatggatgaagctggaaaccatcattctcagcaaactatcgcaagacaaaaaaccaaacaccacatgttctcactcgtaggtgggaattgaacaatgagaacacatggacacaggaaggggaacatcatacaccggggcctgttgtggggtggggggagggtggatggatagcattaggagatatacctaatgtaaatgacaagttaatgggtgcagcacatcaacatggcacatgtatacatatgtaacaaacctgcatgttgtgcacatgtaccctagaacttaaagtataataaaaaaatgtaaatgtaatgaatggggccattaatttcccctttcatgccaaatagtccttagaaaagacattgaattcactgttgagttgtggaaaaagtgctgaacttcagccctaaatgagagcatacagtcaaatatcattttatttagtacaaaaaagagaattagaactgatacatccttttacctttttttgttttctgggattatttatcatagttttagacgtcattaggaggtagaacttttaaaggggtctggggttccaatttctaaagcaattttacagtagaagttattaaaattaaaaagtatctagaataacaggttgatatgttctcccatattgaatagttggtgttttccatcttcaacattgcagccatcatatttcttttgaattttctgacattttggagcttaaagtgatatactttgtgtgtgtgtgtgtgtgtgtgtgtgtgtgtgtgtgtgtgttgtatttaattattatttagcatgtaaatttaaattgctttgagaatttgtcactgactttgtaatatccttcaatatatttgtagacaacaatgaagtattaagaacccaaagctgaaaagcatttaggagaaatatgcagattgtgaagttagataaacatttggcttcaatattacttatatatatttaatatcataatttttaatgttgggagtggagttgtttttcttttctttgctattttaattgtgtattttaacaggaaaccacttaatgggtattaacagagttaagaaaagcatcaaagatttttattttaaacatgattttttttcattttactttttcttatttattggtcttatcttaatgtgtctctattccattccctcaaagatttctccttatgcataaagttatgtacagatccacagtgtattcatgaatctccttcttttgttacagctaatcaggcagcaaaagaagacactgtggttttgaagattggctctgttgccatggctccccaggctgacaatccccttggcagatctgtccttaggaaagatatttaccagtaagtttattttcttatgtccaatcttgcaacaattttcatcctgcaaacacatatagtggtcaataacttagtgtggcctgtagaaatatttctcattcaggatcttttgatatttaaaaccaggtttttctgattttcttcagttgtgggttttttaattcattcagacaaatcaagtatttctgtgaagtgttgatgaataacagaatgtaagtactaagtcaccataaaactgaagaagcatagtttggaaaattttagcagatgtcaaatttgaccaaatctctaatcacataagaaaacgaggtcctctgtagaaccaccacatcctactgtagtcatgttgtatcaaagtgaaacattttattaatttaagtgtaagctattatttgaaatgtaggaatgtggatgtcatatggatcaaagctataaagaaaagcaaacttctaaagagaaatttcacagtaaacactttctgtgaaaatgctatgctctggattttgtcactgagtatttgcaaaccacaccaagcatacatggacaactaaactggtgaacatatgtaatcaacatgataaaaataatatatgattcatactgaagttggcactgctgccagacagaaaagtacagttgcaaataataccaagtgagaaaagtcacagaaatacagatgaacaagtgatttattcttcttgctggtctgtttttcagatgttgtagtctcactcttctaaaaaataaattcctactgttctccagtaaatgttactgctaggaaaagattctaattttggtgattcatttaccatctagagggtgatggctatttttactttaaatagatctaggaactttatttctcatatttctctgatatttgagttataatttcttcctttgacttatgtatgtatgatctcttccttgtattttttttaggtatttaatagtattcaccccttaaataagtttttatgcagctagcttatatataatcttaggatttcagagcagaaagcgtctttaggaattatctaactcaacttccctgttttacagattaggaaactgaataaccaaaagaatactgtagttgtccctggtgaaagagtaacagagccaagattataattcatatcttttgactcccttaggatctagggaaatgattataatagaacataaattctatatgagaatactttaattttctaacatttggaaattctttcaggtgtctttatcttttctacttcagaagtaagtggtcctaaaatagagacctactttacttttggtgaaagaaatctaggttatattaagagatcctatcaccatcagtaaagtgaaccactgagataattcctttccttctgtaccctttccgctttctggcttttgcatgagttgtatttttactttctgggaacaattgtgtgaaattgtttttttagggtttccttctgtctgtcttgcaactttttttcagtcatctttactggtcttcctcttaaacaatctctttgctattagtatttcttagggtcttccttttattctttttttttgcccaactcttcttgggtgaggctctctgctcttttggctcaggacaacttgaattctaagcatgtagggtaacttggggtgaccctgtagaccaaggttagcaatatgtgttagaatgtcaaatgtaaaattctagatgctggatggcaaactcaacctaataatttttctttgaaagctcacattcaagtcatttctacataaacaaactaacaaaaggtattcatataagagtttatcaaaaatgtatcaagatctcagtgaaatgctgtatcatcgatatcaaaggagtaacagcagaattagaaaccacttttgagtgaatgatcagagtgggagtagctcagtataataaatgtatacacaaagcaaaagaccctgcatactagggctgattttattattcctatgattttgttaaccatgaaatctcagtgaactagatgcaaaagtccacatattatgtgattccatttatttgaaacgtccagaatagacaaactcagagagacagaaagtatattagtggttgccagggcctgcttgtggaaaggggagggaagagtgggaaaggactttgtcttgcggcttgggtgccagctcatcctcaatagaacagagcaccaagtagattcctaaggtttctgactccaggccctggctcctggacagcatctctggatgcatttgggagccggggaactcaccactctgaagggaaggacacaagcctggttggcttttctatctgctgattgctgagccctagggccttgagtgaacacaggccatagccaggcagtggttaccacgggcattgggtgggacccagtgctgtgctggcttcaagtctgacccagcgcagtcccaatggtggtggcagccacagtgcttgtgtcacacacacacccacaccccttccacagctccagacagctcagcacaggctgtgtttgtttgggagaaagtaagggaagagagcaagagtctttgcctggtaattcagacaattcttcgggatcttatccaagactaccaaggtggcacctgtacaagtctgcaagagccacagtgttactgggcttgggttactccctaatgcagatatggcggcaatgaccaaaaacttagatcacaacacccaagcttcttcaaataactggaattctttccctagaaaaatgggtacaaacaagcccagaccacaaaagctacagtaaatacttaactcttaaatgcccagacatcgatgaacattcataagcatcaaaaccattgaggaaaacatgagctcaccaaacaaactaaataaggcaccagggaccaatcctggatagacagagatatgtgacctttcagacagagaattcaaaataaccattttgaggaaattgaaagaaattcaaaataatagagaaggaattcagaattgtatcagataaatttaacgaagagattgaaatcatttaaaagaatcaagtagaaattcaggagctgaaaaatacaattaacatactgaatgcatcagagtctcttaacagcaaaattgatcaagcagaagaaagaattagtaagcttgaagacagactatttgaaaatacacaatcagaggagacaaaagaaagaatgaagtacacctacaaggtctataaaatggcctgaaaagggcatagctaagagttattggccttaaagacaggcagagagagtgataggagtagaaagttcattcaaagggttataatagcaaagaacttcttaaacctagagaaagatatcaattcaagtacaaggttgtagaatacaaagcagatataacccaaggaagactacctcaaggcatttaatcatcaaactcccaaaggtcaaggataaaaaaggatcctaaaagaagcaagcaaaagaaacaaataacatacaatggagccaggtacagtggcttgtgcctgggatcccaaccctttggaaagctttacgtgggaggattgcttgagcccgggagttcgagaccagcataggcaacatgatgagacttcgtctctataaaaaaacttaaaacttagtcaggtgtggtggcacacgcctgtagtcccactgttctgcaatctgagatggaagaatcacttgagcacaggaggttgaggctgtagtgagctgtggttatacccccacgctccagcctgggggacagagagagaccctatctccaaaaacaaacaaaaaccatacaactgagctccagtatgtctggcagcagacttttcagtggaaatcttacagtccaggagtgacatgacatacttaaagtgctgaaggaaaaacagttgtaccctagaattgtatacgcagtgagaatatccttcatacatgttgtagcagaaatgaaggttttctcaaacaaaagctaaaggatttcatcaacatgagacctgtcctacaagaaatgctaaaggtagttcttcaatctgaaagaaaaagacattaatgagcaatgagaaattatctgaaggtacagaactcactggtaatagtaagtacacagaaaaactcagaatattataatactataattgtggtatgtgaactactcatatattgagtagagagactaaaagatgaactgattaaaaataatacttagacagtacaataagatataaatagaaacaacaaaaagttaaaaagcaggaggagaaagttcaagcacagagtttttattttctctttgcctgtttgtttgtttatgcaatcagtgttgtcataagtttaaaataatggtgtatattaaatttgaaaaacagaaaactcctagggcacatggtactattctttgaatacgtagctgataatgtgtcatagggagtagttcattccttccaaagctaagaacagacctaggatcattaaatcagtggatgttacaatgaccctaattgcagctcaatagaatgaaaatctttcaaattataaaagcctaataataaatggggctttttgttcttactcatttaacaattattttgagggaggctactgtacatcaggcactattctagatactgggtgtatgtcagtttacaaaagaaagaaaaatccctgctctcacagaacttacattctaatgggagagagaattacaagctaataaataaatcatatggtatactagaatttaataagtgacatggagacaacaaagctgggaagggaaaaagaaatggagagttagagatggacagcatggcttagttagaagacacctcactgagaaagtgcagggatcctgaagcaggaagaagtaagagaagccagtggtggctggagcattgggtgccaggggaatttagcaggctgtgaggaaaacgacattatggaagatccatataggtcgttgtgtggactttggctattagtttgagtgagacatggttgtgggggaagaattatccacacatgcagaattttgaaatatgtaatgcttttattatttactaaatgtctgcctgcagaaagaaatgggggggtggggatggggatcaccagcagggactagagatatacatttaaaaagaggttaaatatacgtttgaaaataaagggagtcacaattaagaacaaatggaagtgtgacattcaaccctaaaagaatcatgttaagaattattaatatttttgctacttgagttaactgaatatatgatatgaatttcttttgcttattgagtagttgattttgtcatcaaatggaaaggcctcagagggtttgagcagagaagtgacgtgattctttttatacttaagcagattactcaggcaaggaaaggcaagggaaagggaaaagctattgctgtaatcttggaaaaagatagtggcggcttgggcaaagttagtagctgtggaggtggtgagaagtggtcagattctggagatgtttgagaggtagagccaagagaatttgcacatggggtttgagaaaaaggatacaaagataattcagttatatatggcctaaacaactaggaggatgaaaataactgaagaaggaaaaccgtaggaagatttgttttggaggattgggtgggtggagattaggaatttatttttgaaaatgttgactatctcaggagttaatgagctccccatttctgatgtagcagaggctaatcagccacatacaaggcttaagaggggtaatgatttatgtcaaattaaaccagtgattcctaaatttactgtgtttccaaatcacccaaggatcttgataaaatgtggattttgacttatgaggtcttgtttgaggcctaaaattttacatatcttctaggcttctgggtgattgggtgtgatactgttactgtgttatactgatatgccacttcagaggctacaccctttgtaggagatgattaaatccattttttttacaaaccttttaaacggagatcatttaaaaaatatatttttaatgaatgttaacaatttttaatgctaaaaatcaaaacactatgaaaggttctgtgagaaacattaaatatcctccattctcagtctttcccactctgtatccgagtttgctctcggtggattctttttatagcaacaaaatttttgtaaacttttagttgatagtggttaacttttggaatctgtgactgagaaaatgtaaaataataaaacacttctgttaactaacaccttatatgaatttgtactttgttactctcaaaagcatctgatccagtagaaaacaacagaacatacataacatgttatttattcagtcactgtgcaatgcgtagcccaggtatgtattgtcattggccctcccttaaccctttaccttctttacttgcctcctccttgcctgataatctacctggtttataactgccagctcctggataggatgatctctgtttcctttaaactcaatctgagattctcctattctgtgatgtgttcaaccatatccctgatttataccatagtcctgaagcactgtctgacctgaagttgtttctttatcttacacaaccccttctcctgagaaatttttcaggtccttgtctcaagccaaaagagaagcaagaaacagttaagtaagatgttataaaggcagatttttaaaaattacctgtggtgaaagtgttttttcataggctgattagagattataaacaaacgagatgaaaatatttaaatatgtttatagcttaagcatattaataatttaataaattgtctgatccaagtgaagtgatgtttacaactaattgatcatgaccagttacagatttcttcatttcttctccaattccactgcttcacttgactagccttaaaaaaaaaagttaataaacatagttacacttctcttatataaatgacatatatttcttagaagctttatgttgtgcaatatgctggtgtatcctctataccttattaactatagtttgtatggttgtttctattaaataatgaaaacaagtctcagaaccttgagccatgttatgctataattgctatataagaattacactggatttatattatacttcctatgtcttttctgaatatctcatttctctgattctgagtactatgtgtaagcagtttgacttgattttcatggtttttaatgattttctaaaaatagcttttattataagaaatagaatagccttattagttattaatacaatagggatctttgagacatttatgcccttcctttgcatgcattcattgattaattcatttattaaatatacattgattaatatttgcagctattcaacagacattgagtgcttatgatgactagacaccaatagtagatatatatttttgactagaacatatggtactgtatgacttcacagaactcaagacttcaaccacattatcttacaattacattgtaatttcattgtagttctgatagattctgtatcataataattgcatgctttgtctacaccacctcccaaaatgcctagattgatgaaataagtgaaattagaagttttgaacttgcaccctaaacttttttcatggtctcatttttatcattaagtatccttacaacattctgttctatcttccgaaaattactgtaagaagcaagaatgatcccagaagttccatctagatttgcaattttcacacaaaggaatagagaaaagtgttcataaatttcattcaagtttttttctttttagaagtaataaagagaatagaaatatcagcattaattattcatgagtatatttaagtaaatacattaccttttcagtacattttaattggtcttttttgcaaattctgtttatatcctgttttttaaaatattgattctttaaaaatttagcttatgatttagtcttctgattatgaaattaaaataagaaaaggtaaaataacattttaaaaatttataaataaattttcaaaataccttttttgaaaatacatctacccttattttaataaacctatataactaagacatttacattttttaaaataaaaagataatcgtgtttatttttaaaaaatcaacaccaaagtgtatgcaatactcctccttaccagggcttattctgaatggtaaccacctccttaccctgtggccactgttagatcaaaactcacagaccgtttgtctgtatgcgtgtgtgtctgtctgtcttaagtaatggaattgtactctgcatagtattctttaacttgcttgtatttaaactcaataatgtattgtggtcatctttcagtgtaatcatatttagacttgccatcatactgacctgtttttgagctgttttagacagcaaagataaaaaacttcatgtaaacactgctttctgttttgaaccgagaaaatattcatcactattaaagttcaattaaaacttaaaaactcttatatactatattgtgactgagacttccctgacctcaaactttattatacattataaaatgtaaaagggaaaaatgttgttttcttccgtgaaatagttaccagggcaattcctgaagaacaagtatatcagcacaaataggaaattgaaattattatagcttatgtgttctttgttactatttgaattacaagggcaaagtaattcacaattcaacactggtgtgtgaattaaaatatcacaggtgtttgggctttaacaaaccactcttaaacattgtttatcaattctctgctcaacacctgtcatagtgttcagtttttaacatgacaaaatccctgtcttttaatgcaaaatgtatcttcctctctgatctgaccttatcctatactttaaatattaccactagttgcttctttacataagacacttgttcaagttaaatattttgtctaatccaataatgcttattatgcgcctttctgtggctcttgtttatgtatgcattttcaactttcttgaaataacagctaacttccagtttagcctttcagggtttttgttacgaagaactttacattgatgggggtttgtatcctttaaaaatgttttttctttgatgttcaactctatttttaatttttaaaaatccttaagaatcgcatctattttttaatatcttacttaaatcttgctctctttttgaaatttttcataatcattttcttagaagtaatgtctccttcctttggccttctacagcaatggctgacctacctttatgcaattataatataataatagtaatagtagcagcagtaggctgagtgcggtggctgatgcctgtaatcccagcactttgggaggccaaggtgggcggatcacctgaggtcaggagtttgagaccagcctggacaacatggtgaaaccctatttctactaaaaatacaaaagctagcaggcatggtggctggcgcctgtaattccagctacttgggaggctgagacaggagaatcgcttgaatctgggaggtggaggttgcagtgagccgagatcatgccactgcactccagcctgggcaacagagtgagactctgtctcaaaaaaaaaaaaaaaaatagtagcagcagcagtagtagcagcagcagtaatagctaacatctattgagtgcttcctttgtgtcaaagattctgtgcattgctttcaatgcaatgcctacatctcggtcgaacctcataataatctcatgagtcaggtattatgattatctgtattttagaaataaaatattcagtctgtagacattcagtagcttctcctaggccacacgtaataagtgacagaaccaggactgtcagttccattgctcatgcactttaccactacatctcgctgcctgtatctgagtttcttataagatgtaccagctgtagtttaaccaagttatttataaccagtttatagcatgaagtttgaaacttatttttgaagtttcaaatttatattccattaaattttgttattatttaaatgttccaaaaaactagtaagtaccatttgtagtgcattctccttgtgttccttaaaatagtcttagctaggatggacttaatattataaccttcaaaccacaatttataatgaaaacatttataatcccagtgtttgagctctttggtccttgaaggtacttgaacatgcaatccgtttttagagaattttcatcagaatgtgcttaatactgcatttattctacaaatatagctccgtagctaatgattttgattgccatcaaggtttttctcacatctcttatgagctctgagatgagtaatgaccagataaatatttacatagatgttgtatctgattaacaaagtcaatatattttgtggcttttatttataggagatatttaaaagtcattataaaacagaagtgttatgaatcttttctcttttctcctagtaaaatttagttattaatctagttgtctcaaaattatgaaagaaaaagagatgttaaaacttttgttaaatatctctcttcatcccattgtatacttacatatcagtatttttataaattgtggtaaaaaatattggttttattttaaaacaattatgactattttcacatgtattttttatatagcaaaattatagcaaagttgactaagtatgttatgaaggcttctagtaacttagatttttttcttcccactaatcttgtgcaattgagaaatactgtgttcaagctacatatctgaatatagagtttatagaattagatatataaatttggaagtcatctaacagtatatatcgaccacctatatcattgctctgtcatattttataaaatattaacaaaagctcttcatacctattcaaatagattttttaaaatagtgattgtaacataatttacctcatacttttttcaagagtatttcatttgttataacagaactttaaaatattaaaagcagagctttttacttcggaggtatttttaattaaaaagttttttttaactttcatctttaacttgagagaagtatattcttcttgtaattgaacatttgtgaacttctgcatataggtttttgttcatgccatgaatatttctgggttttctgaagtcccttctggaattttatctgtgactaattattccatagctcctttttaaacatcgtcaattgtgaggtttttcaaccgttttacatttttttgcagacatttgctaatcctttttagtgcattcagtaccaatagatttgattctgatatgggttttaccttttctccatagataatttcattctcataaaacatgtctacaagcattatatgaaaactgcatagtaattttggcaaacttttgaaagacatcttttataagtgagacttctgaaaggtgtaccctgttctgtggcagtttaatccatgaaattttacctttaaagaattataaaagatagggagctgattcacttttcacccttagaagacatgtgttagtaaaattcttccagaagtatatacagaatttgttttccatctgcttattgctttttttgtgagcaacttttgcaacagtgtttgctctgtttcttactatgagtctgataacacaccctcagccacaggaagagtgtgaaaatatgctttatttttaacatagttgatgaaaaattaactttaattacaaatattcactttatttcattgtattttattgtattttttgtgttaaatatttatgctaacggctcaattttaatagcataaatatttaacacaaaaatacacacttcttcagcagaaatttactgttttatataacttagcagaagtttttttaaaattaatctaaaatgtattttaattttttaaatgcataatcaattcactgaggggtgtttttttttttttttttgagatggagtctcactccgtcggccaggctggagtgcagtggtgcaatcttggctcactgcagcctccacctcccgggttcaagcgattctcctccctcagcctcccaggtagctgggattacaggcacgcacaaccacgccggctaatttttgtatttttagtagagatggggttttaccatgttggccaagctggcctcaaactcctgacttcaggtgatccgcccaccttggcctcttaaagtgctaggattacaggcatgagccgtcgtacctggccaatttactgagatttttaaaatcatagtttactaaaaattaagtatcttattgaaggttttaaataaattgaccttgaggaactaccaagtgatccaaatacagatatttgcaagtgacataattgtttcatgcattaaaatcttgacagtagctttaaaaaaatttttaaactccaaattcatttctcttgttatgtatatactcttgactaatttttaaatggtcattctgacttttcatagggttaatgttcccaatatgaagtaacattaatgtgaccaatgaaattcatgattgagattaactaaattttttgtcttgttttacatatatactttaacagttgaaaattgaggaatataaccaatagaaaatcatagacaagattaacattcttttattgatgagcttaacatcattaacaattatgtttgtatgcttcaacacattgtgtttattttaaaataggaaaaccattcttttttatggacatgtttataatagcctttctttattcctgatgaatgtaactcaaggtatggcatctctcctttatgtatctttatggtttctcctaaaacctagcttatcatctttaacactgagctgtattttctagatgcagtgttaagattaaattctacaaatccccacaaaactgtttcctccttcctcctcccaacttttaatttcttcctaattatataaaggcattctcaaaataacctttgttttggtttttggcaaaggtatgtttcgtatctggtgacattatgaccctaatcctataatggttagtgttggtttcaaataattcccttttagtaagtcagagagagagagagattgggatagtaggtatttagattaacttccctaaaagctttgtttgaaaatattatcggcagagttttagtgcgtcatggtattctgctgatttagttgaaggctttgcatttacatttggccctcaccaaagtaactgcatcttttgtggcttcctgtagcaggatataggtttccatgaatatggtttctatttactgccaaaagctacctcaacaacagtgttgaaaatgacgataagttctaccatcataaatttttgaaatgttttttaaatgtatttacttttatattgccacttttatactttcttctagaaattcatgttagaagctacagaataatagaatgtttgggttcccatcataacagttttgtgttacgaatttggaaaatctattttatacttctttctaatatattttggttatattaagtacactggatatataatatcttactataaccattcctgctggtgtactttcattgaggcactaacattatcatgtgaaattattatctaaacatctctgagtttaaagacaagtgagagaaagcatagggtacctttaaaatacatctttgggacttctggaatatgatggctgttcaccataaccaccaacatataagacaattgtccaaaatatggtaaaacattgtgctactgtcttaagtgtctgatgtaaaggaagaattgcatttttctcattaataacaaagatcaaatattgtaacaaaagagtaacctgcaaatttattcctatagctattcatatagtgtaacctgcacatcatcataaaaggcttgaacagaatgaatggatggatagatttttcaaaaaatctttgaccaacttcaagtgtgagaaacctgtaaatgtgagaagcagtgttggctttgtagttacaatttcagaatgatccattttaccctttgttgactagtgtccattttcagccagccccctcatatcccctaaaccaaaatagaagctaactaaaaagaaaattaagaagcagacatctattaattaatttaatgtgcagaattaataataaattacctctacacattgtataagagcactgctaagccttggtaagataaaatgctgttaccaaaaaaatcctaataatttttacatgaaagcaagtaaataattattttccaaaatactaatttaaacaataagtcttaaatatatatgcttactttatgttgtattgtattctgtgttcactgaggtcactgtcctagaataaacactataattttgcctgttttgtgtactagaaatacttatcctgtttgaagaacttccatcctctgtggtgtagacagatagctcctcaatctgaaacattttccttgctcatcatttctaacattgaactttgagcaaaaaccaaatatctgaaaagcattctacattgagaaaggtaatgaaaaatacaaacatgatcctaaaaatgggtaaaaagtcagtgcatagctaatttttttctttttacttttttcattttttaaagtgagttacaacttacatataggaaagtatatttatcatttgtatacagttgaatgaagttttacatatatatagacatgttatcacaacccagcaccccagaaaccttactcattctcattctagcctgtatttggtagtgcaaagataatcattattctgacctctgtaactatgtattaggtttgacataactaactgttattatcaatgtttacattgtgaaaacttttatctcaacataggttgtcatctgtaaatctacttgaaataatttctgagccaatgtcagatcatataattcaaaatataaatgattttaatccaaattttttttttttttttgagatggagttttgctctttttgcccagagtggattgtaatggcacgatcttggctcactgcaacctctgcctcccaggttcaagcaattctcctgcctcagactcccatgtagctgggattacaggcgcacgtcaccatgcccagctaattttgtatatttagtagagacagggtttcaccatattggtcaggctggtcttgaactcctcacctcaggtgagccgcctgccttggcctcccaaagtgctgggattacagatgccagccaccgtgcccggcctgattttaatcagaatttaaagcacaattttagactttagttttaaactttaatatcaaataatatattatccactctggtattttccatgtaaatctctgaatgcaaccataaggaaaaaaattaaaaatccatatatgaagattaaacattataatttgtaacatcttcattcattagataaattcctagcatataccctaataactggctgtagcatgagcttttgagccaatttttatcaatttcacttaataccatagttatttagtgaaaaatgtcatatacatatgtgtgtggcatttgtacaacatagagtgcatagcttctgtaaaggaaataatgttttgtatcctgggaccccattatcctttaactgaattgactgtcatccaagtatgggtttgataaactgacacaacagtgaaaagaatccctgtcccatgtcagcttatcaaacacactgtggacagcatgtctttggcattaaacgtattcccagtcattaaagttctgaatagaagtcacgaagcttatgttcagtgagacacaacctcagtgtttccaggtgattttaagaacacctgataaaactgaggtatagtaccactaaactttaagaattttccaaaaactagggaaaaaaagtaacatgcatagagttacagaattgcagtgttattgttcagttcgatgatagaacttatattaatgagatatacagaaaagtaattaatatcttgtccttctggtaaaccatgtcaaattatgctgtaaatatatttatactgtagaataaaacaaaatcaaatatgttttgattttttaatcctttttttcaaataataacgtatatccacctggtaaaattgtccatcggtctgaatctctcactatttttttcccaatttcatttatttaatttgaaaatgtctatcatcaaaaatttagcagccttttttggaatagtgcactaaaatcatttgtacattgtccaagttaaagtataggcatgtttgaaaaagatttttaaaaatttattctagtgctgtaaatatatttgggtgaaaagctaacttctatggtgatgtaggtcaaaacgtttacttataataatacttcatttatacatatctataataaaatagttaaatctataacatttataggtgaatttgcctgattctatatcatatacaatgcgaaaacatctttcaggtttgttctccatagtttaaccctcaaagaagaaattacattatgcagttacagtaccttatcagtggagctcgacttctacgctgcaaatggaaatgtattgcaacagtgctaaacagaagttgccctcctctttggagaaaattgcagtatccgagagctctttttaacaagggactacttttaaatgtgtctgatcacctcaaaggataagtagagtgtttcctgccagtagaattagaggaaggaagcaccaggccaaaatgtttgatgtgtgatgtactgtaattcttttcatgtgtttggtggtggcttttatatgatgatcagtgttttgctactatttgtgaccctggtgtggtccaggtcattaaagttcaaccttccttaatgtgtagggtcattaactatacctagcagcattatcataattaaggtactgttttcttttaaacaactatgtctcattttcattaaaatatttcttataattggaaaatcgacctagtgattgtgattctcatgaaagagattattcaacattggagacctgctagtactagcattactgtcgacagatgctctttaggtttcctcactttaccttttagtccttgtttttaaatcagcattttcttcccacaattacctgtgggtatataaagttcaagatggaaactagctttacatggtagttttcctggatgtgagtcttagaggcaataagaattgacaaaattgctgtcagcaatattatatacctttaatgaaacaaaatgtgatgattatacatgttctttgttattctgagatcacatattcagatattcctttaaatgtttaggtttttaaatatttattcagtttaaaatatgtaaaagtaggttctttattctttcatctttatctttctatgccctctaaatttgcttttgggtttttttaaaacttttatatcatttgttcacccattagtcatttagcacttgacaatttgacaatgatagctctaaaggaatatatgctctgttttgggatatgtgtgtttatctgtgtctgagtgtgtgtgtgtttgagggttgtttatttgaagagccagtttcatcttttcccgcatgtgagtatccagatatttttggtatttgccttctgtctctttcaatgctgatactggatatatcattaatacattaatttgaataaagctaaatgcctaaaaggatcttcatgtgataaaataaattgtctttcctccatgcataaagaatcaattttattatcttacttattgatttctttagaataacttgtgaacacctaccattcgctagctatttgctagctgtaaagctgcactggtgacaaaattattcataatctttaccttcatgaaacatagtttaattgactttatcattatacttaaagtatattaattgatttcttgtaaacattttctctaggcaaagaaatacatggcacatttagattataaaggaagaactcacagaattttttatgtcctcagtgtagcaatgtagtgcctgcatttattttattccataagaaagtatttcaccagttttataaattaagctattgtcgtcatagcttactcacttttcaagtcatggcttatgatattaatatttaagatctaaatgatgatgattacattgtaagcataatgaagaacaatgtgaagaaaattttaaaaataactgaggcctttcaccattaatttgtaaataattggcctttaaaaaataggtacaataattttctgcacattcttttgcattatcttgcagcatattaaaatatagatatacaacatgtataattcaaaaacattaatatttaataagaatgatgtatgattataatttttgtattttatattgtattttaatgtaaatgtgatttattaatgtccacaaaatatgaattgcagacagagtatttggagaaggaattattgatacataataaaaattaggccagtgccatggctcatgcctgtaattccagcattttgggaggccaaggtgggagtattgtttgaggccaggggtttgataccaacctggtcagcaaaacaagaccctgtctctacaaaaaattaaaacattagccaggtacacacctgtagttccagctacttgggaggctgaggctggaggatcacttgagcccaggagttcaagattgcaatgagctatgatcatgccactgcactccaatctgggcaacagacctcatttcttgagaaaaagaattaatttgatataatgaatagatgtatttaaataaattggtaatggaaaagatgcctgcaaataagtattgatgctaacttattggaagtatattctgtttctttttttcttttttgtaccataaaacagaaaaggactcatttatttctataagcatttatatatatatatacacacatatttatatttatacattatatttatatatagcatttatatataaaaatgcttatagaaataaatgagttatataaatatataaataaattatatatatatatatatatatatatatatatatatatatatatatatatattttttttttttttttttttttttttttttttttgagacggagtctcactttgtcgcccaggctagagtgcagtggtgcgatctcgactcactgcaaactccgcctcctgggttcacaccattctcctgcctcagcctcccaagtagctgggactacaggcacccgccaccatacctggctaattttttgtatttttagtagagatggggtttcaccatgttagccaggatggtctcgatctcctgacctcatgatccacccgcctcagcctcccaaaagtgctgagattacaggcgtgagctactgcgcccggcctaagcatttctatttttaaggaatactttacagaattaatgaaaaaagagatctaaaattcatcaccagctaaattgggagtcatttttgtagcatctctttcacagctagctgtttgacctcattgttctcagttcataaagtttatattgaatgcttttgcctcagcacatatgctaaggtgtgaagaatatcctttttcacaagactttcatgtctcaattttattcatagaatatttcctagctatttctccacttttgaccatgtcatttttagaactaaatttttgaaactgaagaatttatcagtaaaataatattctatattatctcagtttcttttgtatttcttttgaaagatacaaaaactttcttgtttttgcatttcttttgtaaccaaaatctaaaaactgcataattgttctgtggatttttattgtggtttcgaggccctatttcgaataactgtactttcatgttttaaatgtttgtctttgctattgctcggtgttttcttttctattacagggttattttcttaaagtgtatagagtcatggtatagaagcacaaatactaagattaaatactttttagtcgttattctgcttataaaaactgccaaatgtacattgtgacttttttatatgttgcctcaattctccctatgtgttttctgttttaattatagcttagaaaatctctaggggtaatatatttataccctatatactgtattttagtattacttatctgtttttaagattaccaaagaatattgttttctggtatcaattaaaacttatataagaatttataaacagaatagacaatatagtttaaatattttcatgaaatatttggtattttctgactaaagtcaaccctatgtggctaaagcttttgatatggtactaaatcaacttttttatattcttaagaataagcatggcacatttttttttaactttaagttctggattacacgtgctggacatgcaggtttgttgttacataggtatacatgtgccgtggtggtttgctgcacctatcaacctgtcatctaggttttaagctctgcatgcattaggtgtttgtcctaatgctcttcttccccttccccctgcacccggacaggccccggtgtgtgatgttcccctccctgtgtccatgtgttctcattgttcaactcccactgagtgacaacaaggcatagcacatttattattcccatatttgtataactcttgccatgttaaaacattcatgccgaaagtaaataaatctatctccatactttggtggataagatggggaaaaagatttttacattctaatttttccttaagaaaaaaatgtatctttttattaagaatgccctaatggtgtttcatttcccaagtgaaataggtggtgatctgttctcagctttattaattcctgaatgcatggataaaatattatacttgaagttcttatcagtaataatatataatatgttaaacataattattgctggaaatctgaatagtgtttaatcctagatgtaatggagacctttctagaacctccacttgcaggattaagtttctacagggaaaagttttcaaaagaagcaaattctaatgccaaaccttggaacatagctagcacatttcttcaaagtatgtaccttcattattgtatttttagtagatatggggtttcaccgtgttagccaggatggtctccgtctcctgacctcatgatccgcccgccttggcctcccaaagtgctgggattacagacgtgagccaccgtgcctggcctaagcaataataaaggcttaagcccggcctttattattgacatggacatcatcagaatttcttgtcacatcattgctctttagaataatagagggtcctaataatatctatataatttatcacatcttgattatggttagtggataagggagattttctcagagaggtttcttggtgctatagtagccactgcaaaactcagtggaagagttggaaataggtgagactttgaagaatatgttgagctgtggcaaataggccaggtagaggaaaagaaggtggtcagaaaatagaggcagaaataaagcatggtacacttagagacatgaggatgcttgttttttgtatcagagtacttgttattggggcataatgagagagatgtggggacaagtgattgagatcagactgtggcagctttgaattcctggttaaggaatttgtgctttattacataggtggatggagagcccttaagtatttttgatcaggtttgaaccattttgggagaattaattacagtgccaagtacatagtaagtgtttaaagagcacagcctttccaagtgacctcagccaacatacagcacttaactccctcaattttatttgtaaaacagggatgataatactacctacctcatagggttgttatgaggattacataaattaatgcatataaaacatttaaaacttgtctggtactttgtaagtattcagtgccatcccaatcaagctaccaatgactttcttcacagaattggaaaaaactactttaaatttcatttggaaccaaaaaagagcccgcattgccaagtcaatcctgagccaaaagaacaaagctggaggcatcacactacctgacttcaaactatactacaaggctacagtaaccaaagcagcatggtactggtaccaaaacagagatatagatcaatggaacaaaacagggccctcagaaataacgccgcagatctacaactatctgatctttgacaaacctgagaaaaacaagcaatggggaaaggattccctatttaataaatggtgctgggaaaactggctagccatatgtagaaagctgaaactcaatcccttccttacaccttatacaaaaatcaattcaagatggattaaagacttaaacgttacacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaataggcaacctacaaaatgggagaaaatttttgcaacctactcatctgacaaagggctaatatccagaatctacaaagaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgagataccatctcacactagttagaatggcaatcataaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgctagactggattaagaaaatgtggcacatatacaccatggaatactatgcagccataaaaaatgatgagttcacgtcctttgtagggacatggatgaagctggaaaccatcattctcagtagactatcgcaagaacaaaaaaccaaacaccgcatgttctcactcataggtgggaactgaacaatgagaacacttggacacagggtggggaacatcacacagcagggcctgttgtggggtgggggtcagggggagggatagcattgggagatatacctaatgctagatgatgagttagtgggtgcagcgcaccagcatggcacatgtatacatatgtaactaacctgcacaatgtgcacatgtaccctaaaacttaaggtataataataataaaaaaaattcagaagtatttactgaattttataattcagccgtaattattatacttattgaatgtttttgaaatgattgcttagtgcttagtctgactatagtatttaatatattgattgaattgtggaaagaattctacctaccgctttttgcttatgcaaaattaaataagtaaaataccactgatgaaatgagaaattgtaattttgtatgtgctgcaaaacaacaacaacaacaataaacctttacaagcatccttatcccagctacacaagaggtttatatcaacttaaaatccccagataattttcaacttgtttcaagccctgcctaataataggccatattagtagctagcatttagatagcattttacaggttacagagtacttttttatatattccctcctttagatttcaccaaatccttaggcactactcagtgctgtaattcattttacagtggagaaaacgaagctcagggatgcctaagatcacacagctagtttgtgctctgaaccactacaccataattctgtttggcctttttattgaaacaactatatcaaaacaatatagagtacaagaaaatgctttttctatgcccaccaccttcctctgttctgtaccttgctttttaaactctgccatgtaagactcatcacttggacaaacataatttcattcatagatttttactgtgatattctattgcatgaatatgccaagttattatgtcattccttctgttggtggagatttacgtttttaatttttctgtatcacttgtagtgttaaaatgaatattcttcaacattctccttgtacgcacatgtaatagtttttctagggcagtgccttctagtagaatgtcctgtgatagtggaaatttctgtatctgcactaatacagtagccattatctactgtaactactgtaactaatacagtagccgttagccatgtaactactacactatgactcaaggaattaaggagctaaattttttaaattgtatttaattttaattaattttaaagagacatatacagctggtagctattgggcagcataactctgggttatgtatctaggagtttaattgctaggtgataggttacatagcctcaatgctgatagatttcacgaaattgtgtcagatttatattctcaattgctgagtataagagtttcgtggctctctggcaaacagccttaatactgttgcattaggcactatacacttaggattatcttagtactagatatttgtggatgatgtttaaggaaagatattttctctctacaactggaggtgataaactaatggatggtacctagtatgattagatatgctttctaatgtatggcaattgaagggcattgtgctactgtcaggaaaatatattaaattttctaatcaaatgttagactatgtagcccttgttgctaactagaagatcatgattgatacttttccttaaagaaactatctttattctgattaatttgcaaattaagttattcatattttaacatcatacattaagagattttatggactgttgctgtatttttaaaaattcatacctttctttacaaatagagaattgcttaatgattattgtaagtttgagaatactaacttctgttcctattctttcttcttgaccgattttataatatttgtgagtcggaagtaactccatacattaaaaaccatgttaaataatgtgacaacatttttttaaagggagttgatttgttatataccacatctaaaggttttttttttcctcctcaaatttcctgttttaaatcaattctaatctgttgccttggaattagtctttatcatgtttaatttgaagtcttacagtttttcatccaacaacatacaaatacatttaaataaagcatagttttacattttattttgaaggctagttctcatattgttaggtacagaacgtaggcgacaagaggggactgaatttatagtcagaaggtgtggtttcccatttggactatgctgtttctcatcctccttacctaaatcatcagcatctgtaaaatgaagtctacctatagcaccctgtgagttgtgatttatctacataatattgaaacccctttgcaaaccattaaactgtaatcaaatgtaaagtggcattattaatattattactatcatttatgtatttctgtattttgtattacaaagctcttcataatttggtagtagaattggaatgactggaaatgaaagaatgtaattaaagagaaaaaaatttaagtgatataattagagacatagtaataaaaatgaatttggttaagagataaagggagatatctttgttagaattgttattaaaggtttcccaaacagtttggaattagtacttgtttacgtacagtttaatttagccacaatttacttttcataaatatttttctatgattttttcttattatggaaattatttagaaaattaagtagaacttgacttttaaaaagtaatgtactatgaacatttggggaccttatctgtgctcaccttggttcagatagcagagatacattgttcaaagttagagagctgtaatgacccaagtatcagaatgtggttttgagaatcaatagggatgctagtttagataaaaaagggaaaagagggcatgttcctcagcctagtccagaccttctgaatcataatgtctaaagatgggagctgaatattttgaacaaactccctgggtgattcttctgcactctgaagattagtactcctgccctaatcgttggtgatggaactcagcatttgtttcagtctgacagacaattattatatcccctgtcctatttactctcaaaattactgtcacttatggagacttggtgataaatatgtagacatttaatttaatcaaggcataaaagttttacttctttttcattcctattttctgccttatttaacattttgtggatctcaattgagctataagtgaatgaatttcacttctttacagtgaattcccgagatatgcctattcagcagtgagtagtaaatggttcaacatgagctgttccttatgtaaacatacaaaaggcctgacccagactaaatcaatttaaaaaggaaaacattaaagctatgtttcctgttatatacttaaagtcttctttggttccttatgattacattatcgaccaactattgcagactttatcctcctacaccacctgctgaatggttcaaatggtatgggataagagtttcggaagggcaaagcaattacaattataactcctacattgtagccaataaagcagctttttgtgctaaggataaggaagtcatgggcttcttgattcaccccctttcctgatttgaattgctacaaggttttaaaggctgcaataaggagacagcaaagttcatagagcttttagaagtatgtgaagttgagaccagaaaatttaagtcctgtttatgatagcaaacatttctaggaaacatttaattagtaaatgaaacaacaatataacgcttttttattataagatgtttacattgtattttttaaggcagacgttaacattaggcattctggtcctcaccataggaccagctatagtcctttacctatgattagctgcttagtaaagtatcattctattagaattctttgctctaattattctgcaattgttgtttgtgctaggaaaacttggtgtactaaatcaaagttctcttgaataaaatatactttcatttttggcattgtaatcagaatgtttttcactcctacaagtcttatttttaagttataaagttcttttcttagggaagggagctgtaaaattgtaaaatgattttcagtctttgaaaaaataaattatttgtgaatcttgtgtctgtaactatttaccaaaaactttaaaaaaactctagtgagccatgagatgtgaaatatctttcagaagacatcttgccttaatattgcttaatgaaagttaatgtaccccataaatttatacattatgatttttcattaaaaataaaaattttgaaaagctagcatatggtatttgaaaacattttgaatatgttttcttaatttcatattgaaaaagcaaaaatgcttttaatatttcataataaccgaaattggttttaagtatgtataggacaaaacaggagtatatcttacacattaaaaaatagagattagtgactatttcaagttgagggaaaaaatcctcctattttttggaaaatgaagtaaatcagtgcattactactgtattttcttataacgataaagaaaaataaatcttggggattatgtaataagaaagaaaaattaaatttttatctgcctaaaaaaactatcctgtatttgttttattagagaaaaattaaaccaaacttgtaaattttatacatattagctaattcttcaaaatataatattttattaactcaaaccaataagctaaatggtctacctttataatttgtaatagaaattttcatttgtacttggaaaactatctacagaggagatacattgatgtttcctggttttgatagctcaggagactaagattgttgaagaaactgtgttttaaagatgcaagaatatttttatttcgcctaaattttccacaataaagtttttcttggcttagaaagtaagaggtctattgcatactaaccagcatactgttaaaacactgttaagttgatgaaacagatcaaattagaaaatgtgggtagaattcattgagtttgatttattaaattgagtatcactggtgttctctgctcagctgttgtttctttttagaatcctagtacgtgctttatccagctaagtctgtcttattctcactttccagtcattttacttctatttgacattttatacagagtctgaggaaagatttcaaagtagggttttttttcctgacaatttttgaagtttttatgatgtgatgacttctgtgccaggctctctctatattatctcacttaattttcataattaagacagaaacccaggtttttctctcctcttggctattgtgctactacagaatttatgcaacctatttggcacgggataaaatgccagtttgcaaggcaagcccatcttgtgggctgcacctcttcctcaaacactgggcctcatacaagtctctgatagttggtacaaaacggcctgtctttggctggaaacctccatgccttataccattgctttctcccctgcctctctccaggcccgctgttcagagccttttcagggtttctagatgtgctactgcctcacacctttcagcctttgaacctgctacttcctctgctggagattctttcttgtatgaaatgagataactgggcttttttgaacttgtttctatgttgccttcctctttcctgggcctcccaagtctgggtcaggtgtcccttctatgtgcttccaattttattttatacataaccttttggagtattaagtgttgtataattgcctctaaatcccacattagactgtaagtgttatgagggcagggaccatccagggacctattattcttagggcctatcacaatacctgacatacagtgcccaataaataatgcaagtcaggtcactggaggaagggctgttttgataggagaatataattttgaagtcctgactaaggctatgagtagggaagaaactggttgctttataccacttactactttactagcagttttattttataacaatatggttttaaaatagagtcattttcatgtagaaaaagagttatagaagaagtaatgttatatttggtaggagaaattagaggacgctatattaatagaaatatcttctagggacagtgacgactaggagagattttttttttttttcacagtaagccgtaaaatctttgttgctataaatcttcctattcatttaactatttaatcttcacaacatcctagttatgtttccttttttcttgcgaatagtatattttgccttctatctttatctttttttccctttaatgctagaaatttgtctatttttggctttgttgatcttttttattgtgctctatatccttccctctttcttttagtttattctactttttatgttcagcttattgagacttttttatttgctaaaactagtattttagacaataaattatcctgtgccacttgaactgcatcctacaatgtttaatgcataacatttgcttttaagtattaacttttattatgatttttttgaccagtggatgactcatttagaagtgtgttttaaaatttctaaacataagcagttttgtgaattctcttctttaataaaatatctaactgaattgtattgtgctcagaggatacagtctatatgatactaattcactgaaatgtactgaggctagctttatggcctagcaggttgtcggattttataaatgttcctgtgtgcttgagaaaaatatgtattctccagttgtcagatactgtgttctgtaaatgttcacctcatcacacatattatgtttttcaatttttctgtatttttcttcttacctgcttagagggttaaagttttccaccatggaggacagatttgtcagtttctccttgtagagctatcagtttttcttttatatgttttgaggctgtttttacaaataaatttagaattgtcttaacctccaaatgtactgaatcttttgtcttcaggcagtaactatttttaaatagagttaaagtctatgttgtataatgtaatgtaaatttaattacttaagttttttgtcaaatgtttgcttagtatatatttttgcatatgttgactctttctgtgccctaaagttttaggtgtgcctcataaaaaacagaatattgattgatttattaaatgcaatctgacagttcttatcttttaatgggagagtttaaattatttatatttatgctgcttattatgtttggatttttatttgtatcttcttcttaggtgctttctacttgcccaactttggtttttcatttctgacattctaatttttatttatttggaagttatgtgttccatatctgttattttagtggctactctggctatgttaacatgtgtacttaacagaagtctgaagttaatatctttttcttcttcttcaacaatacaagaaacttagaacattttatctcaaattatctggtccccttatttatatattattatccagtgtcttatttttggcctgttttctcatcacaatttagacatcattattattaatttaaacataatatatgtttagacttagtcatatatttaccaatgtcttccttatgattatttcttgggatactttgggctgcctggatttagggcttggcatttttcaataattgtggaataattataagacattatctcttcaaatattgcctcctccttgttctgtctattacctccctcaagctttaattaagcattttttagactttctctctctattctccatgaatcttaaccttctttcatttatagtatttccttgtctctttggattaaattctggatttcattggacctttcttttaattcactatcactttagctgggcttaatctgcttgagttttattttttttctcatttgtagttctacatggttctttttaaagtcttgttccctgctcatactttgaagatgcttttttactttttaaataattattttatattttatgtttgctagtctgtccattgttactgctgttgtgtgaattgtgaattttgtctgtgagtgtctcatttcacttggaacctgatctgtggaagttctttgagttgaaattgatttcatcccaagagactgtgcttttacttttgcctttacatgtcatctggcagcactgtctacctggagcaagactgtccagactgaatttttgttcataccatatgtgagactcaaacttccaagtcctggctcatgactgcaaaatcttggaacattgctttttagtttgggttttgtgggttggttggtttttattttgtttttttttttttcccctttacccattagtaaggtaaagacaggtaagttgataaattaccttgtccatttctacatgagcataaggagaactgttgctttaaaaaatatattttgaaatatagattcataaagaattacaaaaaatatttggagaagtcctgtgtgcactttacccagtttccctcaatggaaacgtcttgtataactatagtacaatatcaagaccaggaagttgacattagtacaatcaatacacagttgtattcagattctgccaattttacatgcacttagttgtgttaatgtatatagtgctctatgtaattttgtcacatgtagattcatgtaaccaccatcacaatcaagatacagaactgtcctatcaccacagaggtccgtagaagggctgtttctaattcaccctttcactactggtgacccttcgtgatctcagctttatgtgaattgtcttctattaaatagattcatcatttgcgtgagccctgagcttcatctcctcctgtgcagttaacagagcagaaaatcagtatctgcaggatttagcagaaaaccttagagtaaaagccagctttggcaggtgcttatttatcatggttcctggtttcacattatttgggagacttcccagcttctgttattctgttattggtgttggctccaggatgtgtctgaaaaaatactttagatttgttaaagcaatttgttatgagagccaggaggttcattcagagtttctaatatgccatattcagaaataggtgatactagaaatgttaaggaacatttatctttatcgttttcgttgcagttcattcataaagtggattttgttttatcttgatacttgtgcatctgtgattagttggtgatttaaatatgctgttcattcagaatcatataagataatatacttccataatagtcataaaatctacaaggtactttatgaatagtttttcaattacacatatattttatttatctttataatagtcatatcaaaatagctaaagcacagagaagttaaataatttctgcaagctcatgatcattggaaagtctgagactaaaactcacataaatcagctgcttatcctactttccccaactgagatttggaaggttttgcaattaacttttaagttggatttatatactcaaatattataaattactctgaattttttcaaatcaagtatgtcacatatatgtcaatatatcaaatatatagtttaattttaaaagcaagcaataagaaaaaatatagaaatactaatcctaatccctaaaagtttgaaatttgaaaattaccatttttggaagtatctggctatcactcaaaatggaaagtatttttgcatagggaagaagaacctgtgggaaataattgataaatgatggcaggagaaacatagcttaatttaagtccaaaaaaaaaatgggaaatttcaagcctaaaagcaatgtaaaagtctgatgaaacttggtgtttttgtgattgtaatcttgttaattatacagcttttccatgtatcaagggaaataggaaatcggttgtttacattgggattaggttgatttgtcttttaatatagcactaattttgttttcattttttttccttcaaaggtattcttaaagtattttagttcaccttaaaaatatgtttagggagtttatttaaaatgtagagagcattggctgttttaaaataggtaaaagtaatgtttatatggtgagtaataatctagggaaataggttaggccatcaactgcctcagatatttgctggctatcagaatttatgtggccctgattcaaaagtttagtcttttaaagactatgtgctcttattgctgtgtacagataggttctccgcctgagatttgtaaagatttatgtcagtacaaatcagtgaattgaaacagcatttacctgttgctagatagtatagatagttcctgacctcaagaatgtgtggtatatttgggaagactgataagtcaatgtggtattattatatttacaagcatagagagaccctaagaacagagatttgggaaaggggagtttggaggaagggtgatcaggaaaagcttcataaaaacagagttagctgagctgggcctttaagaattaacaaaattacaccaatatttaaatgaaactagaacattcttctacagagagactctcaaaatgcctctccttcatacccccactgtcattcattccttttctctttaccttaaggcaaattgaaaggattaatggcccacttatgagccctatttctcatgcagttcttgagtttgtataaaattttagttcacctttcctgtaatttttctaagttagaaaggagaaaacacagatccagctcctaccttaggaatcatgagaattatcctcagtttctctggctcctgctttggcttgttgaccagtggctgtttgttccccttttcccgtgttcataactctttctgacatctcactagctgagccacttgcttattccactcaggtctgctccttgcttctctcttcacttgaattaattaatgtcagccctcaccttgcctggcccagtcctgagcagctggcccagacacccgttgtcttgagtctgagcagtcattcactgtccattatcatttaaccagcctctgggagtgcttgttctgacctccacaccttcttagtcaaccaaggcataaactgaatcagattttgcctttttctatacttttcacactaggacccccatcacctcccaataataagtttcgttagtgttcaactgatgtaattaacttaattgtatttttttctaatgtctgtaattgaagcttttaaaaatatttctactagtaaggctatttttattctctttgttatttcaacttttcttctgataaaaacttttatgggggccaaaagctattttttcttttgatcatctactttaaaacttttctgaaccaacaaaacttaacataagaaaaaagccccaaattcaggcagacttaagttttctctggctctcaaactttgtgcttcccaccctaccttattgccttgctattttactctaaaaccttcatgaaaatttttatgtatttacttcctttaatttaactttacagattattttattcatttacttagcagtggacccaataggatcaacgttgtatgttccaactctatatagggcagtaaacctctctgttattctacatcagaaaccttgtcatttctcaacaactacatttgggttatataaagaatgaagagcaagggttgaaggggtgaaatagattaagaaggctccattacctttcctaacaagaaatcaaagctcagaagaaagtagacgattagcaagggaaagggttttgagtaaaaaacaaaaaacaaacaaacaaaaaaccctgtatttgtgttgtagttttgtcccatactagttttgtaactttagctgtctttcaaactctgtgaattattttctcattggtaaaaatggacataaaatagaacctcagagcatctcagggattgaaatcatgtatgtgagagtacttagaaaaagagtaacgtgccaggaataacataataaatcattatagtgtagattactgtaagtgataagttttggatatgttttcaagtcataatatgtactaactttctgaaacctttttcatagatgtgccccagtttattcatcagtaatccaaaggaaaaaaatggtattgacactatgttagtgaacaaaataaacatagaatggttattttatctgttttcttgtttttatttttgtttttttcgctgcctttacaggagagccttgaacttaggaattcttcgagatcctggatcagaaatcgaagacagacaataccaaatagatctgcagtccatcaatattggtactgcacagtggcatcaactaaaaccagagaaggaaagtgtctcaggaggggtggtaacagagactgaaaggaattctcaaaatccagcccttgagtggaatatggccagcaggtaggaaatgattgagaaactttctactctttctaatacttcattgccagaatagttggtgatacaatctttagcatgtccaaccaacctaagtattttggtattgcttctgcttttcattataagcataaaaaatattttgtaattgtagctgatgatttggcatggaaacctgctagtcctaccagtgttacactgaaattattacaaatttaggattatgttagcatagaaaaaaaaagcttactatttattgaaagaatctacttcaggctaaaggatacacattttctcttaaaatctattgtatttggggtcaattgtttgatgtttagactctcctttttgcttataataacaagaaaagttaatgaatactctgcaaagttatgtttaagttagagtgtggggaaaaacaagagtttctggctctagggttttttccatccactttaactaaaagcaactatgttgatagatctttttaaattttttttatttcaatagttttttgggtacaggtagttttgggttacatgtataagttatttaggggtgatttctgggatcttggtacacccatcacctgagtagtatacactgagtccaatatgtagtcttttatccctcactccccttcctcaccacccccacccctgagtccccaaagtccattatatcattcttatgactttgcattctcatagcttacctcccacttataagtgagaatatatgatacttggttttccattcctgagttacttcccttagaataatggccaccagttccatctaagttgctgcaaaagacattgtttcattcttttttatggctgagtagtagaccatggtgtatatataccacattttctttatccactcattggttgacgggcacttcgattgtttacacctctttacaattgcgaattgtgctgctattaacatgtgtgtgcatgtgtctttttcatataatgacttattttcctttgaaaagatacctagtggtgagactgctggattgaatggtagttctacttttagttctttaagaaatctcgtagagaacatttttaaaggaagtagtcctgaatgtgtactcttaacgatttatagtcactgccacctttcccaggctacttgtggttctcatcggagaaataggtagaatcatttgctagaaaggcggtattaggcattaaagctacatacctttatattgtaaaactagaggtctttatgattttaagaaagtattaattatttttcttctgcttttctctttataaaatagaatcagtaatacctgttgcttgtaacataccgtggtggtttattgattgaatttcttgaaaacatcttctgaagacttcattgtatgccttttgcaattctgattgcttaggttctgcccttttctaccaaaactacatttgtccatgtcttggcaataataatagcagcaacattaataatggattatgcaacgcttatcactttacccagtttatttaacttaattttcacaataatcctaccaggtaataactgttattttccctaattatacatgaagaaactaaggcctacaaaagataaataatgtatcaaaaaccaaacagtaaaatatagtttgtactccttaggtctttatatgtgatcttctctgtacctgtaactgtcataacccaccctcttcacttgcctagctcctatcatttagcaagcctcagagtagacatcatgttttctttttattattattattatgcttttaagttctagggtacatgtgcacaacgtgcaggtttcttacatatgaatacatgtgccatgttggtgtgctgcacccattaactcatcatttacgttaggtatttctcctaatgctatctctcccccctacccccaccccacaacaggccccagtatgtgatgctccccaccctgtgtccaagtgttctcattgttcaattcccacctatgagtgagaacatgcggtgtttggttttctgtccttgcaatagtttgctcacaatgatggtttccagcttcatccatgtccctacaaaggacgtgaactcatccttttttatggctgcatagtattccgtggggtatatgtgccacattttcttaatccagtctatcattgatggacatttgggttggttccaagtctttgctattgtgaatagtgccacaataaacatacgtgtgcatgtgtctttatagcagcatgatttataatcctttgggtatatacccagtaatgggatggctggatcaaatggtatttctagttctagatccttgaggaattgccacactgtcttccacaatggttgaactaatttacagtcccaccaacagtgtaaaagtgttcctatttctccacatcctctccagcacctgttgtttcctgactttttaatgattgccattctaactggtgtgagatggtatcttattttggttttgatttgcatttctctgatggccagtgatgagcatttttcatgtgtctgttggctgcataaatgtcttcttttgaaaagtgtctgttcatatccttcacccactttttgatggggttatttgattttttgttgtaaatttgtttaagttctttgtagattctggatattagccctttgtcagatagatagattgcaaaaatgttctcccattctgtaggttgcctcttcactctgatggtagtttcttttgctgtgcagaagctctttagtttaattagatcccatttgtctattttcgcttttgttgccattgcttttggtgttttagtcatgaagtccttgcccatgcctgtgtcctgaatggtattgcctaggttttcttctagggtttttatggttttaggtctaacatttaagtctttaatccatcttgaattaatttttgtataaggtgtaaggaagggattgagtttcagctttctacatatggctagccagttttcccagcaccatttattatataggaaatcctttccccattgcttgtttttgtcaggtttgtcaaagatcagatggttgtagatacgcggcattatttctgagggctctattctgttccattgttctatatctctgttttggtaccagtaccatgctgttttggttactgtagccgtgtagtatagtttgaagtcaggtagcgtgatgcctccagctttgttctttttgcttaggattgacttggcaatgtgggctcttttttggttccatatgaactttaaagtagttttttccaattctgtgaagaaagtcattggtagcttgatggggatggcattgaatctataaattaccttgggcagtatggccattttcatgatattgattcttcctatctgtgagcatggaatattcttccatttctttgtgtcctcttttctttcattgagcagtcgtctgtagttctccttaaagaggtccttcccatcccttgtaagttggattcctaggtattttattctctttgaagcaattgtgaatgggagttcactcatgatttggctctctgtttgtctgttattggtgaataggaatgcttgtgatttttacacattgattttgtatcctgagattttactgaagttgcttatcagcttaaggagattttgggctgagacgatgggattttctaaatataaaatcatggtagacgtgttttctaggaagccttccctgagcctgtcagaagaccaagttaagtctcatttgtgtgtgctcctatcacatcacttaacatattttattctaattacttatataactacctctgggtcctgaggacagagatcatcgccatcatgttcattgatttatccctagaacatagcactgccgtatataaaatgtattattgtagtccttcactgacaagtgattgaatgtgcccctgagaaggggtgtaaatttggatgaagaagcacatacagccagccagggtaaatttcagagaggaatgcaataatggagtcatcagcatgcaacttgcatggcagctgggaagtgaatattttcatcataaaggagaatcttggtggcacaccacagcatcaactacactaatcataacctctaaatatcacatgatagcatccagcttcaagccttcctattccttatctttacacagttttcagatttaggaggtgccagcttataaaagtcacaggttattgtgtcttaaaaatcacaaattctatcataacaaagaacatgagccttatttttctaggaaattttatggccacctagccttagttgtatctctcctatttgttctttaattcatttaacttatggtttgtgtatgtgtgtatgtgttttaataatttatggagataaattcacataacataaaattaaccatttaaggtgaacatttagtggcatttagtacatttacaatattgagcaactaccacctctgtctagttccaaaacattttcttcaccccaaagtaaaatccgttgcctggtaggcagtttgtctctatctttctccctctttccagttcctagcaaccaccaatctgcctctaaattcaccaatctggatttatcatgtctgtatgaatttatgtattctggagattttatataaatagaatcatatgatatgtgaccttttatatctggcctctttcacttagcatactgttttgtatattcatccaaattgtagcatatatcagtatttcaatctttttatagccgaataatattccactgtgtgtatgtaagtgatctatgatttataatgggtcaatttaagatttttcaactttatgatgatgcaaaaataataatgcattcagtagaaactgtactttgcatacctgtacagccattccggttttcactttcagtacagtattcaataactacatgagatattcagtgttttggtataagctaggctttctgttagatgattttgcccaaccaaggccaatgtaagtgttctgaacacatttaagataggctaggttaagctatgatgtttgattggttaagtgtattaaatacattcttgacttatgatgcattcaacttacaatgagtttgtcaggatggaaccccattatgagttgaggatcatctgtacactacaatttgtctatccatttatccactgatggacatttgagctgtttctgctttttggctactgtgaataatgttgctatggatattgctgtacaagtacctgttttcacatatttgggtatacacctagaagtagaattacagggtcatatggcaattttatgttcagctttttgagaaactgccaaactcttttcaaccataaaatggctgaaccattttgtattcccaccagcaatgtttgagggttcgtttctccacattcttactaatactcacttttctttctttcttttgttttgtttgtttgttttttggtaagctaacacatcatcctactgggtgtgaggtggtacatcattgtggttttcacttacatctctataatgattaatgaacttgagcagctttttgtgtgcttgttggctgtttgtgtattttctttggagaaaagcttatttgtcttttgccccccccatccccaccccacgcttttttgagacagagtcttgctttgtcacccaggttggagtgcagtggtatgatctcagcccactgtaacctctgcctcctgggttcaacccattttcctgcctcatcctcccaagtacctgggatgacaggcatctgccactgtgccctgccaatttttgtatttttagtagagatggagtttccccaggttggccaggctggcctcgaacttctaacctcaagcgatccaccagccttagcctcccaaagttctgggattaccagtgtgagccaccgcacctggccttttggctgttttttaattgagttgcttgacttcttgttgatgagttgtaagagttctttatttattctagatgctatatccttatcagatatatgatttagaaatttttttataatggaatttttttgtttatggtatgaggtaaaggtccaatttcattttttaacatatgggtttccggttgtgctgtcatcatttactaaagatactagtctttccccattgaatgatcctgtcaccctcatcaaaaattgacagagacttttgatggctgtgtgtggtcaaaaattaacagaattttgatggctcatgcttgtaatcctaacattttgagaggccaaagcgggaggatcgcttgaagccaggagtttaagatcagcctaggcaacatagtgagaccttgtctcaacaacaacaacacaatttttttaattagcagggcatggtggcatgcacctatggtcctagcttctcttgaggctgaagcaggaggatcagttaagcccaggagttcaaggctgcattgcgctatgatcatgtcacttcacctccatcctcgtcaacagagcaaaaccctgtctcaaataaataaatgagtaataaaaaacacagacttttgaatgtctagtgtatgccatcaaaggtcttttacactggagaaacaaaatgaaataatttctaatattattctagtatatgtcctgtaagaagttcagcatccaatcaaagaaacagacttgctatttaactattagaatgcagtgtgaagaatgctatgatagacaaatacagcatagttaggcttacagaagaaacacatccaaatcaagataaatatattccatatacataggagatcttaggcacaggcacataagcaaaaagataaattaatgcaaagttcacataggtacaaaatagtcaatcattcatttctctttttaaaagaaaaaaaagagaaatgaatgattgagtctatcggtggggtttcagagaaggtttcacagagtgcatggcttctgaacttgtttccacagagtatgggtgcctgcagagtagagggagcattccgaagaaggaagcagtagatccagaggctagaagtatgaaagtgtggcatgttttatctggcacataatgtcatgcttggcacataacagataccaaataaaggctaacttaattaatgacagagtgatgattaagtagggccaactaatcaagagactgaatgtgaatgtttatgaaagatattcattcaaataaaaacagaaaattttagatctgttgtagcttagttctgatgattaatcttgacagacgtataaataggactttaatataattctgtttctgaataggtaatatagatgaaattcaaaagatataatgaagagtaatgtgtttacttccctgaccaatattaaatggcaacctttataatgattttcattcattcctctgggtacattactcaaattttgtctttaattgtgatgtgcttctatgtgtatgttgtagggagtggggagtagggaagttaagtgtagagaatcatcagattttaaaacttgaagatcttctgttcctaaaaccttaatttttttttattccaaaggaatatatcatggtttaattaaggcagcagaaccaatagagtattacagagtaagagattcattttaggcataaaatcttacccagttgtagaaaaagctgagaagtaaaggtccagaagagggagttgaaggatcaaagtcacaaccaaccctcctgaagcacttgacctggttaaaaactttggagctttcaagaacctgggaaacatccggcagcacatccaactggtggactgaaaccaccagagagctgatagacattaatgggaggctgtggcctctgcatctggggtaaggccgggaggctggagttgctgttgttcagcagggtcaagagtcaggaagaagaagtgatcacagagacaggaaaagtgagaacaagccagaatctgccagcacctttccattggtctttcactgcatttaaaacatgaagacttgcaaagaatattggctattatttccctccatcttccaaatgttgttaaggttcctcttttgcaaaactctaaactctgaattattcttaggaagttgttataaaacaaaaactacagtaaactaaatttgaagtggttctttggcttgtccagtgtcacaaaaaatagagctatgtgtagaaccttggtttccttcctcttactagtcaactacttttcttctgctcaaggctcagacctcgtaggcttgtgctaaagtccattgttagctaatcactttctttttctttttctcttagcaacatttttgctacatctgggtttattttataatctgaggaaatgtactgatgtctgccatgtgcagtttgcacattcaagtgacttgctgctttatatggatactagtgctttagggggaggtggaaagtttatcttatgattacctgaaagtaccactaagtcttaattctccaagttaatattgatataattttctcatgtataatatttaaagatataattctaatagactttgcaaaagtacacttaaaagtaaataattttgttttgatcataatacttttatttcttcctatctctgacttgattttgttaggtaatttatcttttaaacttcattgtcagagaaatagttacagcatatttgtttgttaaaatatttttatatacacataataaattacatgtaatactctgtgggcttttttttttttacacataaagaattttaaaaattgttgttactatgtttgcttagcaagctgactttgaatctgacatgacatattcctaaagttcatcagtcttatacttctcaggattggtaacattgaatatggggaactatggctatgtgtaggcattaaaattcctaaaccatatatttctagctttatttctgagagattacgactattctctgtgtccttagatctcttttatttttatttttgagactattccccaaatgttcacaccgcacaggacccccagcatagtttgattagtgattaatcaaacatgagattttttccagaattgcatctggaattgtagataggaatatggaaagaaagaagttttctttgttttaaattttcaacctgaaaaacatcacttttatcttactaatttgtgaggacgtcaagctaagacctaagcaaaatttgggcacagtggctcatgctgggcacagtggtctctcactactttgggaggccaaatctaattctcatactttgtaggttaatgcctagattgacctaaacctacttgaatgatatgattttataatttccttaaaccttaccatgcctttacatgaaaaatgtgaatttttcttcctgcctaaaaagttcctggaaagtgagtgggaaggcaaaaggattcatgttacaacaggaggcagcagttggtttttcatgcttagcagccagcagatatcttcttccttacatgttggctgagagtgtcctgtggcaatataaaaagatggtgtagatataacagggcagagatcctgtcttgcctggtcttactcttctttatatcttagtgtagttactgactgatatagtaggcactaaaaaataagaaaatgtttaaattgtatataattatcatggtagcatacgataaaattttaaaatcttctgtattttcaattactttacagtcatcttacagctaagatggatggatagataatgccttgattcattgaaacccaactgaccaaagccctaaatagccagtttccctcctatggtgttttcttcttctttttttttttttgagatggagtctcactctgtcactcaggctggagtgtagtggtgcagtctcagctcactgcagtctccgcctcctgggttcaagcaattctcctgcctctcagcctcctgagtagctggaattacaggcatgtgccgccacgcccagctgatttttgtatttttagtagagacggggttccaccatgttggccaggctggtcttgaactcctgacctcaggtgatccaccagccttggcctcccaaagtagtgagaggccactgtgcccagcgtgagccactgtgcccagccatggtgttttctttttaagagaaggggccaaacaggattatatcaagaatgtattttaaaagcatttgtacaacatgtaacttttatacattatcctgtataattctgtgagcactataactggtacaacagtacatactattgaagtttactggtttatttatgaatgacagggtctcactgtgtcacttatagttcactgtgttgtgatcatagttcactgtaacctccaactcctgggctctaacgatcctcctgcctcatcctcccaaagcactggattataggtgtgagccactgtacccagccatattattgaagctttaaaaatgaaatttaaaaaatctcctgaccttctctcccttagtatattcctatctaaatcctcaacacagtttctaatgttctcttctctgagaaacattcagcaatacccctagtcgctccctcttccatgaagtttttttttaagcttttcctttgaaaagttctaacaagtaaaattagatgaccagcagttccaggttatagatataaacaactggaatcagagctattatccattggacatctcagtaaaattgaattaagttaatattttaatttagtatgctcataaaactgtcttctagatattgtaataaatagacgtagcacttgtgatctccattacaaatatattaacctttgttttgttcttttgttttggcaggaaagtttttgttggtgttttttttttttcaagaatgagaatattttattttaacattatttaattttgccgaactaaatttatactgatactttctttaaatgtaccttaaaaatcatcatttcaagctgtagttcttgtagcattgtgcacaagatgctttatatgtctttatagattctttgtgtatgttcagcaccttgagataaaagattaggtcccctattgagtatttccacacctctctgtactttccttattattatacttatcataccttatgattactttgtttagttatctttcctgctaaactgaattccgtgagaaacaacattatgtatccatttttgccattgttgtttcagcacctagcaaaggacctggcaccatagggagccctcaatccatgtttctcaatttcagagtaataaatgctatgaaaataatataactgggtaatataataagagtaattgggaaatttccttagattggagctcagggaaggccccttctaatacctgaatgacaaaaatgagctatctgttcaaatacacctggagtgtttctgctgagagtgttttaggaagagcaaagacactcgagtaggaacaagttgagcacgtttaagggttcatgcctggctgggaggaaagaagtaatagcagaggagttttagggagaaaagggctaaataatgaacggttttgtaagtcagagagagtttgaattttattttaattgcatttgaaagtcattggatagtgctcttgttgaaaaaaaagcctctaaatggatatataccgataactattattattattattattattatttttttttgagacggagtcttgctctgtcacccaggctggagtgcagtggtgcaatctcgtctcactgcagcctctgcctcccgggttcaagcgattctcttgcctcagcctccgaagtagctgggactacaggcccacgccaccacgcctggctaacttttgtattttttgtagagatggggttttaccatgttggccagactgatcttgaactccaggcctcaggcaatccacccacctcggcctcccaaagtgctagtattacaggtatgagtcaccatgcctggccaactatttcattttttaagttcctataggatttaaattatttatctttatgcctcccattaatataaacagaagaatatctaggaataggtttatgtaacacatagttttccaggtagcagattgtttataataaatgtttgggaatgttactgttttcatatttaggaataactactgtaagagatggtctcaggtgataaccacaagtttttttttgtttttttgttttttttttttgagatggagtcttgctctatcgcccaggctggagtgcagtggcgcaattttggctcactgcaagctctgtctcccgggttcacgccattctcctgcctcagcctcccgagtagctggggctacaggcgcccgccaccacgcccggctaattttttttgttgttgttgtatttttagtagagacggggtctcaccatgttagccaggatggtctcgatctcctgacctcgtgatccgcctgcctcggcctcccaaagtgctgggattacaggtgtgagccaccacgcctggccgattaccacaagttttaagtatcttctgctctagcatcttccatctaaagttcagccataatgacatactaagaaaatctttatgttgcataagaattgctctgtgcaccagcctgggcagcatggcgaaaccccgtctctacaaaaaatacaaaaattagccgggtgtgcagtccacacacttatagccctaactacttaggaggctgaggtactgggatgacttgagcccaggaggcagaggttgcagtgagccaagatcatgccactccactctagcctgggtgacaaagacagagggagaccctttctcatacacaaaagggaaaaaaaaaaaaagaaaaaagaattgctctgtgcacacagaccatctagcatttcttattctgacttttttggtggaatattttgggaaccttggtaccacttttcctacttctggtctttcataatatgcagtttttgaagtgtgattcttaaactcctttagtatttcccacaaaggcataccaaaatgtatgacagatgggcagaagaaccttagtgtaaatattctgagtccaagaaagatgaccacagcctttctgacacatgtgttttcttgagtgcatgtggcatacacctgtgccttcttgcttagtaacaatttcagagaactatactttttttttgtttacaatctatacctcccaaagcttactagaacagcttttgccaactcacatgattatttttctgttatttgcttagaaccttaaaatagtcaatgttttgttattttcatcgagggtttaataaatttctatggacataatcctctatattactacatgataggtacagataattataccatttctttgtttatgtggacaatatagacatacattaaaccattgttttattggagtacatcagcgaattattgattctacagctcctataaccctatgtgccttggaatgctgtaatctgttttctccagctgaatttaatatcttttcatcatcatgggtgatgagcagtttcaccaagatatgtctgcttgtggatttccttgtatttgtctgaaccaggacacactgtgcttcctgagtctatgaattcttatatttcatcatttctgggaaaatcctcagctattttttctttagtattttctcttttcctttctttctgttctctcattttggaattctagttatatatgttggactcatctctccatgtctcttcgttttccttttaaactttgcattttaaaatttattttagtacattctggaattttctcaaatctatattctagtcttaagatatatctaaatgctatttatcccacctattatgtctttaactttagtaactgtattttttatttttggaaattctctttggttgtttttgaaacctgatttgcccttttgaatagtgccttgctttttttcttatgtttttttaattctgtatgtttttagtaattttaagcaaaatttttattgtaatttagtatctattaaaattttattatcaaaagttcttgataatgcttttgaaaatgggatctaattttcctcttgctaataaggatttttatgtatatataaaatagtctgtattagaagcttatcttcaatgatctttttcccttgagtatcctttttgtcattgaggacatgttttctagagaggttttgcatctgtttctgacagatgccccagggttatcaaaattctggtgctactgctgtataaataacagaaggggtatttgaggaccacccaggtaatataagttagagccacttaatacatgtaggatatttctcattatttttaattttccagggagatatttgttttttcaacaagctctcttgccaagacaggcaaactttcttattctttcctgtttctgatgggttgatgtttttctggcccttcaggggccccagatctaggtaggcagctcatttaaaaatccttgccttatctcaaatacctgttaaactctgttcccttgattcattaagagtgctgaccctctcaatttaatgaccctaaggtcattaacaacctcagttaatactttgtgttttagttccttcttttgaattttgaaacttagactgttatatggtaaaatattgacagaatttaattcttaattgtagttattcagtgtttcttttctgtttttcttttgaatttattcctgaaaatatttgaatctgtaaagattttcaatgatttttaaaaatatttaccattacctcaaatatttaccagagatatcataaaacttaatactatataccagaaaaataatagttttataagactactgacttatttatattttgttactacttctaaggtcaaaggtctttcatattttgtgttactgatttaatttatcacatgatggagagaaatgtataatatggacaagtaccctttttttcattgcccttggttgttagtgtttgctcttatttggttccctgccaacttttccattttaaggtatttttaatacatcatatattttagcactcccctatgagagcacatcagatgttatatgtttctcacattggtcattttatggaatttgagctattaggctataattatgatgtctctcaggatctcaacccttcctctgtagtcacagattttaatacttcttccggttactctctactcaccagatctcttaattctttagaattgactttcttgaaatccaatacttatgtgtcatagaaccagatgatccaatttgcttttttggcagacaccatatagagctctgctcattgcaagtttaacaaaagaccagagtattctctggactactctgataaaaacaaaaaatggtgtagaaagacttgaattttaactaggctttttcatgagataatttatgccaattctctgatttgaactttatcattttatgatataagggaataataagggcatatttaaaaggaatattaagttaatagcttgaagggaaatttgaggtatggcttgctaacgaaacataaatgtattattagttgataaaatgaaaactaagaatatacgcagtggacttgaagatctataccagcacaaactttgctttctcaataatgttttccagtttcatcttttaccatgtacttcctttgaaattaataatttttttattattatactttaagttctagggtagatgtgcacaacgtgcaggtttgttacatatgtatacatgtgccatgttggtttgctgcacccattaactcatcatttacattgggtatatctcctaatgctttccctccccccaccccacaacaggccctgctgtgtgatgttccccaccctgtgtccaagtgttctcattgttcaattcccacctatgagtgagaacattcggtgtttggttttttgttcttgcaatagtttgctgagaatgatggtttccagcttcatccatgtccctacaaaggacgtgaactcatcatttttatggctgcatagtattccatggtgtatatgtgccacattttcttaatctagtctatcattgatggatatttgggttggttccaagtctttgctattgtgaatagtgccgcagtaaacatacgtgtgcatgtgtctttatagcagcatgatttataatcctttgggtatatacccagtaatgggatggctgggtcaaatggtatttctagttctagatccttgaggaatcgccacactgtcttccacaatggttgaactaatttacagtcccaccaacagtgtaaaagtgttcctatttctccacatcctctccagcacctgttgtttcctgactttttaatgattgccattctaactggtgtgagatggtatctcattgtggttttgttttgcatttctctgatgaccagtgatgatgagcattttttcacatgttttttggctgcataaatgtcttcttttgagaagtgtctgttcatatcttttgcccactttttgatggggttgcttttttcttgtaaatttgtttgagttctttgtagattctgcatattagccctttgtcagatgagtagcttgcaaaaattttctcccattctgtaggttgcctgttcactctgatagtagtttcttttgcagtgcagaagctctttagtttaattagatcccatttgtcaattttggcttttgttgccattgcttttgttgttttagacatgaagtccttgcccatgcctatgtcctgaaaggtattgcctaggttttcttctagggtttttatggttttaggtctaacatttaagtctttaatccatcttgaattaatttttgtataaggtgtaaggaagggattgagtttcagctttctacatatggctagccagttttcccagcaccatttattaaaaagggaatactttccccatttcttgtttttgtcaggtttgtcaaagatcagatggttgtagatacactgcattatttctgagggctctgttctgttccattggtctatatctctgttttggtaccagtaccatgctgttttggttactatagccttgtagtatagtttgaagtcaggtagcgtgatgcctccagctttgttctttttgcttaggattgtcttggcaatgagggctcttttttggttccatatgaactttaaagtagttttttccaattctgtgaagaaagtcattggtagcttgatggggatggcattgaatctataaattaccttgggcagtatggccattttcatgatattgattcttcctatccatgagcatggaatgtccttccatttgtttatatcctcttttctttcgttgagcagtggtttgtagttctccttgaagaggtccttcccatcccttgtaagttgtattcctaggtatttttttctctttgaagcaattgtgaatgggagttcactcatgatttggctctctgtttgtctgttatttgtggataagaatgcttgtgatttttgcacattgattttgtatcctgagactttgctgaagttgcttatcagcttaaggaaattttgggctgagaggatggggttttctaaatatacaatcatgtcgtctgcaaacggggacaatatgacttcctcttttcctaattgaatatcctttatttctttctcctgcctgattgccctggccagaacttccaacactatgttgaataggagtggtgagagagggcattccctgtcttgtgccagttttcaaagggaatgcttccagtttttgcccattcagtatgatattggcttgggtttgtcataaatagcccttattattttgagaaatgtcccatcaatacctaatttattgagagtttttagcatgaagcgttgttgaattttgtcaaaggccttttctgcatctattgagataatcacgtggtctttgtctttggttctgtttatatgctggattgtgaaattattaataattttaaatttcaggtaaaaatattctgctaaataactgatgaaagctgggaatacataaagaagaactaaaatagaggccaaaagctgttttggtgtcaacttgccctccaggtccaattctggaacctttgttctcattgtgtagccttagcccagtacttgaacttcatttccttacagataataatggggctattaacagtccctactttacatacaggattgttttcaggaagcatttaatatctcacacaaaaaccttaacagctggacatggtggctcaacacttgtaatcccagcactttgagagtcctaggcaggagaattgcttgagcctaggagttcaagaccagcctgggcaacgtgaggagactctgtctctagaaaaaataaaaataaattagccaggcatggtggtacattcctgtggtcccagctactcaggaggccaaggtgggaggatcacttgcgcccaggagattgaggctacagtgagccatgattgcaccactgcactccagcctaggtgacagagcaagaccttgtcttaaaaaaaaatgaattaacattgttcttagaccttaaaaagaaaagaattcaaagactaaaaggatatgcttatgaccctaatgaggtcagcaagacagcagttatcaaatagaaggtcagatattaaaaataggaaatgaaaaattattccaaaaaatagtaagattattggtggtaacaaaagtgatatgaaactatttgcaagaacaaaaaggagtaaaaatttaaaaattaatttgttaaaaagtcctgggatgatactaatatgaaattgcttaattacaccttaatttctcaagatgttttcatcttttgtaaatcttatggaattgaagttaagaaacgatgactgtaaaatatgcaaataggcactctcaaaataataatgtaattttgccatacatgtttgtagtacaaagacttgtacaaatttaatgaaaattgtctttgaaaataatgaaatggctaataatcttttactctatcttttagcatacggcggcatcaagaaaggagagcaattttgacccccgttttgacagatttttctgtccgaataactggagcacctgctgtcattttcaccaaagtagtttctccagaaaatttgcatactgaggttagaacataattttgattttattttagtctaaataatggaattgctcctctttgtatgttagggattgccacagtttcagcccataggacttcaaattagctcattaataataatggctactatcatagctaacatttatggagcactttgtagtactcttcagttattgctttccttgtaataactcatttagtcctcataataatcttatttgctactcctcatatccgtattttgtagatgacaaaactgaggcatagaggagctaaccaagctacccagattgttatgcataccttagttgcctcatatatagctactcttgttgccctctagattgtcataaggttcaaactgatcaatagaagaaataattataagaggaatctgagaagctaaagttctataaaaatgaaaattatccttgtttttatattattagctgctaatcctaccaattgcattcatactatttaacctactagtataagatcaattatttgcaagttttcacaggatgtatgccaccaataaagccaagttatttttagtacaaatttttgtgctcttgggtaatgttacggtgactatttttttttaatcctgaattggtatacttttttccctttttgtcaatacttgaggaatagaataagaattctaactagagtgaatgaatacagagaacttgtggaggaaaaaattgtttaaccaaaaaaaaaaggataattatttcagacatgctgttcttcatggctttattaaaagctgctctaagctgtctcatttgcatttggactagtcatagtctccttaaatccattcctctggatgatactataaggggaagatctgttggacatttccaagcatttgaacattgtccacatgcacatcatgacaagaggcaggacttattaagtgaaactattgtattggttttttgttttgttctgttttccttgtctgaacggttttccagtgataaatgttcaagtgactaggttttgcagaacagcaccaattaagttatggacatctacccaatgctgccaagattttagcagtttaaagaagtgaaattaattagtctagctgtctttagcttcaacactccgttttcttataaatcatttagagtatatcctttggagaatattcatactgtggctcttagcaattaattgcctgcctaaaattgtctgtttacatctgtctgcccaactagattataacctcctcaagagcaggttgcccttcaaggccgacattattctttgtgatattcataggactctactatcgtacctagtacttaggaaatgctcagtaaatattagttggtttgaattcatgaacaagattatgctacacaattatattgttgctacatattgaaaacaataataatagttggagttatggaaaagtcaaataggtatgaaaaggtgaagacttcttattgttagttgtgtatatctagcacaaggcccaacacacagcaggccctcataaatatgaaattcatctgttaaattgtgtcaagtggctgtgctcaccatttttgctcttctccttaatgtatgaacttgagtcctaggaaatgtcaccaaagtagtgaaggtcaaataagtaagaatgataaattatcatctgaaagctatcatgtttctttatctgtattctaccgtttttgcttcaggagattttagtgtgtggccattccttagaagtgaatataaccacaaacctggacttcttcctaagtgtggctcaagttcaactcttacatcagttaatagtagcaaatatgactggactggaaccatcaaacaaggctgcagaggtaactgttacctgattttgatcaggcttactgcatttgttccaactttacattcacagtaggaaaactataattaagctgactgctttctgcttaattattctgtgtttaactttattcaaaatatagtcataagtcattttggattgatattctttattttagaaatttgtttggtctctattcctcttatttatcatgtacctttgcaaaattgctgtggactgacctcagaggaacctctgttatatacataactttattagcctgctgaagttctaaagtatgatgcgagaatcctggtatagctttcatttactcggatacattacagtaataaggcctcttttggaagtgaactttctaagagtactatgggaatatcttcaataaataacttgtaaagcatttgtttcccatgctcagtgggaaatgaatggacacaatcataaaagttgaatgcctgcctagaattttaattttgatacagtgttcattggaagcctgtattgtaaccacaaagtatgtcagcaagaaacaaagaaagctatttgttagattcttctcaagatatattttctttgcattttgtttccacatttctctaacattctgtacttagaataaatattttataaaaactcaggtgaacaaactgtttatatatgaaaaagatgttgcttttatttttgtcatgagttgtaaagaaagctttaagttctgtttagtaagaaggtaggaaatgaagaggaatttaggtctcaagtcagcactgtttccattctgccacagattatgtattataactgtgacattattctttcagtcttctttatttttaaaaaaattattttaaaatgataaatcttttatcttttgtaaatgattttctaatgtaatcatcctttactagccatgatatctatttattcaatatctattgtaaaaggactttagaactacatattgtccaaaatattgagtttttaaatatacattagggaatccataaaaatgtaattatatgacatcaaaataagcaaattaaaaaatatttccccatgcattttcgatgaggcctctgaagcaagttgagttggataaaagtaaattacattcctatattatttgtgccaattttataaatgtctcctgtcaaagaaatctaactctcagatcactgattgttttaggattcacataacttagcaaattggttattaactatttatctacatacttttaatgcctcttagggggatcaatttcagtaaataaagggatactcggagttactaactatccttccctgaatgttgaatcattactgacaattccgtaaactatataggcattgttttcttctgctttaaaaaggtatctgtggctatgtgtttcttcttagagatcatattacaagtacagatgacatgaacatttttaaatggttaaaatggtaaattttatgttatgtatatatatcacaattaaaaaatacaggctatataatgagaaaggactgtttggaccttttcccaaccctggtgggacatatctgtaaaactttccgtattttagaaaagacctacagtgcactggaagaatatgattcaatttttaaattattagcagaactcatatctgctagtctatgaatataaagacattttagttacatagaatactccataataagtcaaaggtatattttgaaagggctagttgattgcctttagtgtggtttcacaacaacactaccagaatttttttttctttttttttgagatggagtcttgcactgtcgcctgggctggagtgcagtagtgcgatctcagcccactgtaacttccacctctcaggttcaaacaattctcctgcctcagtatcccacgtagctgggattacaggtgcctgccaccatgcccagctaatttttttgtatttttagtagagacggggtttcaccatgttggccaggctggtctccaactcgtgacctcgtgatctgccctccttggcctcccaaagtgctgggattacaggcgtgagccaccgcgcctggcctttctttctttctttcttttttttttaacacggagtctcactctgttgcccagactagagtgccatctcagctcactgcaatctccacctcctgggttcaagcaattctcctgcctcagcgtcccgggttgctgggattacaggtgcatgtcaccatacccagctaatttttgtatttttagtagagacgtgatttcacaatgtcagccaggcttgtcttgaactcccgacctcaggtgatctggccccctcagcctcccaaagtgctgagattacaggcgtgagctactgtgcctagccaacaatttttttaaaaattccttttgagaacaaaagaaaaataggaaaattaaacctggctaagttattgggaaaatggaggaagatatacatgttagtatatataatataatcctgatattataaacaactactatttcataggaattatggattaataataagaatcccatttatcaggttttctagaaggcaccctgtgaattatagaccagtaaatgtcaaatctgttctaagtccaccatctgatactatgttgatgcaacatagttctataagaagaaattatgtatatttaattatgtataattaatatatataacattaaatatatatatatatatttcttttcttttcttttcttttcttttgtttagtagagatgaggtttcaccatattgcccaggctggtgttgaactcctggcctcaagggatccatctgccttggcctcccaaactgctgggattacaggtgtgagccaccacacctggcctaatgtagtatattttttgaaggtgttaacattttcagacaacctttggcaatatttatttgaaagattaattttggctgggtgcctagtggctcacacctgtaagtccaacactgggaggctgaggtgggcggattgcttgagcccaggagttcacaatcagcctgggcaggatagtgagtccccatttcaacaaaaaaaaattaaaaattagttgcatgtggtggtgtgtgcctgtagtcccagctactcgggaggctgaggtgggaggatcacttgagccccagaggtcaaggctgaagtgaggtgtgatggtgccactccactccagcatgggtgatagagcaagagaccctgtctcaaaaaaataaaaggaagattaaaaattattcaagaataatatcacttgggaggccaaggtgcgggcagatcacttgagcttaggagttcaagaccagcctgggcaacatggcaaaactgcatctctacaaaacacacacacacacacacacacacacacacacacacacacacacacaaattaggcaggcatggtggcatgtgcctttagtctctgctacttgcagggctgaggcaggaggatcacttgaacctgggaggtcgaggctgcagtgagccaagatcacaccattgcactccaaccaggtaacaaagtgagaccctgtctcaaaaaaaaaaaagtataatatgatagggggattatgtattagtggaggaaacatctattcaataaacaaaggggaaaaatgcacatatctttgaaactagaagtgaaaaccgtaaagtaatctgaggattcttgccagaaccaatatttaatattaattttaattaaaaagacaactaacacataatgaaatttaccagttcacagccaaaatgactggatgatggattaggaaaattgtctcccacattaaacaaaaattttccaatatttttgctctgaaaaatgtgttttagatggggtgaggccactagaccaatgggcctgtattcatactattagattttcactgtccccttcaagtactataatttccatgatttctagctcccagaatatttggtttctgcctttaaatgaaccttatttctctatacatacaggttgagtcccctatctgaaaactcaaaatttgaaatgcttccctgagcattttctttgagagtcatgtcacgttaatactaaaaaaatttcagattttggagcattttggattttgaattttccaattaaggatactcaacctgcgttatgacaggctgagaaattacataaaagaaacaaatttaatattcaaaaatcaaaatgcattccatattacaaagtacatttccttccttatctagctcgctgcgatagttcaccatcccattctatatttcatgtttccgtgacatctggctctagaggactagtacaacaggcacgttatttgggattcttacatgttagttccttgccttttacatgaggtgagagtcaaccttttggataccttaacagccaaagccaaatttacaattctaagtttactcccaaaacagagctccactactcagccttgatttcttaaccagtgtttaacaggactgtggttgacacaattggtttacccttcagaaggttctttaccttcttacaagatagtcttagtctcataaaggcccaattatataatcatgggcattagtttatttattataatatggttttatttttatcaaattagtaagtgaattttaacaaccaaattttgctaatgaaatacatcaaagtagcatcaatccctgataccctcacctcattctgcccaacagtcagccactctttataagctgtttcttcaagtatttatttccatatttctaaataacctgaatggcctatcatatcttgattccctattaccgtattcacttgctatttgttgttaataagggttctatctcttctgcacttcctttctacacttccatcttcccagtattcttatatcatattcttttttgtcaatcttaattgtcttcattataaagatgatataaatattgttcattgcttagtgaattaatgtagtgtgataatatttcttgtcattttactattgaagttactcattgccacattttcttttttttcttttttctttttttgagatggagtctcgctctgtctcccaggcaggagtgcagtggcgcaatctcggctcactgcaagctccgcctcctgtgttcacgccattctcctgcctcagcctcccgagtagctgggactagaggcgcccgccaccacgcccggctaattttttgtatttttaggagagacggggtttcaccgtgttagccaggatggtctcgatctcctgacctggtgatccgcctgccttggcctcccaaagttctgggattacaggcgtgagccactgcgcctggccactcattgctacattttctatttactcagttttttaaaaatctctgtcttccctctcactaacgcacaccccattcccatcagtggctctaccataattcctcgcaatttaatttttcacactgtaaaacttatcgaatagcatcacctctgcttttccccccagagccatttttcctgaagttctttttctgccttctctgttctgggactgttagttctctagacctgcggcacacttggcataaaacagccagatgagagaagattgtgatttgaggttggtgtaaagaatgttagagaaaaatctagggaacaataaaataatgtgttcttctattaatataaattagtaaattgaccaatatctttattctttcattctaaaatattaagtattattatttactacattaaaaagtataatagtatagaaaaatgttgtctggctaatatctacttggatatttaaagttttttatgaaatagaaaataatgcattgggcttttttgctatgaactgtcattgagcttatgccatgtgaagtgatggtagaggttgtttggggtggtattttactgttttaacttagaaataatcagttttgtagttgtgcttcattttaggcatagaaattcttgtcttttagtagaaagtgaaaaattctccaagacattcttgaccaaactaaggattgtcagaaataattagaaataggaacttgaaggtaaagaagaaggaaagggactttaattgtgtggttgcgtaataacagatgtcttctggaatagaatttcaggtaagatgagggatatagaggaaatgaataaccaaaatgcatgtgggtaaaggggggtttgagagaggaaactgagactggcatgaaggagtatgtcgattttctggtcggtcttgctgcttactctcttgaggtagtcatgaatggaaaaagccagatcagaggctacatatttctgtatttaggaaaggagatgggaattttggacgatatgcatagggtgacctcctattggtgttgctatgctgagtattttgtttcctttcagaggcacctggatagaccacttgtaaccaggcaataaacacagactccagtaaaatatggattcaagcagagccttaaaaggacaagaggggctgtgacggaatacctcaaatttcttaaaatctaggcctggaaaagatattaagtattttactgcctatcttctccaagggaaggatttcttaggtacattgaactctcacatctgtcacaattttagttaggccttgtcaacgttaaaattagtgtaattttctcctgataaacaagcttgtgctgagacaggaaaacaccacagttgcctcaaagtagatgtaagacatcaagaagacaataaaattttaaaattttcagcccccatgatgtttatccctatagatttctttgccagaaatccagtaaatgcgttaagttttcctcaggctccagtaaactgtctacgctagtcttattaggcattgttcattgagagcttactatatgccagatacactggctacagtctgacagaggtttgaaaaataagtacactatggtctctgccctctaggcttttataatctggttgggaagtaaagcatagacaaatggaatgataactaagaactcagagcagtatatgaaaagtgttaaatatactctatggaaaattagacttatgagtccagggaagaaagagaaggctttaggccaggtgatcaatgatctagcttcatggagaagtggaatacatagaaaagagtagcctatttatttattcaataaatattgaatgcctcctatgcgtcaaatactattatggatactagggtgacagcattaaacaaaagaggtaatatttctgctttcatgtctaatgcacatatatttagtagggaagacagacaataataaatatttggaactacctcaaaatataaatacacctactcgtgtgcagagattatatagctttacattttctgtaactgacttaatttttcttacaagcctaaacttcatttagattaaggatgttggttgttagagaagagaagcagtaagggagtatacattaaatttgccatcaataaaaaatagtttcaacatggagaaatagcatgaataaagacgtggaggtttctaagcattaggattttttggtaggacagtgaaaaaaattaatctttctagagtgaaggaactgtgcagggaaataatggaagatacactaagaagtgtatattttatcacgagcagttgggaaccaaagtttatagacttgaatgaatggtatgacatagaagaaatggtattttaatgaaatttgttatgcttagtcttttttggcaaaggatttgaagtggcattcaataaaacataaaaaatgaaaactgcagactaatacctctggagaatatggatgcaacaatcctcaacaaaatgctagcaaactgaatccagcaacatagaatgaattatacactatggccacatgggattacccagaaatgcaaggttggtttaatatctgaaaatcaattaacgtaaagcactatatcggtagaattttttaagtcatatgattatctcaataagtgaaaaaaatttttagacaaaatccaataccctttcataataaaaacatgcaaaaaactaggaatagaagggagcttactcaacttgataaatcacagttatgaaaaactcacaattatcatcatagttgatgataaaagactagatactttccccctgaaatcaacaataagacaagaatgtctgcttacatcacttctatttaacattgtactggaagttctagttggagtagttaatttcacccagtatgcttccaatcccttactatgtttaactttataagcaaaaactgatcatatggaggtcctcttacagaatgagagactcttagaactgtcaggtacttcagaaattgtgttatttaattgattcattatcattcattagcccacatgagagtgaaactctacttagcctcctgctgccctctgtgagccttcttgcactccccactcctcttttcagtggacacaaccagaaaacctcaagtatcctcagagtttgacagaaacgggagagggtataagcttgatgccatattaagctgttttccattggatgaggaaagcatagcttcctgtttgttaaaacaggatttctgttttcttaaaacagtataggttcctgattcttaaatttcttcctgataacttcttctcttaaatccacatgatttttctgatggaatccttgctagaaagccaagttaaggcctcagagctgttcatttatttgccatccacccttcagaaaattcttagactgggtcagtcagcagtctatatctatgcacttaactcactgtccagggcacccaatcatttatagaagaggaagattcaacatagtaatgtctaatacctgagtcatcccgtcttcccaactagtctagtccttcttaatgagtcttactgtctgtccccctatttttctgttatggcctgacttttaatataaggctgattctgaatcagattaatcaaatgcatgttaaatttgagtggtggttttgtggggagagggaaaagatgggccagtaaaccctaaaacacagagcaattattttgcacatctttgaaagtgctttacaacaaatgaagaaacagtctatgctcatggatgggaagaatcaatattgtgaaagtggccatactgtccaaagtaattaatagattgaatgctattcccattaaactaccattgacactcttcccagaattagaaaagaaaactattttttttatactttaagttctagggtacatgtgcacaacatgcaggtttcttacatatgtatacatgtgccgtgttggtttgctgcacgcattaactcgtcatttacgttaggtattactcctaatgctatccctcccccatccccccatgacaggccccggtgtgtgatgttccctgccctgtgtccaagtgttctcattgttcagttcccacctatgagtgagaacatgcagtgtttggttttctgtccttccaatagtttgctcagaatgatggtttccagcttcatccatgttgctacaaaggacatgaactcatcctttttcacagctgcatagtattccatggtgtatatatgccacattttcttaatccgatctatcactgatggacatttgggttggttccaagtctttgctattgtgaatagtgccacaataaacatatgtgtgcatgtgtctttatagcagcatgatttataatcctatgggtatatacccagtaatgggatggctgggtcaaatggtatttctagttctagatccttgaggaatcgccacactgtcttccacaatggttcaactagtttatactcccaccaacagtgtaaaagtgttcctatttctccacatcctccccagcacctgttgtttcctgacttttaaatgatctccattccaactggcatgagatggtatctcattgtggttttgatttgcatttctttgatgaccagtgatgatgagcattttttcatgtgtctgttggctgcataaatgtcttcttttaaagtgtctattcatatcctttgcccactttttgatgtggttgtttgattttttcttgtaaatttgtttaagttctttgtagattttggatattagccctttgtcagatgggtagattgcaaaaattttctcccattctgtaggttgcctgttcactctgatggtagtttcttttgctgtgcagaagccctttagtttaattagatcccatttgtctattctggcttttgttgtcattgcttttggtgttttagacatgaagtccttgcccatgcctatgtcctgaatggtaatgcctaggttttcttctagggttttcatggttttaggtctaacgtttaagtctttaatccatcttgaattaatttttgtataaggtgtaaggaagggatctagtttcagctttctacatatggttagccagttttcccagcaccatttattaaaaagggaatcctttccccatttcttgtttttgtcaggtttgtcaaagatcagatggttgtaggtgtgtggtgttatttctgagggctcttttctgttccattggactatctgttttggtaccagtaccatgctgttttggttactgtagccttgtagtatagtttgaagtcaggtagcacgatgcctccagctttgttctttttgcttaggattgtcttggcaatgagggctcttttttggttccatatgaactttaaagtagttttttccaattctgtgaagaaagtcattggtagcttgatggggatgtcattgaatctacaaattactttggacagtatggccattttcacaatattgattcttctatccatgagcatggaatgttcttccatttgtttgtgtcctcttttattttgcttagcagtggtttgtagttctgcttgaagaggtccttcagatcctttgtatgttgtattcctaggtattttattctctttgtagcaactgtgaatgggagttcactcatgatttggcactctgtttgttaatattgtataggaatgcttgtgatttttgcacattgattttgtatcctgagactttgctgaagttgcttatcagcttaaggagattttgggctgagacgatggggttttctaaatatacagtcatgtcatctgcaaacagggacaatttgacttcctcacttcctgattgaatgccctttatttctttctcttgcctgattgccttggccagaacttccaacactatgttgaataggagtggtgagagagggcatccttgtcttgtgctggttttcaaaggaaatgcttccagtttttgcccattcagtgtttatcataaatagctcttattattttgagatacattccatcaatacctagtttcttgagagtgtttagcatgaagggctgttgaattttgttgaagaccttttctgcatctatggagataatcatgtggtttttgtcattggttctgtttatgtgatggattatgtttattgatttgcatatgttgaaccagccttgcatcccagggatgaagcagacttgatcatggtggataaactttttgatgtgctgctggatttgattttccagtatttttttattattattatactttaagttttagggtacatgtgcacaacgtgcaggtttgttacatgtgtatatatgtgccatgttggtgtgctgcacccattaactcgtcatttagcattaggtatatctcctaatgctatccctccccgctcccccaaccccacaacagtccccagtgtgtgatgttccccttcctgtgtccatgtgttctcattgttcagttcccacctatgagtgagaacatgcggtgtttggttttttgtccttgcgatagttttctgagaatgatggtttccagtttcatccatgtccctacaaaggacatgaactcatctttttttatggctgcataggattccatggtgtatatgtgccacattttcttaatccagtctatcgtttttggacatttcggttggttccaagtctttgctattgcgaatagtgccgctataaacatacatgtgcctgtgtctttatagcagcatgatttataatcctttgggtatatacccagtaatgggatggctgggtcaaatggtattgaggattttcgcatcaatgttcatcagggatattggtctaatattctctttttttattgtgtctctgccaggctttggtatcaggatgatgttggcctcataaaatgagttagggaggattccctctttttctattgattggaatagtttcagaaggaatgttcccagctcctctttctacctctgatagaattcggctgtgaatccgtctggtcctggactttttttggttggtaggctattaattactgcctcaatttcagagcctgttattggtctattcagagattcagcttcttcctggtttagtcttggaagagtgtataagtccaggaatttatccatttcttctagatctcctagttcatttgcatagaggtgtttatagtatgctgtcatggtggtttctatttctgtgggatcagtggtgatatcacctttatcatttttttattgcatctatttgattcttctctcttttctttattagtcttgctagcagtctatcaattttgttgatcttttcaaaaaactagcttctggattcattgattttttgaagggttttttgtgtctctgtctctttcagttctgctctgatcttagttgtttcttgccttctggtagcttttgaatttgtttgctcttgcttctctaattcttttaattgtcatgttagggtgtcaattttagatctttcctgatttctcttgtgggcatttagtgctataaatttccgtctacacactgctttaaatgtgtcccagagattctggtacattgtgtctttgttctcattggtttcaaagaacatctttatttctgccttcatttcgttatttaccaagtagtcattcaggagcaagttgttcagtttccatgtagttctgtggttttgagtgagtttcttaatcctgagttctaatttgattgcactgtggtctgagaaacagtttgttgtgatttctgttcttttacatttgctgaggggtgctttacttccaattatgtggttaattttagaataagtgtgatgtgatgctgagaataatgtatattcggttgatttggggtgaggagttacgtagatgtctattaggtctgcttgttgcagagctgagttctggtcctggatatcctcgttaaccttctgtctcattgatctctctaatattgatagtggggtgttaaagtctcccattgttattgtgtgggagtctaagtctctttgtatgtctctgaggacttgctttatgaatctgggtgctcatgtgttgggtgtatatatatttagtatagttagctcttcttgttgaattgatccctttaccattatgtaatggccttctttgtctcttttgatctttgttggtttaaagtctgttttatcagagactaggattgcaaccgctccttttttttttttttttttttgctttccatttgcttggtagatcttcctccatccctttattttgagtctatgtgtgtctctgcatttgagatgggtctcctgatgaatccagcacattgacgggtcttgactctttatccaatttgccagtttgtgtcttttaattggggcatttagcccatttacatttaaggttaatattgttatgtgtgaatttgatcctgtcattatgatgtttactggttattttgcccgttaaatgatgcagtttcttcatagcatcgatggtctttactatttggcatgttttcatggtggctggtaccagttgttcctttccatgtttcgtgcttccttcaggagctcttgtcaggcagatgtggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctgacttgcagggtttctgccaagagatcagctgttagtctgatgggcttcgctttgtgggtaacccgacctttctttctggctgccctcagcattttttccttcatttcaaccttaatgaatctcacaattatgtttcttggggttgctcttctcgaggagtatctttgtggtgttctctatatttcctgaatttgaatgttggcctgccttgctaggttggggaagttctcctggataatatcctgaagagtgttttccagcttggttccattctcgtcattttcaggtacaccaatcaaacatagatttggtcttttcacgtagtcccatatttcttggaggcttttttcttttcttttctcttttttctctatcttcaatcactgataccttttcttccacttgattgaatcagctactgaagcttgtgcatgtgtcacgtagctctcatgccatggttttcagctccatcaggtcatttaaggtcttctctacactgtttattctagttagccattcatctaatcttttttcaaggtttttagcttccttgcgatgcattcgaacatcctcccgtagcttggagatgtttgtcattaccagctttctgaagcctacttctgtcagctcgtcaaagtcattctctgtcctgctttgttccattgctggtgaggagctacgatcctttggagtagaacgggcgctctggtttttagaaatttcagcttttctgctctggtttctccccatctttgtggttttatctacctttggtctttgatgctggcgacctacagatggggttttggtatggatgtcctttttgttgacgttgttgctattcctttctgtttgttagaaaaaaactttttaaaaattcaaatggaaccaaaacagagcctgaatagccaagataattctaagcaaaaagagcaaagctggaggcatcacactaccagacttcaaactatgctataaggctacagtaaccaaaacagcatggtactgatacaaaaacagatacatagaccaatgaaacagaatagagaactgagaaataagactgcacacctacaaccatctggtctttgacaaacctgacaacaacaagcaatagggaaaggactctctgtttaataaatggtgctgggagtgctggctagccatatgcagaaaattgaaactgtaccccttccttacaccatatgcaaaagttaactcaagatggattaaagactaaaatgtaaaaccccaaactgtaaaaaccctagaagaaaatctaggcagtaccattcaggacataggcatgggcaaagatttcatgacgaagatgccgaaagtaacccaacaaaagcaaaaattgacaaatgggatctaattaaactaaggaacttctgcacagcaatagaaactatcatcagagtgaacagacaacctacaaaatgggagaaaaattttgcaaactaaccatctgacaaaggtctaatatccagagtctacaaggaacttaaccaaatttacaagaaaaaaaacaaccccattaaaaagtgggccaaagacgtggacagatacttctcaaaataagacatacatgtggtcaaggaacatgaaaaaaagctcaggatcactgatcattagagaaaggcaaatcaaaaccacaatgagataccatctcacaccagtcagaatggctattcttaaaaagtcaaaaaacaacagatgcttgcaaggttatggagaaaaacggaatgcttttacactgttgagtgggagtataaattcaaccattgtgtgagacagtgtggtgattcttcaaagacctagaggcagaaacaccatttgacccagcaattgcattactggttatatacccaaaggaatataaatccttctgttataaagatacatgcacgtatatgttcattgcagcactattcacaatagcaaagacatggaatcaacctaaatgcccatcagtgatagactggataaagaaaatgtggtaagtatacaccatggaatagtgtgcagccataaaaaggaacaagatcgtgtactgtgcagggacatggatggagtttaaagccattatgctcagcaaactaatacaagaatagaaaaccaaacaccacatgttctcacttatcagtgggagctgaatgatgagaacacatggacacaggttggggaacaacacacactgaggtccatgggtggaggggtgagggaggggtggagagatggagaatatcaggaagaatagctaatggatgctgcacctaatacctaggtgatgggatgatctgtgcaggaaaccaccatggcacagatttacctatgtgacaaacctgcacatcctgcacatgtaccactgaacttaaacgttaaaggaaaaaaaaatgcttttcttttgcatcaggggagttaagagagaatggagagaattgttgcagataaggtctgtttgttgatttttctcaggatatgagtctcgggggacatgtaagaaagaaaacatagtggtcaagaacttgagctttgttgttggagtccggcaataaatcccatctcctgtgtttactttctgtgtggccttggacatgttactttaattcatgtgagcttcaatttaatcatctgcaaaattgagataataatagtcttccccaatggggttgttgtagagattaattgggaagctgtttcttaagcattttccatagtgattgttatataataagaactcaataaaagccatcaccatcattgtcatctcatctagagatcgttaattttcatctctttttctatctactacattatatcttgcccaagatccttctcctgtttgcttgattatagagcatatatgactattgcttaatgtttttgagcttgattggataaaagaatgatgtaatattatgctccaatgtcctatttatcatctggcaggctttgaaagggtgtctgttccatagacttctgtccagttgataacacagtttgctccagcagcttattcctcaggtaaatgagatcttgctgaaactacagttgatagtgagatgcttctgtaagcactggggtttttttcaggtggcagactaacagaaggatgtgtgtatcccactgctttgctctgctcaccttgctcttttcactcaggattcactgttgacttttctcagccataggaaaggtttacataaccaatcttcatgaaatcagttaggactgttattaatgggtcactgtcaaattaattattgctgaaattttagctctttgcaatagatgaagcaactgttaaagctgcattgaaagacacttgcattttctcctcaaagattcattattcccagtgtttctcttcataagctctgtatggttagtgacccatatatgaccctctaaaattgttaagagcttcaaaagtcaatcctatattgagtgccctatatttttttgaactatttgttgggggttacatatagatgaaaaatgttaaactttcattaatataaaaatgtatgacaaagcaacagcaatcaagacaatatgatactggcataaggatagacatatggatcaatgaaatagaattgagagttcaggtactaactctcctgtttatagtcaattgatttttgacaaggtagtctagatcattcagtggaggaaagaatagtattttcaaggaataatgctaggatgactggatattcccatgcaaaagaatgaaggaaaatgcctaaatcatatcatatgtaactcaaaatggatcaaagacctaaatataaagagctaaaactataaaaatccttgaagaaactataggtgaaaatgttcatgatgtttgattaagcagtgtttttttagatatgacaccaaatcacaaaaactaaaaagaaaaagaatagataaatggaactttaaaaaccctgaagcttttatgcttcaaaggacatcacccagaaagtgaaaagacaacccatagaatcagagaaaatatttgctaatcatatatttgcagaatgggagaaaatatttgctaatcatatatttgataagggacttctatctagactgtaaaaaggactcttataactcaggaataaaaatgcaaataacccaatttttaaatgggctcaaagaatcttaataaacatttccccaaagatgttgtagaaataaccaataagcacatgaaaagtttctcagtattatgaaccatctaggaaatgcaaatcaaagccacaagaaaacaccacactgactaggatggctacagtcaaaaaaagtcaaataataacaagtttcgacaagaatgtggaaaaattggaaccctcttacactggaccagaatgtttacctacataacctactgctccagtgacatttggggcacatttgcaaaattctgagagttgaatagatcagcatttgacaactactgcactaaagtatcttctctgaaaagaattttgctgtaagttcttttttttttaaacagaaactatcatgttttgggttacatagctccccaactggagcctagagtagctaagacgtggtacttctgattaaagacagatacatacgcttaggaaaccagatggaaatggacaagttagcagagaagtttattgtgaaaataagggttagaacatttcacttggagactgttttagctgcatgtcacagacactcaaaatagatatgagtttctttttctcaggtaacagtccttaggtcagtagtctaagactggtatagtggctctgctccctaaggtcaatcagagaccctgtctcctctcttgttgttaatttatcatctctgaggtatctcactggcttggtccaagatggcttaccatgtctgtgttataagcagcagattagagcataggggaaatgaaacagaaagtagggacccctccctacaaggacaaactctgacgttgcgtgtagcagttatgctcacattccattggtcagaatttagccatgtcgtcacacccagctccaagtgaggctgagaaatgtagtcttttttcttttattctgcctgtataattgcagaatagaaatatagtattttacatgtgccctgctaaaaattgtttttctgctgtgtgccctgctaaaaattattctactatgaaagtaggtgacaacagatattggagtacaaccagcatccgtagctagagagtcttcagggttacctggtaggcagtcatgatattcctcagaaagcagctttggttcttcctcaatacttcgaacatatcctcaaatagatcctaaagttctatatcatataatatgtcagaaatagtgttagcttgcaaattgttcagtacgtctatagtgacaaatattgtcttttcctattggttctacccctcttcatctgacgatgaactcccttttctttaggtaaacaatagtttcctattccattgtggttttgatggggcttcccattatagggtcgccctgtgacactggcctggccaattgttgtactccatcctcctgacatttactgggtgatctgatcacagggcccagacaaggatagtgtttcatatgaagacagtgagaaaggtaaactgtctttcctgtagttaaataagtttaggtataatactgaagctttcattgttcatgctccatccttctttaccactgtcgtatgaagaaaacctgtcagtgttagagagagaaaaagagagaaggagccaaatgaacagaaataagcaaacttgagagacaaagtcttgatgacatcatctgattcccttgacacagttctggtcaatgaggtgtaaagagaagtgttctacagatttctgggaaagtctttactttctttctcctcctcctccttggaataacagtgatggaagtgaccagccacttgtgaccatgtgatgacaaacaagaggagaaaacacagtaaggataacaaagtggacagagaaaatggtcctaagatatcagtgacatcatgcagctactgcaccagccctaactttaggttatgtgagcaaaataaacctaaacagttaagtcgttggtatttggctcactattacataaagccaagcacaatccttactgatcagatgttcttacagtattctaagtctgagatgataaaacccagggaaaatactgagcacacaatggacttcaatgctgaataaatacttgctgagtgaattaataaatggattcctgaattcatagtaattctcatttctgttcctagaagtagaaaaaataagatgtatacaacatatacttcaaaagaattggaagaaattgttggctaactccatgtttgagggagacagataggttaagtacataccatggagtgctttgaatatcagattgaaatgttttgcttaagtcagtgagcaatagagagaagttggtgtttgtgcagctagacaatgacttaaacaggtgtgcctgaaagttcagatccgttttagtctgaagctctcagttgtgctcccacatcgataatagtcatctgtaattatgtgatcttcaaacataaatattatagttacattttacctgttgtattataatgaggacctattatctcattatttagtaaggaaatatctgtactatgtagtatcacccattgttttcagaagctacaattgttattgattatatagaagggcgagagtgctgagattgccctgggttacgttcatttggctgcagtaattattcatttattcctgaatagcaagtaatcatcttattaagtctacttacagaggtagtgtatgtaaagactaacacatgctcattttcaaatcagtgattcagaataaataaaacttttgtaggaaaatataaaccatgtttttaggggcaaagaatagaaccacatcattggagatctgatgtgggagttctttgatctctgcactacatatcctggagaagaaaataaagacaacttataacactaattgagcattccttcctttgccttctccccttcctcctcctcctccacttaaccacttggttttaggcacttccttagccctcccttcccttcagtccccagtgtagatccacttggtaacctgtccatgaatgtttggtgcctgttcttatgctgtctttgatagttaaaaattatgattttttaaagtaaaatctcatttgcaaaaaaaaaattactttagccaacataaaatatacagtacttagttcaccatttctaaacatttctaaagtagtggttatttctatccaatgtaaagtttccctttccccagactttttgccattatttattgtatttgacttctctacaactatctaaagaataaagaactacataaaacactatattcaactctctatgaagcatgataaatttacattttttaaaatattgtactcaagctggtaagaacaggtaaaactccctttgctccagctacatctccatctcagtcagcccctgtcctctcaaggttactattaatatctgccttcctgtctccccgggcctctcccatctactcctctgtaatttccatttcttcccattcatgctaaattatgtcatctctctgaccctgaattttctcttgaataattgttttttcctcacctactgttctctgatttctaatgcttttaataccatgtacttgtgacacacaaaaatatttgtgcagaaggaggaaagtcctaggaaaatcggttctaactaatttatgatcttttccaagtaaaaatgtgacaaatgagcaggctgttcaaaataattaagggtccgtggtttgcttggtttcctatctgagtttgtacttttctaacaagcaacttctgggcttttggttactattacataaaggaatagacttttaagaaaaattaacattagagccatggaagtgtatataattctcatctaagatttcagacatttttagattgcttatttctagaactttggctcttcctcaaaggttttccacagcaaatgacttaaaatcctctcagataatagaggaataaaaaataaacaccatggcttaaaccccgtaatcttccttctacattttttaagattctcggactttagcaaatgccacaggtggcccctcaccattctttctgaagactggcccatttagtagtgtacctttgagagacaaaaaatacactggggagatggaaggctttgatgatgctggtggttacccaaatgtatacatttgtccatgcccattcaactgtacatttttaaagggtgaattttattgtttacaaattatacttcagtaaacctagctttaaaaattgttgggctactcagtgcagcttttgtcagaatgtgtattacttaggcaactacccaggatccataacaccataacaccagctaacatattgggaactcaccctgtgtgagacagtagtctaagtgttttatataggttaactcctttaatcttcataatcactctctgaatttggggttacttttcagattggatagatatggaaacaaagtctcaaggaagtcctgtaacttgtacctagctaataattatcaaagccaggtgggcaggcacactctctcacatacacaccccacttgagaatatattggttagaagcactacagtttagtgacctaaccggtatggatgtgggtgttcttagggtcagttaagcaaaaatgaggctttacaaggccttaattgtccttgtatataatttgcattttattgaattgcaatggtaagccattgaagagtcaaaaacaagagaatgacatgatcagattcacatttggaatagtggcaggtggactaggcagggagacccagcatggtaatctcctgtagtaattcagataacgaaagcataaattgaagcactcatttggggaagagaggagaaaaaccagtaatgggctaactttgcatttgcctgagaggcagtgtctcagcacatgtattgaagcagagcgagtgctggagagctttctttctccagctgttccaaattggataacaaaaggcaatgactcttctgtttacatgtttgcttgtaggcatcagctattcctaaactggaaggcccctgattggcatctccctgcactttgcaactttattgaactcttaaccagctcactgtttcctttataccctaaataaaaatgttagactggactattgtctttttaaagtttcaaggagaagctttttatttgttttactggtttcctttttttaattttttttattatactttaagttctgggatacatgtgcagaacgtacaggtttgtaacataggtatacacgtaccatggtggtttgctgcacccatcaacccatcatctacattatgtatttctcctaatgctatacctcccctagcccctgaccccccaacaggctccagtgtgtgatgttcccttccccgtgtccatgtgttctccttgttcaactcctacctatgagtgagaacatgtggtgtttggttttctgttcttgtgttagtttgctgagaatgatagtttccaccttcgttcatgtccctgcaaagggcatgaactcatcattttttatgactgcatagtattccatggtgtatatgtgccacattttctttatccagtctgtcattgatgggcattcaggttggttccaagtctttgctattgtgaatagtgctgcaataaacatacgtgtgcatgtgtctttatagtagaatgatttataatcctttgggtatatccccagtaatgggattgctgggtcaaatggtatttctggttctagatccttgaaaaattgccacactgtcttccacaatggttgaactaatttacactcccaccaacagtgtaaaattgtttctatttctccacatcctccacaccgtctgttgtttcttgactttttaatgatcaccattctaactggcctgagatgatatctcattgtggttttgatttgcatttctttaatcaccagtgatgatgagcttttcttcatatgtttgttggctgcataaacgtcttcttttgaaaagtgtctgttcatatccttcgcccactttttgatggggttgtttctttcttgtaaatttgtttaagttctttgtagattctagatattagcactttgtcagatgggtagattgcaagaaatttcttctattctgtaggttgcctgttcactctgatgatagtttcttttgctgtgcagaagctctttagtttatttagatcccacatttgtcaattttggcttttgttgccattgcttttggtgttttagtcatgaagtctttgcccatgcctatgtcctgaatggtattgcctaggttttcttgtagggtttttatagttttagttctaaaatttaagtctttaatccaccttgagttaatttttgtatgaggtgtaaggaaggggtccagttcagttttctgcatgtggctagccagttttcccaacaccatttattaaatagggaatcctttctccattgcttgtttttgtcaggtttgtcaaagatcagatggttgtagatgggtggtgttatttctgagacctcttttctgttccattggtctatatatcaattttggtaccagtaccatgctgtttaggttactgtagccttgtagtacagtttgaagtcaggtaacgtgatgcctccagctttcttttgcttaggattgtcttggctatgcaggctcttttttggctctcaccactcctattcaacatagtattggaagttctggccagggcaatcaggcaagagaaagaaataaagggtgttcaaagaggaagagaggaagtcaaattgtctctgtttgcagatgacatgattgtatatttagaaaaccccattgtctcagcccaaaatctccttaagctgataagcaacttcagcaaagtctcaggatacaaaatcaatgtgcaaaaatcacaagcattcctatacaccaataatagacaaacagccaaatcatgagtgaactcccattcacagttgctacaaagagaataaaatacctaggaatccaacttataagggatgtgaaggacctcttcaaggagaactacaaaccactgctcaaggaaataagagaggacacaaacaaatggaaaaacattccatgttcatggataggaagcatcaatatcgtgaaaatggccatactgcccaaagtaatttatagattcaatgctatccccatcaagctaccattgactttcttcacagaattactggttttatttccaaatatgaaaaaagacaagcatgttgaaatgtcagtgggaagaatccaattgaaagagagattggaatttattggaatgagaaggaaaaaatgatacaacgacattcctaaattagtggagaattgtatgtccctaaaaaaggcagagaggttaacattaggatgcaggatatttcttctaacataaccgaaagtaagagggaagatcaccacagatgcaagtgcagcacttccctcttatctgtgggtgatacattccaagacccccagtggatgcctgaaactatacatagtaccaaaccctgtttatcctatgtttttcctgcacatacatatctatgataaagtttaacttataaattagtcacagtgagagattaacagtaactaataataactaataagatagaacaattataacaatgagccagcatcatcataatgcttgtcctttagggccattattaaaataagggttacttgaacacagcactgtagtacaggaacagttgatctgatcatcaagatggctactcagtgaataatgggcgggtcatatataccacatagatacactggacaaagggatgattcacgacccaggctggatggagctggaaggtgtgggagacttcatcacactactaagaatggcatacaatttaaaacttacggactctttatttctggaattttccatttaatattttcaaaaccatagaaagtaaaaccatggatgagagaggacaatggtagattcacaggttttgttaataggtatttgaaacatgcccatttgatgattttttcctctgtgaactaagatgtaaggccatctattaaggaataagtagggcttacaggtttgagatgggtggcaggaacctgcttattctatttaaattttaacttttagcctagtaaatataaatcaaaatctagaaaaatacttacaaataatggtgaaatataaagatttctaaaatttaagactggaggcataaaaacacaatgtaaattcaggccacaaggactgaacctcaaatttggctctaaacttcttggcagcccaaaaaagaggtagattcagttactaataaatcgcttaagagtttactaatttttggaatgtagctcttttaaaatttttaatattagaatggtcttagatttacagaaaagttatggaaatggtatagaaagttgccttatatactgtacccagtttcccttcttgtcaacattctacaataatatggtacattttcacaactaatgaaccaacagtgatacattattattaattgcagttcatattttatttgcatgttctcaatttttgctaaagacactttactaacatcctttttctgttccaggatcatcctggataccacattacgtttggttatgtctccataggttcctctagaatacgacagtttctcatagtttccttggtgttttttttttttttttttttttgagacagagtcttgctctgtcgcccaggctggagtgcagtggcatgatcccagctcactgcaagctccgcctcccgggttcacgccattctcctgcctcagcctcctgagtagctgggactacaggcgcctgccactgcgcccggctaatttttttttgtatttttagtagagatggggtttcacagtggtctcgatctcctgacctagtgatccacccgcctcggccccccaaagtgctgggattacaggttccttggttttgatgagcttgacggtttttagcagtactgctcagatattttgtagaatgtcttttaatttggatttgtctgatgttaagggaggagtatctacataaatcacatggaattcttctgttcaagggatttgtctattctccttcatataggatacgtgttataaataaaacattttattgaaagatgtgtctttaactctcaaaaacatttaaaaatcggttaatagtacagattgcaactgtaattaattccttctatgccaggcatttctaagtctttcagagctttagtcttttcatttgcaatatgtgagatttgcactatgttatttggccttcacctcccttactagtctttcattagtgatgttgatgacctgagggaaaacccatgactgacctccagtggtaatatgtgctgtggtccaagaaataaatgcctatttgttgacttgagatgagttggagcaactaggtagttaagaaaaagtagcacagatagactgcttctaattgttgatagttcatgaaaagtttcaattgtctatgaaacgactagagaagtttctttctagaagtaacccataaatgtctctttcttctaattttgtgaaatttgagccatttggtaaaaaaaaatgagtctaaacactctattcttcaatctatagataactctaatcctagatataatcatttcataaatgtttctcctgcttaatttatctcctcaacattttagaagagttttggcagtcattaattttagttctaaaatattttctgaaattaacttcccatcattctagttttttcctcaggcatctctcttttcatggagccatattcacataaattctaagatctttccctttcaatagccttggaagatatttgtgaatctttggaatgtgggtgtctctctatctgtgataattcctctaatattgcttttagcattctccagggcaggtgggtggatctaggttctctggggcctgaagttggtcctttttaaaaagaatacaaattataattacaaaattaggttcagggtcataaaatggcctgtgcaagtaagaggccttggagctgaaactttttttgtttgtttgcttgtttgtttgcttgttttgagacaaggtcccactgtatcacccaggctagagtgcagtggtgcaatcttggctcactacaacctctgcctcccagattcaagggatcctcccacctcagcctcctgagcagctgggactacaggcgcatgccaccaaacctggctaatttttgtattattttttttttcggtagatacggggttttgccatgttgcccaggctggtctcaaaactcctgggctcgagtgatccacctgccttggcttcccaaaatgctgggattataggcatgtccagcagcccgggctgaaacttttttaatattttggtaaatcttcctcaaacagcctcaggtgaaaactgacattactattatattcgtgttctcttgctgctatagaaattatcacaaacttagtggtttggaacagcacaaatttatctttcagttctttcagcagtctgacacagatgtctcactggactggaatctggatatcaagccagatgtcagtcccatgtgctctggaggctaaggctgaaggatcacttaagctcaggaattcaagagcagcccagacaacatagcaagactcagtttcaaaaaaaaaaaaaaaagaaaaaagaaaaagaaaaagaaaaaaaagatgtcagcatggctttgtttgcttcaggagggccataggggagaatccatttccttgccttttgttttctttttctttttcttttctttttttttttttttttgagacggagtttcactcttgtttcccaggctggagtgcagtgacgtgatctcagccactgcaacctccgcctcccagattcaagcgattctcctgcctcatcctccgaagtagtgggattacaggcatgcgcaatcacgcccagctaattttgtattttctagaggcttcctgcattatatggcttatggtattcttccttcatcttcgatgccaacagtggcaggtcaggttcctatattgtattaaatatgtctctgactgctcttccatcattacatgtctctttaagcacaggaaggaacagttctcagcttttaaagacttgtggttagattggacctacttggataattaaggataatctccccatttcaagatctataaccttaatcactctgcagagttcctgctgccatgtaaccaacaaaccttcaatttgtaaaaaacacagtatctgtgaagcacaataaagccaaatgcaataaaaagaggcctgtttatgttagtaaaaatgaaagagaaagtatataaccttccctcttttccaagagaacattaaacaaaattataaaatctttgtgaatacccaacattgtaactatttccggagctccttgatgaaaattgtttcatttcattggtctagagagataatctggatagatggagcccaagattaatgaccaatggtagtttatcttatgcatctaagataccatgtgtattttaaaagaaaactttagtctcttaactcctctcccacacgtaagaaatgtggtagtttcatacactgttgggcctagacctgtttcagattgtcccaggtatttccctcactcccattaccctatgattcttttcagttaagtgtctttaagagatggaagctcaaaagttaataagagaaagtctattgaattatatataggtctagtagcaggtcatatacaatttgtattatcgattttctcacataaaagaactctagaacaatggttctcaaattgtttagtttcagaattcctttacagtctaaaaacttgaggaccacagggaacttttatttatgtgggttggctataactcattactgtttattagctataacctaatatttaccatataaaaattaaaatgggacatttaaaaatattaattcatttaataaatattaataaaaatgccttagatgtaaacataaataacagtcatatttccaaattataacaattatatttttcaaaacaaaaacaatcactggcattttctcaaatttgtgtgaatttctttaatgtatgccttaatgaaagacagctagattcctttatttgcttcagtctgttgtaatatttgttttggttgaagcatatggagaaaatacaaccttacatagatatgtagttagaagagagagtattttaataaccttaaagataattgtggatattcttccttgataatgcattaaaactcaaccagtggtagtatattttttaatctacttttttttttttttttgagacagggtttcactttgttgcccaggctggagtgcagtggtatgatcgtggctcactgtaacttcgatcacccatgctcaagccatcctcctacctcagcatccctagtaactgggaccacagagacatgccaccatgcccagctaattttttttttttgtagtgacagagtcttactctcttgctcagtctagtcttgaactcctgggctcaagtgattctcctgcctcctcccaaagtgctagaattatgggggtaagccactgcatctggcctatccacattattgactgaatttgttaaacagctttgttgaaatacaattcacacatcatacaatgtgcacatttaaaatgtacagctgtatgacctttattatattcaaagttatttagtcatcaccacaattttggaataattttaacaacacattcaattttataatttttttcacaccaaaaagaaacctcataactacccccaatttccccatctcctccactgctaggcaaccactaacataccttgtttctctatctatttgcctattctgggcatttgatgtaaatggggtcatataatatgtggtcctttgtggctggcttcattcacctagtgtaatgtctatattattcctctacgttttagcctgtatcagtatttacttttattgttgagtaatattttattgtatagatatataccataggtgttttttaaaaatatatatatatttattaggtgatggacttttgggttgtttccaccttttggctattatgaatagagttgctatgaacattcatgtgcatgtttttgtgtagacatgtgatttcatttgccgtaggaatatacttagaaataaaattgctagatcacatgggaagtccttgtttaaccatggtagtttcttaaaggttagttgcaaagtgaaatcggaaaccatgacaacagacttttcttattctgttatgttatagttcattggtttctcttgacttagaatgaatctttcacccatgcacgattttgtaacattatatattagtcataatagtcatttggaaaatatttgtttagttagttatgcagatcttccaaaagtttatacattttattacacaatatcaaaattcacattggttaatattaccactgatttcatcagaaaaacctaaatattgggaattttatcaggttcataatgactcattttagttttcaaaaatgctaatttttgcttaaaagcttaaattttatcattggcaacaaacgctatctatagttttccttgaagtaacaggcccgctttgttcattgtagagaaaatgtttgtgaagtacccaatttggaggaactgtagttttgtcagttcctcaaacaaaaatgcttttccataaagaaatcagttagtacagcttgcagtttagttgcacatctgcttttccttgaggctatcattttgtggtatgcagcaaaaatgtcttatgtgtacttcctatttcattgaactgaatattaaaaagatgtttattaatgggtcaggatttaataagatgaataatttttgctgtttcattaagaacatccttaaatgaaacttacttagtttgcttcttaccgcaagtgtatggtcagaaggattcagcaagaaatagctgttttcatgctactgcctggattcatgctaaggcactcagtattgctcttgcaccatcagtgcacatgtcaacagggtgaaaaacacaagcagtgccttagaattattatgaaattagttttgatgttaaacggtccttaatagggtctctgggacctcgggggatctgtggaccatgctttcacaaatgctcctctcacacacccaactttctgtccctgtttctttttttctaaaactaatatttccagaaatgttaagattaatggaaagtcatttgtcattttgagtagaaacaaatatatttttgttatcttggaatatgctgttgttttgatcatatttctcctgtttaattcctcaaggatctagaaccagaaataccatttgacccaccaatcccattactgggcaaatacccaaaggattataaatcatcctactataaagacacatgcacacatatgttcattgcagcactattcacaatagcaaagacttggaaccaacccaaatgcccatcaatgatagacctgataaagaaaacgtggcacatgtacaccatggaatactacgcagtcataaaaaatgagttcatgtcctttgcggggacatggatgaagctggaaaccatcattctcagcaaactaacacaggaacagaaaaccagacactgcatgttctcagtcataagtgggagttgaacaatgagaacacatggactcggggaggggaacatcacacaccagggcctgtcagggggtggggggctaggggagggatagcattaggagaaatacctaatgtagatgatgggttgatgggtgcagcaaaccaccatgtcacatgtatacctatataacaaacctgcacgttctgcacatgtatcccagaacttaaagtataataaaaaaaagtttcatgatctaaagaaattcagaaaataaacaatattaaaatgaggaaacattggaaattagttttttacttatttgcctaatattgagtagtgaattttcttattctaatctggaaaccaagacttttatcagctattttactagaaaatctatgtgagatattgtaacttagaaaaagtccaaagcaaggcttaatttgtctgtcatattgaataatcttcaaataatcttttagtcttcaaaaatggttatagaaaaactgttagatttgagaaattggatatgaattatgctgacattctaacattctcaagttaaattcccctaagcagtgttttatgggaaatgaattcatttgaacaacttaaagaaatattttaagaatgagatgtgcctttagttataaaacctcttactgctgcaaacatatgtaagaattttgcagtaggttgaatgaattagctatataaaagtctgcaagtaaacttccttcctatagaaaatataatagacaggaaataaattaagtagagatatttagctggttgaaatcagattcatttttgtcagtgctttatttgtgatatatttttgataggaattttcagaagacttaaagtacatatttatacttttgtactttaaaataatcacattattaatagtgatgaaaatagcaatagataatacttattgactgcttgccaagtactacctgttttttttatatgcattatctcattatctcatttaattctcaaatagctaaatgaggactgttcttaccgggaacaaataaaccaaaaaacatacaaacaaaaaaaaactcaaagctttggatgtggcaatcattgacatacttatttgttatgggagtaatttcactaccctaaaacagcatttttacactctaagcagtcttctgtttgataacaaggattgttttgtggtagatgttttgctttttgctctcttttaacactagtaaaatagactggaaagtcttttagcctttctataaactttaaaacattgttttctttccagaaatactgttctgatagactgggtttgattgaatttttctgtaaagaaatacagataaaggataagatgtgatatctaaaaattttaggactctgaggactaaaaatgataaagatgaaaatgatgacatttattgtatacttattattagctaagtatggtaaatactgagtattagccctctctataactccatgaaatataggtactattcttattcccacttttcaaaagggggaactgagacacagaaaattttaagttattttccaaaggtcctgttattggtaagtgatacagccatgatttcaacccagattttatgtctaaagtacggctgtgtttctgccattagactagcaatctggattcctaatcctggctttagagactgtgttcttgtgcaactttcctaaactctttaaacttcactctcctcatctatcaaatgagaataagagtagcagtgcttaacgttatgagcatcacagatccctgtggggtgtgttgtgagaataaaaaagaaagtaaaagtattcagcacaattcttggtacacaaaagtactcagtaaatggaaatatctatggtggtgaaataaagtctctcttattgagtgtatttccagccatgtggtccttactactatgccacaatactaaatattctgctgacttcctgccttctattttaagccagtctaatatacacagcagccagagtaattatcctaaggtttatttagggtcatttcagtcctttcttcaaaaaccttcattgcttccctttgcctgctgaactaaataagaactcagcctgctactgaagcctccaatttatctttcttgctttattctttctcacagaaacctgtgtagttctcatttggagtgggaatacagttgtttggaaatgttttagaacgtcagcattactaaaggtctacactcagcatttagaggattaggaccagggacactccatattattctgtgagtgtgacaatctcagacatgaatagtctcagacaaatgtggatagtcaactttttccacttcctactctgacccccctccctattttcctactatcattcctttactcctgctatctatttgactatttctatctctctttctaattctgtggcagctgtcatcttatctagccttcaaggccaagcttaaatgatcatttgtatttctggattcctccagtttctatgtgaaaccacccttgtatcttttttaaaaaaatcttagatagctttaccctttatacttgtttataattataattatttttcatgaagaagacaattgactaccatgaaatcttttttaaagacaagttcaaagtctgattcatctttagtgtctcaaaatgtgactatgttgttataccttttaggtctttctggagggtagacagcctgttttacattctttgggcataaatactctgccttatgtatctcagcattgctgatgcctcacatagtaccaggccagtgaccaatgataaattcttgttttctaaatcaattcctgtaagtagactgaaagtttcttgaaggcagttaaaacaatatttattatttggtggttcacctatcaacattcttatttgcccatctatccattcacctgtcccttacttcattcagaaagactatgaaagagctggcaagagcagcgactatacttccctgtgtatatgaaacaatagatagcacgatttcttttatttactaggtgcttaatatgttttgttgtgtggacttgttagtagcctggagcataaaggaaaggtgaaaatgttttcatttcttctgttgttcagtggtaaattaccataaatgtcaaagcacccgggacctgaatgacaggttatagaaatgtaaaattggataaatatggtttcttttaacgtggtgacatgctatcaacaatatatatactctgaacagaccatttaaaaatagaagaagaagaagaagtcttgctatgttacccaggctgcagtacagtgactattcataggcgcagtcccattactgctcagcacaggagttttgacctgctccatttccaacctgggctggtcactccctccttaggcaacctgttggtctcctgattccaggaggtcaccatattgatgctgaacttagtgtagacacccaactggcatagtgcactacagcccagaactcctgggctcaagccatcctcctgccttagcttcccaagtacctagactacagacgcacaccataggaacctcttagtacttgtctagtttatacccctcagttaaataaacaataagaaattaaatgacaaattcaagggcaaacacagatttacattcagagattactggcagattatgtaggctactgtgatttcactagagaaaaataactccctaaaatagtttttattttaaattttatacacacacacacacacacacatatatatatatatgtatttttgagatggagtttcgctcttgttgcacaggctggagtgcaatggcgcagtctcagctcaccacaacctccgcctcccgggttcaagcgattctcctgcctcagactcccaagtagctgggattacaggcatatgccaccacacccggctaattttgtatttttaagagagatggggtttctgcatgtttggtcaggctggtctcgaatgcccaacctcaagtgatccgcccacctcggcctcccaaagtgctgggattacaggcctgagccactgcgcctggcctaaattacaattattttaaaagtgtttcagtataagaaggaagtctaggattattttaacctgagtatttcatgggatttaggcttaatccgggtcatttagaaatagtcctacgttatttaatgatttaaaacagaactttatgctttcattatttggattaaataaacttctattattttttcttatcctgaagcaataatctagagaaaaaagcagatgcctttaccaagtttcatgttaaaaaatttacttgccagccagatgcggtggctcacgcctgtaatcccagcactttgggagcctaaggcaggtgggtcacctgaggttgggagttcgagaccagcctgaccaacatggagaaaccccgtctctactaaaaatacacaattagccaggcgtggcggcacatgcctgtaatcccagctacttgggaggctgaggctggagaatcacttgaacccaggaggcggaggctgcggtgagccgagattgcgccattgcactccagcctggggaacaacagtgaaactccgtctcaaaaaaaaaaaaaaaaaaaaaaaatttacttgccaaaataagtaccaggaagttttcatgtcttctaaaatttgcctttgtttcaatgtaataattactcatgtgttattattataagtaatattattagccgtcttctaaatgaggtagtacagtatagtgcaaaaaccatagaatggtcagaaaagctgttttctaatcctggcgctaccacttactggctttgaaagacagcaaattctgtgattcctctgagcctgtttcccagtctataaatttgggatagtactccttaatccttaatcttattgtgaggccttgctgaaattatgctcattgaaaacaaacacttaagcttggcatttagtagacactcctcaaaagttgtagtagttatcactgctagaatctgctaccatagattaatttgtaagtttttaaaaactctttattcccttgataaggaaaagtgtatgcttaaatatgttttggcagtttataatggatcactgtctagatttcttttggattctccattaatctgaactaaaaatcagataaatttctgtaaaatttgttttgccacacctgatggaatcatggtcaagtcactttacctctctgggcctgtttcctgctggcaaggggagttgtgacgtgtgaatgttaaagcccctttcagttcgagaattcagtgattatttttggaatattattattataatgattcattctaaaagtccaactttctttcaaacgtttattgtctttttttatgcgatgctagtatatatgtatattataggcaatatatacatagacataaatatatatatgtaggtaggtgttttctaaacctagtctatgatgataatcatcaggagtgctcattaaaatgagttaaaaatctcctctacagattcagtaggtctggagaaggccccaggaatttgtagtttgatgagcataccacatgattattattatcaccaagtttaaaactgctgtattcttttactctgttttagctaaaaattaatttggactttaccattttggcagggagagggagaagaagagcctatatcttgagatgctgaggtccagtctctggacatttatttcatgcaacaaatatttattgtatgtttactatgccagataataaaggaatttactacctagatggataattttttaaaaaaaatctcacgagataatgagtaatagatgtataaagaaaggactgaagagcagagagaaggaaatgatcagttctgcctataggggtgaaggagaggtatctcaagacgtttaagaggaagtaacacttagggtgaactttgaaagataaataggcatttcaccagcagaaaatatggagaaagggaaatgatgttaacaagaaagtataagaatgccagatatggccgggcgcagtggctcatgcctgtaatcccagcactttgggaggcagaggtgggcagatcacgaggtcaggagattgagaccatcctggccaacatggtgaaaccccgtctctactaaaaatacaaaattagctggacgtggtggcgggtgcctgtaatcccagctactcaggagtctgaggcaggggaatcacttgaacccgggaggccgaagttgcggtgagccgagattgcaccagaaatcctgtctgtaaataaatacaccagatataaatctgtctctagacaaaagaatgaagaaaactgggaataataactataaaggactttttcccccacattacaaaaatgtatttgaaataattgactgaagtgacaataatatattgggggttaataacatatatgaaagcaaaatgtctgacaatagtacaaaagctgagtgaggagaaacggagatgtatagttgtaaggttcttagactatatgtaaagtggtagcatattacatgaaggcagattataagttaaattttaaaaatatcagcacagatacacatatacacaaaaattgaaaagtcataagatttgacaattcagatgagtaaatttgggagctaagaattgcatctctcctgtacctcaaaaataatttctcacatagatgatctattttaagcctaaaaatgaaggttgattgtgtgaaacatatgcaaataatattactttgaaatagtaaaacctaggttttgggttatttgtttggggtttttttgtttgtttgtattttgtttgtttttgagacggagacaggctctgtcgcccaggctacagtgcagtggttccatcttggctcactgcaacctctgtctcccgggttcaagcaattctcctgcctcaggttcctagtagctgggatatgggcacgcatcaccacgcccagcaaatttctgtatttttagtagagatggggtttcaccaggttggccaggctggtctcgaactcctgacctcgggtgatccactctcctctgcctcccaaattgctgagactacaggcgtgagccaccacacctagctgtttttgtttttctgttgtttgtttgttttttgttttaacacataacttgctttggacagaattaagtgtaactcctgtaaggaacaagaaaacaatataagcctatacttacacatccattacactgaaagatttctaaacaatttttccaccctaatttatgctaggctttgttgttttaagatggcaaagtgtataaatggtgccagtccctgctcaggcaaaattttgaagtagaagaaatgtgttgtccattccctgtccactcctctttgtattggttatcaacctcatacccagcccttgcagctcactcatgatctctcagctgttaatttttttttctgatactctgttcccagaaaaatgtacccatcttggtaagcagtactttcctttctattgtgataaatattaacaatgacataacctcatggagaactgcagtttgctccgtcagtaccatgctccaaacaactgggaagggtgagagaaaaagggcaaatgatgtacttttcctctgtgtgatattgtgacaattttctagcatgtttcttatataatagtgactgataaaaagccttgataccagtaagcagtagcaaatgtactattaatgtatttcctttataataattcttcatgtgtatatttcaaaaaaaaaaaaaaaaaaattctgtcaattgtttctcagagcaatcccaggagttttcaggtttagaaaccgaatcacagaaagttgaaatgacaaaggtaatcaagtaaagcctgaactagaacctaggtctgctgaatcctagttaattgcattctcaaaagcacaaggaaaaatactggaattgagtgacaaagtggttgtctgcatgtttgggactgctggcaagaactcatctagactttttacagcttgaatagaattcattactatatgatctttgatggaaatgttagaattgttcacaagggaaagtctaaaaattctgtccgtgagcaacctcagaaaactgccgatgctgctaaacttaactctgagaatggaattccacagattatctggtattttctgcagcctgcccaactcaataaacccttcattcgcctctgaatataatcctttgacctcgttctcttttagttatttgttttttcattaaagtgttattcttttagtggcttttttaatcagctttgatgcctatggctacaaataacagaaaacctagagtattgtacaggaaggaaatgtctcagctctcttagctcttgtaaaacccagaggtgactccagaatgatctcagtcgaatacagcttcttttctcctaactctctctgctctgctgtccttgatatgttggtttcatcctaggctgctttcctcatggtggtgttatggctataatagttcctatgtacatgtctgcacttcacggtggccaagttgtttcccaaagctaccttataagcatgaggaagcttccttcccagaagccttgagaaaacctcttcccatgttttattagaccaaattatatctcatgccattcctgaaccaagccctgtgatttaagcagtgccatatctgaatggcttaggcttgagtttctgaaccaaaggaaaggaagatcacccttagacccattccacccctggatcctggaggttgctgtgtatttccctgagacacatgggctgggagaagggggtgctgtgaaaaattagatttctcttaggataggggaaagtggaatgtatggtgagtaggtaatgattaatgtctgcatcaattgtcttgttttttcctcatctggcttttagaatcatgtagaatagttaaaatagtgtaaattttgatgtaagactagcttttagagacctcttctggcacttggccaggttccttaactgctcttctatgcctcagtttccccacaattttataatgattaaaaataatgtagtctggccaggtatgggagtttgcatctgcaatcccagtactttggtaggccaagacaggaggattgcttaagttccggagtttgagaccagcctgggcaatatagtgaaaccttgtctctacaaaaaatttaaaaattaccgggtgtggtggtggatgcctatagtcttagctactttggaggctgaggtggaagaatcacttgagcttgggaagtggaggttgtatgcagtgtgctgagattgtgccactaaactccagcctgggtgacagagcaagaccctgtctcaaaatgatgatgataataataataataataataataataataatgtaggcaaggaacttagcacatagtatatatttcaataagtaaatatagctgttattaatggtttttttttacttttgaaattataaacaataagtgaaagttcctttttctcctgctgaggcctgtgctatccccaaatagttattattaaaattagtagacaagaaactgttcattagagaatgtaggtaggatgcttaccataaaattctttcaagtttttctgtgtttgaaaattttcgtgatgacattgaaaaaaataagtttacaagaatgatagtgttgcaataaaaaccactgagggtgactcaagagaactagaaaccaaaattcttcttaagacagcagtaagtttaacccagttcaggtgaattgctggaatgatgttttcctcttatgtcccaagcattccatttctttatgaggaaatacgcagtctaaaatactgggtttcctgcattgaaactccttggccttaacttttgtgtgggcagcctacagcaccaaagtataatgaaatatgtatgagatctcactaaaagagctctggagttagccactgagaaataaagggtgggagggaaagctgtgcatagaaggagaaccaggaaaatgacctttattgagttcccattatgtatgtgccaaaggctctgtggttataaggataaataaaatactttcccaacctcaagagagctcacaccttagatcagaagacacccctctcagtaaataattatggcatatgataagaagtgccatgtgtcagctgggtacagtggcttacacctgtaatcccagcactttgggaggctgaggcaggtggatcacctgaggtcaggagtttgagaccagcctggctaacctagtgaaaccctgtctctactaaaaaaaaaaaatatacaaaatacaaaattagccatgtgtggtggtatgcacctgtaatcccactacttaggaggctcaggcaggagattcgcttgaacctgggaggcggagtttgcagtgaactgagactgtgctgctgcactccagcctgggcatcaaaagcaaaactccatctcaaaaaaaaaaaaaaaaaaaaaaaagtgccatgtgtctgagagcatactggagaaagaaaaactagaggatcttcataaatcttgcagactcctttagttagggttaggaagaagttgttaaagattgagattatttcccacagaattttgttgttggtttaagagcacaagtcactgttctgctgctgacttactaagatttaacaggaaacttagactccaccttttgcctttgtcagcaaaatcccccagtctctctgtatatggagatataattgagaaagattacttgcattcccttctcttctccataaataaggatgaagggctatcaaggtcagaccaaaatttttacaaagtaaattgacaatagttaggacaagatcttgatattaatccccattgccgtctcttttccctcccctgctatatataatcttcttgtccccagcaggttatctgttaagagtctgctctgttttgaccctagcactttggaatcagcccagttgacttttttataacatgtaatatagcccactcttcactgcttaattgctttatcatgctaactcctattactttaccagggcctttttcccctttcattttagtgattgtcttgttgcagaattcgctataacagaatctgacttatgtaagataagttatttttgtaacccttgtctagaaagctcttagaaaggcatgggcagaaagactgaagaaaccccaagaaaacttatcaggagttttttgctagtttgagattcctcaaaagactcttatctacattcattcctttttttgtttgtttgttttttgttttgtttcttttttttttttttttttttttttgagacagagtctcgctctgtcacccagcacccaggctgcagtgcagtagcacaatctcgactcactgcaacctccgcctcccaggttcaagcgattctcctgtctcacgctcccgagtagctgggactacaggcactcaccaccacgccgggcttttttgtatttttagtagagacggggtttcaccatgttggtcaggctggtctcaaacattcattccattttgtaagatggtaggatatatcaatgaatgaatgagcaaaacaattaaaaagtcttgtgcaaattttttgcaaggctagagacaagattagtagctgctaacattggtatagctctttacaatccatgaaattttttcacttacatcatttaatgtaatctcacaccatccctgtaaagtaggtattttctccagtttatgttgtcagtgagatctgcagagattacggtcccataacagggaagtggaagagccaaggtttcgcctccaggtcttctgacactgattacagagatattttattcttgaatctaggggacaagaagttatgagcatatttctttttggtaagtggaaagcaagcaggaattttccttaatgcttaattagtagactagaatttccaactaccccagtgagagaagtagtatcctgtaatggatacaaggtattttatatgagatatgcaacacaattttagattgcctaaaaaacaaaagggcacagattgatttttaatctacagataattttataatgaggagaattaactgaaattttattgcaaagattatggcagttcactgtatgcagttagcatgttcagaatggaactcctgatttttccctttctccaatcctaccgcatccatagtctttctcatattagtcatatacaacacccttttccagttgctaaggccaaatatgagtttatactcacctcctgtttctttcttagacgttgtatctaatctgtcaggagatcttcttggctctaacttcaaaatatatccagaatttgacttcttatcactaccttcactgtttgtctctcttccaagttaccatcatctctcacctagattactaaggtagcctcataattcatctcctttttgtaccctattctcaacacagcagccagagtgatccttttaaaacctaagtcaagtgagtctcttgtcccctcaaaagctttcttcaaggagtcctgcttcttttagagaaaagccagtgttgacaatgatggctttcaaggccctatgagatctaacccctccatcagtctctgacctcctcttctactatgctgtccatcacactgacctccttgctgttccttgagcatgtcttttgtgattcctgccaccagacctttgcaaaggtgctttcccagcagcttgagtctttactcaatgtctcctccttgatgaggcctaccatgacttccctatttaaaactacagtcttcctgtagaacccttcctgatctcctttactctgctcttgtctttctcataccatgtataatctactaacatactgcatattatttacttatttgtgacatttccctacctcctcgtaatataggctccacaaggagagtttttttgttgttgttgttgttttttgtttttactggtatctacccagtgccttaaattactgggcacatagtaggggctcactactaatttgttgaataagtaaatgatggatataattaatgaatcaccgcaaagaagttacagttttattgaggaggtaatattatgctgcttctggtagcagttgaccaatacagagccttatgtggtaaaactacagatagaagtggtagaagtgggagataattgaagccactggaaagggtatattcaatcacttcttggccttttggctgagatcaagtgtagggaaaatgaaagtttcactggctttggtaggttagtttgccagcattgcttatatactttccctcagctttttgaaaatcagatactctccacatgcagagataatggtactcatttatcatcataagaacatgcacttgttcttttgcaatagtaatgtgaaaggggctcacatttgcaaggttgttagagttaaaggtaaaggctatgtctatgaaacatacatatatatatatatttttttttttttttttttttttttctgtgtgaacccaatttaactgacccaatagcaaatgaactaacttgcctagataattcattatgtgggtagatgggatacagagattggaaaatgtcattggtgggttatgtatgtcagttggtagccagtataggtttgattttttctgatgctctggccagcccagttcttttggtttaaagtaccattttttcttttgatgtagtaagaacatttttctgtataaaatagtccattccttggaatggaaatggcattagatctttgtaacttaggtagtttttagcactggattgtttagtttgtaaaaatatttgatttagactgagcttgtggcctgatgatgtttagaagagcgccaaagtgtaactcatagaagatgccagtaaaaaccatagttggaagaggtgaataatggttgcatcattttcctggtaggtgtagccaggcctaaaaatccatccctgctatttataaaatgtgttcctaaggataaagtcagctgctatattgtgaactacattatcaaaataaaatatatgccagtgccttgagtcactgtcccactgtctttacagtgttaaggaagctatatttcatcattgtgttttattgcagtaatatttacccccacttttaatgaacatttttgttccagtgaaaaccttgaacataccaggtttttcattgtgatttaactctttcttttctaccattctgactgcaagtgtctctttgaactgatatttgtgttgtccttgtccttattttgcttttttttttttttttcccccttcctgagatggagttttgctcttgttgcccaggctggggtgcaatggcacaatctcagctcaccacaacgtccgcctcccaggttcaagtgattctcctgcctcagcctcccgagtagctgggattacaagcatgcgccaccatgcccggctaatttttgtttgtttgttttttagtagagacggagtttctccatgttggtcaggctggtctcgaactcccaacctcaggtgatccacccgcctcagcctcccaaagtgctgggattaaagcctgagaacacacaaacagaaaaggctgggaggaagttagatataacatgcaggaggtccacagttttagaccagaacttctgctagggtaactatgtatattatcatctaaacaggaaaatttttagaataaaataaattattactaagtaagtcaagacaatactcatgaaataggattgtttcaggccatccaagacatgtggtcatttatttaaaagtgggatgggtgggaaactgctatttacttaacctcaaactcttcactttcccaaaggcctttgtaaaatatcaaagggggatagaaaagcagtggagaaaatttaaaaaaatttcatccttcaaaaagatcagcaaccaagcactttgagaggctgaggtgggaggattacgtgagtccaggagttcaagaccagcctgggtaacatagtgagaacctgtttcctatatgttaataataataaacaatagaccaggcacaatggctcacacctgtaatcctaacactttgggaagctgaggcgggcgatcacataagcctaaaagttcaagaccagcctggacaacataatgaaaccctgtctctacaaaaaattagcgaagtatagtggcacacgcctatagtcgcagctacctgggaggctgaggtgggaggatcacctgagcccaggaagccgaggctgcagtgagctatggtcacgccactgtactccagcctgggcaataaaataagttccttaaaacaacaataacaacaacaacaacaaaaaaaacccagcaacattgacaactcttagctagtctgtttatgaaaaagaagactacagtactaaaatctggaatgaaagaggtgacagtaatactgactttacagaaataaacagaattagaggaaaccacataccgtatgcaaaaattaacacaaaatgaatcagacctaaatgtaagaactaaaattataaaactcttagaagaaaacataggagtaattttttgtgatcttagatgaaatgaaaacatatgtccaacacaataacttgtacatgtgatagcaacattatttgtagtagctaaaaggcagaagcaacctgtatccatcaactaatgaatagataaataaaagtgtagtgcaccatgcagtagaatattacttgaccacaaaaaagcaataaggtacatgttataacatggatgagccctgtaaacattgtacaaagggaaagaagctagtcattaaagactatatactatatggctgcatttatttgaattgtctacaataagcaaggccatagagacaaaaagtagatttctggttacctcagggtcacaggaagtaggggaggtggagtagtaggggaagtgcctgctaatgggtatggggtttctttggaaggggtgataaaatgttctaaaattgattgtagtgatggttgtataactctaaatatacaaaaagcacatttatatatccactttaagtagatgaattattatctcaaagcatatattgaaaaattatatcaagggtaacaagtttgcgaggatgcggagaaaaaggaactcttatgcgttgttggtgggaatgtaaatgcatccagccattatggaaaaaagtatggaagttcctaaaataaactaaaaatagaactatcatgtgatccatttctgagtatatacccaaaggaactgaaatcaatatgccaaagaaatatctgcactcccatattcattgctgcattattcacaatagctaggagtcaacctaagtgtttatcaacagatgaatggataaagaaaatgtggtatatgtcaacaatggaatactattcagccttaaaaaggggaaaattctgtcttttgtgataacatggatgaatcttgaggacattatgctaagtgaaataagtcaggcacagacaaatactgctcgatctcacatgtgaaatctaaaaaagttgaactcacagaagtagaaagtagaatgattgattaccccaggctagagggtaggggaaaggaggggatggggagttgttgatcaaagagtacagactttcagatagacaagaggcataagttttgagaatctattggataacagggtgactgtggtcaataataatgtattatatatttcaaaataactaagagactaaatttcaaatgtatcaccataaaaaaataggtactccagcctgggcaacagagccagaccctgtctcaaaaaaaagataaataagcaagatgataagatggtggatatgttaattagcttgatttaatcatgccacattttattttatttttattttatttatttatttatttgaggtggaatctcgctctgtctcccaggctagagggcagtggtgcaatctcagctcactgcaacctccacctcccaagtagctgagattacaggggcacaccaccacgcccagctaatttttgtatttttggtagagatggggtttcaccatgttggccaggctggccttgaactcctgacctcatgtgatctgcctgcctcagcctccccaagtgctgggattacaggtgtgagccaccatgcctgacctaattatgccacattttgtacaaatatcaaaacgtcacactgtacctcataaatgtatatagttatgatttgtcaatcaaaaataatactaatttaaaaattacatcaaggggcagttgacctgtagcatgggctgtgttgccctcaaattacatgcacacatatgcattatacagttgttctgtggcaactttgcttttatatgttttacagattgtgcatcccctctctcctacgcacccctcaaccactgttccattaacccataagacgttctttgaagaaagtgtactgtggcagaaaagtagtttgaaaatctctggaaacaatgagatccagaacctcctccagctctaacaagtcatgattctgatgcattgaatttagaatatgaacttggcctagattactccattttaactccgtgtcgactaaaggaaagctgtgaacaaagtcagttttttcccacatagctgcacacaggtgtgacttagtggaaactgtggaactcagccagatctttagctccctagtgcagtgctctatctccaagccctacttcctgttcttgaattcagtgatttgctaaaatagagacacctggttccagcaccttgcaaatggatttttcctttcagcattttaaagtacattcatgtattgatgaagagctttctctggaaagccatctgtctgaaatctgcaggaaaaaaaaaatctccctagctgtcttagatattcataatggtatgtgttgcttcactcctctactcctgcctcctgttcccttttcctcatgttttcattcattttacaaaacaaatatttatgaagcacctagtatgtgcccaacactacatatgtagcagtggacaagactaattagtccctacaattaaggatattgccatctagtaaggaaacatgtggacaaccacaacaacaaaaactttaaagatttttgagtcatggttaagagctatgaaagaaataaggttccgagacaaactatgtaggatgtgattttaaaatgaactccagagttatattgccagtgttcaaattccagtttcaccatttactagctatgtgtttttttttttttaagggggcagacaggatctcgctttgtcacctaggctggagtgcagtggcgtgatcatggttcactgcaaccttagactcctaagctcaagctatcctcccaagtagctgggattacaagcatgcatctccatgccagctaattttttttattttttgtagtgacgggatcatgctatgttgtacaggctgatctcaaactcctggctcaggaagtcctcccatgtcagcctcccaaagatctggtattataggcatgagccactatgcccagcctagctgtatgattttgagcaagttgcttaacttctctgggcctcaatctttttgccttaaaatggggataataatagaaacttctttagtagagttgttctgaggattaaatgagttgatgtacatggtgcacatagaaaagttcctggagcatactgtgcatccagtaagtgttacctatatgttggcattgttgctttaaagaatatcagggaatcaactaattaggttagcattgttatcatcttaatcaccatcatcattgccatctacagatacttatcttgccacatttatgtgcattgtgcccaagatttacagaagtggatataacatgctcttggactcaagaagcttacaatatagagtgtaaggattaaaagaaaattgcagtatatatactaagtgctagataagtgatagagacagcttgttctacagcattgtagggaagagagcagttattgtgggctcataaagagaaggcctctcggaggaaaatggactcttatgagggagagcattctaggctgaaagaacagcacaagtgaggatttggacataggaaggtgaatgtgaagttccagaatggagactttgaatagaggagcagtgaggtgtgggttaaagaggaggccccagcattctggttaaaattatttagtaaacagtaatctgccatgtccagattctgaggtggagtaatcaaataagatttctctaattcacctgaggcctactagtttacatattgccttatttcaggttcccataattgtcatctagttgattgctttccaactggtgttgctacctgcagtctctagtcacctactcccctctgcacatttttatcgcattaatttttctcaaacatccttttgtcactgacttgcttgaaaagttcttagagttctccattgtgcatagcggtgtttctgaaacattaacgtgcataagaattactgggagttcattgtaggtgcagatcactaagtcccaccttcaggtcacatgcttatgacatggtgcctgagaatctctatttaaacaagtgccctaaatgattctgattcaggtgctcaagagtcactgctttgaagacaggcctaaaatgaggagtgcaagtctcttaacctgccacccagagtcttgctttatcctgccttttcaaccacatcttctgttgttctgattaataaaccttttatttgagccaaatgggacattttcttttccatacacttactttttccttacagttatgctcttttttcatcttttgtgtcttttttgtgtgtttccctaagcctcattgtctctactgccatttcaacaagtccaaatcctggcttctttctgtcctggtttaggtatgtccagaaagcatctttagtaaatgagtacatctctaacctagaaggtaggctccaattttaactcatccttttatctactcccctacccaggaatctaatgagcaccttgcaaatgattcccttcatttgtccctccctccctccctccctccttctttccttccttccttccgtaaagatttactgagcacctactgcttaccaatgaactgttctaggtgctaggtgataatgtaggggaaaaaaaaccctctcaaattctgttttcatggaccttacattctcattgggcaactgtttataagtaaatattgaaagtgttctgagagtaatctggcagtgctatatgggatatattaggaatgggagagacctgtgaaagaaattaactaaggaactcttgcaagtggcctttagacagtggaaagggtcagtgagaaagtaaaaaggaaacagcaagagtaattagtgaaatgaaggaatgaccaatagtatttgatgggggccacaaaagtttatttaatagttgagcttttgagaagaaaaaaatgtaaaatggataggtgatgtttttggtaaaagacattaaaaatgttatgatgcattagatatgttgtttatgatgttgataatggggcatccaaatgcttagtagcaattagaaatacagaggtattataagaggccaggcctctctctccttttccccttctccaatttatctcaaaaatcttatgtctgtcttgttgttccaggtccaaaatttcttcccaagaatttgtgtctcattcaattggtttttctgggaatcatggcatgacttcatgtcttagccccatttctctgattgccaaatgtttgtctataaagaggactaggtccaaccctagaacattgtctctaatcatagccttcctttgaatggttctcggctgattaatggtttggcttgtgggaggaactaggaagacaacataattgaactagagattcctttaaaattgggtacagtcgtgagtgtcatgcccctatgggaatatcactgtggtcatttatgattcttagcaaaataggcaaagtttggaaaagcaaattgtaaaagctttggcataacacatagacaggttggaaagctgcttgtaatcatctggaaaatcatttttttccattcttgcagttgctctgactaaaaaaaactcaaattgttcctgactcctgtctttctctcataatactaaacatccagtctatcagcaaatatggtgtgtgtgtgggtgtgtgttttatatatacatatatatattttattggctggcttccccctagaacgtaaacttcatgaaggtaaaagcttggtttttttatatccttagctagtgcctagaacatagtagatgctcaatagcaatttgatgaatgaatgaatgatgtgaaattaaattttatttcacattttgctaattagttttgacattagctctatcttcaagaagcttgggaaatattttatcccaataaattattctagctaaagcccagcagcacaatattatttggtaatattattaaccaaataatattatcttagtgtaagaaaaagtagaaactttatttcttaactagagaaatgtcagaaagttttgaagtctaagaacactctttaatggtgctaatttggtaatagtgttgtgaatgtgatattctaaaatttagccttaaaagacatcctaataagatcagctggtaatcatacaccaggtatgattaaaatttactttttaattcatagtttttaaagaaagttttcttagcagtttggagactggattactactttaatgtttgaaaagatgatgcttgatatttgagaggaagaatgtcttctttttaacctttaaactttattcaagcagttccatatgaccaaaaatatccaagcttaatgtatacattagattaccttcattaatatacagaaagttgctttcttagaacagcaagaatgacttgtgacatatcagcatattaaaatttactggtgctatggggctagctgaccagagatattgttaggaatttttacctgatttagagaatactttgaatttccaaggattgaaggaagaggttatgatcaaagcatttgtgtggaaggtcattttggtgtagtgattatttttatggagtagcagagaagaacaaagtatttgtaatggaaaagaagaattggctgcagggcataaacaaatatttctctctaacatcttagccattgcatttcaagtctgttgcatcattactttttaaggtattgataacatatgacagagagagaatatatggctttagttcagtttaaatatgatctatacaaagtaaagggtggctaatacaagtttgcaaatgactttccattctgttgggtcttgatggatttccataaaattagttaggtagtagagaatattgagacttgggtttactttgaagagaatctagcattaattacaccaggttttttaaattaaatagaataagtaataatgaaaatcaagtcaaatatttctatctggcaatgaaaaccagctactggatgaagttaattgcttgaccattgtcatcactttctcaacttgtactgaatattgggggtaaattagttttaaaagcatgtctttttcttgcttcatttccatgaatcctacataatttctttaaagggatatgtatgatttaggggataaagtaatcaaataaggatttgtatgtatttcatcaatagaaatttctccaagttcaactatagttttcttatcaaaaaattacattcacagttgcaaggcagaggcccactggaatagttaataagcacagtcgacttctatattgctgcagaaactaaatacaaacttttctgtgacttacatataggctcggtaaactttcatctgcttcagggtcagggctgattcaatcttaaagcaagtttatgagagtggctgatgtgatacagttgtttctggtaaaatcagactagctctaaggagccaatctaagtcagtctctgagtcaaattctatgaaaaacagactccaactcagacacaattgtaaaccctaatataatgaggacttgcagctgatttaatcctattgaaaatctttaagcagctatgggacaaaatggtttccacattgacatcagtggaatgaaccttggatttcatcagtctgaagagtagttaccctgtacacacagtagccactttgtaagaattaacatcatggccatttcaaagcaggttgttgtttcttatgtagaggcatctgttttgattaaggtccaagttgccagaatgtgtcaggtgtgtgtgtgtgtgtgtgtgtgtgtgtgtgtgcgtgttttaactgaattcattacaaaaagcaaacaagtcaaacttaaactcagagcctagtataaatcaattagatccagtctccttgaacaaaaatgaccaacctattcctattcactatatatgtgagcaacatagagaaagaacggaacagagaatgagaactgtttttgagttaaactatatgcaaagttttgcctggaactaattatttttttcatgaacttagaagtccctgaaaataagcttatgctgtgaaatcatatatgtataaagggacaaacacacacaaaagtctaaaggtcaacactgcagataaaatctcaacaggaaggttttgaacttacctatgtgcccatgttggtaggtggatacatatactttttttttagtttatcatattgaaataggcactgataatgatctaggtgttatagtcagtttagcactagtcttagttccttttcataatttacaacttaaattagaacaatagaccaaacacagactgcagtaaaacacaaccttgactgaactatctgcatgctgcttttattgcagttagcacttagcaggcagtagtggcctcatactgttacttcaaagagccggaaaagtaacttcatgaaagggaaaacttgaaactgtagtactctttatctttctgtctgttaagcagtgatgggtatcattagttctgctcttttgcataattactgcagtattgtgaaaaacatttttgccattcaactgggaacaattatattatttgagatcttgtatagcatttagttttagagaaataaaagataaaaagcccttgttttctagctctgggtatctgtagtaaggtagtgcatacagtgcttgttcaagtttgtttatttttttcattaaaaataacattaattggtgacactaaaggagacatttcatattgaagtcaattctttttgatgtgtttttgtttaatgtgcttgctaagataaatttcatctagcacatcactgagttgagatggtaattcattaataaaatgataaaggtttatgaaccataatatggacatcattgaaattttgagacttaaaaatatattcttattgttgtctagattaaattaatacaattttctatttatataaagcttccagtgtagattatctctgttaaaagcatgcgacagcctctcccaaccaccccaccctacctcatcccacaaacttctaaagcatagagctagaagtatgtttgcaaatgtttacacaatgaggtgcataactttttcaagtttgtaaaaattctcctttgtaatctcagtatgtgaaaccattaaaatactgtaactttttttactgtatttgttagataagatgttaactttttggaaaatactactacattatagcaagggcggtaaaattaggatgaagatcacagttatatatagatgtgattgtcactttgattctgtggttttacacttgactttttataatttataagatatgaaatataatctcataattggcaaaatatattttgatcaaggaaaaggtatgactgttgcctgttggaaatattacttcagcacggctattatattaccataattatgataggaagttagaagaaattttggatatgcatatgtttggtatatagtaagttttcttacaaagacaaaaagattaaaacacataattttaattaaaagcctggaatagatgctgaatttccttttcttgtcagccatcaaaacaaaaattgtatttgtttttgtccttaataattctcaaaaggttggtttccacaggtttttctttaaaattttaagcatccatttatttgcaacatttttattaatgagctgacatttgaatatgttcataaaaatgttgatatggctgaacaagaagtttcaatcaagcttccccaaaatgctactgaagaacatctaattaatataacccaaaattagtttaatgcattccttggtattgttgcattattcaaatgtggttttatttactactcctgagacactatgcctcttaaccaaactccagagtgagctggtaaacttacctatcttaatacattgaaaagaggaattagctacagttggttagctaccagtacggctttcagcaccttctccatggtggctagtatctgtaccgtatacagctgtgaaaggatgggaaaatgcgctgaaatgatctaagaagtaaactatcaacttgacatgttttcctagctattgaaaactgtctcatattgaaacccgttgatagtgaaactgtagaattccactgatttaagtaccatctggttgtgctcaaggctttaaagctgttatctctgcataaaatttcagagtcctatacttttttcttcaccaaactatccatttttaagccacaaatatttttccagctctctcagattttatctaaaagtatattttaacagcatttaaatagttcttaaacaataacaatttatcttgatagatggcatgctgtattttttcattttattttaattagccattgtggaactaaattcccttttgttttagtcttttgaatattaattatcattatcatgccagatatcttaaaggttattttaccaatacagttccatttaacataacccatatggaatcaatatcccagtttcctaaagtgaatgcttggaaaatcttacattcatatgttaagagtacacatcctttcctcattagttggaaagtacagggattttggcacaggttctgtgtggaagcattgtgcagcttttatatggattttgtttttagcctttgatgacactgtttagaataggaagtatctaataagtaaagcattttgtctcaagtgctgccagtgtgtttaatatatgcctggaggtctgaaacattatcttcttcgatacagtaatatgcatttaattctctgaaagcagaaggtcgaacttttgaaagggacgcaaagtacattttcaaacagaataattcaaaacatatggaacagaggaccgaagtaatgtacagttggtttttatggcttaatcatgatcatgttaatgcacaccagtagctaattaaagaaaacttttattgttcatcttaaataagttaggtaaagagtgggagagctgatgtaacagcactgcccagagatacatgtttctgctgcaccaacagcaagcagatactgctatttttgacaacttaaattattagtccccttggacaataataaagcacaagttactttcagagttattatattgtgaactcttcgttttccacaaaggaatagtaaattgatgcccaagtttagggcccagcacacataattaattataaaacttttcttaatagtggaccagatacccttcaatatagtaaatctgcagtggactggtgacaaaccagtggatttttaaatatgtctcaaaatcatcagcttgtttacttcagtgctacagatagtttagaggcttaaaaaaaatggaggaaatcctggcttttaacccagttttaggaatttagttttctagtactgggtaagttgtactttttcttttccttccaatgaaagccagagtctttcatctctaggtcattggttcaaattccattctgctcagtagtgattagaattagttaccatctgacttctgttcagtaacctttgtgacctgagctgatagctgccatcctgccactgctggttatttatagctcaagatcacaccacttgacatttgctggagactaatgtagcagtctcagcacataatataggctggatgctaaatttctttacctttctctacaggtggtttgttgttttatgttaacacctatgggaacacttaatccactttaaagagggagagagtagattttaagtataaatctgtaaatcagaagtaaaaaatgctctatgcatagaaactatagtttcatttagttaattgtggttgactttcctgagtcaaagaatgaaaatagcttataaagcttgagttcttgattggagtttgccatggaactcaacctaaaggattttttagttatactgtatttagatatttagtttgtaatgcctcaaaatatgcttgatttcacatttgactgcttaagtacttgatttcatcacttttcacatgttatgtgagaattcctagttggtaatatatttggaggtttatttgaaattttcataataaggataactaaaatgaaacttattttgataacaattatctttatcttactgaatttttaaatatgttcatacatttattcagtcagcacacaattattaagctttattatgtgataagcactatagtatgttctaggaaaactaacatgatgtttcctcttacccaaagcctgctagctgtctgaccttggaactattgatcaatctctataaaactcaattttctcagctgtaaaatggagatagtagtactcctcctcaaagaattataatgttagcttatgtaatgtgctaacagtgtctggcaaataataaacatactcagtggtattttattttttcttcaattgctcacaatccctgagacagaatatagtgtgaaaattgctataatattagtttgttataaaagcatagcagtgggaaggactagcaccacctggaagggttgctgaagtcttcacaaagaaggtgaattttttaacttaccctttttagagtgcctactgtgtttgttcaatatgttaattaattttatgctgcagcaaccctatgagttaggtattaatgtcccaatgtgaggacacagacggaagagataggattctttgaagtatgatcagcccacaaggtagagtatgcagatcaggaaagacactatgaatgactatgtctggggaagaccttaaggagtacagtattgagaattctccatttacatttctttatatcgtaacaatcatgtaactctagtctgctgggcaattttttcatttaatgttgtatcaaagataaacatatcaaacattcgtggattctcttcagtgtgctaggcactgccctgctcttcagtgatatatagaagcagaattgtatactccattccctctaacagttcttcacctggtaaaagagacaaacacataacagctgcccattgttggatatttactgtaaggcaggcactgtgctgttcattcagtcattgcagtaactctctgaagtaggagttattatcctcattttacaaatgatattatatagccttagatttgtaatttgttcagagtcatacaattagagagtgttggacttgatcccacatctgtgtgactacaaagcctatatgttgtcttaacactgtctgatactgtcaccacaaaacattttagtaaaatatatcatataatagaagtataagtgaactactaagatcaccaagaaggaaaagagtgagagaacagttcttggacaaatgtcacttatcttgatggataactaaatgttcatcggctacagcaagctcagaggggcactccaagaaaggaaagagcacagtatagactgcatagtttgaaagaatatggtgtcttcaaaggacagaaacaagtcctttttgtttcaaatagctaatgctggatttctctaacaatgtgactttctcaacaactataaaaaccaattaacaagaaatattcttaaaagaattttaatgaggattacctcactttcttgacttatttattcttacataagttgttatatatatataagttattgcatatatatatattattatatataaaaatatgtttttttttaccaatcaaattaaggagtttttaaaataataagcagctttgggaggctgaggcaggaggattgcttgaggccaggagtttgagaccaggttgggctacactatgagacctcatttctacaaaaaatgtaaaaataagctagccatggtggtgcatgcctgtaatcctagctcctccgaaggctgaaatgggaggcttccttgagccaccactgaggggttgtaggctgcagtgagctatgatcacaccactgcactccaacctgggcaacagaacaagactctctctttaaaaatagtaataataataataataataataataataataataataataagaagaagaagaagaagaagaagagaaaagaaaagaaaagaaaagaaaagaaaagaaaagaaaagaaaagaaaagaaaagaaaagaagaagaagcaatacccagttacccagtactttgggagacattttttatcgctgatagtaatgtaacttagtgcagcctttttggatagatgtttgacaatattcagtaactttaaactttttcgtaccatttgcctaataattccactttttaaaaatatttttgtttttgtttttgtttttgagatagggtctcactctgtcacccaggctggagtgtggtggcatgatctcggttcgctgcaaacaccacctcccaggctcaagccatcagcttcctaagtagctgggaccacaggggcacaccaccaggcctggctaattcttcatattttttgtagagataaggttttgtcatgttgcccagcctggtctcgaacccctggtctcaagcagtcttcccacctcagcctcccaaagtgctgggattaccagtgtgaatcactgcacctggcctaataatttcacttctaggagcctgtctgtcctgagaaaatattactaggtgtttgtcagcactaattgaaaacttgaatatccagttatatgggaatggtagaacaaattgtttctaacactaaatgaaatgttatgcagctttaaaaattatatttatgaagagtacattagcatgtcaacatttgagttatcaatttgtccctatggtatcattacaaccataaagggatacaagtgaagcaaacctgtgcataggtaggaaacaaagactgaaaggaagagccatgaaatattactattggttatgtttggtgataagatggggtggggtagttttttttactcttatggattttttatggttaccttaataattctgttgaaaaagcaagtaaaatatctaggtgcagaatagcaagttgcagactgatggttaggcagtctaagaaagaggaactgatgttcttggagccaaatgattataactcttgctgccaccaagttgctctttgttctatacatggggagtcattggtggaaaattttgagaactagtagcctttattgcacaaaggaataatctaccctcaagggtttaaattacttaataactgacttgattttactttatcacttatatttgtccttgttttaagtcctattgtagtaggagaaaataaacatcttttgaaatggcatgcatttattttagtgtacttttctttgtccttcataatttaggactactgatttttccctttcttactgtccaaaaacctataaatcagttttataagaaaggtaaggagtatagcataaactacttctacgtaaaatgtaatttcaaccaccagtaatcatgattttgcagacagtttattatattgcttgagaaatcactataaaagtatgtattaaaataattctttaaagagacattttaaaagatatatgctattctgtattaatgcaaagaaagaagatctgacattcaaaaatatattttaatgatggaaatgaacattagatgctttttctcaagtatttccttggcatttttaggtgattttaggggtctggtgtagaaaatgggcacctattctatttttctgattactgttttaagttatactagactcatttttaaaattttctctttgacaacatgtttatataacattgtttatatgacacttggcatgtaactagtttgaaatattttattacttttttcttacagatctctaaacaagaacagaaaaaagtggatatatttgatggaggcatggctgaaacctcatctcgctacagtggtgctcaggatagtggaattggcagtgacagtgttaaaatcagaatagtgcaaatagagcagcacagtggtgccagtcagcatcgcattgcccgtccctcacgccagtcatcaattgtaaaaaatctaaattttattccctttgacatatttattactgcaagtagaatctcactaatgacctattcctgtatggccttatccaaatcgaaatcacaagaacagaagaataatgaaaaaacagacaagagttcattaaatctcccagaagttgattcagatgttgctaagcccaaccaggcatgtatttccacggtgacagcagaagatctcttaaggagcagcatttcttttccttcagggaaaaaaataggggtcctctctcttgaaagtcttcatgcatccacaaggtcatctgctagacaagcacttggtataactattgttcggcagcctggtcgaagaggaactggtgacttacagctagagccttttctgtactttattgtgtcccagccttccttgcttctgagttgtcaccacagaaagcagcgagtggaagtatccatttttgatgctgtgcttaaaggggtggcctctgattacaaatgtataggtaagaaccttcaaacttactggagtgctaataattactatctaataagttgtattcccatagtttccagattgattaaacagaaacagctggcagacaaaagtcttttctctacagaatatggaaagttcatgttccacagctgaatcctgtttaagtaaatgtttgaaatgtattgaggtttagcttagtattcttactatgcctctgaatattcattctttttccaggaactgaatgaatcaggaactctttcttgactatagagatgcttaacagtttccagtgtttggaaagcatagctcgttttcatattaatggcccataggtatgctttccatgttaatgcttctattcagattaaaaaagaaaagccttagaagatgaagtttgtttttggtattcttttgatgtaatcatcttcatgcaatagcatcgtattaaatgtaattgagaaggtttattaataaagattatttaaagatttttgtacatctacagaaaatatattgatgttggctaatttgctcttgctgcccaacccatcccttccttattctaattataataattatatgaaacttccgaagctttttgcctgttgagactaggaaagtgagcagggttcagatttaagacatacaagttattaagtaacaagggccagtggagtcaagcaaggtgacagtataccctttccctgagttaatgtagatttggagatttggccaaaaaaaactggagagggtagctgggtcacctaagattcagtattcaaagagggctctagcaagctcaggaatagttcaggcattttattgctttcagctggtcccatccagtaggtggaagccagcagtgaggcattcagacaatgtatctaatctggaattcaggtttgttcattcttgccattaagaaggaccattttgcacagcaggatcctgaaaggtagatggcaggtgtgggaatcaggattcagcctgaggaaataggatcaaaggagctctaggccagggtttagtgcaagtcccctgctttaagaaaggggtaactagccagttgctgaggagtaacctagggttacccccaggctgcttgctggccctctctcctgtgcagctcataatgggtcaaaagagctgattgttagactcaggaactttgcaagacagttgttaaactactagtagcttaaattggccatggtgaaagtatttatgccgcagatgcttgcaaactcaatcatatcagctctcctacaccaagagccatttgttaaacccttaccagcaacaactgcctctctttctcaaatatattctcatttactgggtgcctgtgatataacaggtacttcaggggcaatgaaaatgtgggagatgctggtatagtggaacatgttatgtgattcaagaactcatgcctatatacctgatacctgcttgcaagtctgcttggcgttagccaaaacttaagtgcaggattaggagatgaattcttaattctcagcccttcattaagttcactcagctacagtcgctctataggtgggtggcccgtactaaaaatcatcaggagaggcagaggaaagtaggagggggaaaggggccgagaggaacagctatgacctcttcctaaatttgtagatatgcagagatcacagaagcctcattttgcttacttcaagcccaacctaaggatactctgtatataacctcaacctttgaaattgttaaactgaggcaagccagggaccacagtaatagaaaagaactgccaatgatggacttgtttccactttctgaaattgtaagagaagattggcttcagtctgttttattgatatactcccaaatcatgtgtttatacattttcatctaagtctgtattcagcaaagttataagagctcataccaaagataggcatttgaattataatcaattcctaggttaaaataatagaacacttgtttaaagcggggaaaaaaccttgtatgtaaactgacgtggaacccaattttggtacatgaagctagagtggtggtcatgggctagatttaatataggggtggggggtaaatgtaggaggaaaaaggctcacatactttctaaggagcattttctgcataatattctcatggatgcctttccctacacagaatgcatctacttgaacatttatattatctcagtagtatgactcctggttagtaataagcaaaagttatcaatatgcatgataatatttcttaaaaatgaacttagtgatctagggaaatttttttcagaagacccaaaaggaggcaagtaattaaaatacaatggctaaaaataaaattcaactagcatttattgagtgatcaccctgtgccaggcattgtcctaactgctttaacgcattatctcatttcatgctaatgacaactctatgggaaatgttctatcttagagattaggaaactaaggtttagagaagttaagtaacttccccaaggtcacagacctagcaataaacagagctacaattcaaagctaagaagtgttggactcctgagtctagactctcaacctctatgggtcccctgaaaagaaggatctgaattggaggttctctcagtcagcctctattgtcccacttcagaccatgcaaaagattcctgtctaagttttaactgatgaatttttatgttaactgtgtctgtgatgtgattacacagtactcaggtatggaaaacctgggttcaaattctgtcacttatatgtatacctatatcattatgcacttatggaaatgaaaagagataattcatgaataattctaaagtacttagcattgagccagcaggcctaggccctcaaaaatgtgtgctggtactattttagctgtcaatatcatatagtgaaaagaatacttaactaggaggcagaaaacctgggatttttattcatggccctgccatcaattagtaaagtgatcttaggcagtttactctttgactttctgttttcttatctgtaaaatgtgatgattataatagatatcaacaaagtccattccagttctgaagtttcatcattctgtaatttggaattctgtaatttggctttggcttcatggagttgacatctgtaaggctctgcagtatcaggtagaaatttattttgatttgttttgaagatgcagatttcctttgatattctagtggagctctaattagtttattcagagttttaaatatataagttttattaaatgttaatgaaattatttttcaaaaactgatctggaaatgtgttttatatttgtccacttgaatgaattgtctaagtcccattaccaatttggctatccagaaacactttatgtagtactttctttcctgaaaaaagcactgttccataactggtgttttctggaagccccaagatagtaaccttaaggataagaaaaaagagaaaaatataaatggctataatgctaactttcatggggagggaagcagagagagcagtaagttgggggtggctagctccatttctgcattctaaagtgaaggagtcattgcagtgtctttaaattggagggactaaaagagatattaccatgaagctaatgttctaagaaaggtccaggaaaagttaaaggcatcataagttaaaagtgaaagaagtaacatgtcatgtgtttccacagtgttcatatgttttctctggatattaaaattctttttgggtgggcacagtgtctcacatttgtaatctcagcactttgggaggccaaagtgggtggatcacttgagctaaggagtccaagactagcctagacaacatagtgagaccccatctctacaaaaaattacaaaaaattgtaattgccaccagttgcagtggcatgcacctgtagtctgagctattgagaaggctgaggtgggaggatcacctgagcctgggaagtcaaggctgcagtaaaccgagattgcatcactgtactgcagcctggatgacagattgagaccctgtctcaaacacaaaataatttattcttttctataaggtaactccagtggcaactggccaatagcaatttttgcacatatgtatgattgtatgatttggtttggatgtttatcccctccaaatctcatcttgaaatgtgactctcagtgttgaaggtaaggcctagtgggaagtgtttagattataggggcagattcctcatgaatggtttagtaccatccttttagtgataagtaagttcttgctctgggttcatgaaagttgtggttgtttaaagaatgtggcgcctccccactaccttgctccctctctccccatgtgatgcgctggctttcccctttgctttctgccgtgatcatagcttcctgagacctcactagaagccaagcagatgttagtgcagtgtaccgcctgcagagccataatccaaatatatcttttttctttgtaaattactgtctcaggtattcctttatataatgcaaaaatagcctaacataacacgcatctcaataattgccccattgtcacatttcaaaaatacctgtgaggttgttatagagatattggctttctgggttgttttgttttgagaggacaataacatttgattattaaaaaaaaatcctagcacaatgtggcttgtcattgtttattgttttctatacaagtcataaaccattattatatgtgctcatgttcctttatatagaaatcatataaaaaaaggattttgttttactctttaaaaagttttcatggctgggcgtgattggctcacttctgtaattccagcacattgggaggccgaggtgggcagatcatctgaggtcaggagttcaagaccagcctggccaacatggttaaaccccgtctctacaaaaatacaaaaattagctgggcatgatggtgggtgcctgtaatcccaggtactcaggaggctgaggcggaagaatcacttaaaaaggaagaatcacttgaacctgggaggcagaggttgcagtgagccgagatcacaccattgcactccagcctgggcgagagagcaagactgtaaaaaaaaaaaaaaaaaggtttaataattttcagaaaaggtaaaatcatagttcttatgtaactataaaaagaatatatgtcaaaggttttatttaactaataatttatttatctcattaatttgtaagaatatcacaaaaaaattcaggcacaggggacctacacagataacgctggttatctcaagagatttttattctataattcataagggtcttaaaaattgtcactcgatcatgggcattattcattattaaagtatggctctgggtgatgcttctagaaagatggaaatacttttgacattaaattatgaagatttggtttaatttgacatattcaggcaactataatgaagagcccaaaagtgaatattgaaaatcctttgagtgttgtaggaatacagtgtaatataccaaggtgactactttaatcagtctggcttttaaaattacatcttccctcctgtcttatacaatcagcttgacttattacttcagaagaacatcttattcctattgtgctttcatttatacagcagacatattttgggaatattcattcattcgctgaatgtgagcacttgctgtttatcagacatgggcaagactctgagaaaccagtaataagactcagtttctgccttcaggcaccttgcttcatgtgataaccatacttattaagattaattttgaaggtttagcagaataaagatcttcatgccatggagggttgtgaaacacttacattaattaaataaagcctatgacctttatttaagttccagagaagcaatttagaaaagctagtatcagttgtatgtgatggcttaagaaaaactgtttagatacatctttaaagttattgattttttattagttgtatattcagctttagctgtgattcagaatatttttaaatattttactttatgaatttgccttttggctatatttctttgtaatatattttagtggttgctctggggtttccagtatgcatgtctaatcattcacactctatttagaggtaatatttcatcacttaaaggaagatgggagagctttacaactacataggttcctttactgtcttccatttataattgtcataaatattacatctatatattcaaaaccctaccagataagattttaatctttgtttcagtaatcttatatattttaaagaactgaagagggggaaagtggtcttttgtattcccagccatttaccatgttcagtgctcctttatccccagagctccaggtttccctctggtagatttttcttcagcattaggaacctccttttgcatttcttttagagcagagctgctagcaataaatactgttttccttcatctgcgagtaccttttttttttttctctcattcctgaaggatatttttgctggatgtaaaattctgggttgacatgtcttctagcactttagagatagtatttcatgttcttctgtcccctgtggtttctgatgaggaatccatgttcattccaattactgtttccatatttgtaatgtgttgtttttctctagctgttttcaagacacctgcttatctttagttttctgtaggttgattattgtgtgtctggacttggtttctttgattctatcctgtgtggggttctctgatcttcttgactgtaaatttatgggtatattgttttggttttgtttatcaaatttgagaacttttggcccttttttcttcaaatagtctttctgcaccaatctctttctcttctccttttggaattcaagtgttaagctttttaatattgtcctacaaatctctaagactctcatttttttttccccactcttcagattggataatttctattaaatttttcacttctaaaatttccatttggttcttttttgtagttcttatttatctgttaagaacttatatttcaattcatttcaggtgtgtttacctttacctcatgaaatacagttgtaacagctgcttaaagtcttaaatgcctgtgtcactgccaccactgtaacagtcccctctacatacacacacacacacacacacacacagacacacacacacattggatattgggtccaccctcagggcaaagccaggagagagagaaaaaaaaagaaaagaaaaagcaacaagatttcccctacactcttaaaaccacaggggacttaatttccagacaatattcctgttggagctttggatgtgtccttaccttcactgtgcaccacaatatagggctcactctcgagttaaacttataaaagaagacacaaaacaacatgaactgggaaattcatcacaacgtcggttatagccacaaattggactttcctctccaatctgcattggtctgatttacttttcagaattctcaggtatttatttgctttttgtgtcttttacaaggtttttaattgtaagcagcatgagagttaggctgcagtgaggttattccagtctgggctggcaccagaaatcctgccatttaaaaataataataatgttttctagtccattagccaggacttggttttctgggaaacttaataggggatttcctctaaaagtgatacttttatatctttacatcttgagcacagatcagctacatatagcctaatcagtaattactgctcccaaggagttgtcagcattaacttgattcttcccgtgtcaccaataagcacacactcagagggcagcaatggtgttctctctctgcattcctcagggctttcctttcatatactatcaaatcaagttagcaggggaaaatgctgtgagattcattgcccttcttgtcaacctgccttccccagcacatgtgactgatatatacaattttaaaatatatatgtatagttaaatatatgtgtatactctgtagtgatgtcccttatccatagggaacatgtttcaagatccccagtggggcctcaaattgtggatagtactgacccttatatgtactgttttttcctacacatacatacctatgataaagtttgatttatacatttggcacaatgagagattgacaacaataataaataacaaaataatacaattacaacaatatactgtaataaaagttatgtgaatgtggtctctctttctctctcaaaatatattttcagaccacaggtaattgcaggtaactgaaaccacagataagggcaggggattactgtataaaattggccctcagtattcatgggttccacatctgtggattcaaccaaccatagatcaaaagtattccaaacaaaattgcatctttacaggacatgtacagactttttttcttattatcctctaaacaatacagcataacaactatttacatagcacttatattgtattaggtattataagtattctcgagatgatttaaagtatacagtaggatataaataggctataatgcaaataccaggtcattttatatcagggactgggatatctgtggaatatggtatccacaggaggtcttggaaccagtcccctgtgaacaacaagggatgactttaaacatatacatttaaaaacgtatttgagatacttcccaggataaataagtggaatctatacctacatctaaatctgttttacaaagctaaagcaaaattaaaagtatgataattataattttgaaagtcctattaatagagtataattcatattctgcataatttactggtcctaaattatgctgactgtatctttaagctatacatagcaatatgcttttcatccttaatttaaaaacattgtttaaaaactaaattatcaacttgaatttttaatgaatattaatattaataatctacttcaaatgattttccaagtagatagtaagtctttgagttaacttctttttagaaatattagactaatgtggcaataggcttttccatgcccttcccacctggagcaacctctaacagaaatgagatcttctgccagcacctttatacatagcagctgtattattggcagttctcatttaaataaagatgtatgtagttgtttttagcataatcgtattagttgtgtttataaatatttaaaaattggtatttgttttgtttaaggtaatggagtccagatttgaaattgcctcatgtcttgactatgcagcccaaggcagcctcaaaaagtcatttttcttcttgtttgtttggggcttttttgtttgtttttgaagaaatggctgtgccatctggtcaaatgtgaagggattgaacagttctgagggaatttaactaactccttagtgcaatatcttgttacccattaatgtgtgctaggacctaacaaagaaaccaactgaaaacatttacttctgccatcttgcaacttatttacctgattgtatcttttcaaacatcaactagactaaaatacagaagttaaagtttatttgaatgtatcatactgaaaaagtaggtcatagcacacttctgtgtaggatactgtaatgtttaagataggttatctaatatgggacaatttctgcattttgaagttttataaatgccaaaggtctaatgaagggtcaaacttgaaatatggagtcctatgagagctcaggattagacctctcggtactaagttttaatcctgattctactccttacagctgtgtgaccttaggcaagttatttaacctgtttatgcctcagtttccttgtctatgatatgagaataatactggtagcagcctcctagtgttgctattaggattaaacaatgtatgcgaagttcttagctaagtgtatggcacaaggctcaatgactattaataaatattgttgcttttgtcatcattgttaatatctttaagtgtttttttaaagtagtggttgtaaatggtaaaataatgcatatcatttcaatgtaattctagctattgtggtttgaaaattttcagttacagtaattgagggttttttttttatcctttcatgaataggactgtagaaatgtgccaaagacatttgagtaaacgaacagttgaaaaatcataaaatggcttcttacacctcataaatcatatcttgatttcatttagttattgtgactttaagaaaaagattgaattatatgcctctttagaattaaggtttttgttaatatccctggaaaggcttagaattaacctgtgactttaatgtcataatgatcacactctgaacatttatctggaaatttagctgctgtgaacattgcttgctggctaataatatgaaataaaattattactttgacaggaattagcaagaaagtagatctcttaaatgagaggcattctagtgtatcactcagagagaaaggtgatgagaaggttaaataagaaatgacccaaccagctgagggaaataatattatatgaggaagggtattagaacagaaatcagaaatcttgacttttagccttggttctaatgccaaagctctttcatgcaaacagctaaatttcttggtgctttagttttctaatctctaaaatggtttgataatatctgctgttagtcaattaatggttaaatctgagtttcaagtgaggtgatatttatgaaattaagtggaaatatgaaacattattcaaacataagttgggacttcagtgattattagtattaaaagggaaactttcatttttagacacgaggaaaagattagtgccctggcctttgtgactcccattgtaatcatcaacatttacttaaaacaaatgaaaatggggggaatcatttaaaggcagtgattagctttaatgttacaaaacccaactttgcttagagcagaaaagaggtttacagttgggattaagttgatcttccttggatatgtgacttcatttttttttttttttttcactgaatagcaccttgtgcttacttgtgctgaattttaatcaaatgttggccacattagaatttaatatgaaacaaccaaattttaataagaaagagatcaaggacaacacagagcagcacataaaatgaattaaaaggaattaattgaattgatatttcacatattatctgctggttatacttaatattcattaagtataaagaatacacttccttctagcaagatatgaaagacttggttctaaaagtaagagcaagtggacattgatggtcaaacattccagcagccaatttaatcccttccttttcctgttactatggactgcagacctggggtttcaaaccaggaaatctcttgcccttcccatcacatcttacgaggtgcagagtaggtacagaatcgcagagcatgtgaaatactgcttatagagttagccaaaggtctggatatccacagggagatggtggcacttaccttgcatccagagcaatttggaactggtttcttggttgatttttgctgtcctgacattggatgatgatgatgattattattattattattattatatatatttttttgggacagagtcttgctctgtcacccaggctggagtgcagtggcgcgatctcggctcactgcaagctctgcctcccgggttcacaccattctcctgcctcagcctccctagtagctgggactataggcgcccgccaccacgcccggctaattttttgtatttttagtagagacggggtttcactgtgttagcaaggatgatctcgatctcctgaccttgtgatccgcccgcctcggccttccaaagtgctgggattacaggcgtgagccaccacgcccggctgacactgaattattatgatgtttaatggatctagattccttcacaatttaacttgcaggctttatagagccttcatggactacttttgcttttgtggctacataagaaaaagaacaaattagccatttaaactatagatcaaaaagtaaatatagaaaatatattttctccaagtaagtatagaaaaatgtatgaaactcagtaagcttgtagcttgccttttacatgtccagtggtcaagaagtgactgttctgatagtgacctcttattgcagaggattacacttgaagccgttgagcatagccaaaaccattcacaactttggcctctggcagaggctgcttgggagctttaataacatcaatttcatagatagccacaaataaatgtatcatactacaaataaatgtagcatgataggaatttccaaaatgctgtcctttaaattctctgtaagttctattaagaaacacctttatttgttcttggctggggataaaaggattaagccaaaaaaaaaaaaaactgtctaggaacaacttgtctcaatgaattgggacacaggaagggagagtaaggaatctctaagcactcacctgctaccctaactcctctttaggtgtttcctcctaccctactctagctagctgcttgatcatccttgaaacagaaaactctttgaaatagaagttctgatgttcacttgtaaattattttgaagtctcatttcagtcccttctttgaataaaagttgatacacccagacacctttggaaaaggaatcagcactctaacttctagtttagaaaatggaaagcagtctattttggcttgcagattatttacttccttgatacaacactgaatacataacgaagtccaattacactggatacttctaagtgctatctaccagagacaaagagttttgatactttttacaatatgaataaagagcactgaatcttaaaaagccaagtgtcataaaaatctgtttatttcaaagtaaaatatctattataaaagggaccagagtgagacttttagatcaacatcattttcctctttattctcccttctcttcttcgtgtccataaactgctgttgtgttaagtgctctcttggctgtggtaggtgctgctatttcgcatttcactggtaggaaggcatagggagtcccgaggaggtgggttaggattgtagatggaatcagtgggcccggttagtgatttgaagtgacagccagtctttgcctgcttcctagccttccaaaccaaggtgtctccatccttcccatcctctgccccagctggccttgtcagatgcttttcctcactgtactgtctcctccctgctttcaggtgctgttaggttccaagcataaaaggttaaaaagaagaagaagaaaagaagtgaattcaatttcagagtttcattttgagttggctgcactgaatcatgttgtattttacacaattcaagtagtaaccaaagacatacttaactctatgaatgtttgctaagggttaaaagaaatagtgagcagcacttcaaaagaccacttttatcagatttactggaagccctgccaaacaattaagtgaaatgaagggttttttctgaagaagagcaaacctacaaacaaaacgaatgcagtcttaatcaagtcttcatgaaagtcttgattcatctgggaactgagttggggctttctgaatcttctctttaggtattccttatgacataatatgatgaaatttggagcagaggattgggattttttggttttgtttttctttgagacctggtcaacccagaagaaaaacaattattacagctttgtcaatacaaatgccttatgaaagtgaaatcgaactcactctgaaccaaatttatggctgtgggcagtttgtcatttattctgacacatttcctaccttctgttactcctcataagataagactttctcctgtttctttggcatagggacaggagcgtaaatgtgctcatcaacatcagcaggaatttattatttttgagagattcctatgacttgaatacatccagaagaggtctgaaagagcttccaatatgaaatagttatctgtttgtcactccatttatattacattcataggctcctttaatcttagtttatctggtacattccccagtgtgttgaccctgaagaatgtgtaatatgaatcctatattgtagacctgatgatggaattaaggagaagttaaactgaggacaggacaggaagactaggagtcatgcccctcattttctagccattagagcataagggactaaagggtgacttttgaacttgagccgtttctctgggattctgacacacctttctgctactacagctgctttcagagtttcattttgagctggctgcactgactcatgttatattttctatgatttaaatgataaacaaaggcatacttacctctatcaatgttaatgactacaggcatatgcgaagtagagagtttagcaaaaactgggaaaagggccaccagccctatcctgcattcaattttcattaaccatgcaacctgtatttttctggatgttcctaatttcagttattctgttttatcaaccctgtaaattcaggcatactttaaaaacccgttatattaatattttgttgggaaatagtcattttggattccttggatggatttcctagacttttacagttgctttaatttctaacttctcctgtgctttctactatggccagttggtttattgtgtctcctattaagtcatctccccctgtaattgcccagagtagactcctaagcttggtgccagatggtcaggtcctctaacttgtgccaaaagagaggcaactgcacaaaacccacttcacttaccttgaaaactcttatctacattatcagactttgctattcccccagtttataccttgagaggagggcatcaaatacccactaagtgttttttctttttccctttaatttttataaatgcttggtaaatagtgctattttgtctttaagtcctgaataacttataagtcagcatatgtttaggatcatcctagaggtgatcattcagcagtactttaaaaattgtgtgtgtgtgtgtgtgtgtgtgtatgcagatagattttttacatttgaatttactgaatctgtgtcctatttcattgttttattcactgatcaatatatttttaagctcttctcttttagtatatgagagtcacaccattctcgttatcagtagcatagtattctatgcagtatttatggtgcattcatagtttattttatatttatctatagatagatatttagtttaaattttcccaaattgttaatatttcaaatgatgttgcagtcaacttctttggacatttacttatatattcttaagtgtttctttaaggtacagtactaaagacggccttcctgattccaaggacatgtacatttataattttgataaactttcattgtcaggcttctcctctgctcatgcaaaaatactgcatgtacacccttatcaaccatccatgggggaatttgtttcttctccttctcccccaatataagatattatcaattttttaaatttatgctaatctatggaagaaaaattgtatttcttgttttaatttatatatccctgattaagaatgaagctgagcagagttttcctatttttcataaagcagtgctctccaggaggattcaacagctaaaggtaaaaccaaaagcttaaaaatgctttaagaaactataggaacatatataattacctaggaataaattcataaagtaaaagttaacagattttttttaccatatgtgtttaaaaagtatgcgtgcaaaaagcatcagaatacagttaaatgactgcctcttcacgtgaggaaggctttgctaaataaggcaaacaaaacactaatactcagaatatataaggagctcctacaaatcagtaagaaaaagaactcaagagaaaaatgtgtaaataaattctttgtagttgaggaatcctgaatggccaatgaatgaaaatgcttaacctgcttgctttttttcccctgttaacaatataaaataactgtcttatgtcaaccatatagatcttcttgattctcttaaacaattatacagattatttatttatttatttatttaaacattaatctgttgctggatatgtaggttgttttctatttttgctatgataattctccagtatgtttatttacacacttacctgacttcttatttggattaaattcctacacattaatttcctaggtcaagtgacatacacatttaaaatcagttatgtattataaaatactctccagaaaggaattaatgagagtggacctctcatcacaaactaccaatacaggcattatcgggtgttgttttttttgttcttgttgttgttgtttttgtttttgtttttatttgagacaggatcacactctgtagctcaggctggcgtgcagtggcacaatcacggctcactgcagccttaacctcccaggctcaggtgatcctcccacattatcctctcaagtagctgctactatggggactacaggcatggcaggtgccaccacgcccagctaaatttttttgtattttttttgtagagctggggtttcaccatgtcacccaggctgatctcaaactcctgggttcaagcaatatgctcacctcggccttccaaagtgctaggattgcagacccgttgtcagtttttttagtcttagcctatctgataggtgaaaatttctatcttatttgaagatttgtttctttaattattaagatttagtatattttaatgtttgtatttttaaaatgtttatatgccatttgcttttattgttttgtttagtaattttcatttattgcttattctatcctccactggtttttctgttggtacctatattgaatatgtgaactctttatatattaatggtatcccttttcttttactgtcacatatgttacaatttcatcttttctgtcatttgactttttattctgttcatggtgttctttcacaaaagttttgtgtggtcatatatgtcagcccttatgttttttagttttggtgtcttattgttattattgttgatatacaataggatagttaatgcacgttacctcagtatacattattttgctacttggaatctatttctagaaaaatgtagaaagttgattaaatatgccacaaggataaccattctcagcgccatgtaagtttgaatatgcagttactctaacttgttttacttatcctaagtcttacttgtcagttttttatacatcatattaacatttctacatcaatttaatcatctctgttcattattttgttatttatatcacttaagatctgtgttttctctattagatcactgttttatctccacattgtattctcttcaaaatgaagagttatgtctccttgtttagatctatcacggtaccacttacctgataataaccacttttgatgatagctgtggtggtgggacccaaaatagatgcccaggtcctagcaggttacatagttcctacaaactggttgtagatcctaccagcaacagactttttaatcatcctttcaccagacttgaccattatatttaaaagagagaatagtacagtgttactatgaaatggatctactatgcatattctcactgctttaaaaatcactgatgatataaaaagagaagactgcactagcttagtgtttgatcttgaccatatagatctaacgtcatgatcaattgctttcagcattttctttgaaatcacataaggttcatatgtgccaaatttcataaggatcacatgataaggtcaagaaatacaaattccaaggcagaatttatatgcccacttcacatatgacagcaatactaaataaccatatgttgaatataatacactgtatgtaaatactattcttgaaagcaatccaatcaataaaacctaaaataaataatactttaataacacatttcaaatagactgaaaatggaatagatggactctatggcaagaacatccctataaaactgacattcagaggccattaaaacacagagagtaaaacaatcatgaaactaaagaaaaactgtgaatatttagaagttttttaaagcctactacactgtatgccaagatacagcagtcgtttttatttaaagagctatttcaataaaagctgtggattcctaagtattaaaaagcaaattaagtttaccacaaccaatagccaaaaatactttttaaaaaatatacaatattacccagaaaattttaaaaatacatagtattaaacagaaaaaaagtctaaacagaaaaaaagtcaaaacagaaaaagctcattttcattataattaggattattaagagactgaccaattttatcaatttaaagaaggttgcaggaaagctactgaggttaacttcaaagatctagaagtaaaaagtgattgtaatgtcagtaaaactcttaaaacagatcaaatagcccctaagtagtactaatctactgtatctttgaaaatgtatatgcttttttttaaagctgacaagattgtccttttttctttgtttttaatatcacattttaaaaaatatccaaccattaaactgtaaacagcagctcagaatacataaactttaccttccctcatttgtgatatgaattcagatttgaacatttttttcctctttgttctggaaaacatggttttgtcatcccacattgtacagtgatagtttatctttttcagcgcgagtgcttgtttactgtatgtgcacaaacaaatgaaacaatgaagcttgcaaacagttatttaaccagtttttctctcatttattaactcaaactcatatatcaaaatgagatatttgtgatgtaactgatgtttttaatttcaattttgtcactttagatcctgggaagactctgcctgaagcccttgattattgcactgtttggctacagacagtgcctggagaaatagacagcaaaagtggtattccaccttcctttataacactacagattaaagactttctgaatggaccaggtaagaaagtcataaaatttacatgtgtgtacattttttatgtgaatatattagcatgtatataggatctgttagtaatcttgacattccgtgcaaaaaatgaatagttcattttttcccagaggtgtatgcttttcaggctgcccattttagagatcaaaaggcaaatataaatatgcattaagaattaccttcagtctgacaaaaaggtagttatcaattaaagaatagttgactggaagccaaagccccaatattttatttctacctttcctattaattaactgtatgatcttaggtgattgatctaatcttctatacttcagttttcttacctgtatatgaagaggatagactagatggatgaatggataggaaacatgatatatatatacataagatagtatacatagatagattagatttgatagttaaatgtacctgtttcacatgcttagcaaagtgcttgaaacatagtaattactcagttttagatagatacagatatcaaaaatttttgagagctaattatgtcccaggcactatgcattttaggagtatgtactatagttattcttattttatgaataaggaagctaagacttagaaaagtgaagtaaattgcctaaggtcatagtgacagaggagccattcaaacctaagtctttatgactccaaagaccagagcttaacttctgtactacactaatttgggcataactaaagtttttttctttattcctcgatcttcctcctctgtcttttcttccttcatctcatgttcttccccctcttctgttatttctccctcacttccgtatagtcttagctatttatttaacaaaaattattacatttcactttttgttttgttattttgtagttacagtgcttcagagtgttacccatggaatgagtattagtttcttccttaagaattttatttaattttatttatttatttatttattttttgagaccatcttgctctgttacccaagccaaagtacagtcgtgcaatcatagctccctgtagcctcaatctcctgggctccagcaattctcctgcttcagcctcccaagtagctgggactacaggtgtgtgccaccacgcccaactagttttttttatttttagtagagatgaggtctcgctatgttgcccaggctggtcctgaactcctaaactcaagcaatccgcctgcctcagcttcctaacgtgctgggattacaggtgtgaaccactgctcctggccattaagaatttaaaataggctgggcatggtggctcacacctgtaatcccagcattttgggaggctaagataggcagatcacttgagaccaagaattccacaccagcctagccaacatggtgaaaccctgtctctactaaaaataacaataaaaataaaaaattagctggccatggtggcacgtacctgtagttccagctactctggaggctgaggcacaagaattgcttgaactgggaggcaaaggttgcagtgagatgagatcacgccactgcgctccagcttgggcaacagagcaagactctgtctcaaaaaaaaagaaaagaatttaaagcaatgattttacaactgtcttaagatctctagcaataccccgcaaggcatgaattttaaggaaggaaaaatatttatatatagactttgttgagtacatgtgttgtggcgtgctagtgtacttatgatccatactacagatggagaaagccagtcatggattaaacagagactgaaaccatctccactgactttgtcactggggacgaattcttcttcagcatgtttttctagtgctgggattgtaaaggtgtagaagtatgaagaactatttctaatcttgataaactctagatatggttttaaatatatgaaggaaagcaagaaactgaaggataagcaagtcattaaagtgtaggaagaagcctttggagtgaggtaatagactgaagaaggtgagtgctagtatttggttagtaagcatgaagtaccatatttcattccatctaagccactagcaattgtaaaaaaacattctatatgccactaaaaatgaaaaaaacatatgctctttacactgtgatacagggcctttttattacatcagtttgaagacacttcctgatttcagagttgttcacacatgaaagactgaacacaatagaatagatgcaatagggtaagaacacgtaattagttcatggaagagtgacaggggaaacttggatttacttatttctcagttttagtttcacattcgttttgtttttaggcacactttgctcattttggctagaaaattatcttgtagtttacatttgattgatttgtttgtaaaacaatggaatttgaaagttgatggtaaattagatacaatattttcaaggcaaccaaatcaattgaattttaagagaaatgccaatgaataaatgaaaaattatgtatttacaattctggcatttaacatgactcagtattagaaatgtgatttttttttttttttttgagatggagtctcattctatcacccaggctggagtgcagtggtgtgatcttggctcactgcaacctctgtctcccaggttcaagcgattctcctgcctcagcctcctgagtagctgggactacaggcacgcaccatcacacccggctaatttttgtatttttagtagaggttgggtttcaacatactggccaggctggtctctaactcctgaccacatgatccgcccaccttggcctcccaaagtgctgggattacaggcatgagccaccgtgcccagccagaaatgtacttttttttttttttaatcatactttaagttttagggtacatttgcacaacatgcaggtttgttacatatgtatacatgtgccgtgttggtgtgctgcacccattaactcgtcatttaacattagatatatctcctaatgctatccctccccctgacccccaccccacaacagtccccggtgtgtgatgttccccttcctgtgtctatgtgttctcactgttcaattcccacctgtgagtgagaacatgcggtgtttgggtttttctccttgtgatagtttgctgagaatgatgttttccagtttcatccttgtccctacaaaggacatgaactcatccttttttatggctgcatagtattccatggtgtatatgtgccacattttcttaatccagtctatcgttgttggacattcaggttggtttcaagtctttgctattgtgaatagtgccgcaataaacatacgtgtgcatgtgtctttatagcagcatgatttataatcctttgggtatatacccagtaatgggatggctgggtcaaatggtatttctagttctagatccctgagaaatcgccacactgacttccacaatggtttaactagtttacagtcctgccaacagtgtaaaactgttcctatttctccacatcctctccagcacctgttgtttcttgactttttaatgatcaccattctaactggtgtgggatggtatctcattgcggttttgatttgcatttctctgatggccaatgatgatgagcattttttcatgtgttttttggctacataaatgtcttcttttgagaagtgtctgttcatatccttcgcccactgtttgatggggttgtttgtttttttcttataaatttgtttgagttcattgtagattctggatattagccctttgtcagatgagtaggttgcaaaaattttctcccattctgtaggttgcctgttcactctgatggtagtttcttttgttgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttagatctaacatttaagtctttaatccatcttgaattaatttttgtataaggtgtaaggaagggattgagtttcagctttccacatatggctagccagttttcccagcaccatttattaaatagggaatcctttccccattgcttgtttttgtcaggtttttcaaagatcagatagttgtagatatgcagcattatttctgagggctctgttctgttccattggtctatagctctgttttggtaccagtaccatgctgttttggttactatagccttgtagtatagtttgaagtcaggtagcgtgatgcctccagcttcgttcttttggcttaggattgacttggcgatgcgggctcttttttggttccatatgaactttaaagtagttttttccaattctgtgaggaaagtcattggtagcttgatggggatggcattaaatctataaattaccttgggcagtatggccattttcacgatattgattcttcctacccatgagcatggaatgttcttccatttgtttgtatcctcttttatttcattgagcagtggtttgtagttctccttgaagaggtccttcacatccctttaagttggattcctaggtattttattctctttgaagcaattgtgaatgggagttcactcatgatttggctgtctgttattggtgtataagaatgcttgtgatttttgcacattgattttgtatcctgaaactttgctgaagttgcttatcagcttgaggagattcacagccgaattctaccagaggtacaaggaggagctggtaccattccttctgaaactattccaatcagtagaaaaacagggaatcctccgtaactcattttatgaggccagcatcatcctgataccaaagcctggcagagacacaaccaaaagagagaattttacaccaatatccttgatgaacatcgatgcaaaaatcctcaataaaatactggcaaaccgaatccagcagcacatcaaaaagcttatccaccatgatcaagtgggcttcatccctgggatgcaaggttggttcaacatacacaaatcaataaatgttatccagcatataaacagaaccaaagacaaaaaccacatgattatctcaatagatgcagaaaaggcctttgacaaaattcaacaacccttcatgctaaaaactctcaataaattaggtattgatgggtcatatctcaaaataataagagctatctatgataaatccacagccaatatcatactgaatgggcaaaaactggaagcattccctttgaaaacggacacaagacacggatgccccctcttaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccatcgtctcagcccagaaatgtactttttacaggagctgtacttttgtgtttcttaagatacttttcaaagttaggaattaaatatatataatttctgattttatgtccatgctgtaatagtgataatatatttagagatttaaacttttaagtaaatgaattgaaatagttattttacagcagcacttctcaaacttgattttgcatttgaagcttccctggggagtttgttaaaatgcaaatggtgatttaatagttctagaaggtagggcttgaaagtcatgtctaaaaagctcccagatgaagtagatgctgttggtctgggactgtactttttgtagcaagttttatatggctcttatcaaacttctttttaaaaaattatacatgacttatcatatatgatttttgtttttagtatcagtcacagtctttgagagccaaaccacagatattttggggaacaggacagggtaatgataaagaaagatgaatggtttttagaatggtgctttgattatggaaaatcaaatataatatccaatgaatgatttaagttcttcaaagtctaaaacattttaaacaaaagtactttttttatttgagagaagattagtttaaatgatatatcagctgtgtgtgacttcttctaaaacactaacctaacagcctgtaactgttccagaatttactagcttagacaaaaattttcctactgtaagcaatttgtgatttagagtagataagtagatgttatttcatagagtaattatattgtctcactacacagccagattggcatgctactacattaatttaggaatcaaatggctatagaagatagtgagacttgcataccactaattaaatgggaataacaggacacattaaaacagcttttaccatacgaatgtattattttatagattttggcaactcaaggaaattttattttttccagctcttagggaataggatactaagaggaatgtcatttatgttgagattgggcaaacaaatttcagctttataatgttcccaataacattccctttccttgaagaaaaagcattacaaaaaaataataaaagcactacaagtaatactttttgtttttaggtaatgacattgtgttatcattagaaatctttagctattattatgttttaatctgtatgcatacctatttaagtatcattccagagaatgtcttgaactatattagtaatttccacctattttttttcttgttctttaatgaagggtatagtaacaatgaaagttatgaccctgaattaaccaggcatggtgatatgtgcctgtagtccttgctactcagagagccgaggtgggaggattgcttgagcccatgaggtcaaggctgaagtgagctatgatcatgctactgcactccagtttgggcaacagagtaagaccctgtctcaaaaaaaaaaaaaaaaagttgcaacccttaaaggtagagggaatactgattataactgcctaaccttaagctttcttcaaaaagatgtaaacttcacagcttttgaaatttagccttttagatgtattttgcagggattattttctctaaacaaggtgatacaaatgctgctctttagcatttgtttttagaaaaataatgtagagttcttgagtattcccctatttcttctgttcacctaatggtaccttaatagagcaaatggtaggtcccaacttctacatcaaaaactctttcaaagctctcccaaccccccaccttttccccttgtacccattagcaaggtcagtggcttggagaaacctggaaaacagcagctaccagaaacccactagaataatatctccagcaggtgatagattagttggaacaaattggaaccattgcagttcggcaatcctggtttctttcaagctgtttttaaaatgtcgtcattttaatacacaatctaaaccctgcggaacagtccacagcaggttaatttgaatcatatgatgtgtcactgccctcagctgacatgagctctattccatgtgtgaagccataataaatccattcccaaccaaggaaaattccccgtgagaaggtgaactaatccaggcctcacactggcatgctagccctccataattgaaagcagggccacctgttcccagcacagttagcctatagaaaaaaattagcattagatcagatacgtcttatattgaaaaatcaatcatacttcttgcaaattcaaattcatctgtgaagtgtttggtatgacatcatacagaaatgtaggaatgtgcccacttgatcccattttaaaagtttttttaaccataggattccttaactttgaaatgcaatttttttttaatttaatgagagctgacacatgagaagaagaactggaaatggtgcagatttttctaattaactcagggttatttgcaaaaacatttgagctctctggtatttttttcattgttctttcacgaatttttgagccactgtcattgtagccatgaaatgacatttaaatgacaacaaagaacaaaaatgccacattgggaaaacattcccaagtcatttatgttttattataaattaatgcttagcatgtcacattcatcatataatttaaataacatggttatatcaaacacaagacaatgaatgcaatttcacatttcttttagtgtagtatatatggtgtctatatttgaaatgcatggccactggtctttttctcctaatagaatcacttctttagtctcaccctgtttaactcattcattaatttacctgtctagttgtcagtgtttctgatttcattctggcttctgattggtttcatctctggttttatttgattttgattttaagaatctgttgacttgaactggttataatcctgttttgaatacagttttctccttatattgtatggattaatgtaactattttataggttacaatgattttcatttctactttaaaataattcctaaacatccttaaatgattgcatttccacaaacctttctgatttgaatgaatatttgtacttaaatgctataaaatagtaaaagagttcttaggtacagtaacacagcattcaaataggtttgtttatatgaatataaagtagaaattttaagttgtttacccccaaatagatgtattttttgagtgcttttgcctttcttggttaaccctgcttttatgttattactgaatttattactcagtggggattaactcagacatatctgaaggtaactgattcaggaggattgagatacctggaaaagattaatcaaatagtgtctcgatttttctggagtagaaaatgaggaataaataatgtgattttttaatctttaaaatttttttcaattgcaaatttcaaatggatttttggttacctatttcaagctttattgaggtataattgacaaaaattacaaacatttaaggtgtacagtgtggtgttttgataaatgtgtcattgagaaatggttaccatattcaagctaattaatatatttatcacctcacatagttacaactttttatttgtggtgagaacccataagatctcctcttttaccaagttgtaagtatataatacagtagtatttattaattttagtcataatgctgtagattagatctccagagcttatacatcctgcaaaactgaaactttgtacccattcaccaacctctccatattgtcccttcccctagcccctggcaacaaacattctaatgtctccttttataagtttgacatttttacgttccatatataagtgaaatcatgcagtttttgtctatttctgtttggtttatttcatttagcataatatcttcaagttcatccatgttgtctcaaacggcaggatttcaatctttttaaggagtgaatgctattctattgtaaatatctaccacattttcatcctctgttcatccactgatgaatacttaggttgattctacatcttgactattatgaattgtgctgcagtaaacataggagtgcaaatatatctcttcggcacactggtttcatttcctttggatctatacccattagtgggattactggatcatatggtagttatatttttaattgattgaggaatctccatattgttttccataatggctgtaccaatctatattcccaccaacaatgtgcaaggatttccttttctccacatccttgccaacacttgttatgttttgtctttttgataatagccattctagcaggaatgatgtggtctttcatgattttgatttgtatttctctgatggttagttatattgagccctttttcatatacctgttggccatttgtatgtcctcttttgagaaatgtctatttaggtctttttcctatttttaaaatttggttctttgtcttcttgctattgtgttgtttgaatttctcatatattttagacattaacctcttatatagtttacagatattttctcccattctgtaggttatctcttcatactattggttgttttctttgctaggcagaagcttcttagcttgttgtaatcctatttttgcttttgttgctggtgcttttcagataatatccagaaaatcaccgtccagaccaatatcatagagcttttcccctgtgttttcttctagtagtttcgtagtttttggtcttactacatttaagtcttcaatctattttgaagcttttgggtttgtttgtttgtgttttttgatttttgagtgacggagtctcactctgttacctaggctggagtgcggtggtgtgatcatggctcactgcatcctctaactcctagtgtcaagggatcctcctgcctcagccccccaagtttagttgacttttgtacatagtgagagataaggatctactttcattcttctgcatgggctagctagctttcccaacagcatttattgaagagaccatcctttccccattttgtgttcttgacacctttgttgagaactaattagctaatacatggatttctttctgggttctctattctgttccattggtttgtgtgcctatttttatgccagtactatactgttttggttatagttttatagtatattttttgaagtcagacagtgtgatgcttctagctttgttccttttgctcaagattgctttggttattcagggtcttttatggttccacataaatttcaggattgctttttctatttctgtgaagaatgtttttgatactttgatagcagtttcattgaatctgtagatcaatagcatgggcacatcaatagcatgagtaggatggacattttaataatattaattcttccagttcatgaacacaggatatctttccattgatcaccgttttatagttttcagtgtacagatttttcacatccttggttaaatgtattcctaagtatttaataatttttttagctattatgaaatgagattgttttcttagtttcttcttcagatagctctctgttagtgtatagaaatgctataggtttttgtatgctgatttttaatcacgcaaattcactgaattctaacagtttttagaatgtattaattctaacagttttctggtcaagtttttaaggttttctatatataagaaaaccttaaatgttataaggttatctgtggagacaatttaaattcaccttttcctatttggattccttttatttctttctcttacctaattgctttgtctaggatttccaatactatgtggaataagagtggtgagaatggccattcttgtagggttctagattttagagaaaaagctttcaacttttccctgttcaatatgatgtgacctgtgaatttgtcacatatggcctttattgtgttgtggtatgttccttctatacctaattttttgagagttcttatcacgaagggattttgaattttgtcaaatgctttttctgcacctgttgaaatgatcatatggtttttgtcctacattctgttaatgtgatgtatcacatttattgatctgcatatgttgatcatacctgtgatgacacccgcttgatcacgagtagatttttaatgtattttaaattccgtctactactattttgttgagggtttttacatctatgttcatcctggatattggcctgaagttttctttttttagcatgtctttgtctggttttcatatcaggctaatactggcttatagaataaatttggaaatatttccctctcttcagttttttggaagagtttgagaagaattggtggtattagatatttaagtactgagtagaattcagtggtgaagtcattggaccctgggcatttttttgatgggagattttttattactgattctatctccatactcattattggtttgttcaggttttctgtttcttcattatctattcttggtacattgtatgtgtcccggaatttatccattaggttattcaatttgttggcatataattgttcatgttattccctaaggattctttgtatcagttgtaatgtctccttttccatctctgattttatttatttgagtcttctcttttttgttcttagtctagctaaaggtttgcctgttttttcaaaagactggttctttgtttctctgatcttttctattatttttgtagtctctatttcatttatttctgctctgatctttattttatttccctccttctactaatttggggctttgtttgttcttgtttttctagttccttgtgttgtaatgtgagattgtttattttagctctttcttcatttatactgtaggtatttactgctggaaaattcccctcttagaactgcttttgctatatcctttaggtttaggtatatggaaacaccatttcatttgtctcaagaaatttttaaatttttcttttaatttcttcattgattcattgatcattcaggagcatgttatttaatttccataaacttgtgaattttctgaaattcttcctgttattggttgctagttttataccattgttttcagaaaagatacttactatgattgcagtcttcttaaatttgttaagacttgtgatctgtcttggaggatgttccatgtgcaattaagcagaatgtgaattctgcagcttttggatggaacattctgtatatgtttgtcaggttcaaatgttctagattgcagtttaagtctgatgtttcctgtttaattttctgtctggatggtctacccattgctgaaagtaaagtgttaaagtcctccactattattaaattgcagtctatctctccctttagatctagtaatatttgctttatatatttagatgctgcagtgttaggtacctatatactacaatgttatgccgtcttgctgaactaatgcctttgtcattatataggacttgcattatctctttttacagttttcacttaaagtatgatataagtatagctacttttactatttttgggtttccatttgcatggaatatcttttttcattccttcacttttaacctatgtgtgttcttataagtgaattgagtctcttgtaagcagcatatagttgggtgtgtttttataatctattaatttgctctttcttttcattggtgaacgtaagccatttacattcaaggtagttattgaaaggtaaggactaagtactgccattttgtcaattgtcttctggttgtcttatggactctttgtttcttcctctcgctgtctttctttgtggttaagtaagttttctctattggtatattttgatttcttgctttttaattttttgtgtatctgcatggttatcatgaggcatatcaaaaaatcttatagttataacaggttattttaagctaataacaatttatctttgatcatgtacacaaaaaacctctactcttatactccactacctccctccacattttgaatgttatttaaaaatttacatatttgtatattgtatattccttaacaaattagtgtcattaatatttttatctttgaacctttacactaaagatataatttacacaccaccattacaatattagaatagtctgcatttgatggtatatttttaccagtgagttttatactttcagatgttgttgcgttattatcatccttttctttcagcttgaaaaaaactccttagcatttattgtaatgcaggtctggtggtgattaactccctcagcttttgtttgtccaggaaagtttttatctctctttcattaaagggcagctttgctagatacagtattcttggtttgcaggttagttaattagtttgttttccagctctttgaatatatcatcccactctcctctggcctgtaagatttattctctgttgagaagtgtgctgctcagtgtattagaatatccttctatattctttgcttctttcttcttgctgctttcaggatcctgtctttgtctttgatctttgatagtttgattgtaatatgtctttgggtaatcttatttggattgaatctgattgaagacctttgagcttcttgtacctgaatatttatatatttctccaggtttggaaagggttctgctgttctttatttacatatgctttctacccctttatctatctctattctctcttgaataccagtgaccaagaatttacccttttgatgctgtcccatgaatcctgtaagctttcttcgttcctttactgtgtattttttgcctgtatattttcaaataatctgcctttgagttcatagattgtttcttctgcttgatcaattctgctgttgatattctcttttttatctttcatttagctcattgtatttttcagctgtgggatttctgggggtttttcaaattattctttcaatctcttaaatttctcattctggtcatttattgtttttcttatgttgttgaattgtttatctgttttcctgaggcttattgagtttccttaaagcaattattttgaattacttgtcaagcagttcatatatctctatttttcaggggtcggtcactagcactctattttgtttggtgatgtcatgtttctagttttgtttttttttattcttgtggtcatgcatcaatgtctggatattgaagaagtaggttcttattccagtctttgcagtctggctttgtctgagaatgcccttcaacagtaagcctgtctagaactttttggtcatgttgtctggcattgtccctaagtccatgattgccacagccatcaaagctctagagggcaccctacacccaggcctgccacaccagcccaacaccaggatggaatcccgtggccaccaaggttggcacagtgctggggcatactcaaagcccatggccattcaggtttgtctgaaaccaaaggccttgtagacagctggtagtgattcaggccagtgatcaagtctatttcataggggctatgggatcctgcctagcactgggacaggtcaagaggctcagtacatgggtactgacctaaataaggggctacaagagtctgcctgatgctagattttactatggcaggcccagtggtggagaccaagacaaagtcttacattcacttccttctagttcccccaagcagacggtgtctctctgaatttgctacttggggataggggagagttgacacagagaatgtccttcctactctcttaagtacatcttttcatattattatgatataacaaggtactgtgatcgctcacctcatttctttagctcttgtgaaggtattttcttgtgtgaatagttgttcaacatgatgttgctatgaggggatgatcgctgaagagtcctattccaccatcttgctccaccctcataatatgatttttaaatgcaagaagattcaaagcaaaataaaatattttaagaagctaattttgggctgggtgcagaggctcacacctgtaatcccagcactttgggaggctgccgtgggtggatcacctgaggtcaggagttcaagaccagcctggccaacatggcaaaaccccatctctactaaaatggacgtgatggtgcatgcctgtaataccagctacttgggaggctaaggcagaagaatcgcttgaacccaggaggcagaaggtgcaatgagccgagatcgtgtcattgcacttcagcctgggcaacaagaacgaaactccatctcaaaaaagaaaaaaagaagcagctaattttaataatttatttctgttcatcttacccaaaatatcatttttaaatcatatttaatcctctgccccttctctcttgccagaaattgggctaaggcctataccttaatcatgagagtcctgcctctatcttaattcaattttacagccatgctagcaggctatcttctacatttaagaaatgtaaactagttaatgaaactgtaaggaccttgacttttacatttcctgaattttatgggttccaatttccagtgtcagtgctatattatcatagtttgttttctctgtgatttatcaaaatgaaacagtaaacttgatgtcagaatgtcaactacggaatggaccaagaattttaaaatagggaaaagccttccattatttcaacttttgtttttcaactataacttttattttaggaagaaatgagaaaaattacctagctgaaaatggtgccctcaagggtttacacctctgaactacttggctaagtaatagacctcaaagagtcatagaggctggttgtgcagttggcagggaggtagggggccagtactaggtctcatgcagagaagtcagtagagtcgcagtcatttagatttttttttatttcttcatctagcctaattctgttagaattatttcttctacagaaaagagtgagagtaattgggaaatgtcttcctaggaacatggagtaagccaagttagaagagataaagaacattttctggcttatcctaactctaactttccaactttctgcctgcagtttttttccttactctccagccccatgcctttccattgacacagtcttgagccttcctttcttatccctgtacaatagtctcttttatgccaacaactcccaaatgcagctcttttgacttaatatctaactctaagactatttctacatataggtattaggtatactttgttatttaaacatgttcacagtaaattaagccattttctctcttctctctccttgctcacttcttcctttatcatagtcttcaaacttttttttacaactgctgatgataggaaaaattttctggtcatgtcctctcacaatttactaccatcttcaggccattcttatttttatttcaagtccttctacttttttctttgaaatagtcctcaattatgcctgctacttctctggtgtaggcttaatccttgattacttcctcattctgtttactggtagcactaacttcagattctcttatttactcaataatgctgtcttctatgcccttactagatttgcctcccctgccaaatttatttgaatcttaactacccccttcctcagttgatccagtcaaaactctcctcagcccccaaccctttgtgcacctgttcactgtatttcttacatataaattgcttatttggcttaatctgattctgttttttttttttaagaaaaactgttttgcaagaggttttgtattgctctatcaggaggcatataatgtccaaaggtctctctttttgtgatgctagcacccattggtgctcaatgcctacatttattggaggttgtaaatagtaatattctaattctagcattccttttccatatgttagctggcatacttctttgaagagaagcattccccaacctactatttgagtattcagtagtattgctcattcaaaaaagcaggataaatgcttaattctttccctttatttaccccttttcaaaaatgagttcattctctagcatattccaatggtggccagttagttgatgttgtttgatattattttgaactcattatttttaataattctcaagttgtctcaccattggcagtgagaatctctataaactggcttctctatgttttaaaccttgctgttttcttagtctgcaattcttacaccctttttctttgcccactctaattctcagctgccattaggttagcctaagtcttgttttcttctggaatagtttccctttcatttccattcatgctgatctctcctttttcataagcagattagtaataccattttcactaaatttatctcaaaaccacttttggctgtttctaaaaatcatgtgtgtcatcaaggatgagtatatgccatcattgaaatagtaaaacaaacaaaggatgacataggcaccaaaaaagatacaaaattgttggagtagtggaatatagttatcccttatggttattactaagagggagggaaacttattttgatgagtttagttcagtacatttactttagaaattggtgcaattaccctataattagaacttttgtgttgtgatttggggaggattatgaaatttagaaagtcaatgtttgatcataaaaatacgtttctgagtaattttgctagtagtgatgatgtccagatcccagtgataagtatcatgaactgctgctgacttattcaggtcaagaacctttcatttcatgtctctgagcttcctcatagcacataagacagcatgtagcctgttccactttgtataccatcattaattaaagcacacgtctgccatcactgaggtctttacacttcacaccttcaatgaaagcacattaatctcattgtcatggacagctttccaggttttctagctcttatacctgtgaatactccgtctcccttgtccactgtcatcatgaatacctttacttgaacactataacaaaaacctgaatttcaattgctgaataagagaaaaaaatattatgacctagtaataattttttaccagagttattataatacataaggtcaaccttgattatgggtttgttagttctgtgttttgcatttactaagatggtgaataaaaacatcatttctgtgtctgtacatagccacccgtgtatgcactgaatgttttcttgtaagtcttgcttgtctaaaaaattttttatcttttgcaaataaaattccacaggaagaaacacttaacaaagaagttttctttcataaatgttatgatttgagtataacaagccatattgaattcattgggtttttggtaatagatttcataatacatcataaatgtaagtaatatgatgactaatgggtcaagtaaagttggaacattttaaatgagaaaagagctggaacagttctcaggaaacttttccagttgatgtttggtcccccacaaggtgtgcattaacataaacttatgggaatcacctctggggcttgaattccctctctgatttcattattacaatgtgatacttttcctttcactattaagtcatcctctaagatgataggagcataaaataagtataatttatttgcatttgtctaatcttttaactcaatagtcattccatcattctgtttcctggtagctgttcagaaagttttgaatggtaattaggatctaataattggcaggcatgggtttacttaaagatacagaatatgttctgaaaatggtgagaaattagatctggcagagacatagatgactcagctgggagattctctattactgcatattcctaaaatcaaaactttgaaaataatccatttattaaagttcaatgaggattataacacaattctaaactcttaaacataagtatctgataataattggaataaaatttatagtaacagtctgtgcctggttccctatccagttatatttccagttcctgtaaaacattattctttatagctccccctgtgtctctgttgaataaaactgtcctagtccatttctttaatgttgtatcttaatgatcagattaatatttttatcaattttttaaaagtatcaaaaaacaaaatgtggcttgctcaatttttacttttattttttaagttaaaaaataccagacactatttttgcatatttttttctatttgtaaaaataatcttcctgtcattatcagactgaaaatatttgcaatgaagactaattttctaccaaaaaactggctagatcaaggatgtgaaagttcagagaaacatgttgatgtactttatacaacaataaacagtgctgtttcacttgtgatggttctcattctggtgcgtgcctcctgtcttttggtggacctggtacttttgaaaggaatacctggtattacaatatagcctaatttcaactgcttttttggttcttggcctatcatcttttccaacttgcccaactgggactgccctagccactctgttcacacattgcacagaatatgttttgcaagaaatgtggctcagcactgtctctatgtggtccagtccctccagggtgagggactttgtggcctactaacgtacgtcttgtacagaggttgcactgtatgccctgtatggaaacaaatatacaaaaaacatttgaaaagtgaattacttaaatgtcttaaatagcaatttgtttcttattaaaccttaacagaatcatgtgagtctaggagtttgagtctgcagtgagctaggatagtgccaccacactccagcctaggcaacagaccaagaccctgtcttgaaaaataaataaataagttaacatagcaactgtttgggaatacatatagctctgctagattttcaaacgttctaaaaactttcatcaactgctgctcagtgactgagaggttgcatttgtaatccttaattactaaatttaaggtaatcaaaagaattaaattttgatacataaataacacttttgacataaccttataggaaagatagatcaagtgaccaagtgtccaaataagtaactcccttaccaatccactggtctgagaaagggtcgtccagaaaccagcaccacaaaaagttaacattaaaaattcactgttcaaattcacaaaacaaaataaatctataaaagatttaaataattaaacttttcaaatgatgttttttaaatcagcctgcagcatttttatgctgctgaagttattaaagtttaaaatcacactgagacttttgggacaaactatgagagacagagatccaagattgcttcagatttttcctaaaatatttagtgctgtccaagcatggtggctcacactttaatcccagcaatttgggaggccaagacgggtggattgcttgagaccaggagtttgagaccaacctaaccaacatggcaaaaccccattctactaaagatacaaaaaaattagccaggcatggtggtgcatgcatgtaatcccagcttctgagatttaaaaattaggctatctaaaaattagattattttctcattgctgagttataatacttttttatatttttttgatacaagtcttttgtcagataagtaatttgcagatattttctcccagtacatagcttctcttttcattctcttaacactaccctttacagaggaaaagtttttaatctgatgaagaccaacttataaatttttaaaatatgcctttttggtatcatgtataagagactcagtacagagtttctctgtactgagctgcctggagatggggctagggaaggtaacatcagcattgtggtggccactgtgctgagtcatacctgaagccagcacagcactgggcctcacccaaggcccgtgataacccctgcctggctatccgcctgtgttcactcaaggtcctagggctctataacctgccaggcttgtgtccctccctataggacactgaaatttctccagtcccaggtacgtccagagatgctgtccaggagccagggcctggagtcagaaaccttaggaatctacttggtgctccattctactgagaatgagctgacacccaagccacaactctaggacttgaagattttctcctatgttttcttctttgaagaccttctaattttacattttatatttaaatccaggattcattttgagttaatttttatatacagtatgaagttgagtttaaggtacttttttttgtatacagatattcaacaccatctgtaaactacctttctccattgaactgtctttgcacctattttaaaaatcaactaataattctttggaccctatttctggactctgttctgttccactgaggtacatataccctctccaaaactatactgtcttgatcttaatagctgatagtaagtcttaaaatcaggtagtttgagtcctccaatgttgttattctttctcaaaaatgttttggttattcttgttcctttgctttactatgtaaattttagaatcagcttttctatatttaaaataaatatttctgggattattggaattctgtgaaatctacagatctgggagaaactgatatatttactatgttgtctgccttcgaattcatgaatatggtatgtgtatggtatgtctctctatttatgttggtcttttaaaatttattgtcagcattttgtagttttcagcatacagatcctatgaccatttgattagatttatacctgtgttccttttatttggatatgttataaatactatcttttattttaaggcttttttgttttccacctgcatattgttagtttatagaaactcaattgatttttgtgtgatgatcttgtattctaaaactttgccaaactcacttattaattctgggagcttttccgtagattcttattgggttttcaacatggacaattacgtcatctgcaaatgggcatcgttttctttgttatttatgcccttttatcttgccttgttgcactgtctatgatttccaatactatgttgagtatgaataataagaagggacatccttgccttgtttctgttcttagggggaaagcattcatttcttcataattatgatgttagctgtaggcttttcatatatagccttcatcaggttaagtttccctctaccaatagtttgcctagagttattataaatggatattgaatttttcaaaaatgttttctgcatcaattgatagtatctttgttattgttgtaaactgttaatatttttacattgattgatcaaggcttatagtcctaggacaacccctgttttagttgtggtacatcattagttctgtatgctgatggatttgatttgctacattttttgaggatttttatgtctcttcttgaggaatatccatgtatattgttttttatactttctccatctacttttagtatcggtaatgatggtctcataaaatgaattaagaagtattctctcctcttctatttcctggaggacaggggaatgaagaaaagaaagaaggaaaacaatagatttccctagtccctctgagcattaagagactccttcacactccttgaagccagaaatagagggcttctccttgaactctctctatctccacatgatatccacttctgggctttgggctgccattagtctaggataagggggtaggggaggaaaaattagaaactcatcaccattttggtagtattttgaattctagtcttcttccttagtctacctgttaccatatacttttcaaaattctcaaatagctgctctgtgtaggttttatagctggtttattgccagattttgtaactgcattcagtggaagagacaggttccatcattcctagaactctgaaataatttttaaaaagaaagagtaggcaactgacatcattagatgtttatttggtttttgggttttttgtttgtttgttttttgttttgagacagagtcttgctctgtcgcccaggctggagtgcagtggcacgatcttggcttactgcaaccttcacctcccaggttcaagcaattctctgcctcagcctcccaagtagctgggattacaggcacctgccaccaacctggctaattttttgtatttttagtagagatggggtttccccatcttggccaggctggtcttgaactcctgactttgtgatccacccgccttggcctaccaaagggctgggattacaggtatgagccaccgcgcctggccccattagatgtttttaagatatattagatatttttcctttcaggaaagagataaacaaaacttcaataaatatacctaggtcttgaaacttcattttaattgcttttgaaactggaaatgccatgtgggcaatatgcatatggaatttgtattagttttctattgatgcataacaaattacgacaaatgtagcaacacaaatttatcatctcacaattctatggttagaagtctaggtgagttcagctggttctctgttcagggtctcacaaagccaaaatcagactgttagttggcctgggttctaatctgggggctcctggaaagaatctactttcaaacttattccagttattcacataatctagttccttgtggctttaatattgaggtctccagttccttattagctgttgtccaagggttgccttaagccctagggaccacccattcattctcattgtctcctctgattgtgtattttcaaactcactaattctttcttcagcttgatcaattctgctgttaagagactctgatgcattcttcagtatatcagttgcatttttcaactccagaatttttgcttattttaaattatttcaatctctttgttacatttatctgacaggattctgaattccttctctgcattgttttgaattttgctgaatttcctcaaaagaactattttgaattctctgtctgaaagaaaggtcacatatctctatctctccaggattagtctctggtaccttagtttgtttggtgaggtcatgtttgcctggatggttttcatgcttgtggatgttcatcagtgtctgggcattggatagttaggtgtttattatagtcttcatggtctgggcttgtttgtacctgtctttcttaggaaggctttccaggtatacgaagagacttgggtgttgtgatctaagtttttggtcactgcagccatatctgcattagggggcacccaaagcccagtaactgtgtggctcttgcagactcacagtggtgccaccttgatggtcttggataagatccagaagaattctttggattaccaggcagagactcttgttttcttcctttgctttctcccaaacaaatagagtctctctgtactgagctgcctggagctggggctaaggaaggtaacacaagcaccgtggccaccacaatgctggtggccactgtgctgagtcatacccgaagccaacacagcactgggcctcacccaaggctcatgataacccctgcctggctatccgcctgtgttcactcaaggtcctagggctctataacctgccaggcttgtgtccttccctacagggcagtgaaatttctcttgtcccaggtacatccagagatgctgtccaggagccagggcctggagtcagaaaccttaggaatctacttggtgctccattctactgagaatgagctggcacccaagccacacacaagaaaaagtccttcccactcctccctccactttccacaagcagtggagtctctccccatggccaccaccatcccaggcctgcagcgagtgctacgtggctaccacagatgttcccacaaggtccaagggctcttcagtcaacttgtggtgaatgctgccaggcctgagactctcctcaaggcaatgagctcccctctggcccagggcagcccagaaatgaaatgccatccaagaaccaaggcctggaattgggaatcccaagaacccacttggtgctctttcccactgtgggctagctggtacctaagctgcaagacaaactacccttcacttttctatctccttttctcaagcaggaatccctccctatagccatcacagctgggaatgtgctgggtcacagctcaaaccagcatatctttgagtgtctcacccagggcccatggtgagtattgcctgggtgctactgctaattatttaaggcctaatggctcttcagtcagcaggtgatgaatcctgcaaggactgggtccttctcatcaaggcacggttcccttctggcccaaggtgtgtctacaaatgtcatttgggagctagggactagaatggaggcctcaggactctgcctggtgccttatcctgctgtggctgagctggtatccaagctgcaagacaaagtcccctttactctccctctcctctcccagagctgcgagctgtgctgcctggattggaggaggggtggcacaagcactcccttagctgccccatctggtgtctgactggattgcatgccccccaagttcactggctcctagcccagcacagaaccaggacttaacccagaattgcagttcttgtggcctagactgcctttcaggtttatttaggaccccagagcactttagcctgcagtggcaaggcttgccagaactcaggttctgcccacaggatggttctcctgtggctagggatggtctaaatactccctctgtgggtaccagctgagctctgcctggtattgatttccactgtaacagggcagcatgagttccaatgccaagtcccacaatcactactctctcccgcccacaaatgcacagattctctctctgtgccacacagccacccttgcggagatggaatagggttggcatccacagttcaagactgtctttcctaccgtcttcagtacctctttcagtgatacaaagttaaaaacaggtacggtgattgcttacctgacttttggttcttgttaagttccttttttttttatggataattgttcattttggtgttgctgtgagcagggtgattggtggaggcttctatccagctgtcttgctctgcctccctcttggcctagccttgtgaatgaacttcttggagaaaatgctgaagcagtatcccaatgattaaactggcaaagaaagggtacattagataaagggaacaatatgaacaaggcctagtgatataacagcatgggttgggggaagtgggctctgcaaactcagatattataaggaaaggcaagaactctttcttgcttccttgcttgcttttttttttttttttttttatctgaggagcttgttcttttgtttcttaggtaaggaggaggcaataaagagttttaaacaggagtgagccactcagaattgcatttaaaacaaattatttggaaatcactctgtggagactagattaaatctaaagacaattggtctagacaggggaaccatttaggaggctttataataactgaacgatatcaaaaacatggtggaggaaaatagggactggatggaatgctggagagaaggggattggaatcaagcaatgttttggaactaaaattgacagaacttaatcagtttttggcttgggaccagataaagagggaatgaaatgaggagtcaaaaagtcagatttctgactaaagccacttggtggattatagaaccattaactaagacagggaatacagcatgtctgagaggagttaatggattgcttggataaattaatttgacgagcctgtgagagttcaggagaaaatggcgacagacttgcattcactcatattttcttcattacatcattaaacattgtggggccataggcttttggccccctaaaggttatctgaaaatcactgacatgtggcagattgattaatagaaaagccatacaaatgtatgtaatgtatatacatgggagccttcagcgtgaacatccagcatcccaacaaggtacagaagcttatatatcatctcgaggtcacagaaagaatgaggcttggatcctggtaaaacaggttatgggaagggatagaacagaaattctattgaggggcaataaatgattactagggagaatgactggatcagagagcagagaataacttgtaaatagttatctttgtaacttaaatgaccttgggatagtcactatcttgaaaaagggactgttcaggtgtggttacatttttggtcttctttccggtaaagaataatgagataataaagaggggaacaagaacaattgttctccttggtggggcggtttcatctttatatagatagcagaaatgtctcttctagtacttgttaatctctaagagtttttaatttaaaatactcatcacaactgggaaccatattttgaaatgaaatatttttacctccttcagcattcagttagtacttcctgtagatcaaacagtagtttaggtatttagaatattaaaatataggacagtccaggagctcacagctcactgaactatgacagatacctaagtaggtaactacaaaaataatatcagtaggtgcctggtaatggcaaaatgcacaggatattccaaaagtaatgatgagaggcacctcactcatcaacaagggtcaagaagggtgtgctggccaaagtgatccaaagtctgagtctcaaaaaaaaagttagcgcttggcacagtggtgcacacctgtagtcccagctacttaggaggctgaggcgggaggatcacttgagcctgggagtttgaggccaacctgggcaacataatgggatccaatctattgaaaaaagagaaagacaagttaagcaagcagccagagttataaatagtttttttctgtgtccctgggaccacaatggtgcctgagatatgagggtagcaatcagcagctttagtatttacctctctatggatgctttgccagtctgcagtcagggaaaatggatcccttaggttcagcagttggtttatgtggatatttgggcaacctcctgggtaggttactaaattgtttctacagaatgagtacttctgacccttctttagttttcattttatacacccaagaaaaagacagtttcaggatcgaacatctgagtcttctttctactttagctttgttttgtttttgttctaatgatcatctgttaaaattgcaccttttttttattgttgttaaaggtattattttctgtgaggtcatagaatttggaagcccacatacagggatgcagaggcaaatgtgtgagtcattttagccatccaatttatctaaaatatttttcccaccagcctcttccagtaccccaaattctacaagtcaaaaataaaaataatgcctttcaacaaatgttgctgacataactagatatccacacataaaagaatgaagttgaacccctacctcatacagtatacacacagcactaattcaggaaagatcgtagacttacatttaagagataaaactgtaaaactcttaaaagaagacataggtgtaaatctttgtgactttgggttaaacaatggtttcttggtatgacaccaaaagcacaagcaaaataacaaacatattggactttgcaaaaattaaactgttttgtgctgcaaaaaagtgaagataatccacagaatgggagaaaatatttgcaaatcatatatctgatacaatatttgcaaagtatatatctgatatgatatatctgatatttgcaaatcatgtatctatatatatcaaatataataatcttatattttatatccaaaatataaaaagaactcctacaattcaataataaaaggacaaataaccaaatttaaaaatgagcaaagggtttgaatagatatttctccaagaatatatacagtcaataagcacatgaaaaaatgctgaacatcattagtaattagggaaatacaaatcaaaatcacaatgggatagtccttcacgctcactaggataactgcagtcaaatatgtcttagcagttccactgctacgtacatatttcagaaaattaaaaagcaaatttgcacacacatattcatagcagcattattcatcatcaccaaaaactggaaacaacccaaatgtttattaactgataatggataagcagaatgtgatatatgcttatgttgtaatactgttcagccacaaaatggaatgaagtattgatacatgtttcaacatggatgaaccttggaagcattatgctatatgaaggaaaccgggtacaaaaatcacatattatatgattccatttctatgaaatgtcctgaataggcaaatctatagagacagaaagaaaattagtggtttcttggggctggaggggagcatgagtgaggagtgactgctcagtagtatgggatactgtgtgtgtgtgtgtgtgtgtgtgtgttgattatgatgttctgggattagacagtggtgatggttgcacaaacttgtgtatactaaaaacaataaattgtatgctattgaaaggtaatttttgtggcatgtgagttatatgtcaataaggtgttttaaaaaataattcctttacattaaggtgtttttcctgtttaaaaacatggggagaaaggaacattttagtattgtgcacgggtgactcaagtttctgaccctttccaatgcacaactagctgtaaacaagactcagagttttgttaggcctgataagaaaatacagtgtcagccgctgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaagttggataaagagtcaagacccatcagtgtgctgtattcaggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacagaatggtaaagggatcaattcaacaagaggagctaactaccctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctgtgcaccaagcggacctaatagacatctacagaactctccaccccaaatcaacagaatatacatttttttcagcaccacaccacacctattccaaaattgaccacatagttggaagtaaaactctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccagtgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagaaacaaaaaaacccttcaaaaaatcaatgaatccaggagctggttttttgaaaggatcaacaaaattgatagaccgctagcaagacttataaagaaaaaaagagagaagaatcaaatagacacaataaaaaatgataaaggggatatcaccaccgatcccacagaaatacaaactaccatcagagaatactacaaacacctctacacaaataaactagaaaatctagaagaaatggatacattccttgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaacagggaatcctccctatctcattttatgaggccaacatcattctgataccaaagccgggcagagacacaaccaaaaaagagaattttagaccaatatccttgatgaacattgatgcaaaaatcctcagtaaaatactggcaaaccgaatccagcagcacatcaaaaagcttatccaccatgatcaagtgggcatcatccctgggatgcaaggctggttcaatatatgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaaaggtattcaattaggaaaagaggaagtcaaattgtccctgtttgcagacgacatgattgtttatctagaaaaccccatcgtctcagccccaaatctccttaagctgataagcaacttcagcaaagtctcaggatacaaaatgaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatattgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaaccaccatcagagtgaacaggcaacctacaacatgggagaaaattttcaccacctactcatctgacaaagggctaatatccagaatctacaatgaattcaaacaaatttacaagaaaaaaacaaacaaccccatcaaaaagtgggcaaaggacatgaacagacacttctcaaaagaagacacttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctaaaactagaaataccatttgacccagccatcccattactgggtatatacccaaaggattataaatcatgctgctataaagacacatgcacacgtatgtttattgcggcattattcacaatagcaaagacttggaaccaacccaaatgtccaacaacgatagactggattaagaaaatgtggcacatatacaccatggaatactatgcagccataaaaaatgatgagttcatgtcctttgtagggacatggatgaaactggaaaacatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcactgggagatatacctaatgctagatgacgagttagtgggtgcagcgcaccagcatggcacatgtatacatatgtaactaacctgcacaatgtgcacatgtaccctaaaacttaaagtataataaaaaaaaaaaaaactccataccaagaaaaaaaaaaaaagaaaatacagtgtccccacatgaaggaaggaacacttacaagggatgggaccctgagagagcctgggtatccaggagcgaagccaaagatcctgatgtctgaggaaggtgagaaggggccctgctcatgaagatgtagaatattaagtatgagtgaatgctgtaatcaatcatgaagccttgatgagaacttctgggtagtccacccagaagtccaactgctgcttgtctcacctgtgccaacatcctggggttgaggagtggagcaaatgttccatttggctgttgcactccggtccaccccgtgtacccttccttcagaggcgatcgccatggctgttaggccttgaggcagaagtgcccacgcacggtggcgagagtgccatggacctctgccacagtggattttatggttgcgggacctcggtgccttcctgtgcacagctggcactcttcacgccgtgtctctgatgacttggtagtagagaagtccctcaagtccttcaaggacaagaacaagaagcttgaggaaggcggccaagtgtacacccccaccccacagaggtggtggtgaataagtcgctcgggcagagggagctggatgagctgaagcgctactgccttggcttctgcctgctgtggatccatgccaagatcgtggtgctcatgctgtggcacatccttgacagccacaccctgaccaggcaaagcgcaggcagtttctccggatccgcgccgacctcctccgcttggtgccgttccttgtgttcgtggttgtccagttcatggaattcctgccgcccgtgaccatgaagctcttccccagcatgccagcatccacgtttgagacccagtccatcaaggaggagagcctgaaggagcttcgggtcaacctggagctggcagagttcctccaggacaccatcgaggagaggaccttgaagaacatagcagccaagggcagtgccaccagacttctccgttttcccagaagatccgggggatgggggagagacccagcaatgaggaaatcatgcgtttttccaaattatttgagaatgagctgaccctggacaacctgtcacggccgcagctggtggcgccgtgcaagctgctggagctgcagtccatcggcatcaacaacttctgcggttccagctcaccatgtgactgcgctccataaaggccaatgataagctgattgctgaggaggggtggacaacctgaacgtcaaggggctgcagccggcgtgtgggaagtgaggtatgtgggccctccgcctcagctgaagcagtgtctggacctgcacctgcatcaggagattcccatatcgctactcatcctgtcccagacgatgtacctcccagaaactcttgccagctgaccagctcaagtccatactgcagactctcccagagattgtggcaaaggaagagcaggtgaaagtggctgaggtggagggtgggcaagtgcacaaggtaaagctggaggtcacgctgcaggaggaggcagccatccagcaggagcaccacaaggagctgcagaagcgctcggagttggagaaggatgtcgcgcccgaaggtgtggaagccacccctcgaaggccaggggcctaacctcagccagaagtgcctgaagcagtcctgtggtcagagaccctgaaggacactgccccctgctagagagcttgaaggagaaggagataactaaggaggaaatcgacatcctcagcgatgcctgctctaagctgaaggagcagaagtcgctcaccaaagagaaggaggagctggagctgctgaaggaggacgtgcaggactacagcgagaacatgcaagagatcaagaaggaactctcaaagactggtaggtgaagaaaaatatgtgaaagcatctaaagccaccaagagactgacagagggtgcagcagatgatcgggcagatcgagggcttgatctcacacctggagatggaccagggcctgcaagctgggcctggcctagggcgcgcccgtaggggagaacatcatcagtgtcactgagctcatcagcaccatgaagcaagtcaggcacattccagaaagcaagctcaccagcctggcctcagcactggatgaagacaagaatggcaaggtcaacatcaatgacctcatcaatgtgattgagttggtggacaaagatgttcatgcctccaccagccaggtggccaagattgtagcgaccttggagaaagaagagaagatggaggagaagactgagaaggaggccgcagaggtgaagagctagagctgctggcctagccacctgtcctcctgctgccccactgccctggcgagggccgtgagagcaattgctttgaggtgattctcagtggctcatctaatacattggctggaatgaatcagagacttccataatcaagtaaattttaattttcatcattccatggatattcacttagtctggaatcccagaacccctccacagaattgtgttggaaccacactgtggtgtggtgcagctgctgcagctgcctgactccagaggccactgggccaggctagggcaggaaggtgcccccttgtgtgtgtcctcccatctcggctgccctgcccccagggaagagaatgaggaccacgcggactctgcccacacagagctgtcagctgcgcccaccctcagaggttcatgagacacagcccagcctcctcggggctgaagatgcctctgttcatctgtgaatcttgatttctagatattggtgtcaatagatctctcttcctgcacacacagaaaaataatattacatatgatttataacttaataataatatgcctaataactttgctagtcctagcttcatttgggattatgtcttctgttacatcctcagggtgtcatgaaatgagcacttgttagggtcagttaagctcaaacatttgttgaatgcatgcatatgtaagacacattgtgctaagcactgggttttaaagatgtgtgacatgctctgtcttgatgcttatagtcttatgtcttattaataatagaaatagagtgattttaggtgaaataagaaggttaaaaacaatacagctagttttcatgtcaggtaagtaagagacaaataaggacaacatgtggtatatggtacatataaaatggactacagatttaaagaaatctcagtctaccaatgttacattgggcaaggtatttgaacttttatcaatgcagagtgtagggaaaggtacagggactcttctggtttgcaacaggtcataagggggaaacagacattttctgcatgaacaattagagaattgtagggatacttggataaatatttattagtaataccattatttgtgtcaaacatggttctgggtagtaaggaaagtcttttttttttttttttttttttttgaagaaaggccagtttcatataggtaacaaactggaaaacctgcttcattttgccttggactataaggggcagagtggaaattgacagccttgatatccttgtgtggccctcgatgtatcagggccacacatgtcacaaggattggccaggaatgtaggcatgtaagtagtccagggagagtgctccttcaagtaacaacatggaaagaatcgttaagtgatgagtaagagatatatcatgttcaggcatcctaatgagtccataatatggatcttgggacacttttatgtaggagcttgtcagagaagtaaaggcttgtattcagtaagaaagcttcaataattgttttctcttttttacttctatagcggatgtcaatttggatatatcaaagcctttgaaagcaaacctgagtttcaccaaactggatcagataaacctttttttaaagaagataaaaaatgcacacagtttggcacatagtgaagagacttcagccatgtccaacaccatggtgaataaggatgatcttccagtctccaaatattaccgtggaaagttgtctaaacccaaaattcatggtgatggagtgcaaaagatttcagctcaagaaaacatgtggagagctgtttcctgctttcaaaaaatttctgttcaaactactcagattgtgatctccatggaaactgtaccccataccagcaaaccatgcctgttagcatctctctcaaacctcaatggaagccttagtgtcaaggcaacacaaaaagtacctggtaagtcacagaaaaggggaggggggagacagaacaagtaagatgatttgttaacatctgaaaatgcatcattttgaagatttatattatgtagaagttaaaagttgtaaaggccattagagatgaggacatttctggtttgtgaccttatttttagagataattttagaacaaatcctttaagtaatgtctaaacagaaatgttcctgtcctcttgaggcatgttcttccaggtatctaaaactgttaattcctaaattcctttttacctaaaacagctatagtggaacaacagtatatcaagttttatgaaccataagaagagtgtttctcaaagtgtgatctctggactagcagcatcagcatcacctgggaaattgttacaaatgcaaattctcagaccccacccatgacctactaaatgcaaaactctgggcatggagcccagcaatctgtgcttcaacaagccctataggtgattctgatgcacagcattaagtcactggtaaccatttacttaaaaaagaaaagttggtgttgtggcagatatgctacacaaagtgtaacagaagccaaggttcaactttgcaagaatgctgttgaggcattttatcaggcagcaacacctggcaacgaaaagctgtgcttctgtgcctagcctagcaaagtggggtacagactctgcaaagtgactgccattgatgggaggatatgtgagaaatcaactggcagtgacatctacattttccacttctgttaccatgactaaattgttatatactttttcaaaaagcatgggaagtgtgggcagaaggattgtgaggaggggaagaggaaaggcaagacacaggtgggaaatagcagttttcaatcacagaaactgctactgtaaaatttcagggcacagggccagaaatttggctctgaaagtaaatgtagcaaaagggaaccatgtattttccctctttaatttgtggggggaaattggggattggggatagtgcaggggataaagcaaatccttatatgcaacttagttgcttatcaaaaagtaattaaattgcagctgtagacttactgtaacttagttccacatagccaggttgggcacagtagttaaaacagaaaggaaaagttttatagttgagaagcctgaattttaggccaaaacatagatgatttatttctttctcactagaaatattcgtgaccaagccaactaaaagttctgtattttgtttaattgtcttaaaagttacaagtgaaaaaggtaagtaaagttcatgggtcatgaaagactatgaaatactggagactacagtatctgatttatccacaaataaattgcaacccagacaacactaggtctgttcccatgcctttccagttgtacctcaatcatagcagggaaaggttaagactcaaacaaaatggaagaatttaaacgtactatactcacttttaggtgcttttcttttttcatcctcattgctttttttattcattagttactcatattttatccatgtttaatgatgtctgtctttgggaaacacctctaaaatattaaaaatccttctctcactaagctgtgcaagttagtaaactctagttttggaacttgttttttccccctgtatgtaagaaaaactatatacccctaatccttttacaatgctgttcttaaatctagttaaacacaaaaacagcaactatagctttgactaaacatactttatacaactctaacatgtagtgtccagcaaatgttttaaaataattatttgcatcaagtcaaatcagagttgagattagctacttaatagtaacaattttgttatgagactataatgaacaccaaaatctatttttagtacagttttttctttatgcatactcaaacagtttaggatgataacaaggttagcaaaataataaactgtaattacatgaaataagatttattaacttctagttataaggactgatttcttggaaaattgtgattaagagattgccacatatttttttcaaaaaaattgattttaactgtatttttaaaataaaacataacttaagttttgaatgttaatttcattgtgtagttgaatgtcttaaaaattcatgctttgcaatttggataaaatacatgcaaacatatattcaaagtataattttgataagtggtaaaaactatccaccaccaccaaaaagcaaatatactcacataaaagcctcctaccagtagtcatatttctttttgtagttttcaagtaacattgttctacattcaactgaaattttttatactttagtatatctttgagctcaatggagttgatgtcagatttttatagtttgaatctaatacagaaatacttaactgtgtctttgattttacagtttatataactgttgtgaccatctgcagcagctgcacttttcagaattatttgctgaaccaaattgagcacagtgacaaaagtagtcatctcagatgtactattaaacgaaagaaaaaggagcattgccttggtacagtacagccatctgctgtacagatgttattgtatagaatgacttcagataaaataattgtagaaaattttcattaaaacctcaacaatttgcacttgtttatgtgaatctgcataactccccaatgagagaacacacttggggtttcttcggttctcactcactttctctttgatcctttttgatgtgctgattttaataaacacagtcaaaaacactgtgcaaaaacatcatggaaaaaactacaaaggaacaattatagcagcagaaactactctaatccctaacttatgcaagctatttttagtgaagtatttttttaacactctttatgtgacaatgttatataaacagggtaaaacggtcctttccagatgagttttaatttaggagccgaaatagatttgtaatgctagaggaatcttatgtgctaagtaatatttagagaaacaccattgagaatgtgttttagatatgtttctttgtcaaaggtacaaaaatatttgatttcacctaatgattatatgtttttatcatctaaactgtcataagcttacaggaagtgtatgtggaaaggaaataatatgatcaaaagtggtaagttaattttctcccccgggcattccgaatacatttaaatctgtgctttcagatttatttactgatttataaaactaaatatttataaattattgactgaagcagttaaaggaattcctcttattatcatttggaatgaaacgaaatggttaaatattttctactttaccaaaaatatctaccagttcttcttagcctcctatgttattctttaaccctaaactatgggagtttcataggatttgatttttttttaattccactctgcagatactggtatagcagtgacttagaataaactaactcccatttctgttagaatacttatgttctctcatgaatctttggtaaaatgacccaaaacttctgatttcagtagaggtaatgcttgtatttttaaggttggtgtataatattgctgaaaatcctatgattatattaaaagtacatctcctttagaaattatatcatatattttaaaatattttaaggcagataatatttattttgctattcattgaacccatcccattctatagtattttctgaaaacaaaacaacagaaaaaaagcctttcccttacgtgtatatacaacgcaatcatttttgccatttgaaatatgtagctttggagaaaccaaaagtatatagctataaattgcgaacttgcagtgtagcactttccagaggcagggtggagagtgagctacagactttagctccccttgtctgagtaaattatggctctgtttgggcggcactccttagatttcgacaaacgagcacacagttgagagctgtgaaatagctgaactttaggctgccttgctctttctcggggcacttagattggcagcctccatatatgtagataaggaaaaggaaaatagaatatgagcaagttaggtgccacaaaagattgggggaagaaccttaatgaggtcatcttggttggcattttagtcagaatagggaagaagttagaaggatcccctgtccataaggacttgggtgactttttacccaagccaaaaccagtgagttgaactccttctagtcaaaggactatggtttatgtaactttcactaccccaggctctgtcatccagatgtacttatctttttgaataaacaaaagtagagagagaaagcataaccacattatttttcacatatacaaaatgccttttctcatgttcactgaattcaggaccaataaaatgtaaagaacctaaagttccttttcatgtattgaaaagtgaaaccaggtcattaattgataaaaagtggagctccaacttttcattctatagttaactgggtctcccagggaaaatcttataaggcattgtcataagctttggatgctgcagagatgcgagttagcctaaggggaaataaaatagtaaattagatatgactacctaaaataatatgttgcaataaccagccaattacagcaccccaaagacttttgttacttttagcaagaaatagcatctctgtctaatgcctgaacaataggaaatgagttctttgacagttaaagccagaggacaaacttaacttttaagcagccactgaggattgaagtggaagtacagcttgtagacagctatacaaatcactaacaaaccttaatgaatattgggtgtgggcatcagggtcctgtcatttttgacactatgtcccaagtagcttaaacccaacacttaaggaaaggtggagacctcattgggtctgtaacatctgggtttttatttgtcattttggcataccccacaagcgcaaaagaaagagtaaaaggggattatcttgacaatgaaatgagttactgaatcttgtgataatgaaaagcagaagaattctaatgcctttctatagtccctgaggtagaggtgcgtttatggtttagcagaagtaaaatgtagaggggaagaacagatggcctaccgtccgtgaaacatgacacctcccctcccaggactgagtaccactattaatcctggtcagattccctcctattactttataacaaggttcaaagttgctactgataaactggcatgtacttcttttttcacccttagattacctgtagattactgataatttttgactatgatatatctctgtatatcctggtgaaccttgaggcattcgacaaaaagtagaacaggaatttctaaaaattggctgggaaataagaagaacaagtaaaattatcttaacttttttcaaaaaatgtcccatattatgttttctaatatgacgagaataaaaaccataaatgtatgagatactgtaattctcctgtcctcttagaaattatatgaaatggagaagacatctcaacatacaaattatattctccttgctgtaactgttatatgattagatacactaatcattattaattaccactaccttagaaaagatttttttgacaccctcaagaaaggagattaaaaattatgactgtttgacatttaaaaaaaagcactaggaggtatgtgctgctcagccgtgtttacatagtcatgtattgttttgtttaaccaaattatgtaaatacagtattctacatcttttattttgaggtatatattcattgtcctgtgataaatagcttgtgcatttttaaaatgttgtttatgtacatttttgttttagtgctgtgtggttgctatagctgttttggattccaaagggaagcctttaaaatacataggagaataacttcagagatatggaagatatccactgggttgagtttctgatgtatgtatttcaaagctgcataaaaataaaaattatctaataagcaacaaacttaggatatcagagcgatctcatgtgctgtggtgtagtgaacatgatgtacctgcccagcctttcgtagagggagatgagctcatttcagagagataaccatctctgactttttcttctgattcatcactgacctgaactcgatttgaaccttgttagacaaaaaacaagcagaattcctggcctaaactataaaatataattaagcccttttgaaatgatgtgtaaaagaacattgctgtacccccacttataaccaccaccaccaccaccgcaaccaataaagttaaatcaagcactgcctgtaatggattaaaataataaatgttcctggatttcagtgtttgaagtacttgaagaaaacaggctcccagcagccggggtagctgaatgcaagagagacatttattaatgacgagttcaaggatttggcctgtttaagatcattactttctgtttaccgtgtgttacacatcccttgtatttttacacagcccacatgtgtccacatgcaataatgagaagcttttttcccaacaaaggaattaattgtgtaaatatggttctcttggggaatatgaagtcttcataagactctgagcccttctaatgagaaatccagtgtagtcattatagtcttccatgtaaatccaccttcagatcttatctttaaccaaattagtcatttctggttattggttttagttaccaaattccaaatttaatctagactgtttgctagaaaactgctggcctcagggtatttgttttagaattgtgtgccattacattggacacataattccagccctaataattaagtactagagacttttttcttaatagcatctccttagcattctaatgatagcccctattaggttagtattaagtaaaatggacaagcactgtagccccaacccaaggactgtggaaaaataaaagattagaagtaaatctctatcccccactctactgaatttgtgacagcatttagtgttgcctgtggtcacaggaaattgcccgcttgtccatataagccagtaggctgtttgctaggaaagcttctagcaaagcaaccctgagtgatgagtaactgacaacatcttagatgttcttttactccctggttggtcccctggacttgttggctatgttggcataacatactggggctgagcaagggaactgaggacaggaaaaagcatgtatttacaacccagttaccaattagaaaaatgaaattactaagaactaatagcagtagtttgtataaagcaacatggtgctgtaaagaggcagacagaatctgcaccccagccctgctacttactgaccagctggttgtgtcaaaagttactctgtagtgcatttcccaaatgaaggcaaaaatatttaatttataggactttgagaggattaggtgacataatgtatgcagaatacccgacacattgcttggtacaaattaagtgctcagtaaatattggtctttgtatatattcctttccccaaaatcacaccacatgaatatggaggtcatagattactaaatgtcagagctgaaaaataccttaaaggtcatccttttttatcaataacctttattatccttttctcccattgacctcatggtctaggcacactgcatttagtattagataactaactataccaacttgatacaattttaaccaaaacaaacaaaaactttagaacacctccacaacttagtctcagacaaattcatgatttcttttaggttcttaggaatactaaaaatacctcatggaccaccattactatgtgggacccactaagtgtcaaggaaccttgggttgaagcccatggagctagtcttaactccctcattgagtacagagtgaagaggttaagcggtttgcccagggatactgtatggtggagttgagactagaacacacatctcctggctgctggcctttctgttataccagtctttcaaaacctggattatgtagatcaagaccattttctaaggcactgcagtaaattacttagcaagtcatgttgttttcaacattatttgagtaagtttatatcaatttttccatccatgtaacttaacttttttaaaaaaattgattcttcagcagtttcctcgcataattcaattaaccagctactgaattcatcccagaaacttttcaagtatgtatttgctattattctttcctatgtaagaaggttgtcttacactttccagtatgcacagtcagatctgccagtctgcttttttttttaaacatagccacatgatccaatcaagttatatttttctaataaactaacacaactgtaaaaaccgtgagcatggtggcagattggaggggaagaaagaggcaaagcatatcctccatcaccctttggtatttttagttttcatttttccaggatcctagagttctaaagcatttcataaaaaatacctttcccagacaatggccatgtgtgagtagccagctcagtaggcatttcttctttcatgacaaattcttccttttttttatgggaaagaaacactcctcttccagttacttgtttttccattttcttatgtccaaacaaagaggtttgaattaaactaggaggtcccagcttttacttaccagtaaggactaagtcacagtccctggggaatagaaatctcacctatgagaagtcatcaggtgctttgggaagggaaacatgttagtagcctggccacccatttggtctattattttgatgactagacttttaagttcatttgttggggaatactggcatcttttacagcttaaatgtcagtgtccatgtagttctctggttttgttatgttttgtcccacatatcatttcttcctgtattttagtttaccatattaataggttctctctctctctctgtctctctctctctctctctctatatatatatataggctctctcttttgcgctctctatatatgggcttattacagaattaaatataattaaataggatctgatcaacttacatattctgatcaagggcggggacgaacatgtttttttcatggctagagcacccaaatgccatttttatctgcttcaacataattggttgaaggaatggaagactttatttttgagggatttgttatgtctttacagacaatacttacaaaattttgtcgttttcacattttaaggttttctgatgcttcactgttatgcaaatcagcttccggatgtatctaacacatgcttgctgattttctagtagccttagattacttacagctggataaaataattacctggatatgctttgctagcaatgtcatcattgactactctttctaatgatgcatagaagcttgatttagattgcattttgcttagtcagcatgtagacactaggagccttactaagggtctagtagacactgacaacatagggctggcagcactttgtaaacattttccaaaacaagtggtttgcatttattagtcttctgaaggagtattttagaagtcatgaaactatttgttccttgaagtaaatttttatactcaatgaaaagtatgtcagtattcaaacaaagcatgattggttctgtttatcgtaccagttgtttctgaaattatttctcaatgttgctacacctcgtttagtttaattaaatatctgccattagtttgctaaaacttaaatttaaaagataaacagatttttgagaaaagtcaacagaaaaaatcagcaggaaagcattctgttgaaggaaatgtagaaagaagaagtcataccgtacgattggtcaaagtgacctgatcacataatcactaaatgcaacatgggatcctgagtgggatcctgaaacagaaaaaggacattggaggagaagctggtgagattgaaaggtctttaaattggtagtattgtatcactgcaaatttaatggtttttgagaatcataatctgattttatgtaagttattaacattgacaagctggatgaaggatatcaacttttctgaaagcctaaaattgtttcagaatttaaagtttttaaaaaatgacctgatcagcaattgggtaagtaactttaataatattcatgcttttaaacatctaagtgatgattttatatcgtaaacttttgaagcatatttttaaaaattttgtctttactgtttttggaaatttagggaaaaaactacaagtacagaaaatgtacagggtaattcatcaaatgcctgtgtactcatgagctagaacaaatataaacatttgtcttatttgttataaacacacacacacacagaactttacaaaattattcaggccttttccaatgttccattgttaagaaggtagctctttataatttttacttgtaggcattttgtccaatggtgcatttgtccccctaggaagaagaacacatgtcttaactcactttctgttgccatttataccaggttgttggatgtgtaaatatctagtttacatgaactctgagtattctctgtggccctaggtttatatgtgtggtaatatataagattcaaaataaggaagatatttagtatgtttcctgggaaaaaaagaaaggcctgatgtcccatgggctggcttctcagagtgaaataaaggggaaaggaaaattaataaccctgtcatgagtcccagggattactttcgtattttgtggtaaaagtgtataatttggtttactatcctgtaagtgaccctttgtgaaattcatcaccaccctttattgctattaagttatcacaagctcttaataaatactggctcacgcctgtgatcccagcactttgggaggccaaggtgggcagataatgaggtcaagggttggagaccagcctgaccaatgtggtgaaatcctgtctctactaaaaatgcaaaaaaaaaaaaaaaaaaaatcagctgggcatggtggtgtgtgcctgtaatcccagctacttgggaggctgaggcaagggaattgcttgaaccagggaggtagaggttgcagtgaactgagatcacacactgtacaccagcctgggcgacagagtgagactctgcctctaaataaataaatactggttccaagattaaaagcacttaactaatgtgtttattattatgttgtagctttttttaatgtaggagtaaatgttcaaaggaaatatctattttaaacttaaaagctgatatttgtgggttaacctttctgtggtactacagataactgtgttccctcattgaggaatggagtcacaacaggttggtgtgtgcagtatgtgtagcagacaaggaaggcacatggggaggagttgaatcagttgtgtaagtttcaaaattgaaccacactgaatttccttgtaggtatatggcaagaaagaaaagggacaaaaaggaccaggcaggatatatttatatctgtagattttgtattttcttagtactttctggcaatggctgttcctgtgtcctcactgcaaacattagcatcttattaaattctcagtgtcatttgtgtatttaaacaagctcatgatcagtgctggtaggcctgagttacgggcaaataaaaactgtagaatgactgtaaaaactaagactaaagcaaggggtaggcttgagcaaaagaataaaagagactgaaaaaaaagtgaacagcacataaagtgaataaaaagaaagcaaaaaatattagggtttgtatgatagcagggaagtattcctgttcaacagttcatgtgcttaacagagtcaatattagaaatgttctgggatgtctcttccccactcagtacttactgagattgcagaccttgaagctaatacattgccaagagaaaatctgatatgaaagaaaattgctaattatttactttatcttcatatacccaatatatggtagataaccactaacttttggttgaataatggatacatgcctacataaatatcaaattgaaggtgacccaggatatgtaaattccttagaaacaatcagaagcatggtaatagcacttgtttaagaaattaggcctggttttagatactgtctcataaggacagaaattatggtttaagccatgagagtagagaagtttgctgaaatattagttcaaggggagaatagaaaactgaagattacttattaaaatcccattggttaaagatattatttgtgacactttggattgcacacgacagaaaatccaacctaaactggtttaagcagtttttacgtatgtgaaaagctccaaaccagtgttgtcctgaggcatggaagagtctgtcagatttcttccctctgcgttacgcagcttcagcccttaggctccacatgctgactgccagcagttccaaggccttcattttcttaacctcaagaccagggagcaagaggaagggtcatgttcccaaaagtattattataccttagtggttttcattgaatattatgctcattcctggaccaaatcaatctccagagaatatcaaacataaagtcccataaagttccccatcctgctagactatttcccggcaaaccagtcattggattccgttgtcaccagaacatagctatagctagctcagtgcctgccttcattgcagggcctctgtttctgaagcacattgtgtgtcctctggtcctctttagtgctcacctaagtctggccgactttctctcttcttgttccagcctcccaaatgtttgtgtgatcattggcttcctaattctgtgcaattttactgatatttctgtccccacctttatctttattctcttgagaattctagctatcccattctgtgtccccaagccaaaaaaaaaaaaaaaaataggatttgtgtaatagtaggaaagtgtttttctatatttgttttctaataattcaagtctggaatttttttttcattctctccttgccctagtcaataaagtcaataagaacttgtaattgtataacgttgggggggttaagaagagccttccatcaactctacttaagttctctaagaggtaggcactttgcaagtgatatgcatcatatagaatgatatgaattttgacatttcagtactagttcttttaagacaaagcctcataattttagtacaatatcagtatttagcacaatatcagtattttaaagtggttcctgcataatagagatacctaacatgatccaaattctatatgtattatgttatttctacaaatataagattttgtcatgcttacaaatactcttttttaaatgaaagccactatagcgtgagaaaggaatctcattcctctgtatgctttgtagacaaaatgttgtcaagcccattcctaaagagacttccagaaataaatatcaaccttttatggcttttttttagtagataattacctttgcttccataaacttgttctttatggctttcttagttcttttgctttaattttgaccactccaagtgatgttttaaggtggattagaaacagacacacctgaagaggtgcttagcaagtttctgatggtcatagaaagaggttacaaataaggaaggcgagaagactagaaaccaccctgtgatgttggatttgaacctgaggtatcagtatgcattcatggtttttaatgtatttaccagtggatagagagagagacaaagatatgtaggtatacaggggttgctatacatacatatacttcttatctctgctgaaggggcctagcaacagtgacaccccagtagcaatgagcatacctaccacccagattttggtttctagataccattcttcaacaaaagaaaccagagctccttggagaaatggctggtgctagagatggggtggtaaaaatacaagatgagcctgaaatattttgtggcctgaaagtaaagaagttctcaaaaaatgattggcataggccaggtgcagtggctcacgcctgtaatcccagcactttgagaggccaagatgtgcagatcaaccaaagtcaggaatttgagaccagcctggccaacatggtgaaaccccatctctactaaaaagacaaaaattatccgggcatgttggtgggtgcctgtaatccaagctgttcgggaggctgaggcagggaatcgctggaacccaggaggcagaggttgcagtgagccgagatcatgccactgcactccagcctgtgtgacagagtgagactctgtctcaaaaaaaaaaaaaaaaaaagacaggcatatactaaaaggacacagggaccatcttaaagggctcccaatggccaaagctggttcagagtaagcaacaatgtaaataatgatagtattggattataacccataaaaatgaatattcatgagtccatactgatataaataaataattgaattagtatatggggtagaagggacagctgtagtatatgtgctaccaaagtgggcgctagaagggacagctctaaataagggaaataggaaaccaccattatcacacaccacaataaatcattgcaggtgagaccactggtggatgctaacattagtgggtgaaaatttgaagaaaaagagcatatctgcataatctccaagtgtctccccacaaaaatacttatttacaaggggaaagtgttaactttacaatggcaaaatctgacagacaccactttagccatatgatcagagttaatattgtaaataataaaatattggtatcacatacaccaatatgacgcactaagggggtcactttggtggtattgtcaaaaatgcataacctctttctgatcacaagaaaacatcagataaaccccaacagacagacacgttgcagaatgattgtcctgggttattccacagtatcaaggtcatgaaagacaaagaaagctgggggatgtgtcacatattaaagaatattaagaagctttgatgattaaattcagtatggatcctaggttgaatcctggaccagaaagaggaaattagtgggaaaaatggcaaaaatttaaaaagatgtgtagattatttaaaagtattatatcaatgtggatttcctgatttcagtatttgtactaaaggtacatagctaggtgaagggtgtacaggaacattatacagtatgttttttcaacttttatgtaggcccaaagttatttcaaaatagaaagctttttttttttttaaagtgaggggacttggaatagatgatttctagatctcttccatccagcctttttatgttacagtggtaaaaaacgaaaccaaagatgtaagcagttttatttcctgtctaccaattaagaaacatgttgaggcagctgaaaaataggatcagattctaaactgtcgattcagttcaatggaacatgtcctgaatagctactgttgtgcccaggactacactgaataagctggtccttgcctccagcatggtcagtactagaggttgaaaattgtgtgatcttctctttcactcactcatattattcaggtatctcttctttgatgttttaaaataatggaattggagagaatgaaatagaaattgataagttttagaaatttgtcaaaggaaataagagccttcaaagagggcctgaggtttttcaatctgggtgcctaaagagataataataaccattaaataagataagcaacctaggtggcctttggcattaaacactgtgtacaaggattcaatatgactatcacactaagattacaaacagataattagatatgtcactgtggggttgtacaaagatatgtgtatttgaaaataaaggatgatgcaatcctgacattctgttaatgctcatttactaaataattgtactgaattaaggctatacttttatgcctttatggcaaatttctggatgatgaatagatatatttcatttagcaaatatttacttttagaagttttagatattttagaaatgtaatgctgttaagtcagaaaattatggcttcagttatggactgaagttaataaagatggttttttatttgggggtattttggggcctgtttctatttcttttattttctggagtgctttttttgcttgtttatttgtttgtttagactaagtggaagctttgaatcaggataattgtaaatgaaatggtagtttcagtttcacaatttgatgaaacattttaagaaattgatttccaccatgattatttttaaaccaaagtcttatctctaacacttttgtgggtgtgatgccttctgtggaggattagaggttgaatatcttatttctgcagtaggaatatacaacatatatgaaattttcaagtctctacagaattgaaaagtcaatgtggttactgtactttaaaacatgtgtatactgtgggcctaaggtgttttttaatctttcatcttttttagggatcaaatatcattagaaaaataagccatgggcattacaaacgtggtctggtgaaattcaatattcactatgacaatttagaatatgagctccttgggaggaaagttaactcaccactcttaactttgcatctaaatatcctaaaatgtgccattggttttatgaaaaggttttgatctacactcctattttaagttcaaaagaaagcctacattttaaagtgtattccttttctgggtatatttactttgaactatagcatatagtttttctcataaatctaacctgccactatctgtttttaagactttgtaaacttcaagtggttatgatgtgtgaagtttggattaaactaaaatttttagaaaacacacgttatatattttgattgttttgaattttaacatgggccagtaaaaaacttgagtgtctagcagagtaacatactgcactctgttactgtaggaaatcacagaaaattaccctttcccatcatgttaacaatagacaaatgaagcagctgttcttattcttaatgtagttgcttgaaaaacttgcacaatttaatgaaaatgtctctactcataaaacttaaaatgctcacacatggaaaaagtcataatgttttggcaaatattactttgttaggaatgtgaatgaggtatacctgcttcataactagaactctgtataaacggcatgaaacggtggtggactgccaaccaagcaagacgactctgacaaaggatgaattaatactcttcaaaaatatagatagttctttcccaaacattttttttgataaggatgaattatatactcttctgtatttttttttcaggcataattcttgggtcatcatttctactcagtataaacgattttctccttaaaacaagtctcaaagaaagaagccgcattctgataggaccatgttgtgctactgccaatctggaagctaagtggtgtaaacacagcgggaatccaggcccagaacaatccataccaaaaatatccattgacttaagaggaggtctactacaggtctgtgggtattggccatatttttttcataggttattaactagcctctgttcattttttgaactgtttcactaaattttaaatctttgtgtggtaagaaagggtatttgtcagattgctacttgttaaattttcaacaactttattgagatataagtcatataccagcaatctacctatttcaagtatacaattcagtggttttttagcatattcagagttgcacaatcattaccacagtcaatttcagaacattttcattaccaccaacaaaaaaacccatatccattagcagccactcacattaccctctaacccccttatcaggcctaggaaaccactaatctactttctgtctccatagatttacctattcttaacatttcgtataaatagaatcatgtaacctgtggtcttctgtgaccgacttctttcactcagcatgttttcaaggttcatccatgtttaccaagtgtcaatattttattcctttttatggccaaatgacattccatcatatggatataccacattttatgtattcattcatcagttgatagacatttgggttctttccacttttggctgctatgaataatgctgccatgaccatttgtgtacgactttttgtgtggatatatgttttgatttctcttagatatataactaggagtggaattgccgggttgaatttttttttttttatgggtagacttttctttttgagacagggtcttcctctgtcacccaggctggagtacaggggtacaataatagctcactgtagcctcagtcgcctgggctcaagtgatcctcttgcatcaacctcctgagtgggtagaactatgtgccaccacacccagctaatgttttttattttttttttcagtagagatgaggtctcactatgttgttgaggctatagatttttttaattattaatacaaagtagtcaacctgttgcaagcacagtgtcactagcaatatataagaacaatttcctaatattaaatattttacatgtgatgatatctgattacaacacttgataaattagtcacactgcaagctcttaatgcatttgtcttaacagccaaatatagaatgtgtgaaggcatccaacttatttcttgattattttgtatttggatagattttaatttaatcttcatgtaacttgatgccactctaaacttgacatgaatccaaaaagcttgaaagattcacaatgatagaaaattaaaacaactaattggtcaataatggagacattaaatgtgaatttttttctttttttctttttttttttttgagacagaatctcattttgttgcacatcctgaagtgcagtggtgtgataacagctcactgcagcttcagcctcctgggctcaagagatcctcccacctcagcctcccgagtacccaggaccacaagcatgcaccactatgcttgactattttttttaagagacaggttctcactatgttgcccaggctggtctcaaactcatgggctcaagtgatcctccacccatgctgggattacaggcatgagccatacatagcacccggccaattttttgtatttatctaaaagttgtattgcctcaagttttcaccagtttcctttttaatgcacagagcaagatttgggaagatcctaataacttactgttttgtgttgctttggagattttcagtatctatcagaaatcttcatatatttagcaataaacatgtattactttatcaagaatattcattgtcttaccttttttccaaggcagccaagtaacttcacattgaaaacgacaatgatctgtttacatgaccaagtgcttaaaaataaaaagtaagaaaattttaaaccacagcattaataaaagcaaaaacaaagtacagtgtattacctctgtattacagtcattgtctcttgacaatttaaaggctagagcacaacattctactccccgtttgacttttcacctgtctctatttttcagcatccaataaaaataagattgatgagaacacaagtacacttagtgttacatcttttactttcatttctgagatgccttaattccagagagcagaacctaaggctagggtttaaaacttacccacacgatatggggctattattttctactactatatattcttttttcttttctgcgttacctggttctcttagaattgatagttgtattgcctttattcagtatttacagagaaaattaacatttttgaaagttttaatcttcattataacctactggtcattatatgtctataacttagtagttatagactaatattactcacatgcagaaaaataaaacttaatctccattagaggaaacactaagtccttttgttctgaaactctactgtagctactgtagtataattgattttcaggggctctggaatcctctgtgttggcacagtcttactaaacacagaagttgggagccttctaagttcaggttcattgagaaatctccctctaaaagtgcagagaaagaaaccctataataaggattgcttatttaatctcatggcagaatgtcagagctgtcccacaaggttattattatgattttattaacattttggcctagaggatcttcattgccttctctcagactataataggtgttcttttccctcttagctaaattaattcataaacattacttcacatcaacataatttcaattcaacatttaaaatttattgttattcacacaatataagatataattaatttttttgttgttatatatttattcaagcaatagaatttcatcctgtaagtcaattactttttaggaattatagtttataagtaattaaattgaacataattacagtcctacattaattcaaatatgattatacctaattagtctcaagaaatgtttgtatttaaaagctactagaatttttttatgattttaaaggtcttctggggtcaagaacatttgaattgtttagttcttctacatgaattactcaatggataccttaatgaggagggaaattttgaagtacaagtttctgaaccagtgcctcaaatgtcatctcctgtggaaaagaatcagacatttaaaagtgaacaaagttcagatgacctacggacaggtctatttcagtatgtacaggatgctggtaagtagcaacagactcagtatgagagtgtctctgtgcatgtggttgcattttaaatgcatgttgactaaataaaaacaatcaagatggctttttaaagtgcgttaaaatttgcagtacaaaaatagtacattatcattcaatctctcttaggggaagttcttcatttctttctgttccagaatatatataaaaatgaccaactagcttctttatatcttttattctcataatttcttcttcctttactttttcccctttgtcatgttcccctttaaatcatacaattaattatacttttatttgacagaatctttgaaattgcctggggtctatgaagtcttattttataatgaaactgaagattgcccagggatgatgttatggagatatccagaacctagagtactcacccttgtacgaataactcctgtaccttttaacaccacagaggatccagatattagcacagcagaccttggtgatgtgctacaggtatgtaatgaccattcattgtaaaatgaaaacattgtgggaaagggctgatcatatattaggaaaaatgtttggaacatacttacttcttacattaatagtatcagagagaaatacacatctgtgtgtgtggtgtgtgtgtatccacacacatatataatgggattttaaaaaataaggtaataatgtaatccaaattcatgatacatggcaattttaagagttctcaattctactctccattttattgtgagtagattataatgggacaaggaggtgtcatttagttcaccactcctttattaagtgcctatcatgtgttcacactcttcagagtttctagaaccgccccatgaaacaaaatatgcccatgtaaggctagaaagagatgactgtagttttcatttccatagctgaaatggtcttggggcttgaggtaggctgatttttctattaaagaaaaggtctaacctgtgatcatattccctaaggttttgtgaaagtgtgttgcttgttattccgagtttaatataaatgtcattgtggatatcactatgttatctttgtacttactaatgttctactgataggagtttctcttaaaatttgtttctcccttaatcttccacctattaccagatcatacaaccatccactcaaaatctacaggtcattcctgattgccttctttccctacttccctgcgtcaaaacccatcaacaagtcctgtcagttctgcctacaaaatatgtccctattccatctacttctctgtttctgctgatacaacttgagttcaagctgccatcttctgttccctactccagtagcttcctaattggcctctatgcttctgttcttgaccacttggaatgcattctccaaatagcagctaaactgatattttttaaatgtaggttatactatatcacttccctaacttaaaaccctgtggtgacttcctctaatacttagaacaaaattcagatctcttgctgtggcctgcaaggacctatagtctggactctgctcacctctccaactggagttcatgccagtttctccctttctcatgatcctttagccactctggcctcctttttctccttgagcagaccacctgtcacattaccaaccttggtcttcgtcagtcaggtaccagctcaaatgtcatatcctgactagcccactacaactacttcattctgtattgcatttccttgttttgctttcttatagttcttactgctagtcctaattatgcatttgtttacttgcgtgtgatctttctactgttagaaaataagctccttatatgtcttgatgatgtatctccagcctctggtacataggtacactcaccaaatgtttgaagtgactgctctgttcttaacaaattagttttataatacaaatcagctacatattaatataagtcatattacaatcttatgtaattccttttttttttttttttgagacagaatcttgctctgtcacccaggctggagtgcagtggcaagatctcggctcactgcaagctccgcctcctgggttcaggccattctcctgcctcagcctcccgagtagatgggactacaggtgtccgccaccatgcccagctaatttttttgtatttttagtagagatggggtttcaccatgttagccaggatggtctggatctcctgacctcatgatccacctgcctcggcctcccaaagtgctgggattacaggcgtgagccaccgtgcccggccgaattctactgtcttatcagacttgcctaaatgcagaatatctgtagattttcaatcaacatgaaaatacgcatacattaaagttttaacttcatgtaagggctaaaggtttatagttatagctagatattaacacatttattaacataagtgtaataactaattattggtggtatgatgtaaattatattaattaaggcatctaagatagtacatttactagtggcatattttctatcttctcacggttattaggagagcatagtgattaagaggatgaactatagccagaatgcctgggttcaaagtcttgctctagcacttgcaaacattgtcacattagacaagtaacaaccactcaggttggatttttgttttactttttattccaacaacaaaatgaggctaataataatgtgatgattgtaagaatcaatatttataaaatacatagaactgtgcctggcacatagcaaatgttatataagtatgactattaccactattacagattcagcagtctaatccaaaaatctgaaatctaaaatactccaaaatccaaaactttctgagtgttaacatgatgctcaaaggaaatgcttattggggtatttcagattttgaatttatggattagggatcttcaactagtacgtatttgcaaatattccaaaatctgaaaaatatctgaaatccaacacttctggtccctagcattttggataagggatactcaacagatattatgatgactattgtccaaactcctttcatcaagtagaagcacaggctagaccaaggagatctggagtatgatggatgactctacagaccagctggagtagtccaggagatcagagagtcccagggacccagacagtagccttggcatataagcaaaacacagcctggcagatttcagcaagcaaagagttggtatcaaaaaggtcttgctatgtttcatattttgttggagaaatgaagatcctatatgtgggcaaaattcaaagacagggatgctggcctagggagcaagacagggttgtaactaccagaagttagaaaggagggagagctggatcctagtggtgagaaggagcgcactcagaatctacaacttggatcgaggaacagatcaagactggcaacgaggctgacttgataccaagctgctgagctctcagttcaattctcatactctcccagataggagcagagtttgtcccagagcttggagtgggtctcatctgtggaaacaactctcttgagttgcaatattagaacgatacaaaatattttgtttcattagaacttcagttgaggacagaacatatgtaacatgaatcacaagtttgatttaatacaacagctttctccttgaggatctacagtgccaggccctgggcttgctctgggggatccagagacagataagacacaatcaactcattaaaagctcaatccttcagtctagcagggaaatttctgtggtcgtgtggggtagaagaatctaatttcatctgttgtcagaatcattctcctaccatatgtgattatttctggttctatactagaggcacagctaaaatcctcaacagctgatcctgaatttcagggagcttatgaaaggaaggccctaatcaacctagtgtatattataaaatgggttttgaagtctcagttgccactgtctccccaccccccgccttattttaactaactcattgaccttgggcaaactactgatctttttgagcttcagtttcctcaactgaacattggagttgatgttatctacctttcacagttgtcgtggagtattatatctaatacacttaaataaataaatgcattacacatagtgagctcttaataagggcttgtttcctcccctccgctttttcttatcacacaaatgcctagaccactaaaaaagactcctagatggaattccaggctccagtatctcttccttccagcctgtccttctaagtttttagaggaacaaatagattgtataattccctgaagaaaaccttcagtggctctgttactctgccagactgaccttgagagcccggcataaactgcccccatcccccaattttgccttgcagtcccttagacatggtctgtcctctatcaaactggcctatctggcattccccaaaccaacctataacatcctgcttcctcttcatttgaatccctcccatctctgccagctgaattcctccccacacttcagaagagctaaaatgccatgtagtcaatgaagcctttcctagatgccatgttcaaacatgataaagccctcctctgaaatcttgtagcacttcatggtactacttttatgctatttttcactgtattcctcacacttgaacttatgtgtccccatcttgtgtctctcctagattgtatgtctgtaaaggaagaggttgtatctaatttgtcatcatgtcctttacagcagggtcccccagcccatggcctgttaggaaccaggccacacagcagaaggtgagtggcaggcaagcattcccacctgagctctgcctcccaatctaatgagcaggggcattacattttcatatgagcgcaaaccctattgtgaactgcgcatgtgagggatctaggttgtggactctttatgagaatctaaccaatgcctgatcatctgaagtggaacagttttatcccaaaatcatctccccaccccttggtctatggaaaaattgtcttctatgaaaccggtccctggtgccaaaaagattggggaccactgctttacagtatccatcgcagtagagatgttcaataaatatgttgactggataaacgaatccatgaacttccgtgttctgtttcatatcattcaaaagtattacattatatatcactattttatggaacgaatgaatgtgttttgattttctacaccaaactatatcagggtgcgttgtgttatttttcagtggtatcatctgtacacacagtctaatgtcattacattactcaacctctttgtgatatcattgaatagtctgccaagcttacctgctcccttaaacagtagctaattcttaaatacagagatatattaatctccttaggtttagtcctcaaaacagaattgagtttagatgactttttccttcaagaccatttaattcacttaaaaattggccttatagagttggcttataatacagaagcctcagatttgtctctttatattcctcattccatgattgttgatgagatttataaacaaactccccatatcactttatggaatttattttgtaattgtaatgaaaaatataaacatgaaaaacatgtctataataataaatcaaactaatcataggttctgaataaaaacctcaaaagtaatgttcctagaatgcaaaagcttattttatggtcagcttataattttatcatgtgaacttttaaatgttagtagtatatttagatctcaataaaattagcatctgttagataaagtaatgccaccaacctaggagtgttgtgcagtttaaatgggtctcaataaaagaaatttctggcactgtatatggcacatagtaggttttcctctctcctaatcctcctgtgtgcactgcctattgaggattccattttggaaatgcatatgttcccagattataaatactcaatccattttttggtagtaaaattggtaatgggtattttaattcctatacagatctgtcatggttcttggccattgtcacatgccaaatgaagatatctaaaagtttatggcaacatataaatgaaaataaatatgaaaacaagaagaatacaatgataagggaacaggaacaaattcttaagattgaaaatgccttttttaatcgagaaagtgttagccacacctggctaatttttgtatttttagtagagatggggcttcaccatgttggccaggctggtctcgaactcccgacctcaagtgatctgcccgccttggcctcccaaagtgctgggattacaggcatgagccaccaaaaattctattatttataagttacccagtatgaagtattttattatagcagcataaactttctaagacacagagagaacctaaatggtagagatctctgttatttttgctccagtgggcatttctgatcacttgtgtgttttgcacccagcactgtgctgggtactttacatacataataactcattaaatttaattttactccatgaggtgggcctcattcccattttacaagtaggaaaactgaggccaagaaaaagttaattaactggttgtgaatcacaaaatttataagtgagggagccaaaatttaatccccagtctttctgactataaaacctgtttttttcacttatatgtaaaaaattgagatgatacattagaatgacagtgagccacctcactgagaaatgtggaaagaaggaaaatagaattatccttttacttcaaatgttaaatcatgaaataatgagttagacaaagatatgcaaagtaactttaagtcaataaaaagactgccaaacacacaagatggattgggtattgtattagtctgttttcacactgctgataaagacatacccaagactggccaatttacaaaagaaagaggtttattggacttacagttccacatggctggggaggcctcaatatcatggcagaagacaaaaaggagcaagtcacatcttacatggatggcagcaggcaaagagagagcttgtgcaaagaaacgcctgtatttaaaaccatcagatcttgtgagacccattcactatcacaagaatagcatgagaaagacctgccccctgattcattcatctcccactggttccctcccacaacacgtgggaattatgggagttacaagatgagatttgggtggggacacagagccaaacagtatcaggttttaagatagctaaagaaaaaacttttcctttaggaagatgactagtcagctctggagcccaggagggtcacagaaatatttgttggaatagatcttcctggcagcaaccaaagaaatggtgcctaagagtctggttcacctggtagctaaatcccctttatggaaatgaatgtagcagctgtcaaatctctatgtctaacattcaaatcatgtaaccacctaaatatccttctaatagtttggctcccagtgtagtctgtctacatggagaaagtatatcatacactggttgagccaacatcagtatccagactgcttggcagttatacatctcatggtaacttaataacataacttggcattttgtttatatgtcagtctctagtgaactttgttagcatgagtcagcattcctaagtctagtcagtgctagaataccactgaaattttctgagactctaggaccaatggctagatcttgaatgatggttaatccatcacattaaatgcccttttcattaaatgcccctcccagcaggttggcctttccctgatgacatctctgttcaatatgtcacaaaccttttcaaacaaatgtctattctcactaccttaagagttatgaggagtggggataatgtgtgtggagcatttagcgtaatgccttacatagttgaagacccaatcaattattatgacacatcataaatggtagctgttaccatcattatcttctttcccatatcaattgatcaaagaatctgggattctaatgtgttagaccacattagacagacaaagccctgttttctgagaaggaggtttttgtgtttatagtctgttaatgtcgtaataattgttagggatgctggctctgtgtgtgattgatgaatgctttcattgagagcaactgctgtaagagacactatcttccccacagttatggttagtggactctggtagtatgtcgactacagttctttaggttgcaggtagcagaaaccccactgaagttagcttaagctaaaatgagggggattaatatcaagatacagtgggcagtcctggaaacaattgcaaattgcagcagggcctctggaagaactggggccaggaatggaagataggaacccaggggaatattcactcgctattgctttttctctttttctttccccgtatttgctttattcttccctttcaacagactttttttttctccctttcttcttaggccacccagtactttccccacagcttccagagctccaaaagtcacatttacaagtccagcctctgtttcagatccacattcgtaatttaccaagtttgatatcaggtgctcttggcccagtcaactttggtcatggggagagccacgttttaccaacacggctgaatttggggtcattgtgagctttacagaaatttcccaggggatctattttatgtcacatctctcttactgctcttgctttccaccctggctatattgggcaaactcatggtttgtgttgacctctcactgacaaaaattgactcaattttgctgtggtttttccagcttttccctttgcaaatatctggaaaagacattctgctctgcacatcaaaggctatctgcatctggagaaaagccttacaccatttttaaatcctgtcgctgtcttcccctagtatcctctcaaaatgtaggttaggcaaggtcctttgtcttacagacacacatgagatagtttcttatctccagtgtgcttaagatcaatacctttcttgactagtgcttgctttttagtgcaatgactatgtaatacattggcaacttcacagattctatagtcttccagttctaatgaagtatgagagctttacatataaagtaattttctttttttgaaattgagtttacaatgtaatgtttaatgtctgtagcttgatggtgatttcattgtgtttagttttctaataatattttatctactacttgtccacagactgaactaaagcttcattaaatcttatagttgtgtggggtttttgtctttttcataattacatggaaaatgttctgagtcagatagtaatagtcagtattatccaataaagtagaaactagacttttgctgctttaaatttgactttacaagcttcccgtaattttgaagcacctggacctgataggcaaaggttatgatattagcacatgatggcactacaaaaagagaatccttctgagagttatttgcaattgaatatgatttgcctcttccacacatagcttaaaaagaataaaaggaagtgttcttggatgtttcttttcagctgggttgggcagttcacttatagctgcacatatgttcccagaatcctgagcctttttataagcacctcctgcccactggcagctgtactaatgtgtcccagaaggctttgctcctatccatcatctttaggagggatgctcaaagccagatatgaaattcattgttgttgaaatgcagaaaggaaaataaaaaggcctgggggctttggggaagtaggaggttgagccagactcttaggaaataaaggaaaggaacaagtcttgtgtatccagtggacacaataataaatgtttttgaatgatgggtaacggtgctggatcaactgctaagtgttttgcttccagaagccattgcctcctttttttagacaaagaaaaatctaaaatagagtgttccctgaatacacttttaatcattctgtcttcataatgttgtaaaagtatgaaaaaaagatctaggaatacattaaaaagagccctgcctgagatttttgagattaactcagtaaatacagatgaaaggacctgggctaaatgctgagagagagacacaaaagtggagagggctctagctcttctctcctgaaaggtacctgtaggtacaggtacaggtacctcctgaaaggtacctgtaggtacaggtacaggtacctcctgaaaggtacctgtaggtacaggtacaggtacctcctgaagggtacctgtaggtacaggtacaggtacctcctgaagggtacctgtagtctttcaggagggacaagtacataaaacatgacagggcagaacctgtgacatgccacgaaaaagccacagagaatctgcctttttaaacgaagcttacatttgaattgagacatcaagacaaggcttcatggaggagatggttactgaggtgatccttgaaggatgaagaggattaaaactgaaaaaaaatggagtgaagttgtatataaagaagaactcagtgagcaaaatttcagaactggatagagagggcagaacatatttctgggaagtggcaaatcatctggtttgactagcacaggttagacaagtatgggattagtggaagagtgagtgagaggccgcagatgtggcttcttaatctccattcattccatggtgggaaaagagaaggaaactcattttttgagcacctagtatgtaccaagcaccaaacttgtcattttatatgtgatatcccttctatcttccctctaaccttgtatgtaccattatcttcactataaccctgtgtggtatgtactgtttagagctaaggtaaatgaggttctgagaaaaataattttcccaagatcataaagcaagttaagggagtaaaaccaggattcaaatctcagtttgtcgatttcataattctttcatctttgttgtgctaccttgactacatttagagtgtggggtttatatttcatttgataggcattggagaaccactggcagtccagagctttggaaacattagtagtcttgtggaggtgaaatgaatcaggagagaccagaataagaagacctggtaagggtcttagagagatgagaggctgcaacctgaagggagtagtggggaaggagaaaaagaaatgaatgcaagagaggttatagagaagaaatctatgttcttgacaactaatatggtaatttaatgaggaagtaagagaagtcaaggtaattgcaagatttaagctcagtgggatgtgtggcaaaagcattcacacaattttggaaataaagaggagtgcctgctatgctaggcactattcactttgtgaggtgctttacacacattctatctaagcctgaatcaaccctgcagagaaagtgttgctatccccctattacaatgaagaagctgaggatctgaaaagttaaatgggggacctcctctccctgagcagtgcatgaattaacaagagatttaacatacaatttcaggaagtttatagacccccctataagccatgaaagagtctctcgtgaagaatcacaagaacataagagacactgctggggcttttcagctctatgtcaattagtattaggtttagatatgaaagacagaaaatatgcaataccagtagcttaggtaaaatagaagtttatttcctttcacacatgggaacagtctggaggttagtgatctaggactgcgaatgtctctacgaagtcatgaggacccatcttcctgctgtatgctactctgccatccccagcaccctttccttcatggtccaagatggctgtagaagcttcaagcatcttgttcctgctccagccacaagaataggaaaggaccaaaacagagcatgcctccccgctttatggatatgccttggaacccacacactgtcctgctgtgctgctaacatcccagagcccagaattttgtcacatggccacaccaagttaaaagggaaatggggctcgtttgcagaggaagaaagaaagaggagatattgggagacaacatcagccctgctggcatcacagccataacaccaaggaactgtccacagtctctccacccacccagtaaactgcttctcatcttgcctgattgtgagcttctttgtctagtctatggtgcagtaagaaaactcgctttccagttcattaacgaaaggtctgccaaggcagaatttgtagataacacttaagaagcaaatgggattttcgaaacaaaaaataataataaatagtttgaaatgctagcattccttgcccttcaaaaaagtaagaggtggggaaggaatttgtcagtaagacgtgcttttaaagtaaatggaaaacatttgcaaactggaagaatactgaagtcatttttatcctgtcactttatttggtggtagaaattttattagcctatttctcttttcctattaaatactctcacatttaaaagggggaggggagcatttctcaaaatgaagaactatgtttagcaatcagtgtgtttgatgttcactgctcagtattaaaaatgtttggggtgtaaaaaatgaaagaatagtaaatatgaattgatggtctggtaccatcttttatgacttggtctctgtcaaatagaagtatttgcctcctatgagattcacaataaaaaccattatccattaagcatagatcatttcttgggagctacattgttgaagagaacagcaaacagaaggaaagagggaagtacagaaaaacaatgtcgtccagctgttaagagcacagattctggagctaaagtctctgagtccaaatccaaggtcagctggtgatctcgggcaagttatgtaaagtaacttcttagtacttcagctttcacatctgcaaattagggataatcatagctcatgcctcattcagttgttaggaggaataaatgactgttggatgtaaaaaaatatgtagaacagtgtctagcacatagtgctgaataaatgttagcaattattatgttctgctaagggcttatcatctgcaggtgctaatttgcctcttgttctgtcctagattttgaatcttggaggaaatctgagttttgattgcaagctacaaattctttacctctttatctgtcctttccataaagatattggaaaaaaaatttatttttgtcaagcacacatggcttccaattttaaaaattcaatacctagttaaaaaaaatgaaactttattaccttagatgttttctagcaacatttttaaatgctacgtcaaagttaaaggtcttggttctcttatgctttttagcagcaacctttttagcagctttattgagatataattcacacatcatacaattccctaatttaaatagtataattcagtgattttaatatattcatgaagttgtgaagtcctcaccagaatcaattttggaatatttttatcacctcaaaaagaaacttaggactctttagctttcaccttctggtcttcccaacccccagccctaagtaatcacgaatctactttctgtctctatatatctgcctattctggacatttcacataagtggaatcatataaatatagtttttttgtgactggcttctgtcatttagcatgttattttcacagttcatccatgtcgtatcatgtatctgtacttcattcctttctgttgccaaatgatattgctttatatggatataccacattttgcttatccattcatcagctgatggacatttgagtgtttgaactttttgaatccttatttactttacttagactctgttgtatccaacaaacttgaggggaagaccaaaagatgatgatgatgattaatcatatttacaaggtactcttaatgtacattttctcaaaaagcttaaaatctaagcttcatgaaacaaatagattggcaataattacccagcaaaatacagtaagtgttataactaaaggcagggatgggagttgatataataggagatgggtgtgaaaagtagacttaaagcatgatagtggagggttttaagtgcttgctgagacacttgggctttattccataaataagcactttattctgtgaaggtagtcattaaggctattgagctgagcaatgaccatgaccaattacagaggaaaggatgaatcaggacatactatatattggatgcatagacaactgttcagagcacattataattactcacaagtaataagaatgacagttggaatgggaaggaggaaatgaatgtaagatggagacatctggaggcagaataaacagatttcaatgcccggatgtgtatggtaatgggaagggaaaattaaagatgaccctattctaaatgactagatggatggaaaaccattaatggggactggaaatgtcagaagaaaaatggagcagccaggactatggaagagataataggttctacattggacatttaaaatttaaggttttggaggaataatcgtagtaaatgccactagaagtttggacatgtgggctgataattcggagaagagggagacttatttaagaaatggtttggggaattatcttcatggaagtgaaaagtgaagccaagaaagcaaaatagaagtcacactcagaaaaagtaaagagttcaaagactagagagatgagaatagaaccatgaaaaaactcattgtatctagtaaataaatagtagatgagtaattttaatgggttgaacagtttcccctcccaaattcatttctacctggaacctcagagtgtgactttatttggaagtagggtttttgcagatgtaattaagttgtgatgaggtcagactcgattagagtgggctgtaatccaacaagcagtatcccttataagacaaaggaaatttggacagagacacagacacacagaggggaagaccatgtgcagagggaggcagagactggaatgtcgcaactacaagccaaggaacacctgggattgctgggagccaccagaaactaggaagagacaaggaagggggtcttctctattgccttcagagggaatatggccctactgacacctcagtttcagacttctaaactccagaactgccagaaaataaatctcaattgttttaagccagtaagtgtgtggtaatttttcatggaagccctaggaaactaatacaggaatcaacaaaggagtggtcaaaaaggaaggccgtggaggcaacagtgtcaggaaagcccaggcatagtgaaaatctcaggaagtttacagagctcagtggtatcacgtctgcagaaagagtatattatggactggggggtggaaaacgctgcgaatttgacaacttccagatcaccactgacttgaagagatcaattttagttgccagagcaccatgtagagccctttgaatagcccatctccctcttgtgttctctgcgcttgggtcgcagtgggcttaattgtttgaaatcctcaatacactgttaagttccatagcagtagagtaatggtaaaaacatttgttttttaccaatgtttccctgttgtctagagactggaacgtagcaattgctcagtatgtgtggaaaggattgaaggatggagagaagaagtgaggaactagaaagttacgaatttagtttacacttgattttaggacatggagggggttgtttttaggaggggttataggtagagagttgagtgctaagattctctccttagaggtggagaaattagaggtaaaaataacagtttaggctgggcgcggtggctctcgcctgtaatctcagcactttgggaggctgaggcgggtggatcatttgaggtcaggagttcgagactagcctggtcaacatggtgaaaccccgtctctactaaaaatatgaaaagttagctgggtgtggtggcacgtgcctgtagtcccagttactcaggaggctgaggcaggagaatcacttgaaatcaggaggcagatgttgcagtgagctggatcacaccactgcattccagtctaggcgacagagcgagactcttgactccaaacaaacaaaaacaacaacaacaaaaatcagtttaaaagaagaaaaaaaatagtgaggtgacaaggcctaaatgagagtttgagctatattcatgtgctattgtactgtagcccacaaaccttgacacaaacttggaaaaaaaccctaagacttcaggactgaaagatgtagttttttacttattttatatttttgcctccatgtattttcttatctagtgtcagacattacgctgagagctttatgtaataatctcgttcagtcctcatgctacaaaaatgtatcattcttattttataaaaactgttaccattcttattttacagatgagaaagctaagcccagagaggttaaataattttcccaagggcattccattggtaaatagcaaagctgagattctatcaggcattctgattattgaacctacaactcttaactgcagggatggatatatacttgtagtttaatgaaaaattctgtcctattgaatttgaagtgtttcaggaaagcctttgaagatgtccttcttttttttttttttttttttttttttttttttgagacagagtctcgctctgtcgcccaggctggagtgcaggggcgcgatctctgctcactgcaagctccgcctcccgggttcatgccattctcctgcctcagcctcccaagtagctgggattacaggtgcccgccaccacgcccggctaattttttgtattttcagtagagacggggtttcaccgtgttagccaggatggtctcaatctcctgacctcgggatccgcctgcctcggcctcccaaatacactttcacatatgatcagtgcttcttaaatttttccagtctgtagatgtggtgatagggtcccaaagcagcagccttcccccacaagcataatatttttgaaatcacctcttgttttccatccaaattctatattttgctctactatgcatttttattagttttactcttataaaatagttttctaatttctatttcattacctgtactattagttaatggagagatcctgttgcatttataaaattaaaccaaaagcgtgtatcagacagttttctctaccttggtgccacaatattttgaaaacctagagttatacaaataagtaattacagatggcaaccatttttttcactgctttatcagccacatagtggtgaatcactgagaagagatattcagaatgctgctaaagcagctaaatcatatgttggttttagactactattggaaggaatttggtaagtgtgttttcttgttaacagttctcttgtatcatatcttaggctggaatggttgcttattcaatatatgatataggagacagcctcttttaactatctgaaggaaatacccaccaaagggcatttccagtgaagagagatgaccaatttggttgtgctctactttggggagtctcactatatataagctgaaccctgattctcaaaggactcgttatcactacaactagctctcttaagaccgctctcagacttcattttattgcagtgatctggaaacatacataagagtacattcacagttttatctatatttgttgattgaaaattattcagcgttgcagaaatatttgctaagtcaactttaaaccatttttcaaaaatgactaatgatttcattaatcttacatacatttttaaccctttatcatgacaccttttttgtttttaattctccatgaggaaaagccatttcaatgcaaattccaaacaccaactactatcttttttctctttagctaaatcatggtatatctgtataatataacaagctttcagagttcctttctacttcattagaaattatcttaaaagatgggtactcaaattactgaattttttctctttcttaaaacattcttttgaacacattaagaaaattcagagcttaaccttgatgtaagctacttttagtaatcgtgtattcagaatgaaagatggtcttgaagaatcaacgttttcacagtttatcctattgtagatttgactccttctacacatacaaccttacatttttttccaggcaatatctttatctctctaaagtctatataccgtgttgaaaatcttcagttattttaccattgagtataaaatataccttcataaataccatcatattaatacaatcaacatagaccaataaaataatttactaatgtttagtgctagtgctatcatctagtggtaagttaaagaacctgtctatcgagggtggagccaagatggctgaataggaacagctccagtctagagctcccagcatgagcaacacagaagatgggtgatttctgcatttccaactgaggtaccaggttcatctcactggggagtgttggaaagtgggtgcaggacagtgggtgcagcgcattgagcctgagccaaagcagggcgaggcatcgcctcacccaggaagcgcaaggggtcagggaataccctttcctagtcaaagaaaggggtgacagacggcacctggaaaatcaggtcactcccaccctaatactgtgcttttccaatggtcttagcaaacggcacaccaggagattacatcccgtacctggctcggagggtcccatacccgtggagcctcgctcattgctagcacagcagtctgagatcaaactgcaaggaggcagtgaggctgggggaggggcgcccgccattgctgaggcttgagtaggtaaacaaagtggcctggaagctcgaacttggtggagcccaccgcagctcaaggaggcctgcctgcctctgtagactccacctctgggggcagggcatagccaaacaaaaggcagccgaaacctctgcagacttaaatgtccctgtctgacagctttgaagagagtagtggttctccctgcacacagccagatatctgagaatggacagactgcctcctcaagtgtgtccctgaccccagagtagcctaactgggaggcacccccaagtggggcagactgacacctcacacggccaggtactcctctgagacaaaacttccagaggaaagatcacgcagcaacatttgctgttcaccaatatccaccgttctgcagcctccgctgctgatacccaggcaaacagggtctggagtggacctccagcaaactccaacagacctgcagctgagggtcctgactgttagaaggaaaactaacaaacagaaaggacatccacaccaaaaccccatctgtacgtcaccaaaatcaaagaccaaaggtagataaaaccacaaagatgtggaaaaaacagagcagaaaaactggaaactctaaaaatcggagcaccactcctcctccaaaggaacgcagctcctcaccagcaacagaacaaagctagatggagaatgagtttgacgagttgagagaagaaggcttcagacgatcaaactactccaagctaaaggaggaagtacgaacccatggcacagaagctaaaaaccttgcaaaaaaaattagacgaatggctaactagaataaccaatgcagagaagtccttaaaggacctgacggagctgcaaaccacagcacaagaactacatgaggaatgcacaagcctcggtagctgattcgatcaactggaagaaagggtatcagtgatggaagatcaaatgaatgaaatgaagtgagaagagaagtttagagaaaaaagaataaaaagaaatgaacaaagcctccaaaaattatgggactctgtgaaaagaccaaatctacgtctgactggtgtacctaaaagtgacggggagaatggaaccaagttggaaaacaccctgcaggatattatccaggagaacttccccaatctagcaaggcaggccaacattcaaattcaggaaatacagagaacgccacaaagatactcctcgagaagagcaactccaagacacataattgtcagattcaccaaagttgaaacaatggaaaaaatgttaagggcagccagagagaaaggtcagattactcacaaagggaaacccatcatgctaacagctgatctctcagcagaaactctacatgccagaagagagtgggggccaatattcaacattcttaaagaaaagaattttgaacccagaatttcatatccagccaaactaagcttcataagtgaaggagaaatagaatactatacagacaagcaaatgctgagagattttgtcaccaccaggcctgccctaaaagagctcctgaaggaagcactaaacatggaaaggaacaaccagtaccagccactgcaaaatcatgccaaattgtaaagaccatcgaggctaggaagaaactgcatcaactaacaagcaaaataaccagctaacatcataatgacaggatcaaattcacacataacaatattaaccttaaatgtaaatgggctaaatgctccaattaaaagaaacagactggcaaattggataaagagtcaagacccatcactgtgctgtattcaggaagcccatctcatgtgcagagacacagataggctcaaaataaagggatagaggaagatctaccaagcaaatggaaaacaaaaaaaggcaagggttgcaatcctagtctctgataaaacagactttaaaccaacaaagatcaaaggacacaaagaaggccattacataatggtaaagggatcaattcaacaagaagagctaactatcctaaatatatatgcacccaatacaggagcacccagattcataaagcaagtccttagagacctacaaagagacttagattcccacacaatagtaatgggagactttaacaccccactgtcaacattagacagatcaaccagacagaaagttaacaaggatatccaggaattgaactcagctgtgcaccaagcggacctaatagacatctacagaactctccaccccaaatcaacagaatatacattcttttcagcaccacaccacacctattccaaaattgaccacatagttggaagtaaagcacccctcagcaaatggaaaagaacagaaattataacaaactgtctctcagaccacagtgcaatcaaactagaactcaggattaagaaactcactcaaaaccactcaactacatggaaagtgaacaacctgctcctgaatgactactgggtacataacgaaatgaaggcagaaataaagatgttctttgaaaccaatgagaacaaagacacaacataccagaatctctgggacacattcaaagcagtgtgtagagggaaatttatagcactaaatgcccacaagagaaggcaggaaagatctaaaattgacaccctaacatcacaattaaaagaactagagaagcaagagcaaacacattcaaaagctagcagaaggcaagaaataactaagatcagagcagaactgaaggaaatagagacacaaaaaacccttcagaaaatcaatgaatccaggagctggtcttttgaaacgatcaacaaaattgatagaccactagcaagactaataaagaagaaaagagagaagaatcaaatagactcaatgaaaaatgatgaaggggacatcaccaccgatcccacagaaatacaaactaccatcagagaatactataaacacctctacgcaaataaactagaaaatctagaagaaatggataaattcctcgacacatacaccctcccaagactaaaccaggaagaagttgaatctctgaatagaccaataacaggctctgaaattgaggcaataattaatagcttagcaaccaaaaagagtccaggaccagatggattcacagccgaattctaccagaggtacaaggaggagctggtaccattccttctgaaactattccaatcaatagaaaaacagaggatcctccctaactcattttatgaggccagcatcatcctgataccaaagcctggcagagacacaaccaaaagagagaattttagaccaatatccctgatgaacattgatgcaaaaatcctcaataaaatactggcaaaccgtatccagcagcacatcaaaaagcttatccaccatgatcaagtgggcttcatccctgggatgcaaggctggttcaacatacgcaaatcaataaatgtaatccagcatataaacagtaccaatgacaaaaaccatatgattatctcaatagatgcagaaaaggcctttgacaaaattcaacaacccttcacgccaaaaactctcaataaattaggtattgatgggacgtatctcaaaataataagagctatctatgacaaacccacagccaatatcatactgaatgggcaaaaactggaagcactctgtttgaaaactggcacaagacagggatgccctctctcaccactcctattcaacataatgttggaagttctggccagggcaatcaggcaggagaaggaaataaagggtattcaattaggaaaagaggaagtcaaattgtccctgtttgcaggcgacatgattgtatatctagaaaaccccattatctcagcccaaaatctccttaagctgataggcaacttcagcaaagtctcacgatacaaaatcactgtgcaaaaatcacaagcattcttatacaccaataacagacaaacagccaaatcatgagtgagctcccattcacaattgcttcaaagagaataaaatacctaggaatccaacttacaagggacatgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaacaacaaagctggaggtatcacgctacctgacttcaaactatactacaaggctacagtaaccaaaacagcatggtactggttccaaaatagagatacagaccaatggaacagaacagaaccctcagaaataatgcagcagcgtacctacaaccatctgatctttgacaaacctgacaaaaacaagcaatggggaaaggattccctatttaataaatggtgctgggaaaactggctagccatatgtagaaagctgaaactcaatcccttccttacaccttatacaaaaattaattcaagatggattaaagacttacatgttagacctaaaaccataaaaacccagaagaaaacctaggcaataccattcaggacataggcatgggcaaggacttcatgtctaaaacaccaaaagcaatggcaacaaaagccaaaattgacaaatgggatctaattaaactaaagagcttctgcacaacaaaagaaactaccatcagagtgaacaggcaacctacaaaatgggagacaatttttgcaatctactcatctgacaaagggctaatatccagaatctacaaagaactcagacaaatttacaagaaaaaaaacccatcaaaaagtgggtgaaggatatgaacagacgcttctcgaaagaagacatttatgcagccaaaagacacatgaaaaaatgctcatcatcactggccatcagagaaatgcaaatcaaaaccacagtgagataccatctcacaccagctagaatggtgatcattaaaaagtcaggaaacaaacaggtgctggagaggatgtggagaaataggaacacttttacactgttggtgggactgtaaactagttcaaccattgtggaagtcaatgtggcgattcctcagggatctagaactagaaataccatttgacccagccatcccgttactgggtatatacccaaaggattataaatcatgctgctataaagacacatgcacacgtatatttattgcggcactattcacaatagcaaagacttggaaccaacccagatgtccaacaatgatagactggattaagaaaatgtggcacgtatacaccatggaatactatgcagccataaaaaatgatgagttcatgtcctttgtagggacatggatgaagctggaaaccatcattctcagcaaactgtctcaagaacaaaaaaccaaacactgcatattctcactcataggtgggaattgaacaatgagaatacatggacacaggaaggggaacatcacacaccggggcctgttgtggggtggggggaagggggagggatagcattaggagatacacccaatgttaaatgacgagttaatgggtgcagcacaccaacatggcacatgtatacatatgtaactaacctgcacaatgtgcacatgtaccctaaaacttaaagtataataaaaaaaaaagaacctatcagttttttcaagtatgtattttgaatacattaaaatatatcatttgatagcatgtaataggcatggccctttttgttttagcttttaggctgcctctttttacttttttctttttttgattcaatacaaatttggccttttctaagttatgtggatttagtttgatcaaaattacttctgtcatataaactccaccttccaaaaagtgatttgtaaactgatcttgaagaacttcaagtaatttttttggaagtttcttgttctatatgtgtcctattttattcttcaaactgagacttctatcattcagtcaattttagttgaaaaaaattctgatgatttccctaaaaaaatttttctattatgaaaaatttcaaataaataatctccctttatccatggtttcactttctgtggtttcactttccacagtttcatttacccataggtgagtacagtacaataagatattttgagagagagagaccatattaacataacttttattacagtgtatattaatcttttgctgagcataatttataaattaaactttatcataggtatgcatgtatagaaaagaacatatatagtgtgtatatatacagagagagttcaatactatctgcagtttgagtcatccactgggggtcttggaatgtatccctcatggataaggaaggactactctatatagaagtagagagattagtgtaattagtgtaataaactctgagtctaacccatctttagtaattatcagtatcttgtcctagttacatctgttctccactttttgttgatgttgttattgtttttctggaatattttaaaagaagtctcagctatatcattttatccatattatcagagccaacaaaaaattaacaataattccttaatatcatattatactctatctatatttttcccctattgtctcacaaatctgtgtttagatttggtttgtttgaataaggatcccgctgaggtccacacattatattagttgatatgtttcttaagtctcttttaatcagtaagagtccccttttatcccccttatgccgtttacttattgaagaaattggattatttggcctgtaaattttcccactttctggattgtggcccactctgtctttataatatcgtttaacatgtttatctattcccccatatcttctgtaatctagtcatcttatagagcttgattagatttgaactggattttttggaaagaatacttctcaggtgacagaataatattattcctattgtatcacaacaggaggcaagagatgtctgcttatttcacttttagcaatgttaaaattgatcaggtagtattagtctggcccatcattataaattcccccatgaatattttacatgtggttttagcatccattgatgtgtactatggtttgtcagcaatttccccaactcacaggatttaaatttagtcatttaaattcctccactaggaaggaggaggcatcctgccgttattgagcaagttctgtgcgccagaaattctgcttaacagtttacctacattctgtgctttgctcttcccaaatcttgcgcattccatacatcatagtagtttaataggaaaggaaactgcgaatagagagattaatctgttcaagatcatgtagctagtaagtgagcccagttctgcaggtttggagggttgttttatgaaaaattaacctggaaaatattaattctcatttatatgtagaagtgagtaaactagattaaaagtaaagaccaaactgaatggaatcaacaacatctgtagcatttgtactgccatcaataaagcaatgctaatgttatacatgcttagtacttcccttgccccaattctggaccattggagcctagcaaataatttatttcagtgataaatatccctttaatggaccaaaaatgtaagatgtatgtattttaaggaacaccatgacgtccaccaaataacatttttataaaatgaaaaactgtatcacaaagcattttctataagtctttaaacatcatttgttttcaaggtttggatttagtcttgttcagagcagcaagctgatgtctatatgacctcccaaagtcctttccagtcctgtgattctcacactaatgaattgaaacagaaaaggattattgggccagaacttggagagtcttcagagccagaatgtagaaaaagttacaaaatacagatgtctgtcagggatgggatccaaagagaaaagcaggccagaagttagaaatagatatgttattgtacaaaaaaaaaaaaaagttttaattttggcttttaaccagaataatttttttaaatattcagataaagctattaagctataatatccagttgagagacagtgaagtcctgtgattaaggatatataggtgaaaaaattcataattctttacattcaagtgaatacagaccagctgttggttcttcagacctgtgccagattgtaccttttagagaatctataatcttatatttttcattcagaagtaaaatcattctgatgccctttggaattgtcagtgttgcatatcaagaattataaatagaaataaaaacctttaaaatattgtataattatgtgagatatggcaaaaatgtttatactttttaacccaaaaagtaagccattatttttattgttttgttgtttattgttctattgaggaaaaagcctcttaaattaatgccattcattttaattgcatactaaacttgggagaatttgttatattagggagattttgttctttctgaggttttttgttttgttttaacttttcaaagggtatcttgttccaagaatacttttttttttctcttgggcggcagggtcaggagaagaggatcagagtaggcaacaactgagaaggttcctgattgactattctgtgtggatgtaagacctagtctatgggcaccactggttgttggatctgtgttgttgtcgtttatccatccatacaattttttagttttctgttttacatctttatttttgtaaactttcatgaatctcaagagaaaaatttgccacctataacctgtaatgtatcccctaaatagctaattaggtgtctatggcttttattctaccctataatgtgttatgaatttaactaaattgtctaaaaagcactccccaaactcatcttttccacattacattctttctacctgatgatccacgtaacaggacacaggttaccaccaaataatagtggtcagtgcagccagaaattctatctgcaaattcctgaattaagagccagtctttctagcccaggaaatttgcctctctgtagattttctaagggttgattttgcaagacttagaaaattatagattctttgagaggcttctttgttcccttagccacctgaaacctaaaaacaactaaatgaacagatgtatggtttgatatgttcagttgatatgtaaatagacatatttttgaaaatcctgtggctgctcttatgggaaatcaggtatgtataaggttaagagtgattggtgctaaactattatatgtcattatttcaagcaaatttgacatgacagacagtaggaaagaagaacatgatcaatgtcaaagacattcatgtttccttgtaatggtatatgtcacatatgtgcttgactccttttttttgcattctactttgtggagacagtgttgaagtggtcatttaagaatatgactgtgtttgcaaactatatactcaggagtatatagtctctctattcgcagtttcctttcctattaaactattatgatgtatggaatgcgcaagatttgggaagagcaaagcacagaatgtaggtaaactgttaagcagaatttctggcacacagaacttgctcaataacggcaggatgcctcctccttcctagtggaggaatttaaatgactgaatttaaattctgtgggttggggaaattgctgacaaactatatactcaggagtatatagtttactatataaacatgagtatattcatgtttatcagatttaaacaaatattttgaaattccgagtagttagaaaaatttatttttaattttttgggtacatagtagatgtatatatttatgaggtaaatgagatattttgatacagtcatacaatgcataataatcacaacagggtaaatgcaataaccatcacctcaagcatttatcatttctttctgttataaacattccaattatattattttagttatttttaaatgcacagtaaattattgttcactgtagtcaccctgttgttctatcagacactagatctttttcattctaactgtatttttgtatcccttaaccatacccacctcccttcccctgccccaatactcttcctagcctctggtaaccttccttctattctttatctccatgagttcaatcatttcaatttttagctcccacaaatgagtgagagcatgcagagtttgtttttctgtgcctggcttatttcatttaacgtaatgtcctccggttccatctatgttgtggtaaatgacaggatttcattcttttttatggctgagtagtactccattgtgtgtatgtaccacattttctttatctgttcatctgttgatggacacttgggttgcttccaaatcttggctattgtaaatagtgctgcaataaacattagagtacagatatcttttaaatatatgatttcctttctttttgttatatacctagcagtagcattgctggatcatatgatagttctatttttagttttgtgaggaccctccatactgttctccatagtagttgtactaatttatattcccaccgacagtgtacatgggttcccttttccccacaccctcaccagcatttattattgcctgtcttttggataaatccaagtagttttatgtgtcatgaacaaaacgtattatacacataatgaaaattaagttttctgatttttaagtttatatgcaaatacatcttaacatcttatctattttttaaaaagagacttcacaatggtttgcaataattacatttttatttcctgtcagtggatttatgtgtgtttgaaatggtttatattttatatgcatttagttttaattgaatggtatatattttatattcattcgtgatgaagtatttctaaggtagaaaagaccttaagttgaactctgaaatagcaaacacattgtggacatttgtgaatttatgttacttttatatgtttatttcttgacccttcctccagaaagccttcccctgatgtcccctgtctccaaccaggtggaaaagttgccccactttgggacacttatattaccctttcctgggcccatttatattacttccttccactttgctcttcttgagaacagagtttatataatatttatctttgatctccagtgcctaacatagtacttagtgagtgttgactacgacttcatgaaagcttaaaatgaaatagaagaagattatcttaatgtactgaaaatgtaaagcccatagtctgggctttacgtgagcaggctgaagagcaggagacctttgtagcacttctggagagggttttgaacaaagacatagaagctgagattagtgcttattctacacaaggcaccattgtggagagacaggcagttagaggggcacataagttagagttctctgtgcacagatatgcacagataacaacattagatagtattattaagtgccgtaagagtttaaaccatacatggggtgttttgggaattcagaaattacttctaatttggatgattggggagggctgtttgtttttgtttttcttttttgtcagaggtgtagtgagtagttttgaaagatggatgagatttcaagaaactgaatggagacaaactgatgacagctaaaggtctatgtagtgtgaagtggtacattagtttgggcagagagttaggggccagaattggggcctaattccttaggaatgttgatggaatttgcacacaattgtgttttgaccacactgagatttattcccctaggacatttatccagaataccagaggtcaactaagataactattttcaaaactacactgtatagtctgccccttacttaggagctaattatgcaggcttattatttttttttagcttttcatgctttttattctttctccttcctgttatctgcctataaataatttttattttgatcagcacctccatcagagtcaaaatcatgagtgtcttgcctacttttcatcagctctacagtatgaaattacagacttattatatgagaagaagatctcttccactgatagttaaattaattcatttaatttaatttggactgtaaagacatattcaaatctaccagaaaagtatggaatgagtacattggtaaagaaaatgcttatatttttaaaacacacttcaaatcacttctagtaatcccaggtacttgactatttattacgtttgtaagttctatgaagtcacgaatcatgtctgtctgcctcgctgatcgttgtatccctagtttacacttatcatggaaacatttaatgaatatttgataaatatattaagtatacttgataggctaattaaaacacatttttaaacatacatttctatatgtatgtaatatatgtgttacatataaaatcactttcaataaagtacagacattgtcaagaattgtgaaaagttagagtttgaccttatttgcaagtctcatggatagaaaacatgagaatgctggatcagagatgaaacatagttctttacctacaacagagtgtctgcagatatgctagttccaaaccctaagtctctgaggatgacatgaagaggaccagctgatgtctgcacacacagggagttgtattatagtagaggactctgatttggaggacctgaatcttttataatggacagtaagcctgcctgcccttttctttctagggagacaactatctgtcttcgttgactgtttatcatatatttatccttgaaaaaacagtctggactgggtttgtggcatgcgcctgtaatcccactcaggagactgagagaggaggatcgcttgagcctaggagttcaaggccagcctgggcaaacatagcaagactccatctctaaaaaaaaaaagtacattttaaattttaagaaaagaaaagatagtctggggaaaaggcaggcaatgcctttacctataagatatgtgaaaatgtgctagacccatggagaactattccctagtagacatataccctaaagggcctctgtaagggcattgcttttcatctaatcaagggatcagcagcaaactacagcctgtgggccaaatctagcccaccacctgtttttgtaaataaaattttattggaacatagacacatatgctcatttacatattgcttatatactacaatagtcagagtcaagtagttgtagagtcaagtagttgcaacagagaccacgtggcaaacaaagcctaaagcatttgttctatagccctttacaggcaaagtttactgaccctagatctagcctaaatatttgacatatgaggaagctttgtaaaatatgctaagttgacttttttctaaaatatttaaaaattttaagttattctctaatccttattgacttcttcacagttactgagagttgcctatctgtactatagttttcacattatcaagagttattaagaacctattatctacctctgaatgtaaaacttgaaaataaattttgaaagaaccaactatcaatgattacacctttttagctttaaaacaatcatgtaacaagttgtcacagtgtaagtgtttggtttatgagcattgcttatttgtcagtttatatttttgaaaaccatgaccgtcaagtaactgaaatacgggagtcagtatgacaaggtgaaaaagcttcctgggctctggaatctccaggagtcccggctttgcaactaattatcattgagatccttgacaggtttttttaactttctgaactttattttcttgatctgtaaaatggatatactcttactaacttacagaattaccattaaaattgaataatgtaaatcttcacatgtagtatgcattttaaaatattagttcttttcctaaaatataaacttaaaaaagtaaatcttatgtatttcttcagagttggaaagaactaaagtagttcttattctatcttcctaaatttttgtgggtaaggaaactaaggcttacgttggttaggtgactttaactcaagatgacaaaactagttagcaagtaaatgtagaattaagctctccctgattcccaagtattgttatttatagtaaatgatgtacatttgactgcatttgatacaaataagtaaaatatctgaacagttagaaatgagactaaaacataatatgagtttagagtttgtagtctcattaaaagacaccataaactagtaaagttgcccctgctctaagttttaactcagaagttctgagtatatttttattctttctctttaaggaaaaatattttcttgaaagatgtcatattacacacctgcatttgcttgaaacctggtagcttgataaatcgataagataactgggtcatatgttaagttttttgaaaaaccaacccaaacatagattctaataaaagaacgttacacatttccttttaaagtctaaaaagtatttctcagggctcttaaattaccatattctgataccaggggaaaataaaatctggacttagagtcttgtttgtacttagagggttttccggacaggaaggcagtcttgatgcaatgcagtaagccacaataccagtggggcattacaggtgaaaaatctgcagctgtaccccttcaccacagtgtattacaactgtatgctggaatatttcctgtacaaaaatagggtttggttaactttgtttcccaagagtagatcacattaaaatgttataaaatcatgatttcctgcatttgaatacttgtggtttctcaactggttccaatagtataagggtttttttttttttttttttggtatgacttctattagttgaagatgtatagaagcttttcttttccttcttcaaaatcaactaaaaagcagatacatataaaaagaaataatattataagctaaaacttttgagattgcaagcacattcatcttttatctcattggtagattttttaaatgatatagaaactcaaaatccaacttccattaccagaatacattttatttttatttagtaactattgaaaagtatctctactcaatttgcatttgttttgagtgatgaatatgtgtctcctactgtaaattataaataactgattgtaagaaatactctttatgtttaaaaggacagttaagccctaacacattcataaagagaaacctcccattattgtacaaagacaaagccggtttcttagcctattaaggttttgatgttcataatgctgtccatttatccctatctctagataaggactgtctctttcagtcactgaacatgtctatttcatgcccagacctcactttctattttttaactatctacttactctcctccagccatcagtttaaaactctttcacctatgtacttgtctactaattttctagtacttttctctttggggaatatatttggttttatcaccatcttaacattgtataagtgcagtatatacttttactttgttaatgacataaaatagcattctataattgaaataatagtttcacaacaattactctttcaaaagttactaattaggagctttcaggggcaaaaggcctcccccaacccccatgcccccactccctgccacaacacctagggttgtatgtcaaaaataattagaggcaattgattagttttaaagttgcttgaggcagtgggaaccagttggggtaaacaataggctaaccaaaatgtttgaaaggaaaaacgggaatgagatgtccatggggttttgaaaagctccaacatattcctgggaaactacaagtacatgctcatgaataagactatgcacacccccagggatgtgtgcctgctcagggaagacctgagaaggtcctgtactctcacctctgtctgtccttaaagctctgtgcaagcagtaagtgaaggctaaggaggagttgaaggtgtgcgccagagctcaaagagcccttcagccaagaattggaggcttattggttccagacctttagggaagtctgtttaatcattagctgactactacactaaccaagtggagacttcactaaccaactggagacttcactaatcaattggagacttcagtggccacacaatgaaaattacaaacttcacaaaattagctcataaatattactaaacaacaactacaatgtatagcaaggataataaaccctgaggaggctggaggcggtggctgatgcctataatcccagcactttgggaggccgaggtgggcagatcacctgaggtcaggagttcaacaccagcctggccaacatggtgaaaccccatctctactaaaaatacaaaaattagttgggtgtggtggtgcatgcctgtaatcccagctactcaggaggctgaggcaggagaattgcttgagccaggaggcagaggttgcagtgagccaagatcgtgccactgccctgcagcctgggcaacagagggagactccatctcaaaaataaataaataaataaataaacaaataagcaaaccctggggaagaggaaggatctgatttttaaagttccctttgtttatttacaataatatagttaataatgttatttattaatattataaaatcttatatcattaaaaatgccattttcaagaaagtagtatgagatgggcaaagaaataagaaagtacagcctgtatatgttaaaaaagcgatcaatagaaattgtccctgaggaagcccagatgttggacttattagacaaatacttgaaatcacctgttttaaatgtattcaaagaactaaaaaaggccatgtctaaaaagcttaagtataggaatcatgtctcaccaaatatagaatattaataatgagattgaaacaataatgtttaaaaacaagtacaaattccagaattgaaaagtgtaataactgaaatgaaaaattcactagaggggctaagcaacaaatttaagcaggaagaagaatgaatcagtgagcttgaagttaggttgttttgagattattgagtctgaagaacagaaaattttaaaaaatgaagaaaaatggacagagcttcagagatctgtgacacaccatcaagtgtaccaatatatgcataggggaagtcccaggagaggagagaaacgggaagaaagaatatttgaagaataatgggcaaacacttcccaaatttgatgacaaacatttatctacatctaagaagctcaatgaactctaccttaaataaactcaaagatatccacacttagacacaaactgtcaaaagacaaagaatattgaaagcaacaaaagagaagtaactcatcacatataagggatattctaagattaacagctgatttctcatcaaaagccatagagaccagaagacagtgagatgacatattcaaagtgctgaaataaaaagactactaatgagaaaaagcctgccaaatgaagtaactataaatgactgggataagtggcaaaaatgaaaatgtattctccgtttattgcttcctaagaacccactttaaagaaagtggaactggaaattgtaaatggcacattatggggtctatcttatttaatctaaaaattattaaagagcataggatttacaaccagaaagtttgccacttactaaatgtgtaatcttgagcaggttacttaacttcactgagccatatttcactcatttataacatgggaataatattttcctccctgaaataatgtgtaagaaaaatctgtaaatttgtatcttgtagagggctattcaaagggtagtttcttctaccacagctgccatcactacctgctactatcaaaacaccgatgatggtagatatatagctgttcttctgctataattacccaatttggcaccctgggaagtctagaaatatggcgggaaaagtgatgaagagagtatcctctgctgtaaccaaactctaataactaagtctagaatggaagctctggctttgtactcactaaccagacttacaccgtcagctaccctgttttgtcatagttgagcagacctgataggctacatcagttgctagatctcccctctctacctaccaactctttattaggctacatcagttgctagatctcccctctctacctaccaactctttattatgcacatatatacagcaaagacacttcctttgttgttttgcctaggttgcttagttggactgagtggagaaaggggtaatggcccagcttcagcagcccctgcgcaaagaaatccatgaggacagatgggcagtcataaccctgctaacagtcttggcagtactattaagtaataaaaacaaattaagtgccaaaatattctttgtaccaaaaatatttttaaatggccaacacacatgcaaatcttcccaaattagccatcaaatggaaacaaattgtggaataacattttaaatgcaaaaatacatgtgctcttaccaactggcagatatacaacctaagatattcatatgcaaagactacatatgcttagagtacagtttattatgtatggctggctaattttttaggtcctgtcaaataatggataggaaaacaaaatgtaataaaaaaatatataatcctgacagtcatttgaaatgtaccatgtgttacatgtggaatgttttccagtgaaaccaatttacttgttcccacttcccatgactcagtactagatattcgggctttctaaactatttttttggcaccaaactcttggaatagtcatctttccttcaagttattcagtacaggcattaataacaaatccttagttatagatattgtaactaaagatcattcacgtcatctctttcaaaactaaaagcacataataaagttattttaaatagatcacacaaaatagagcccagagttattccttgagaataattaattgctaccatatgaagttataagaacaataagaccacattaggtttttagcttaattatgtcaccaccaactagagattagttgggcaatgtcaacttctaactgaaagacaagagaggattagtgagttaagttaatgcaaagtttgttaaaaattggcatgaatgcaaaataatttgagtggaagtaccagtatattaaacaagatctttttagaataaaagactgctaaagaaggtagcatggttatttttaagaatactagtctgagaacgtagaataaaagactgttaaaggaggtagcattgttatctttaagaatactaatctgagaacacatggcatgcaagccaggcctcaagaagtagtagtaggttacctttagaaccacagccattgtctctactcctcctaaatcaggtgtcagttccaccacatgcttcacttccttgttttctagtcaccacccaaactataagatgcatttcttcctgtctagatactgtacctactcttaccaacctccctcttcctcagccttccatgcccttccactttgccctctggatcatcttctccttgattaatgaactctcccctaaacctccacctgttcttccagaagttcttctgtgccattactttgaataaaattttgctgtcccctgggacctagttcaccattgcgaccctctgatgtggaggctctcacgttctttttgtctcaaggccaggaggataagtgttctccttgctcaccagtgccactggcctttactcttcaaccctcttgtcaagtccccttgcttctcattttctctaattatattctcctcatccctctttgttgttgccatctactaactttttggtcattctctcccattctcacaagtccttaccccatggctgccaacctttttcttcactgccataaattacccagccaaaaccctacgttgatctcatatctctaggaatcttttccactccatttaactactcactcccatgcacaagccctggatcttgtcatcatccacaactgctgtgactcctaaatcattattccagcatcttaagctccctcacagtctttcatagctctctgtcctgcttattcaaaaacccccactacagttattcattaaactattcattaaactgtagttctctgatgtcctcttttcatcagctcaccattttcatatcctcttttaaccagtttgcattcttagttcatcatttaaaataccttcttacaaataagtaacctaaacttcattgccctctgtttttccactatacactcctgacaaaaggctagtgctgaatgaactgtagctgtgtatcagcacagttaactccctcttccagtctccagaattgccaaccccttattcagtatttttgctgggatggctcattggtacctgcagctcagaatggccaaaaatgaacttctgatctctcctcctctacccacatatactacgtatcagtcttacccatcccagtaaatgacatcagcatccatatggctgctcaggctaggaaactgggagttattcttggcacttccctctcacttctcagccaatcaatcaataagacttattaattagtatgtcccaagaatctcttacatactactctgttgccaccaaccatactctcagctatcaacatttctagcttagacctcctaattggtcttattgcatccacgcttgtctctttttttctttttcttttcttttctttttttgtattattgttattatttttgagacagagtctcactctgtcacccaggctggagtgcagtggcatgatctcggctcacttcaacctccgcctcccaggttcaagtgattctcctgcctcagcctcccaagtaggtgggattataggcgcccaccaccacacctggctatttttttattattattatttttagtagagacggggtttcatcatcttggtgaggctggtctcgaacttgtgaccctgtgatccacttgcctcagcctcccaaagtgctgggattacaggcatgagccactatgcccggccacttgcctctttttattccgttgtctatagtatccaaaatctttgaaaaatacaaatttgacatcacttctttgctttcagcccttcaaagaaaataaagtcaaaaatccttaatttggcctaaaaacaatacaggttttattatccttgtttacaagtgagggaactgaggctcagaatcattaaataggttgcccaaggtcatagagcagtgatttaagtggtagggccaggattttatccgaagtgtgacaccaatgacttttttttttgtaggatggagaaataagataatgtaaagatgatgtctacatgcttttaaaagtaaatttatggttcaatatgtatttgaataaaatctttaaaatattgtactcagtgttgtttttaggttttatttcgatgtgttaaggacaaatagagttagccttttgtatccatcagttctacctccatggattcagccaaccaccaatcaaaaatattcaagaaaagaaaattgtgcttctactgcacatttacagacttttcttgtcattatttcctaaacaatacagtgtaacaactatttacatagtatttacattgtattaggtatcatgaggaatctggagatgatttaaagtatatgggaggatgtgcataggttatatgcaaatactgcagcattttatatcagggacttgagcatccatagattttggtatctgtaggtagtcccagaaccaacccctcatggatactgaaggatgattatatattcttataatgggaaaaaagaataagtacgtgacttttatacatgtatttaaaggcatacaacttaaatttttaataggggtttcatttggtgtgaatttattaatatgcctttgttaacagagtaaaatagggcacataaaggaaaattctgacgcataactgacatactttggtatgtatctccatagtaatctattgttttctgaattttcagagtagctgagaatattccagctgaagtatgtaactacagagccagcctcacacaagttgtgaactaaataaagtttttctttggcattcttccacatctcttactttaggctcccagaattcctccttccctaaaccccactgttggtgcagtccacattcattgcccctaggctacctaatggcttcccacagcagttcccatcttggactgccttatattatgtacctactccaaccctcgccttgtacttaaaaacttagtggtgctttttccttaaggtcctactctgccttccaatgtgccagctaatttttataagctattatatattaattttaatgcagaatttcaggagatgatgctggaaacaagtattttttgcatattttctgtataccctctccaccaaaaagattacattgaactttatattccgttatttgtattaccaaaaacaataggtatattaatatgctttttcttttgggtggatgataggcaattttatattctttgttgtacttgtgtttatgcaacattttataataaacacattctttaattttttatttttagttagtatgggtacataatcatatatatttatggtatgggacacgtaatgttttgatacagacataggataaataagatctgatatttgatagcacagcaaggtgactatatcattaaattattaatatgctttttctcaactcatttgcccttcccttgtccactgagtttttgtttgtttgcttgtggttttttttttatttttttgaaacagggtctccatctgttgtccgggctgggtgcagtggcacaatcatggctcactgcggcctcaacctcctgggttcaggcgatcctccgacttcagcctcctaagtaactgggaccacaagaacatgccatcatgcccagctaattttttttcctcctgtagagacagggtcttaccgagttgcccaggctgatttcaaactcctgggctccagcaatcctcctgtctccacttcccaaagtgctgggattataggaattaaccactgtgactggcctccactgagatttttatatgtctctctagggatttatactccagttaccatatctcttccaccgctggttgttatgagtgtcttaaaccacagggctgacccactggcagtccagagagtagttaagcaatgatatattcctttatctctgaagtcatagcatatatggagggccacacttttaacaggtatgtagcagaaaataatattgaactgtgggtacagtgttcctgaacatccagattcatagtttattattttcttccaagaagtccaacccattattaagaaatctaataatcagaactcttacaacttacctgattctggcaacaacatataagcttccaaagtgttctttgagcatgagaggggtaaataatggctaacatttcttaagctcttactatgtgatattaaataaaatgctttgtctcatttaatatttatgaaaattcatgagggtagctatattcttatcccccttttacacatatgggaacttgtgttagaaaaattaatttaatttaggcctggcacagtgggtcacacctacaatcccagcactttgagaggccaaggtaggaggattgcttgagcccaggagttcgaaactagcctgggcaacagagggagaccgtgtctctataaaaaatacaaaaattagtcaggcatggtggcacgtgcctgtggtcccagctacttggggctgaagtgggaggatcgcttgagccagggatatcaaggcttcagtgagctgtgatcacaccacttcaccctagcttgggcaacagagtgagaccttgtctcaaaaaaaaaaaaaaaaaaaaaaaaaaaaaagaagagaaaaattaatttgcccaagaaaaagttaatggagctaggatttgaatcccgatagatctgatccaaagttcatactttcaacttctatacttctttgtggagaatctttaatgtgccagagatgggttgaaccacccagaatgtgtatattcattcattgattcatgaattattcattcatttattcagcaactctttttgaacatttgctgtattcactatcccaggtgctgtgaaaattcaaagcttagccaaatagaaatcattccctcaaggaatgtgtccaccagagaagatgtcacatacagaaataactataacatgaagtatatagtgataagagctgtaaaagacattcccattttaaaaaaattatttgtgttcagaaaagagaaaggatttttccatctggggaggtgaaaaggctgagataggtggtattctatttggttatggattgatgtgaaggatttagacctgagacagtgagaaagtagggggtatagaggtatttcaggctgagagagaatataggagcaataacccagagaaaagaagttagagaaaattatgtcatggaaagcaagaaaagagagaatttcaagaaatggtggctaaaagtttaatgccatggatatgtcacttatcactaaccagaatatgtgctactatttcatcacatttaccctcttccgcatatccattctcccctcgtccttacagcatctcatcatatatggatgctcaagtcactgtttaaagaaaagaaacttaattataggtggaggtaacgtttatttcaacatttagtcctgttgaaagattgagaattacttatttaggaaagaaaggttagggagcaatctgttcattaaagaagcttttttgagatcccattttgtcctcaaaactgtgttaggtgctagtaatatttttttaaataatgtgccatttctgccctcaaggatcttagagtcaactaaaggagacaaacatataaataagtaattacaaaatatagtgagtcctgtgttagagtagtgtactaggtatagacatgacacaagagaggcagtgatcagttctgaggatggtaattagggaatgcttccaaaaagggaaacacatctgagccactcttttattttttaagacacataggattaacccacatgttctcatcctaaacaaaataatatttcctagatgtctttttgtgttaatatagagagagattcttttttttttttttttttttttgagatggagtctccctctgttgcccaggctggagtgcagtggcgcgatcttggctcatggcaacctccacctcctgggtttaagcaattctcctgtctcagcctcctgaatagctgggactacaggcacctgccaccacgcttggctaatttttgtgtttttagtagatacggggtttctcaccttgttgatcaggctggtcttgaactcctgacctcaggtgatccacccccttggcctcccaaagtgctgggatttcagacgtgagccaccacacctggcatagagatatactttattcattttaacagttgtgtagaaatacatcctatagatctgcatgttacatgtaaccaatcctctattgatgatattcgacttgtttcaacttttcttattaataaacacagtactgaagtacatacacacacatatgtatatacatatatatgtgtgcacacacacttgtgctttggaatctctgtaaaacaaattcttagaagcatacttcctaggggaaaaaaaaagttttggctaggcgcggtggctcatgcttgtaatcccagcagtttgggaggctgaagcaggtggatcacctgaggtcaggagttcgagaccagcctggccaacatggcgaaaccccttctctactaaaaatacaaaaattagctgggcgtgatggtgcatgcctgtaatcccagctactcgggaagctgaggtgggagaattgcttgaacccaggggccaaggttgcagtgagctgagatcgtaccacttcactccagcctgggtgaaaaagcaaaactctgtctataaaagaaaagttgtttttttctcatgcttgtacagtactcagaccgatcagtcttcttaaactgaaaggttagtaaataaaatattacattattgctttaatttgaatctctttgagtattggtgaagttgagtatctttttatctttttgtgtttactggctggttatattttttcttctgtgatctaactgctgtcaggatctgggattttacccagtgcaagctagtaagttatcttgttagtgtttcatgggtgctggcagaaggaataagactcctggtcagaagcaaagaagtctattgcttgtggcatggcaagcagcatgagcatcatgttttcattggttccccttgttcccaagtcccacaagcgtgatgcagaagtgcccccagggggatgctctgcttgcagtagacatttggcacagttgaggaacttgtaaaatctaccttttctctgtgattatgtatcattttctcattgatttgtaagagctctctcctatcagaatgaatattccttcacctgtcatcaaatgttacctgtcttattccagtttactttttaaaatttgattttatcatgggtttcatgccatacatacaaaagtctaccctattataacattttaaaaatattaacatgtttcttctcttacactttcacttcttagccttcagcagttttatccttttggagtttacttttgtgtaaagaatgatgtagggacccactttggttttaccaagtgactagttagttcttgcagcttcattttccgtctttctcctacttatttggtgtggcaccttcattactttttttttttttttttttttttttttgaggcagattcttgctctgtcgcccaggctggagtgcagtcactggtgtgaccgctgctcactgcaatctctgcctcctgggttcaagtagttcccctgcctcagcctcccgagtagctgggattacaggtgcacgccaccacacctggctaactaatttttgtatttttagtggagatggggtttcaccacgttggccaggctggtctcaaactcctgacctcaggtgatctgcccgcctcggcctcccaaagtgccgggattacaggcacaagccaccatgcctggctggcaccttcattgcatagtaagattttgtctgtacttagccctttctctgctattttattcttttaatctatttgtatgttactacactagccttatcttttacttactatgggtttataatacatttaacaccttgtagaatttgttctccattattacttttaaaattttggctgtttttatatattattcttgaattggtctttaaaaataaacaggatgaatatacaataatatgaaaagaaatcctaaactactgtcttttataaccttattctcctctaaaggtcttaatgttataatttttataaaggtttaatttgaatttcaacaaatataaaagcatagtttctatttgcaacttctaaattttttttattttaacataggttccttgtagcttggaatactgggatgaactccagaaggtttttgttgcatttagagaatttaatctgtctgaaagcaaagtttgtgaactgcagttgccggatatcaatctcgtgaatgaccagaagaaattagtatcttcagatctttggagaattgtcttgaacagcagtcaaaatggagctgatgaccaaaggtaattcattgaaagatgatatggtagcattacactgggaaacaatgataagtcatcttttcctatctagtgacccctcacttaactgtatctcagctgtctagcagctgcatctctctgaacaacagatgagaaccacaaagaaagacaaaatctgatgtttcaaagtctgcatactcaaaatcctgtgtttttactcataatacagctctgtgagccctcactaagaacctgttccttaaatataaaaagaaaaaaatggaaaaaagcaagttaaacaaaaagtctagtcatcttcaacctcaaaatacagaggcatacagtcatacacacacctcaatagaagcttaatgacatcataatcaatatgtgtaatgattatcctggggcattaaaagaaatgttaaaaaaaaattgaattgtctccttctaaaaggtaaattttaggaatattttcatcttaattgtttttttaaaactttaaaagacaagcctcccctaggtgacaaagtgcaactctctcaaaaaaaaaaaaaaaaaaaaaaaaaggcgacagtcctccagacactaagaaacttgtgtagctaaccaaaataactcatacccaatggattttatacagataaagttttatccacctataaagcctcactggccataaagaatccctagagctggccgggcacagtggctcgcagttgtaatcccagcactttggaaggctaaggcgggtagactgcttgagcccatgagtttgagatcagcctgggcaatgtggtgaaaccccatctctataaaaaatacaaaactagctgagcatggtggcacacacctgtagttccagctacttgggaagctgttggggagaggatcccttgagccccggagggtgaggttgcagtgagccgtgatctcaccactgcactccagcctgggtgacaaagcaagaccctgtcacacacaccaaaaaaaatctctagaccagattatcctcatttcagtttttgcctacttaacacatccactaatttacagtagagaaaaatagcttcagcaatctattcttcagcacttctagcttacacacatttgctaagtccctttgctcatgcccccataaaagacgataaacaaagtaaaccacaaccagtggaacagctttcttgggtcatatactatcatgtgtactgtgaggctatgctgttcattgctgtggatgccctacgtgccacttctcctgatgggctggcttagtgttgttatcttattccttttatgtaataccttcttctttccctggaaacaacattctgacagtaacagaaaaaaaaccatccaccattccaataccttgcaaatcaaatgttttttcttttctctgttaccgttctttttgcccatatgtgtacacgcttttacaaggttataatcatagcacaccactttgtattccagttcctactttttattataaattattgtgaatactttttctttggaaatatttatttttattaacatatgttcattgaagaacatttggaaaataaaacaatactgcccataattacaaggagataacttctgttaacattttggtttgtagcctcatagtctttttcattgattattttgtatgcttgataataatgtgttttgtgttttatatttcatatattctatttctaggtcatttgggctctttaaaaatatttactttcctaacagtttagctagtattgtagaattagtgaaaatatattagagaagtagtgttttaattttacctgcatatagttcagcaataaaaagaacacccatcctgtgatgaattatttcatggatggaaagattgctttttctaagttcaggttatctcatcagaaaccaggaaatctcagaaaatagagctatggataactaaattgatttttttaaatctgagtttcattaatagtatcaagttagaaatgacttcttgattctaattatgaagtaatacattttcaccatcgaaagaagcattgtagagaaagctaatgcctctgaatctgaaacatttataaaaattacttttgtggtaagcttagcagtatagaaatgtggagcctttaggaaacagaaatttaagcagataatcaaattcaggcagtttttcaccaagcatctgacattgtagtcacagatctttgtcctcaccagggatttttcaccttacctaatatttcacaatttatctcactttaaattgtttgagactaatcatttttcagatagaagttgatattaatgaaattaaattagaagagctggtttaaaagtcaacaaaataaaacactattaaggattatatttgtttcatccaatttctagaaagaaaacagtaatgatttgataatatgtcaatatttcatgcagacagaaagcttttacagttagcctcagtatattctgtcacaagagaaatctaaatctggacaaaaacctggtacttttatgattagagattgtcttataaaggatagtctcagtggtttgagaaggatttacatcagactattggacattactggaagaaaggtcacaaaaatatatcccatgaagcctaatttaaaaagaagagcctcttgcctataattgagatgaagttttaatgttcctgtggtaatggcatcaccgtaaatatgtaaatagagatagcatttaatagatgtagaagacctctattccacctttcaaggtgaagacctaggtttaaggcctggctccatcaacaatatgctatttggtgttgtgagattgatttctaaactgagactttaaggaatgaataggcactaaccagttcaatggatgacagggagcccccagtgcaaatgaccaaagacaaaatagagtcaataattgggtgggttcagtggctaacatctataatccctgcactttgggaggctgaggtgggaagatggcttgagctcaggagttcaagaccagactgggcaatagtgagacttttgtctccacacaaaaatttaaaaattagccaagcaaaacggtgcatgcctgtagtcccagctgatcaggaggctaaggtgggaggactgcttgagcccaggaggcagaggctgcagtgagccaagatcacaccactgcactccagcctgggtgacagagcgagaccctgtctcaaaaaataaaaaatgagtcattagttaggttcctatatctttaactaatggtttgcttgatcatattatggtttttgggagggagcatttgaagtaaatgttgacctttatagtactgacctttgaaagccttccccttctatttgctgtgcactggactagaggcaagggatgcaccctctggagccctggtcatgctatccatttcagctgtttatcttactcccatcgtgtatgtatttgtccacacccattgcctgtttccaaagcctaagtaaacctcttatcagtcaggttctgacaggaaacagatggcaactcagactgggtgactggggaaagtttaatgaactgcaaaagtatgggctaggaaccctgggaaactgtcccaatcttaggccaaaagaagccaggtgatagagccattatcaaaactctaactcagcgaggatgtttgtagctacgtttggtagaggaacacagctaatgtacagagatctggctgcaaaggaaccgggaaaatacatacccttacctcattcctcttctgccttctaagtcaccttgtgggtacctcccactgactgaatccgaggacaagccagaggacaaagtagcttgttggtgcagtccagaaagctcccttccggaggcaaagaagaaggtggggaatggtagaaggtgggtcaagagagcaaacagaagacatccagcaagtgcacactcttatttgcaattggcagcttcttaccaggtgactaaccctgcgaggaacaaaagggaaaaggaatcatgagccctactctcttgggccagcctggcaggttccctgggtttgaaatcaatcaggtgtcttctgatggatcagaacaatttttactttatttattccctcttaccttcacccctagagagctaattccagaaatacttattttggctgtggaaagtcacacaaattacagacatttattatataacacaatagtaactgtgcagatctcaatatgtatgtctggttaattctgtataagttgtttgatgataatgttaaactcttgatctgtgccaagactttggtactttcctgtccatatttcatggtcatcttctcacaatattaaagcatgtgagagcagattgcttgtaaggactttttatctctacccacaaaatgctgactcatgacagaaggcatcttggaaagagaaatggcttaagggtgtatggctctttcttcatgtgataaaaattaaacctctggcgagttgtataaagtgctttttaatatatctatatattttttcttcctactcccttaaggtctcataaaagaaatcactgtccactcatatttgggaatctttgagacagtgatccacagcctgtgtatatatgagtgtgtgaatgtgaagaagaactccttttcatttcccaaaacctttattcttgtgtatatagacagtggaggaatcagagaaagcgtgatgatgaataagtccctgaatcatttcttttctctctgctggttgaactctctcctcccaaaaagtgactgtggccttccagatattgtttctctccatttggctacttgggtctgcccttttagatgtatctagatttttgggtaattcatttagtgttataagccatttatacataaatcttgacatttggaactgctttgtcacctgtgtttctagttacacactggtataatccaggatttatccagaaaattctttcctttacccttccctaaggctaaagctgagtttttgtcttctcttccttgaatggaaggaatacttacattttttccccaggtttgcttttgaggccctttgctattttcttttaggtggtgattgaactctgtatacgaagtcctccagggagttggcctttgccatgcagtccttcttgcatacacagtccctgaagtactcaggtgctgctcaggtctcagagttcttggatgatggtacttatgagctctctatgtcgtattgcctactctatgaaccttgggagattactcttcctttttttttttttttaagttagatttaaaggagtgttttacctgaaggctcatttaaggttatttttcaaactacaaactggagcacattcatgggttatgaaatagctggttacaactggaatttttttaataacataaaataaaatagaaaatagtttgaaaaagacaaatattatatgattctacttacatgagatcccaagagtagtcaaattcataaagagcatagtggtggctgtcaggggctgtggggaggggagagtagggagtgagggtttaatggacatggagtttcagcttgggaaaatcaaaaagttctagagatggatggtggtgatggttgcacaacaatgtgaatgtacttaatgtcactgaactgtacactttaaaatggttaaaatgataaattttatgctatataagttaatatattatcacaatagaaaatagtatgcatcatattttcagaaaaccttttcccctgttttatatgtgtatactggattacaataaaagtgtgcttgttatttggagttagggttaagacatttggaaaacaaccattgtaaggagtggaagaaatgcagtgcaacaggcacacactcctgcatcctctctcacctctctcctgcgtcctctctcagccattcagcactctcacgggatggacagagcagtgttcatgcagtgggtaggggagaatttatgtgaaccaacgttgagagacagtgccccattgagatgaatgccagtatgctgttgtgagatccctcttaggaagctaaagataatcaattaacattaacctatgtagccagtatggtaccttgtcttgcccgcaagaaaaagaggaatggatttttttcatcatttgtttttaatcaagtggtggacatcatgctaagtagtttatatgcagtagctcatgtaatacttgaaaaaggtaggtctaattactgtactcattttataaatgaaaaatacagagacttagccaggtgaaataacttgcataatactatagtataaatgatagcagcgcatacattattctaggttctcctaccttggtcattctctgcttaatctcacaatcatggcggaaggcaaggaggagcaagtcatgtcttaatctctatgctatattatcctatattataaaatctttattaccataaagggatccatagagaagtgacattcagagctggatctttagggattgtgcctaggtccccacagtgccattaagataggatcagtctacatctagatgtactgaacactccttgtttaaagaattgatcccctctgtaggtcactcaggacagttggtaagtaactctttggctaaaatgaaggtataaataaaacacctgccatccttctcactgtctaggatatttccactatcctaaaaacaacacttaaataaccctctgaacttaaagctacttgaataaattactgaatcgtgaattgtgtttattactatttgagaggtcttgcttccaggaactattttccagttaaaagtgaagagcaccagataattctgtgaacactgtcattggccatgaatttgacctgttttgaaagtcttctgggaaaaggggaaatattgaaatataaatattataagttgtgatattttttacttttctttttctgcttattatacatctgatgtttgaccttttaagatgtgaatcagattaaaatccactgttgtacttaattagggaaattatacaaatgtagctactgcaagtctctagcagggtcatcactcatatttatgactatttagtcctattgtacttagatcattttaatccttaggtaaaaggtaaacacatacatgctacttttatagtatataatggtgatttaagttaagaatatcaaaaactataaatgtgctaatgtaaaataaagttgtattcaaattacatatactatattttgtgtttaagaagtgtgtgattttgttgactccgatttttaaataaaagttttaatttttgcatataaattaacctagtaaccattttagtcgggatttcaagattgaaggagtattgctgactagagtagtgctactagcactaatgcttactggagtatgattttatgattcaggagctactgtatatacctaaaaatatgtctaaccattgctttgtgcattcaatttaggaaaagtgaagaatcaatcaatttgttataagtaaagattgtattagatactcatgatgttttagcaaccttttgtaatatgttataatatttgccactctcaggagatagaaaaataaatcttggaaaatatcagagtgtcaaaaactataattggtcagaaaaatgctcaaactgtgtacccattttaaaaaactggtcccatagaactcttgcctggatttttaataatattttgactaacattgtgccctatttctaaaaacttacatgagtagtataagggaaagagttcaaatgtgtaaaacacatgtacaactaatatattttcctctttctgaataaatacaagttttaattttatcttgccaatgaaatcttttgttaactctacaaattcctagaaagttacttggattactgtgcccattatagatgttttaagaatatacttagctgcatttttgtgcatagtcaataacctagtgctccagagtctgttttctttgtctgcaatggagatttactagcattgcagtaaatgcttacaccacataactgaaaaccctttgaggttaaacaactcagtaaacatgctggaatgctcctagctttcattttcaccagcctgtttcacaacctctttcaaaacccaatggaagattcacacctctgaaaatcccacatgattcacccatgccattaagttcctcttgtgtttccaccctggcagcacttcccactttcctattcctggggggtcgttctgtttggtaatttttgtaaatgtctacgtattgagtatcaccagttagactgtgagttctttgaaaatcaaggatttgtttctttagtgcttcctgtcatagttctccctaggatactgtaaatgacattgcttgtccttaggctcctcatggatttgggagccaggctgtgatagctacagagcatatttcaggatgaaaagaagagagtggaagacagtgagctgtggggaaagggcaacattgattcggtgatccacaattaacaggacacaccttgttctcctccaacaatcccaaattcccaggtctcgtgctcctgttagcattaatgcaatctaggcagcatgcttcccgtgcacagcagcagccaccatgtgcagacatcttcccttctatggatgccatcactattcactttaatcagatttaactcatacaggctgggattggtggctcatgcctgtaaccccagcactttgggaggccaaggcgggtggatcacttggggtcaggagttcaagaccagcctgatcaacatgttgaaaccccatctctactaaaaatacaaaaattagctgggcatggtggctggcgcctgtaatcccagctacttgggaggctgaggcaggagaatcacttgaacctgggaggcagagattgcattgagccaaggttgtgccacgctgctccagcctggcctggacaacaaaagtagactccatctcaaaaaaaaaagaaaagatttaacttgtataaaatagtgttaagaggatgggcaagtgaagagaggacccatgcattgtaattgtccatgggaccctcattcttctggatatggtcataacttttatggcacccgttacagtagtgagtgagtgcttaataaagaatattgactgactcctatggaaatatgggtatggacaatctggagaagtaaaacaagggtgaaatatttatggtgacactgaagtattgggtttttgagtggcagagtcatactctgaactgcattgatcttaaactaataacagaacaaatggcccgtaagttttgtgagatgtggatggaagcacattgatttggagatcagtatgatcatagatcagtatgagttggcatttgaggaatcctttaaaagttttctgtgaacaattcatagagaataatcaacatgattccaggctggaatgcagtgcacgacagccttgacctgctgtgcttaagcaattctcccacctcaaccaccaagtagctgagactgcaggtgcatgccaccacatccagctaattttctggatgaggtgaggtctcactatgttacccaggctggtctcgaactcctgagctgaagtgatcctgctgcctcagcctcccaaagtactaggataacaagcatgagccactgcacctggccaaacacgagcttaattttaaaaaatagctaatttacataggaaaatacagaagatttgataaaatattgactataggattttcagtactagttttagaaacccttataaaaagacgtttcactcatataatattgggaaattttggttattgaacttcttttatcacttctttcccatagctctgcaagtgagtctggttctcaaagcacttgtgatccacttgtgactccaacagccctggctgcctgtaccagagttgactcctgctttaccccatggtttgtcccatccctttgcgtttctttccagtttgctcacctggaattccatctttgtcatcaccttgaccaactaggcacaggtactcttttttttagcatcagaataacatccatttaatacttaccattttctcttgagtgttttcaaaagagaagtcaacaatcttagataatgtattttcaggaagtataaagcgagcagtggcaaagttatcctggggttgacttggcaaaacaggcataacctttacttctgaaccagcttatgaacccattatataagttgtcaatggtattgagctgacatgtttttgaatgctacctaatgagaatttttcaaggaagttagttttactgtaattctaattatgatcttgtattagttcatttttcacgctgctgataaagacatacccaagactgggaagaaaaagagatttaatggacttacagttccacatggctggggagacctcacaatcatggtggaaggcaaggaggagcaggtcacgtcttacatggaaggcaacaggctaagagagcttgtgcagggaaactcgtttttttataaccatcagatctcgtgagacttattcactatcacgagaacagtacaggaaagacctgccccactgattcgattatctcccacaacacgtgggaattcaagatgagatttgggtggggacacaaccaaaccatatcagatccctttgaaagaaatatgtctgttcttgttcagtatcctgagtcattacattagtagcaaatagattccaaaaatacttggtattgcctgatttcaaaatcatgaatactttccacaaaagataggcacagtctcaaattaatttaaaggggtatcatttttacaagtttggaaggaagtttaaattttcccacacaccaaaagtggccttttataagcttactaatgttatttgaacaattatttctcaatatgctctgtaccaaaccttttctaggtgatacattttgactcatatattaggtttttgacctacatgtaatgaagggaagaggagaaaatcagattaaaaccaaacacagctggctgggcacagtgactcacacctgtaatcccaacactttgggaggccgaggcgggtggatcaccatgtcaggagattgagaccatcctggctaacacggtgaaaccccatctctactaaaaatacaaaaaaattagctgggcgtggtggcaggtgcctgtaatcccagctactcagaaggctaaagcaggagaatcgcttgaacccaggaggcagaggttgcagtgagccaagatcacaccactgcactccagcctgggtgacagaacaagactccatctcaaaaaaaaaaaaaaaaaatagctgttgttaagcatcttgccttttcagcaaaaatggagtttaacctgctttctctaactctctttgagtcatgtttttgttttggttttgagatttgattggtagctacagagcagttctataaaattctctttagatagatacctgcttttcagtttatttattggcttctgtgatcaattttttgtgaaagttacttttggacaatatatatttaagaggcctaattgaacaaaacagttttgttttcaaatatcaaatgggaatccaaagattataatatcttcaataaataatttgaatttattaaacaccaaaaactaatttcaataatcaaaaagtgaatagtttgaatgtcatttcactctttattttcacaaaatattggctcatcttaattgctgttttccttgtttgttttctcaacagctgcaccacagtacctacagccatttgtttccgacagaaatatgccatctgaactagaatacatgattgtttccttcagagaaccacacatgtatcttcgacagtggaataatggttctgtctgtcaggagatccagttcttagctcaagcagactgtaaacttctagagtgcagaaatgtcactatgcaaagtgtggtgaaacccttcagcatcttcgggcagatggcagtttccagcgatgtagtggaaaagctgcttgactgcaccgtgatagttgattctgtatttgtaaaccttggacagcatgtagtccattcactaaacactgcaatacaagcttggcaacaggtatgcacattccataacagtttacagtttggccacatatgatcttttattaggttctgtatgctatcacttctgataataagttcaacacaaacaaaaatgttagagaatgaagaatttgatgggcaccattatacttgaggccttctctgttttggcaaagtgatgcatgttatttttgaaaaactggagaatataggttctctacacatgcattggagatcatgcccacatttttgtgactaatgcaccacatctgtgtggaaagtaacatattcccagaaattttttccaagtattgtggctttagtttgccaaagcttcaacttagctatgtatcaaattgtctaacggtccattgcagaaataaagaacctgtgtgaccctttctaatgataagcattcgatcttttcaaacaaacaaacaaaaaaagcagcgagatgaaatatgtgagtacaatacagtcttagttttttcctctactctttctgactttttgattcactaaaaagtactagataatggatttttaaatcaattagagagccttgattattttaataattttttaacttttatttcttatcagaaataaaccaaaccaaaaaaagggatgaagcgtaagtctatgataagtggcatatttaaaatgggaaacctgtccatgtctgctagcacaaaagtaacttcacagaatatttggatgataatatgttcaatgatttaagaacaaatcacttctgcttcccttactgattttagtgttatattgtatttccatcaagtttgtgttgctatttaagctgaaacatttccccacattttgtatatattacatttgtgtgaggctggctacccgagagaaacggtgcttcatcccccactgacctccttttgggatggagcagttaaggggaagaggagcttttgttctctaacttaagaatttgtatgagaataaatatttttctttatatgcatgaagacctatacaagaccaaggaattaattacctaacatggcactataatagcaaagggaaagaagataacacatctgttttatgttttaaaaatattttttaagggcattccatggttttcttgttgcaaaggacatgcgtaaaataagagctagtgtgatctaaatctttgcagctggttcaaatagccatgtgaaaaaaaagacctctatggctccaatttctgttttttggttgtattttgaacaatacatttaataaaaaacaaacctagaaaatataaaagaatcattgatagaacatttaaacccaggatatttttgtcttggtatcagaaccattataaggggactcatgtgtagcaactactgcaaaatggccttcagaaataccagtttcctcccagggtaaaaatactctcttagacacagctatacatataaataaaatatggtgcataaatatttaaatgttttaaaccacatcagagtgtgaatgactgactggctaacatagtgccttgaaggaatattctgagtttttttaatggaattgtatatttgattaagtagagccatatgtcacgtagcatattgctgacaggtacattctatgaatagttggttctgatttatacagggatttggcaacgttaacatgagccacaagaggatatacttctgtaattgttgctgtaattttcttgtttcctctcatgtcaagggtacttgccaccaagttttaatgtggtaggcacctaaccctgtgtattctaaagtaaatatgaaagtgcactactttgaaattataggacatttgacattgaaatgggcttacaaagggttattgagttcattgtttctaagatgttctgaatgtggtttatcccctttagaagcggaagtttagtttcccaaacttggattttattgtgtgtatactgctcacatatagtgtaattgctgccagtgaaaaatatgaatttaataagcaagcaaagtgattttagttctccacataccttttatcggattcatattggagacaagtcatttttccccagtgtggatggaccagacagttgaagcatgaaacaatttggccttccacctttaggtcataagttcaagattaacagaagccttcatcagtgtctgatttctctggctatagattttcttttcccttttataaatgatgactgttttgtgaaaacagattaaggatccaaaatgccatttgcaatttgttttatatttctatgtcactttcccagatttggacaaaaagtattaaaagggtttttttcttaaattaaggttacacttatgtgtcttctcttacaccaaaatggtgtatctgtttaactgcaaatgcttgtatgacactccatgaaacttaaatgtggataagccatcttttaattatgattccaagtgagcattctgaggctcaacatctatgatgtgacgtcaaatacatgtgaactttttaatattacaacagaatttaaaacattccaagaaatgcttaaacttattacagttataatgaactccacagatgaagcagcagtagagaaatagttccctgaggactttgaatattctttagaaaaatgtaaacaacccccttgtgttctttaatttacattttttcctaaaaccctcatcatttattaaaggtcagtttttagagatgaagaaagtaatatgatgttttttttctgctcaagccccatctggtaacttaacctctgtgttaccagcagattgatcccaattcattatgaaaactgaattttaatctcaggatgtgtaactaagtgggagattggaatcatatccctttcttcatgtctgtactcgcactgaaaggaaagaaaaatgtttacaagtagagcagttcatgttgattatataatgctcaatggaaaaatctcatcaaaactaattacatactatgattccagtttgattgaaggtttgtagataaatatataaaaaaggattggataggacagactagaatagtaacaggcaggacattcagaagggaaaaactatttgaagaaaattcaccaaaatgttaatagtagttattgctgagtttaaaattaaagatttttaaaaatccatacttcctgtatttcctaatttttccctccccttcttctcccctgtattttctaactttgtacagtgaatatataattataattttacaaattaaatctaccaaagttttcgtttgtttatttcctaagtatttatcggctaggcattatgctggatactgaagataaaactgtaaagaataaaaactgtaaagacgtggttgctgcccttctgcagcatacagtctaattatggagacaatattgaacccataatggtacaaattaacaagtgctctgaaggtgaaatatagaatcttatgtaagcgtaaaataggagaacctaccttgaccttgggaggatctcagaaggctgctcttaaaaccaaccttaaaacaggaatctggaagttgagtagaaacaagttggtcaagcaagaaatggagaaaaagatgtccaagcagagggaaggctctgaggcaggaagtagtttgatgtgttggatgagttggaaggaggtcagcgtagtgctggaggagctggaaaaggctagtggagctggagtgtcctgagcaaatgccctcagcaaatggagagtagctcaagatgcagttggaggcatgggcaggggctgggtaagatgattcatctaaaactcaacagcagtcaagttttgaaatcattgctaccaattaaaatccatagtagagagtattatggtagatgacagatgcttgttgttatgagtactttggtctcacttagccagaaactcttttggcgattagtgtgactatgaagcaaggttcggttcaatgggaatagatggatgatgtgagagggcttagaagtcctcaagggcctctggaagaataaggtatgtcagggccacttcaccacctgcagcatagagcctgcccacctacttcaagggcattctggatgattaggagtagattctgtttcccaagatgagtctgtaccctaatgggtacaagtctggtcatggcccaggctggattccaagtacattcatctgtagtctccttggcttcatgcctcctccgtacttgaatcacaatgcttctgagttgtatctctgtttactcccccacttctcagtaaagtggcaaatgatggagtgtgacattttgacattatttagatccatagccaggaaatagaggccaactggagaagcatcagttacatgttatctcccattatctgcaaattaattagctacttatgatgtttttcttatattctcaagttaatcatttatttagcattcttttagtttaccaaaagtatgtttattctttttaagccatagcctaaccagagtgataaaagagtaagcaaggaaatactttattactttgccagtgttttaatgtaacagcaaccaatggaggcaccattaaatgagaaaggagttatcaacaaaggaacgtattattaatttgctgcgctttagctgactaatgaaggattttagctgactgatgacttagctgaaacaaatactgaaaactgtttcaactaacattatttctcaagaaaactgcaacttggcttacactgactctggagttgatctgttttgtatgttcagcctcttaacaatagagggaaagttatggttttatttacatctctcactgagcagatttacacacacacacacatatccaccctccctcttaagggatctggggatgttttacctaaatgattcttactttctgtagggtacaaactgtggctttggtaattggtcttgattgttgagtttagaagctgggaacatggtaattctagcctccagtactctgctcaaaaacgtgcactacccagtacagcactgtttgtagcatgttaattcactttaagaaatgttaaaagtttgagggatctcattgttcttttactcttcagcgtgtatgatttattttgagggagtataaatcaaaacacattcttggaacatttaaaatctcttaaaggtattttttatgtgtgtgcttatcctggcagtatagaatactttgtataccagagctaatgacaacagatcttttagggtttctgtgttgtaacaatcgccactgggcagacagctgccaaacatcttacaattaatccgatccatgttggctttcgtatcctttttctttcagaacaaatgccctgaggtagaggagttggtcttcagccattttgtgatctgtaatgacacacaggagacactgcggtttggccaggtggatactgatgaaaatattctgctggcgagtctccacagtcaccagtacagctggcgctctcacaaatccccacaggtatttgagaaacacccttacaaacagccattgttaaggttggggattcatttcttctgcacttgtgtgcctgtccagttatttccctttttaagtctccgaaggaaccacacagcgtagctacatctgacggaaacccaagagtgtttagagatgggagcacacgcttctcttggaatggagcattttcctgtttagcactggtgcttggggcgggggcagcagggtgtggtgatgaagaggctgactcgagagccaggtttggatcctagctgtgtgtaaccttgctctactttctgttcttcagttttctcatatgtaaaatgggataaaagtagtacttatttcatagggttataaggactaagtgaattcatatgtataaggcattaatacataagcattgtgttcggtattattattcatttgtttcttcagattttttttctgtgtgtgtccttggtagcaggcacatgctaggcactgggaattcaaagacaggtaagtcacaggccttgccctctgaggacagctcacaatctgtgatacaatgacagtgaaaaactatgtccaagggagcactgagaaaagacacaccaaaggatgtctgttttccaagtagtgtaatttcattttcctgtccctttagatgggaataattagagatatgtgtcctgtagcgataatatgaagatgaattaaatacaaagatgtagtcttaagtgagcaaaagaaatcctaggaagtactctcgagaataatgtatttgttaaactctgggtaataagaaaactactgcctgcttgtgattaaaagaaagtcattagattagagaacaagttttcccatctggtctctagaccagcatcagaatacattataccccttgggctccatctgagggtagctagatgctgatttcttgttttttcatcagattgccacactattggtatacaatttggaaaagtaaatataatgcagtatttcttatttaaatatatttagttcacattaatctgacaggacactgaaatacatgtctgtttttcataaaaattttttcacatgatatggtattgcattcatatttttagggtaaatcacatacccttgttttctaattttcctctttagaaatgtccatgttagaagtatttaagttgttttcctcgtgtaacataaaggatgttttatttgtttcaaattcatctatgtttaattttttttcctatggactacaaaagtgagagcatacaggtatactgacaaaaccaaacaaaaaacacctataattccaaccacctagagagaactcatgttaacacttcctgtataacctattagatcttctaagtttccattgtcattgcattcccagcaatgaattatgtgggacaggaaagaagcctctgagaagctgcagtaacatgtaattgtacactgtacctgtagccactttaccgatgcacacacagcaagctccaggccttagccggtagaaagcaaagcagaggaagcttaactctccagtcatttgaagatgcatagcttgcatatccctcagagaccctcaggattctctggacactggagccaggatgggaagggtgatcataagagaacaactggctcaggagtgtggggagcagtagtcttcatgctatagacatacagtttctgggtggagaggaggtcagcaggaaagaatgaatagacaaccactgtcaccagcacacctttcattttcatactcatttgcactatttcaaggcctttttgtatttattacaagttttatattcacagcattcctgtgcagtattatttgttatgcatattttatagataaggagacaaatagaaatgttaagttaggtagtggcagaattaggactgaattccttatcttttaattctcaatacagtgtcacttcaatgttgtctcactcccctaggttttggcagcatgatttgtctgttagaatagccaagctttgaagtttgaaaagaagggctgagaaatcactggaatagtaggccacatctaaggctaaactaataggggattcttagtccaagtatgaacccttgcaaagtcttaactgtgttaccaaaaataataggagcttcttaatcacaaactctaaacataaaacaggtatctaataaactttgttttttcttttaaatttgtaactgcatcttgtggatgcaacttttaaaataagctgcagtcattataatcttcttaagactaaaacctagataacctagataatatttataaaaaacgacgtcttcttactatatttctgtatgctaatgtaagtgggttttaggaccctctgaagccagaagccttaatgggcccagagggtcttcatgggattccttacattcattacattcacagttgaaaattctgctgtgttctaatgagaggctacatgaggatcagaaaaactagccactcagtttcaaactgcacctggagcttgtcatagatgcacaattgagcaaaatattcctttttccagactccaagtcatatcctgcattgcccagcaagctttgttttaggaacatttgtgtctgcatgtttatgctaccttgggtgttagtcaattcatagtctcagggaggatttctaaagttcacggaacttaactccactaaacaatgtagctaacattgcagagatcaagaaagtggcagtgacacctggaaaggtttcaaagaggtcaagatatcttaaaaccacacaagaggttgctaacaacagtaagtcccaataggatgaagagaaacatggacacaaccaattctagaaatccaaagctgacaaaccttttagaattgaaagtcataaaatgctccttatagtttctaacacatgctctggggcagaatcacttaacattctggatatctcacaacagtttcttgcctaaacaaacaaaggaagaagaaaactatttcctagggaataattgaatatattcagctgcacagaatcatagatgccatcacaaagggctcttaaatattccaattcagtagactttagatcaggttggatgagaacaataaccagcaagggactggtcttcaaagaagtatgtcacattatgctacgttgaatctagggaccagaagtgtgagtttatagaatgtttccccaaaatataggcagtatatgcagttcatagtcaagggaggctttgtttaatttagacaaaccagctatagtgacatctccaccaactggtaggatttatatagaggctgtttaacttccttttctagttaatagagagcactgttggttaaactgcttggaatagtattgcctttatcttgtatgtaaggatttacacttgcttttagcctcaaacatgtataatttatgggttatgcatttttttcagaattacagaattctagttaccaatgacttaattgtggtaatcaaaccatcaagcaagtggaaataggctctagacagagctatggaaaataataaaacatttatccaaaatgaatataacggaagtttcataagcttatgaaaaaatagcaaatatttaaaactacaggtcaggcatagtggtttatgcctgaaatcctaacactttgggaggctgaggcaggaggattacttgaggccagaacttctcaagaccagcctgggcaacataacaagacccaatctctataaaaaaacttaaaaatttaaaaatctaaaaattaaatttaaaaatttaaaaatctccacaaaaaaatttaaaaagtatgtgtggtggcacatacctgtagttctagctacttgggaggctgaggcaggaggattacttgagcccaggagttcaagaccagcctgggcaatataatgagaccccatcttaaaaaaaaaaaaaaaaaaaagcaaaatgtaacaaggtaaaattaattttgatgagcagcagagcatcttggaaatattcattaaacagagtgacacatagtgacaaaaatataaatcctatattactttaaagcagaggtggcaaacttttcctgtaaagggccagatagtaaatattttaagctttcaggatttacagtttgttgcagctactcaactctgtgtaaaatcagccataggtgatatgtaaacgaatgagtgtggctgtgtgccaatgaaactgtatttatgggcaataacatttaaatttcatataattttcaaacatcacaattactattcttttgattttttccatccatttaaaaatgtaaaaaccattctctgctcacaggctatccaaaaataggctacatgccaaatttggcctataagcctaagtttgccaacacttgctttaagacttctcagttgatcaaattcagtagactaaaggtttgatttaaaattgttttcactctgacctcactggtattcctatcatttgaaagcttggtacaaagttccagaaattgagaaatgacagataatagttaaaatctaacttctatgtaattaacctgtactcaccaaattacagaaaatatttttattatactcattctggtcctaatcagtacataacagaaagttctccaatttttgttttgtatgtaacaatattttaaaacgagacctggtaattttttcatttgtctaaaacggaaagcaacaggttttgagtatctgcctatcttttagtaattccagccagttgtcaatttcattaactagactgtaattcttagttactatgctttacaaatccgtttatataatgcatgtatacatatatatttagagaaagagcatatttcttgttgccacagtaacaatttaaaaacttaaaaagccgacttgggggacaaagaaatactctgtgttgccaaagctgataaatttttcaagtgttctcctatgtgtgcatgcatgttaaagtttgtttagaaagggcaaatgaatagacactattacacactggagttgctaatggaattggtactttatttctagaaagcaattgggtaagaaacttcaaagctattaaaattattgtagattttgacccagtaagtctcccagtagtaatctacccactggagagaaggcaaattaaaacaaagatttttataccataaaagttaatcacagtttgtcacaaaatatttaaagcaccaaaatgttcacttttaaggagttaagtaaaatctggcataagactatcttatagatattttatgggatctttacatttttacatggaatggaggaagtcctacctatcatatcatatcatataagtcagaaaagcagaatatgaaattctatgtatacaatgtgatcataacaacacacaagcaaatgcacaaaacatactggaaaaagacatgtcaaaatgttatcagtggttgcctctgaattttgggtaaggtgatattattctatttttgtcacatttttatgtacttttcaacttcttattaaggagaaagaaattaaatttgagacattaagcacccccacacacacacccaaaactcacatacagactaaaaggaacttcaaatattaattcttaggaacagcaccaagtgtaatgatatatcaagagtgattatctttattacttcttatacaaactattgcaatagtttttctcaattgttctcttagttaacagttttgccctgttttaactctgatttatctctcagactacagctcaagcaattttcctaaatactttgattgttacactttcctgtccagaaaccatcacatgctacaccatgatttattaaataatatccaaattatctgacctccaagggctaactcagtcttttcacaggccctcctgccattatttctctgtagctgtttatttagtctccctcacattcatttttttaatcagtatattttcatgtattacttattgcgtttaaatatatacattcttctaaggaacttactgtctattgagggacccagaaaagtaaaaaattattatagacatgacattgtctatcagtctatcaggatatcattgcagtagttcaggacagagagaaatgaggggtgaataatgaaaacactagccatagggaagaaatgccagggaatcaggaagtaaaatcaattgcatctggatatgaacaaagtcttaatgggaacccaaaggaaatgtttccaaatccaacatgaggatgggaagctggcaaggcttccagacagaagggatatttgtattacacgttaatgccttggagttagctaggccagtgaagtgagggtggaggcgatattccagctaagaggaccaacatgtgtgaaagccacagagacatgaaacaatatggcacagaaggataacttgactaatttggctacagtgtagagtacatgtgtggagctgcaagagggggaagtaggctaaggccatgagggctcctgtatgctgtgctaagaagttttaataccgtcttgaggccatgatagcacaaaggtgtgataatctacgtacccagagagatcaaagttagctttccacagaagctaagtttgaacagtaagtataggttggcccagcggatgacagtggaggagtacaccaagaagaacaagggaggtatatataaacagcaagttatggtcaagggatttcaggttttgtgcagtgtaactcaatcataaaaattgcagaagagatatgtgctggtccactggctcttagagtggtagtggtggggaacccctgattgtagggatggccaactttcatggtgtaaatactccaaagcttatttcaggctaccaatgggttgaccaccagtttgcaaaatctctaaacacttaattgctggttttcacaaacaagtatgagccagctccagcacaccactgtctggcagagttgtgttctcaagagcctgggaatccatttcaagaagatatacatctatgtgatgggcagctcttggctactgaatgagtttaagtagaggaatgccaggatcacagatgtatttcagaaaagttctactaatgtatttgagaagacggtctagagaagattgagaatacaaacagagactactatggtcactgctgcgtagtgcaggagtgagagagattatagtaactgagctaagacagagtaagggcattaaatgatataaatgcctaagaaactgatatttctgtgaataacagcaacacattctgaacagaacttaaaaaaaaaaaaaaaaaaaaaaactacctgaaggctctggagactaaacaaaggcagattttggaggggagtcaaaattttgagcaagtaatttgcaggatgactttcccatttttttggctttgccttgagggcaactgcagtcacggcagcacaggggtggcctatcatctttctggcccagggtaccaggggaaatagcctaggcatcctaggctgctagagtgtgaagagaaaaccctggagaggagaaagccataaaatgggaacataatatttttaaatgtagcccaactgttcagctgactgctgaaccacacacatgcatggggcaaactgaatgcagtttgtacccaaggcttaaagaagtaaactaacctgagctgctgctcacccaggtatgagaatttccagtttgagtctaaacaagttagttgcctgttaactacaaacatcaacactctttggagcagtcataagagaatccagattctccacaacaaaacatgtacaatgtccataatataacccaaaattacttgacagataagagtcagaaaaaaaaatgttaactcaatttccagggaaagacaattaatagatgctaatccaaagatgacccagatgttggcattatcggacatgtactctaaagtgtctgtgtcaaaggtgaagggattttacagatgtaattaaggtcctaaattagttgatttttagttaagagagaaaatcttgagtgggcctaatttaatcagattaaaaaccctaaaagagtgatcggacccttttgtaaggagagagaggcatagaggctcctgctggccttgggaagcaaactgtcatgttctgatggcctatgaagagggtcctggggcagggagctgtgggaggcctccagaaccggaagatggctgccagcaccaggcagtaagaagttaaggcccttgtcttacagccacaagaaaataaattctgccaacaacttaagcaagcttgagtagagtcttaccaagtcaagcctccagatcagaatgcagccaactgcagctcatttggagtcttatgaaccctaaacagagaacgcagctaagctatacatggactcttgaccaacagtcactgtgagagagtaaatgtgtgctgttttaagctgctaaattagtgctaatttgttacagagcaataaaaacataatagatgggccaagcatggtggttcacgcctgtaatcctagcactttgggaggccatggtgggtggatctcttgagtccaagtgttaaagagcagcctgggcaatatggcaagatcctgtctctaaaaaaaaaaaaaaaaaattaggcatggtggtgcacacctgtagtcccacctactcaggaggctgaagtgggaggattgcttgaccctttgaggcagagtttgcagagagctgagatcatgccactgcactccagcctgggcaacagagcaagaccctgtcgccaaaaaatttatatatatatatatatttggagacagggtcttgccctctccatatatatatatatatatatatatatatataaaatacatgatggaagaaaaaagtaaatttgaagataccaggaacatcattatgaaactactgaaaaacaaagataaagagaaaattttgaaagcagccagaggaaaacaacgcattacctaccacacattaggagaacaacaatcaaattactatggacttctctttagatactatggaggctagaagacagtgaaacaacatctttaaattgctgagagaaggtttaacttgatagaggtctgtttggaagatatttgggaggttaaaatcaccaggatttattattgatcatggaagagaagagtctggtttgactctgagatttcagacttaggtgatgtgttgctagttttgctattggccaagacagggagctgagtaggacaatgtttgagagacagagaatggggcagggtgtaagagcataacagagtaatcgtgacaaccattttggacacattgaattttaggctgctatagagggcaggaaggatggtatattagaaaaagcacaaatttgaagccataaatacctgagtttcactcctaaggtttgatagctgcatgaagagtggacagtttcttaatttcttggcacttcaacttcctcttctgcataattaagagactgttgtaaatattccatgtaaaacatttataaagttcctagtaaaggactcagcttggctgggtgcagtggtgcttcacacctataatcccaaaactttgggaggctaaggtaggaaagatagcttgaggccaggtatttgagactagccaggggcaacatagcaagaccctgtctaaacaaaacattctttaaagtaaaaagaacttggctctctataaccaagggttcctttttagtccttttcccctaactagacatccaaatggacatgtaaagtaagcaaattcgatgtaagaggctggagctcaaaagaatagtctgatctggagatataaatttggcctgttattggtgcctaactagaagtgggaataagtgagcattcccaaggagagagtgctaagagaagaattatctgttgctgcagaacaatgtacaatggtatacgataggcatacgataactacagtagacatttccatgtataaaagtaggaaacagaagacacacaggagtttctggtccatagaaattattaaattcaatcagataaatgttggaagtttcttaattagtactcagtattactcctgcttagaaatagctccccgttgctcgtggctttgtgcacatggctccagcctctgagtcacccattcttttccatgaaaagtagcttttgtttgcaccttgtagttttcccagcctgctttctgctggtagaattttgaaggttcagagtcctcttttcattttgtactgtctttatctctttcagtctaagttggcagtgtttctgccaatattattctttaaacaactttgtaggtctctttttattcttactgaggtttactatattagacaaaattaacacccatgtatcttttagataagcccttctctactttaagatttttctgatattactgagggacataacccttaagagtcttagaactccttttgtttgactagctctctgagccatcaatttaggtctttctaaggtctttcaaaagattttacaggcatattatttgcttcatatttagacccagcttttccaaccatgtcctggatttgatctttgctgggaagccatttcttgattttagcatcatttgcatctgataaagctaggaactttcaaaatagcaaatcctggctcctttttatctgacggtccttccttaagcttgtatctccccttgtgggttttaatattagcagcaggtagaagctaggaggcacttcaacactgcctggaaatctacttagctagatcatgtagtttattaggcaaattttctactttccatgttactgcaggtgatagtgttgaaaaactttctgccaccacatagcaaggatcccctttccacccatgtccaataacatttttcgcactctgtagctggcagtctcctgtagggccatcacgtttctattaataatctctctgaagtatgtagacattcactaacagccttctcaagttcttccagtttttactcactttccagctccaagcctcctccacattttaggcttttgttacagtagtatcccatttacagatactaaatctctattagtcacctattgctgtataaaaaattaccccaaaacttgagtagttaaagcaataagcacttattatcccacagtcttgttagtcaagaatttggggcatggtctaactaagtgattccagctcagcgtttctgataaggttgtaatcaagacatcacatggagctgcactcctctgaaggctcatctggtctggaagatccatctccaaaatacttacctacatgccttttggtaggaggcctcagcactccactacagggatctctccagagagttgctcgagtaatctcatgacatagcagctgctgtcttccagatcaagtgatccaaggcagaagccacaatatcttttatgtcctagcctcagaagtcattcattgttttatttgtaatatcctacacagatctgtcctattcagtggggggaacataaaggcacagataacaagaggcaaggattactggggctgtcttggaggtgagcttgcaaaaggatcagtagcagaatttgcgagttgggctgtgaaatagaatgtattgaggggaaataagagctatgaggaaaaccaagatgtcacaggaaaaccaggacataatggtgttttaaaatccaaaaaggatatttagggggatagaattatcagtgttgttaaatgtcctaagggaactgagtgaggtaagaattgaaaaaaagagaccattgtatttggcgattggaacatcattgatggctcaaggaaagcactttcagtagagagagggataaaagccagattacagtgggctaagaagtgaatgggaagtgacgaagtggtgatgatgagcatgaatttttttttttttgtcttaattatgtgttagctacagaaagccacaggtttaaggaacaattttaaatggaagagagttaggcacattaatatagaagaagaaagaaatgcgagattgatgatccagaagagagaatgactaatggcataaaatcttagaagggaagaaaaggaaagaattcatatcacgagtggaaggattgaccttgaatgggaagaagtttataccaaattttattgctgtttaacaaaccatcccaacacttattgacttaaaaaccatttattagctcgtgagtctgttggtcagacatctaggtgcactcaaaaggttcttctgtgggtctcacctggtctcacttaggaggctgaagtcagctggaggtcattcagggctgggtggtctacaatggcctcacccacatatttagtggtcagcaggctgtttgccaggtgtcttggttctcatccacgtgatctcaccaacaagctagccaagcttcttcacctggtaacactgtcccaggagaatgagagcagagactccaaggcctattgaacctgggctcagaattcacccagcatcacttccgctacattctgttgcgcagagcaagccacaaggttaagccagatccaaacagtaaggaactagatcttggtgagagttgctgcagagaatttgtggccatttgcaatgtaccacaatagtttcctccttgagataggagggagagaatgaagatggacatgaatatggttgaggttgtattggatgtttgctgagaatgaaagggaagaaaaagagggctttgaataaggtattgtttccacaatatttaatcctgtatcttgcttataatagacagctgataagtgttcctttatttttattattatttttttttttgagacagagttttgctctgtggcccaggctggagtgcagtggcacgtccacagctctctacagcctctgactccggggctcaagcgatcctcctacctctgcttccaaaagtgctgggattacaagagtgaaccaccacacccagccaataaatgttcattgaataagtaagttttgggatttctcaagaacatagatttaaaatcttaataataaaattgtcaacactgttctttgcataatgttggatacttttgtatatactattaatatacacagaaaagaggcactgatctcaaaatatatgcctcaatatactgtcaattcagttgggctcttaagagtagctcctggtcacacacccctccccttttcccattcctgcccctttggcctccttatggcctctaatgaaaaatcataaaataggaacatgctacaggaggagattagcaatatacttcaaattggccacaactttcatgtatgtctaactcttcacatttttgtttagccttttgtgcttattctatgaaaatttttgttgtttatcataaactgaaagtatatagtgtaatcactaaatattatatatttaaagtagatgtcattacaagttaaatttgccacatattgtctttctctaactgtggaaatagtttcccagaaatctacagtatcacccttattgttgtgtagggcacagctgtctgcaactagcagttccatttggggaggaaggattttatgcctttgctcccgagtggcagtaacaagcttctttttattgttgctgacattaagatagctaaaatcaacagtgaggtaaacacttcttgggaccatctggcaagcattttaatccaaaatattctgtaaacactgactccatttgagtacccaggaactaccgtccagccgccatcaactgcatttttatttcagttttaagcagtaattgaaatagccaaaaaaaaaaaaaaaaaggtagtctgtagggattccaggaaacttacattctctgagggagcttacagtgccttttgaagtcaccagtagaagtaaatggggtcctagcagttttggtcattaagtatttaatgcacagagcatatttggatttttttcattttctgttgggagatacattctacctaaatcagaggcagaagtttagggttgagttttccttttcctttatatttcaaagtttctttgtaaaactaatttataaaatgaccaatttcaagaattttaaagtctttcacaagaaatggcaaagataggattgtgatagggtcctttatccagtcccagggctgatttctggagttttctgcaagcctgcatgaaagagaatggggatatttcaagtgcaaagcgcccagaggaatggctgctggtgcggctaatggtctctctcttcctcccctggcaataaatctcagatattgaaatatagctttggagaaaaatatactgaagatttcttaagctttttacaagacactcaaagccttttcacaagccagtgctctgcaaatgtaaattcttgatgtctaaacataaaggtcctttactgagctaattttaaatgtgaattttaatacagagtacttggagaaaggtaatgcagctggcctattaaagcatggtattttgccatttttaagtaatgggaaatactgattaagaatgttataaagatttcagcatacataatgttgttgtctttaatcataacctgttaccatgagtctgtgtaacaaaagcattaactcagagacaatggcatacctattatactgtggcacttattatttccgtgcttttaaattatttccagaatattgaagagcttgttatttaaaggtcagaataatgcccaggacatggccaagcccactgagtgtcagatgcatggaatgttggatgacttcatagttataaaattatttcatttctcatgataattccggacttgccaagttagtgaattttaagaactctgagagcagattttaagataaatgtgaaataatccatacttctggagtcagggacttcccttcaggcattagttcatgtttgacttgcttgacttacacttggggataaaatgagttaggacaaggtcttagataccacattcccttactgggaaagaaaaccaacttgcacaactttggctggctcatatttcttgttatacaggcactaagaagcagcggttgccatgaaatactttatttaacctttacaaaaatgttttcttagtacagcaaggcagtttagttaaatgaaaataaataactgtaaaaattttggatttctcttatatccatctattgacttcttttttctaattaaaaattaaagataattacagttgtccacattgccatgatgactaaaaaatgaagtttatgtaaaaatcacttgatcttttcttaggacatgtgttggcatgtcttctattttacattaaactgaattttactgaatagtgaatgttacatctgagaacagtttaaaagaaagtttttattcaaactttaggtaggtttctctattgtttgtattttgtcaaaattgattttcaaacaaacaaaacctgacaatttgactcccagaatatttattcaaatccgaatgactaacagacagcctctccaatttcttatcttgttgctcccatttctcagctcacctaaattattcatcatcatttccttctaacatactgttaactctcccactgaagaattgggtctaaccaaatgcatgatcaccattgactatcattctgttaagagtttgtctgcatagcatcagaatctcctggttgttgacataacttaagcaatcaaagtcgtatttattttacttatttttaaaaaaagaaaatgtgaattatttcagattttatagacagtccctcctcttctgtatgtacatatatatcaaagttctttgaatctgtgcttttcaaccctttgtggtggtaccaagggtaaacagtcttaaggactgtcacacaattctagacttaaggcagctgttaatatcacagctcatgttttttcagtcacgtatcatttatagggaagcctttagaagaatgaaaacaatagatatgtataatgttgaaatgacctatttaaaacaagcctatttatcatttcatacttttttaactgtatttatatctgatttcatgattgaaatggtcaaaaaaagttatgcataaaatttaaaaatgaaatattttaatgcatgaaacatctttctcattaaatctttttgcaaaaatgtttatgcagtatattagttttccctaatttagttcacttagatttaatttttttttagcccagaatacccatgaagcatctcattgttttgtagaaaataatttaaatgaaaaatgctactattttccccacttttctttttttaggttattttacatatgtaaacttcagccagagattgaacagagaaaattcctgaacaataaaaatccataaataaattcttgaatttagagttgtgtttatagttatttgtgaaaaataataaaaagattctatggcttgattataggtatgttgaaacatggattaagccttaatgtttgctagaaacatgtgaaatttgataccctgacttacccagggaaattcaaatgactattacaaagtatatgatgaaatgacacaatgcactgttttaaagctatgaagaatatagatataacatatgagtagcattatttcaaacagccaaacagtgactttcttgtcagttactttgttccattgtctctcacgtatcaatccctggtgtttattgatgattgatgctctgagaggaaatagcagttactgacctaagagttcactttctcttcacccttccttcctatatctctctcccaccctctgtctcaagatttgacctcctaaaacaatgatttttttattccagagtgactccttctttccaaaatcaatattcagtgactccatttgggttacaatcaaaactattagaggaaagtaagctgacaagttgataatagaaagttaattttctaaattctgttgacaaaacaaatgaccaggagttgttttcacaaatagtttgaagccatagcttgctgcatttatggcttgtctttgtttctaacacagtcggtatgctttgtagacacaaattttgtgcagaaagaactactccctccctggttgtcacatgacaggttaggttgtcacctacttttgtttatcggaagtaacattactgtcatcttttgttctatttcaacatgtctttcttattttggggagtaagtaaaatacattctctggtccaacttttaacttccccaagcagaacacctcagaagccctatgtttttcttactctaaaaacattttgcagtgtaattattcttactgaatatctgtttatcctactatattgtaagcattttcagcccaagtgtactgtctagttcttttctgtacctaccatgtgtagtacagttagttggcttatagtaaacatttaatagctgtaaatccttaaaaatacttgccaaattgagccaggtacagtggtgcatgtctgcagttccagtacttggggaggcaaaggtgggcagattgcttgagttcagaagttcaagagcagcctgggcaacacggcaaaacactatctctacaaaagatacaaaaattagtcgggcattatggtgcatgcctgtagtcccaactactcagaaggctgaggtgggaggatcacttgagcccaggaggttgaggctacagtgagtcatgatcgtgccactacactcaagtctgggcaataaagggaaacccagtctcaaataaaaaaaaaaaaaacaagctgtggccctagggaaaaaagctcacataattgcattaaatggctcctaagaatcatgtgaatatgtaatatagcaatatagcaagccagactctgtgctaggaattatggagactacagagatgaactgaagatcatgtcaccctcttggcaaagtgccaagagggcaagttgggaaaatttggctttcattaggaggttgaacttgaatttttaaaatagaaatgtgtaatttctttttacctaaaaatgtgacctctgtatgcatcctattagacattttttttattttaataacatttttgtctgattgccaaataagacatagttgtaatacaaaatttggaaattacctgaggaagcacacaaaacacacatggaaaaaaggaaacttaaaatgcataatcctataaccctaaaataaccactgttagcattatggcttatttctagcctttttcttcctttggaataggtatacatactttttgtttatttgttttacaaaaatggggtgtactgcccatacctttttgtaatgtgtgtttttcaattaatctgttgttaactgatagcattaacatgttttcctgctatgactgtttttcagtcatttgaaagtgctctacagtgtaagtatagttttgaatagaggctctaagtaatttcagatcttttatctttcccttcccaacactctggccctgaagaaatcactcagcctctgtgtacctccatttgttttttcatctgtctaccttacaagattgttttaaggaataagtaatattaaaaatcacttagcccagtgcttgacacataatgtctaataaaggaaagctgtttttatttttactgtgttatttgaccaatttcctaatgctgccaaatttttattaaaatagcactgggataaacatacatctagatacattctttacacacatctgtaattattaccttaggatagattatttcatagaattgatgcatcaataggtattacaagtaagatttttttatataaggattacctttcagccacaatttttattccaaccagctttttatgaatgtgtcaggtttccctctattgtaagaggttgtttcatgctaattgcacagtatttgtggccttcagttaattcagataatcttgagagagaacttacagcacccatagtttgtggaagaatagccaacacttatatcacgacaatgcagcctccattatatcacaccctgaatgatttagaaaggctttctcagttgagcttactttctctttttctttttcctaccaaaacaaactacatcaaagggtccaaaaataaaattcagttgtatttatttaaacttactcttttaggtgggaaattatattctataaatgtgaaaggatatgcagggccctcagaattttagcattaaaagtttcagcattgaattgacaccaagcattagtcattacctagaaatttttctacttagtttttggcattatttcagataacgttgaacatcctgaaattcaaattccttgaaaaagcaataataagcaacatatttcatttttatgctaatttagtagtgtggaatgtactatcagttccacttagactcatgtattccaagcaagtgatttaatttcgattcaattgactttccagagagtattttggatagacaagaattattttagtattttaacttaatttttactcatgatgctcacctattgtatcattttgggcctacttgatattttaatatcagtactgcagtatctgaattatgaatctgagggattacactgacttggcgtttaatctaatattattatccctgtaagacaaatctgtgttgaaagatcattcaaaataggaaactcttgtaaatatcttgatttaatactcattttggtttgggttttgtttcgacattcttgagtttatttggacagacctggggtgagagggcccagcacctaaaagaaggtgttgggcctcgtggtgttgaagcttggcttgtgctggcgacgcaggatgccatgaggcagcaggaattcgatctcggagttgtagaatggcttggctgatggctggcagcacttgctggctgcagttttttctgccttcatgatctggattgagtgggcccaggcacagtacccagtgtccatgtcttagtctgcagaaaataggaggcagggtgaccacattcaccaggatttgggcatatggccaacctcctatcaagtatctggcacatcctgtttggtatagtaattgcctggggaccgcaactggggactgaattggggacggagtgactgcagtctctggccccaggaggcactcatactaattctgtgataccattttatgaacaaatatcaccactgacattttaagatatttactgttggttattttgtattaatcttgatttatttattcaacaaatatttattgaatgcctgccatacactaggctcttgggatattacgatgagtttagaagtttataaaataaatgggccgggttcaatagctcatacctgtaatcctagcactttgggaggccaagggggaagaattgattgaggccaggagttcaagaccaccctgggcaaaataacaagacctcatctttacaaaaaatagaaaaatttgaaaaagccaggcatggtggcatatacctatagtcctagctactcgggaggctgaggcaggaagatcacttgaggggtcaggatttcaaggttgcagtgagctatgatgacaccactgcactccagtctgggcaatagagttgactctatctctaaaacataataaaataaatggtgcctaagttttgatatataaataatatataaaaatatattaccagaatatatatatatatatacagtagtttatttcacttggattgcatgttaatttttaagaactcttaaaatttctacaatgaatacaatggattgggacattttttgaagttgtttaaatctccagtttctgtttagaacattacgtattactgtagggtaaattactataaaatgcaaaaaaaaaaatacacaaatgagtgtgaagataaaattttaatttgtgattattgaagtagaaaaaatcttgacagtagttttaaaatgaatagtgaaatatgtaacttcacaaaaaagtatttggtacctttatcatttatgttttaagatgcagtttaacattttttatttaaccatccactttctcttctttggtgtactctgttttcctagattttatcttatttttctttcctcttaaatatatcaattcaggaattctccctttggacaaaactgtaggtggtcctcagggctgatccccaattccctgatcagtaattctgttttaagttttattttgtatagaaaaaaaatgagttgaaaactgtatatgcttccatctgaggtcttcaatgggaaaactatgaatttagtctggctgccagcgcagctctgggggtctgctggaaaaaaagaaaatgtactctcttgggaccttccatcgagtgtggccactatacaacctgccttattgcttagttttagttgtcatcgaaaacttccaacaagaatagttcctgtttgacttttccccccaccgtggaaaatattagacactatctaagtagaccaaagagactgaaaagcctggatagattgaatgatggtaggggaagtaaggaaggaaaatcttaatagaaaagaggtgaaagaaaatttccaaattgataaaagaacacaaaaatgccctgggcttcaggcagaagggatagttattttctgtgaagcccattgctttcctctcccctgtatttctagcccacgttgcccctcatgcaactcctgcagtcttcctgcctctccacgtgctctcactctttgtcagcacattgctcacttatagggaagatatcagtgactatccactaattcctgcataaagtgcaaattccttagtttagtaaatcagtgccagccacaatctaaatctatgtatttaaccttatcctccaaccctttatccacgttcccttttctctcgccagttgagatggttaaccttgtcccgagcatgtgtactactttgcacatctcacattgtctttttggcatgggaaggaactatcatctttgccagttgaaatcctacccaaactctgagacccagctgcttcccaatgttttcttaatcacagcaacctgatccagacccttccttaactggactactatgtgactgctcctctcctttcctgactgcttcatgttagttatttgttcttgccttattttccctatgtgatcataagctccttgtggggcaaagaacatatctcttcctctatatttcctccatagtgcctagcatattaccttccttatagtacttgagtaatgaaaatgtgttggataatgatcgaaatctcatttgaatcaggtgatctaacacaaatgtcacatttttttgtgcctgattttatgcttccttctgtatagaaataaaaataggtatgcaagtatttgttactaaatggagacttacagtatctgtagcagtgaaatttagtcagtgggtccaacaagaacaaaacctctcacgttagctaggtgtctgtgcatatctgagcactcactgccatccagtgctcaaatccagtgccgcgggttcccaggcaggggtgattacaccatgggaaggaaaactgaagtactgctaggcctcctgaatttctttttgttggtttctctcaagaatgtagttcctttcctaatgaattatatgcatctaattgccaatgatatttagatgttttttaacagtagaccaaacattacaaatgttccattgattatgcatatgggaagaagtgttacaaatgcttttctcccacttaattttcctgtgtgaactaaatccaaacatatctgaattttcataattcaaagaaaatatctgtgccaacattctgagaacaaatagctgccaagcaaaacctgacagcatattccttggtgacatccagtctttaaaagctgtgtacacagagtgagcagctatctaaaactgagctcatatgcaaatgtgaacattcctcacttaaaattacattgtgtacattaaaactttctctagagtctatgaaatgttcaggaaaaatgtagctgagcttgatcttaagtaccttgcctcattatttttttttttttgtcatttctagctactagtctgtccaaagaaaacaactttcttatttcttttagttttgtgtgtaccctgagcttgattcccagttgctgctataaaaaactgaaagggttcccaacactgctatttttctttttttctctgttactaacatttaaacatcaaagatattctggtacttttatgttgtagagtatatataagaccatattttccctaaaggtatttactatccagggtgtgtttgtgtgtgtgtgtgtgtgtgtgtgtgtacgcacacgtgtgttttcttagctgttagccttttttagaagtcacctaactgatagcattttcctatcacaagatcactggcagtgcgtggaggaagaacttgagtgaggccatattaacagcagggagatgagttaggagatttttaaaaataatgtattcagatttaaaaaaaaaaaaaaaaaagccctatcttaacatcgaaaacgtatgttgtgatgaccttgggaattttttaaatttaagcatgttatcaggactcctcctaaggctgaaactaaaaactaacctgcttccaccaagacatttaatattatggcaatttccatgtaaatccttaatgtatttattattagggccttttatgatagtcttacaggaggttttcaaagttttattctgtctactaattgggagtttttcatgagatttacctttggttagctctgttaaaaaattatatgtgatatgaaagaaagatttaaattgtttgcatatgatataaatatatctttcttaaaatatcagttttcagccaggtgcagtggctcacgcctgtaatcctagcactttgggaggccgaggcaagcgatcttgaggtcaagagatcgagaccagcctggccaacatggtgaaacctcatctctactaaaaatacaaaaattagccagtcgtggtggcacacctgtagtcccagctactcgggaggctgaggcaagagaatcgcttgaacccaggacgtggaggttgcagtgagctgagatcgtgtcactgcactccagcctggcaacagagcgagactcaaaaaaaaaaaaaaaaaaaagtcagttgtctttccttgtacttacaaatcatagaacgttgttttcatttaaacctgtttcctacaaaagtactaattattattattttttggaatactcatatagttaaactgattttcttagctgcagttagtgggtaagagtagaaataggacatatatgaccccaaaacaaatccaaacatgaccagacatggcaatgctacatgaataaatataaatatgtatcaggaggctcagttggtaaatgttacaataagtacataacaaaaaaaaaaaagaacaaatacatcatatcttacatttaaaatgttgagggtatttctaatttgatatatctgtgatctcataaggaaagtatattaaatgaattgcatcttcaaactgctattttgttctttatcaaaagaaaaaaggtatgacaattgatgattaaaaaaaaaacccacaaaccaaatttagctttcattactgtctagccataagaaggaaaaaaccgtcagccaataccaaggttctttgatctcacgcttcaacctttttgtcctccagatgaatgaaatgatcttttctcaaatgttcagcaggccttttaccatttgataggaaaattatttttaagaaggtttaaaatgtgatctgaaaaaccacattgactctatgtgacatatttgctattcttagcctggtggaataagttggaagtggatgaataatgcaggttagaaagaaaacagatgcaaaatattacaaatggaaaggttttccagcaatgagactttcattttaggactaggtttttgttggcacgtttggcattatgacgattattgtttttttctccagctgttacacatctgtattgaaggttggggcaactggcgttggtcagagcctttcagtgtggaccatgccgggacttttattagaacaattcagtacaggggtcgaactgcttctctcatcatcaaggttcagcaactcaatggagtacaaaaacaggtaagtttctttgtgttcatgacccagacacctcttaattattcagtgtaatggagatgaaaataattaataatttttttaaaatcacagtggttatgcctagttatatctactactaccatgcatgtgagcatttaataaatgcttatctatgatcctgacaatgatgatggcttcaaaccctttgtcccacttcttttacaagagctgctaacaagcagtaaaatttactgattttagtttcacctcttctccctgtcaccacctaccttctggtggaggtgctaatgagctgtgaaatagccaaaagtcctttattgagaaggaaaagaagcaaagagtagtgggaaccctggataatccaccagcggataaccaagagttggttctcatgcacgtgagaatgatctgtaaggaagtgctgtgatactctcccatgacagagtgggcctgggtctccagcaagcttttcttttcctaggagttaatattaactgcagtaaaaattcactgcagcctaactcttggcatataaaacctcagctctcagcacatatttttacgtattttataaaacttgctttttggctgtttttgaagttctaagactgcaaagggaaaaaagtatctgacactttctttttgttcttaagatgtgaaaatgtggtttctaaaagatgtttttcaagcatggacaagagtagaaagaaaagaaggaagtattaaaatctgaaaactggcttcactgcacacataataactggatttgtcgttagagtttcaacatatacatctggattgtaacagtctacccagagcttttgtgggacatgatagaaacagcacttagtccctggaaaaggggagcttcccctatggagcagcaggggctattctgttgctgcatgccaaggaggaatcaggaagctgctagtgaggtgaacagtaggacccacaccatatgcattcttggtctgcacctaatcaaggagctggacttggtgatcttattattgtgggccacggaaataaaaagagaactcaactctagcagaggagtctcagaaaagaagcatggaagactcttcccaattaactgagcattcctcagaatatttattgattgcctaaagtggaacaaagtaaaatggaaaacaccaagtatgtgaaacagtctttgcttttaaattgcaattttatgtaagcccaacaatgttgtcaactgacagtaagtgtaaagggaatttagaggtttcactgagaagatatgacttgagctgggctttggaaaatatgtagaatttggattaagagagagcattccaagtagacagtatagcataaacgaagagacaaatgtgggacaaatgagtcttactgaaggattcctgcagggaccggcctactagtgtgagcattgagccaaagagaacaaggagtgtcactaactcccatctgccctcagaacactcttacatgaatctgctgtcaatgaatatctgcccagtaagtgtatactggttttctgattctgtcactcatggtctttcaagaatgtcttacccaccttcccattgagtaatatgtctgagaaaaggtcatccagcctctttgaatagttcagatgacaagaggctcattccctcacacagcagccctttctgtttgctaccaccagctaagttttcttcctgatttcgaaccaaaaatctttcaccattccaccacctttccccattccctagaactatgaggcatatacaacaagcgcaaaacttgtgagaactccacaagtcacctctcctctacattatagcccttcaaaaacataagggaagctattgtgtttccccttggttttcttctctctaggccttctcaaatttgagtatgcatcagaatcccctggagggcttgttaaaacacagattgctgggtcccaaccccagagtttcagattgggtgtggtctgtaatttgcatttctaacaagttcccaggtgctgctgatgctgctggtccagggaccacaatttgactactatagctccagtctaaactttcccaggtagttcagctcattttagtgtggctgctagaacatttatcagttactgaaatggcagggtccctccatagagaaatggttttaatggtatgtcctcgtagtcaagatcataggcaacttggctgtatccgcttgctagctgtgtgatcttcagaaagtcatttaaactctgtgaatcaatttcctcatctgtaaaatgaggatagtaatagtgccctcctcaggaagttagtgtgaggattaactgagtttgtgtatgtaaaatgcttacaacgtgcctgccctcctgccatagccctatataccatatttaaaattactctaatgaaatgttatcaggcatgagtaacactaagttggacggttttgtattataacaatagtgactcattcttgaatagatactatatattttcaagaaacaatgttaaatttcagggataaattaatatatacagtgttcctgcacaaatattacacatcgcaacagtatacctaccaaatgtcataaaagttggttatttgaaaaatacatttctaaaaatgtctggcagttttacctcttccctgccccctcactcactcagatacacacacccacaagcaaaaatgttaaatgtctttttcaattggatttaatttttgctgtcagggtagtttagcgttcagatttgttctggttaaagtacatcagagacgtaggatttcctcaattggcaaggttgggaaggaagaagggaaccaagcttcagaagagctttgtggattcttgtctccctcacatcttggcttctttccttctaccccacctgggcctggaaatttgcaataaactgcagctgcctaattaccagggcccatttggggaggtgagtatatgcagatccctgatgcaccttaacaccccctggataatggagaattggctaaagctcttttcttaacattgatgctgggttatctgtgctctgcatttcttatacccctctcatttccctcaattgaatgaaaattgaccacagaaaattttgtgggaactttgtatgttctacaactactatgtacacacatttgcttccatgtttcccatctttttgttgaagaaacctttactactctaaaatctcaaatgtacacatgtatgtatgtataatggtgtctttatacacatacttttaatcatgtttaagatatcgttttccagtgcatctggtgctctggagttattcttcaatatcactattcttcttggcactgatctaataagagttctgaaacctgctaagtaaaatcatatgtggaaatcttcaatacacatctttgtggctttggggaaggaggggaattagtgtgaaacctggaaatgtgtattaaagagaaaccgtgcatttaaaaaaattaagtagctgtcttcaactgataaattaatcttgaaattctaaccataattttcaaaataaaggcattgtaagttttgccactttgaagaaaagcagatagagctctcctgagcctaaccctggaacagccgtgcaagcacactactccactgagtgaccatttttggattttctttcatctaaagtagccttccctccctggccacttttaagaattttcttttatcaaatttgaaagcctatttaacaggctttttagttgaaaatgagactataaaaacccaccaagaggatctttgtctttaaacaaagtgagtcccagatggttgtggagattctgtggtttctctgagaaacagccaaattctcttctaaatctcctggggtccaaaggttctgaagcaagagccatgtgcatatattgccaggcttgggcacatcaagaataacagagttaaataatgcttcagagttttcaaatgtttatttcaagttaggcaatgctatggcatcataagacttatcatgagtgtctagtaacccctagcatatgctaaagaaaagtttgcttcctaatttaggatcatagttcagttgacttttatggtttgttattgtgaaagcatagttttaaaagattatgatggctagagtatctaggggaaatacaactgttcagcacagcttggttttacagatgtgctccttctaaagaaaattcaaataagcagatagttgagaaataaatgagaaaatctaaacctcaccattcaaataatgcaaattaaaacaacaatgacatttaatttttggttcctcaatctagcaggtttcttttgattaaataatagttcatcccagcgtagtggcttatgcctatgatcccagcactttgggaggctgaggcaggagaatcacttgagcccaggggtttgagaccagcgtggtcaacatagcaagaccctatctctacaaaacataaaataaaatacattagccaggcatggtggcatgtgcctgtagtccaagctacttaggaggctgaggcaagaagatcccttgagccgaggagttcaaggctgcagtgagctgaaatcttgccactgcattccaccttgggtgacagagcaagacccccatctaaaaatagtgataataataatagttcatttataaatagttattcatatttattggtgtaaataatagttcattaaaattgatggttacagagaactcttgatgacataggaaaatgtatcagttaggacgctttcagtttgaagttacaaaatatgcttgttaatcttcatagcaagttaatgaggcagatactattctattttatgtttattgtttcacataacgaggaggaagaaggctggttcagtattggctaagcaacccagtgttgtatttgcttctctgtcatcctcttagatttgcctgcctggtctcaggtggcattaaagctgtatacatcctctgataacagcttctgtgacacaaaagaagggcttctcttctcaaactgtctcccttattatcaaggagtaatatctttcctagagccttttaccagtcttaccttctcatattattagccaaaccagagttccatgtttaccctgatcgatggcaaaaggagaatggaattaacaggattggcttgtaccaatcatgatacagccactgggggccaagggaggtgtctaccttccctgagtactttgctgccttttgatacctaaccaaatcaagtgagggtttttaacaataagaggaaaggagagaacagctattgggaagagaagcaatggtgtctgacacatttatgttataaagagcagcccttactttcttttttatggtttctaacttttcttaatgagtagatattaattttatgagagacagactatcagggtgatgatcaacaaactctgggccagacttactgggtaacaccaagcaagttattaaatatctctgttaaattttctctctgttaagatggggagtcacagtagcacctactttataaggttgctgtgagaatgtgttctccagaaaaaccgcactgatgagggggtgtgtgtgtgcacacccatgcatgcacacatgtacatgcatgggtgtgtgggaaaagaatgatttattataaattgactcgtgattatgaaacatgacataatcttagagaagtcccaagatctgcagtcagcaagctgcagacccaggagagccaatgtgtagctcccatctgattacaaaggccagagaaccaggagagcgaatagtgtaagttccagtccaaagtctggcaagttcaagacccaagaagagctgatgcttcattccaagtccaaaggccagaaaagaccaatgccctagctcaagcagtcaggcaaaatgagtttcctcttacttagccttttccttcgattgggtcttcatttggttagatgaagcccacccatggtggggaagacaatctgctttactcagtctaccaatccaaatgttcatctcactcagaaacaccctcacacacacacccagaataatgtttgactaaatgtctgctcataccatgacccaatcaagttgacatactaaaattaaatatcatatgcttagacttgtacatatactgtgtatgtgtgtgtgtgttattctggaaaaatattacaaataggaaattcagtatgtgaaagtcctattttctccaatcatggtgaatattcatattacagaaggatttgctttgtgaaagaattcaccaccgtattaaattttgcattatattttcaatttcaaccaatttaagaaaacatttgttgttttttgtagaaatagggtcttgctctgtcacccagggtggagtacagtggtgcaattacagttcactgcagccttgaactcctgggctcgagtgatactcctgcctcagcctcccaagtagctgtgactacaggcatacaccaccatacctagctaatttttaaattttttgtatagatgggatcttgccatgttgcccaggctagtctcaaactcctaaccttggcctctaccaggccccccatttgttttctctctctctctctcttttttttttttagacggagttttactcttgttgcccaggctggagtgcaatggtgtgatctcggctcaccgcaacctccacctgccaggttcaagtgattctcctgcctcagcctcctgagtagctgggattacaggcatgtgccaccatgcccagctaattttgtatttttagtagagacagggtttctccatgttggtcaggctggtctcgaactcccgacctcaggtgatccacctgccttggcctcccaaactgctgggattacaggcgtgaaccaccgcacctggccaagacccccatttcttaatacctactatgaactatactctcttacctgggtgtaaagttgaataacccataggtttagtggataaatctgtgtgtttataaagataaaacttacacagtttaggccaggcacagtagctcatgcttgtaatcccagcattttgggaggctggggtgtgaagattacttgagctcaggagtttgagaccagcctaggcaacactgaaaccccatcctacaaaaaaacacaaaagttagcgaggtggggtggtgcattccctgtagacccagctactctagaggctgaggtgggaggattgcttgagcctggtagattgagactgcagtgagctgtgatcatgccactacactccagcctgggcgaaagagcaagaccctgtctaaaaaaaactaaataaataaactgaataaaataaaaaaaattagatatctgcatcaaagattttgtattatctgtttatacagagatttcttactagataagagtgaaataaacccttgaaaatcaacttcaaggaatagattgatcacaattgccctctcagttaccagagctaaatgattttcaattcccagtcttttccatttctacttcacttgacaagattcactgccacctcctgggcaggcacttctcttatggcttcagcaaaactactgtcccctgattcacctctgttctccttcatcccttcttctctggccccattttctagcttttcaccccgagtctgcccttggagtattggtcagtttctgggtttgagcttctaccctctctttcaggtaaactatcttctgcttgtgcatgtttgcaaggctcttctttcactaatcattatctccacctccacattttctctggccagcacctgagcagcatttctaattgagtactggactcctacatgtctgtcctttaaatactgcaaactcaacatggccaaagcaaaatttcttcttgacttcaagtcttttttccttcttgtactgtttaagctaattacttcattttctttccattaacatcaacatagtttactctgtttgaatgataacatatttccagttaatgaagtctgaattgatgaagccttatatacttaactgtcttttagattatcatctgtggaagacagatcatctgtagttacttgtctcaaagcatagaactaaaagtcgttcagcattacattggtcaagatggacaagctgtagttcgggaacattttgactgcctcacagccaaacagaaattgccttcgtacatactagaaaacaatgaactgacggagctgtgtgtgaaggccaaaggagatgaagactggtcaagagatgtgtgcctggaatccaaagcccctgagtacagcattgtcattcaggtttgaaaagacgttcaatctagaatagagcagctttaccattgaaattttctcaaaatgttctttactcgtacagcacttaatttattaaaaagtgacatataaaaaaggggagtgaaaggctttgaatagtacttctcaaactgtttcctccccatcccacgacaatacatttgtatcagttccagtagttcttacagccaagactctgtccctcccagacgcaagtgatatcttgaaaaagattctgctgccccagggttaggggtagggtgggactgtgggggtggtatcctcctcacttaaggatctttatgatggtctgttactttatctcttcctcagtctttaccatcatcactttcattcccataaaggataaattctctttcattttgccacttagtcttatatctctccttatgcaaatctctttgtctttatggaaagagttggccccgctgactcactgcacatttgctttctgccataatgaagtctgtttttgctcagttttttttaataatggctttttccctaaactttaaactctttttaatcttccaaactgatgtatctgtgccttattttgattaattagtaaactgcttagtattcaataggaccctttgctatttcatgtgcaggtgccatcttcaaacagttccattatttatgtctggtgcacagttttgactttagaacccaactctcaagtgcaacaacgaatggtgagtgctttcccaatcctaaaatatggtatatgactctgacctttcctgttctgaaataaattaaggtcagagtgacccagggaagagatttattacaagtttgtttcagcatcaaacagctggaatactgcaacaaagcaaatatgaaagttgttctatccttttatttttatagattgtgttcagccctctttttatcatgaggagtcatcttccagaccccattatcatacatttggagaaaaggagtctgggattgagtgaaacacaaattattccaggaaaagggcaggaaaaaccactgcaaaacatagaacctgaccttgtacatcacctgacattccaagcaaggtactagaaaaatccttccatacattttacattttcctaggagaaattaagtagaaaagtaaccttgcactggggggcggcgggggaggggtgggtagggagatgggagtggagggagttttttgtatgatttcttatcttatgagaatgttattttaaaattgccctgcctagggatctcttattctcatctgtagttttagataaaaatcagcctttctcattaagcttagaaataaccagcagggatcatcagaacttttaatttaatttaggtttcattgacacatgacttctgtggtgaaagaagatgtgaatagagatcaacacccaggaattgaggggtgggggaagaaagaggaaaagccagggcccagatcatccacacactgtcccataaatggactctatctaccaaaaaggtgttggtctataatacatttgtagttagatatttttcaataaattatataccactttagaaatctgataattattcttggtttttatttcaatttcctagagaagaatatgatccttcagattgtgcagttcccatctcaacatccctcattaagcaaatagccactaaggtacaccctggaggcacagttaatcagatccttgacgaattctatgggccagaaaagtcgcttcaacccatatggccctataataagaaggattctgacaggtaatattcttcagtgatctttttctacaaaaatttctcaacattaacaaatgatcattcacaaaaatattaaataccataagtggtgtgtgcatgtatctgtcagattcttaccttttatcatctagtaggtgtattttgtagatttctttattcatgatctagatcataattgcatgaaaagttgctttctcctgcatgcaaatttagcattgaaagattctggtatgaggaggtatcatgcaggagcatggtgtgtttggaatctttaaacatatttcacaaatattaaagttatcatatttcattgagtctcttggatgtggtttttggaacaggaatgaacagctaagtcagtgggatagcccaatgcgagtgaagctgtcaatctggaagccatatgttagaactttgttgatagaacttctgccctgggccctgcttatcaatgaatccaaatgggacctctggctatttgaaggagagaaaattgttctacaggttcctgctggcaaaattattattcctcctaattttcaggtactataacttttttaactaatacgaattcttatctctcaacaagtagattttattgtaaagttgcgtttatgatcttaacagaatgaatcagttgtgaaaaattcttcttagatgcatatgtaagaggtatggaatgttctttgatattcaaggacttttctgatgtcttttttttttaaccatcaacactattggtgcttgagttaccattaaatttgataacttggattagttacattcttatttccattgttataggatatttgacaagtatttgggctgctctatcagtacatattaaggaaatagagccatcatgtgtgcttatccataccctaggtactctttgctgttcttctggaaattctctgcaatctgcaagatattgaggatttcagagcaactgtttttgtcagggacccctttcctttataggtggacttggatgttcataattatggatgtctacccagttgattataacagtgtggaatgattactgacacagagagaaacctaattgcaaaacaaaatatcgcaggaaaattttatatttctgtcacaaaaccttctttataaggctagtctatttcaagaagacacacaaatctatttaaaaaatagagtaaaagtaactcctaaataaaatgtctttctgatagagaacaatttcagaatccttttttgagctccaggtcataaacatctttatttaattgcattttttcttttttctgtaaaataatcaggtgatgttaccttatggaattggaatgttgacctatgtggacctaatgttgcatattattctcttgtcaaatgagatgaaaccttcagtttttaaagcctttggtatttgcagggtagtcactgtttgggtttggttttcccctcccttccgtaaatacgaattccattgtgagtaaaaaaaaaaaaatacattgggagccaaaatagaatgtacgttgtcattacaaaacacacacacacacacacacacacacacacacacacacacacacacacacacacacacacacaccatggagggatatttggttaccttagtagacctattatataatattaaaaaaaaaatcctgaggattgaagtaaaaaatatcaaaggtaagaaaattactttataattgaggcattatttttccaggaagcttttcaaattggaatatactgggcaaatacaaacactgtgcacaagtcagtagcaattaaactggtccataacctgacatctccaaagtggaaagatggaggtaatggtgaagttgtgacactggatgaagaagcgtttgttgatactgaaataagacttggtgcttttccaggacatcagaaggtaagatcaaagtctatgtggctgggaggaaatagcatgccatccccttaacctgtctaaaatgaatctgcctttttctttttgatacctttttcatattacttcttctaaacaatttataacagtacatttgatttcttaacttcttagacctctgttttacagtgcttttttttctttaccagtgataaaagctgtgtcacataatttatccaataattgttctatttcagaatactcagcagtaacttgatttatagtatgtggggagaaaatgaacttactccaaaatatccacaaattgtacttggcctccttctttagagcagaaagtagagtcactaacgttctgagcatagagtgaaaggacaaaggctcctcctgcagcaaagtttatatttctggaaaggacatcctgagaaaaattatgtggatcaattctaattctctcctagaaccactgttatatgaggaagttatattcttgaacagtggactggtgtctatgtttttggagatgcatacaaaaaacataagtcatttaaatataaatggtatgtgcttttcagcataaatctaaagtctatgaaaacaattagctgaataatataactaatcacattatgtatgaaagtacaatatcatagtgtaccatgcagaagttttttgctgtacttctaatatcatcattattttagctgtccaaaattagaaaaagaagggatacttcatcagagtagtagaattcagattgacctttttcaggggagaagttagatttttgacaagtgtctttgaaaagtcttttgagaaaagttagggtcatttggtgactttttaaaaaataaatttccgtgataccaagaaattggtctttcttcagcattcaaggctggtatccatttcctcaaagttgtctgggcaacacatgtttatgctctgacggccaaagtactgtaacatgggtgtaaatggcaaagagctgtaagcatgaatcacccaaagttgaatagttgtaagttgagaactaccatcaaaacctggaaaaaatgttataatattcagtcaacacccaatacctctagcacctaacaaagtagccacagcaagtgttgaataaatgtttgtgaatcaatgaatgtactgttggaacacatattgatgtctaattatgctttggtagtgactcaggacctctttatactctttttagtctcaggacccctttatactcttaaaaattattgagaacccccaaagaccttttgtttctgtgggttatatcagtatttatcagattagaaattaaaacagaaacttttaaaacacaagaatatacaaatatatattccattagctatcacagtaataacatctcatgtcatgtacctctggaaatccactgtacgttcatgagagaattcaagtgtaaaagattaatagcatcttactattattataaaaatagttttgaccgtgggaccccatgcccagagatcccctgtgggtccccagaccaccctttgaaaaccagtgttctgatactattaactagatgggtatgtttaagcaagaaacatcttctctgagcatcagttccttacataacatgataaggtaatgaaatgatacatgtagtggttaagagcagcaccacagagccagactgcatgggttccaaccccctagttagaccctcttcatctttgtgaccttggggaagttacttctttgtgcctcactttcctcttctgtaaaatggggttaataatagtaactcccccacgtaggtactgtgaggattttgtgagttaatatgtatacagcacttgaaactagtggaacacaatattgcaatatatgaaggtcaatccttattgtcttcattgtcgtcattactgaagttctcagaactctccttggttcatcataggcattagtgaggcagctgctgggagaccatgaggaggaggaggaggaggagtgaggctgggtggaattctgccaagtaagatgagtggcatttatttacatatacatgctttctaaataaacactttgtgaggttactggtaaaataaccagaaaacaagtcttttatctgtcactacagaacagcagcaaaagtaacagggctgctaaagcaccatgttgtaggctaaatactgacaggggccagaacatttctgagaatgaaaggaacgccattaaatattctggggaaaaacaaaggtaaaattggtactgtcctggcagacaattagataaaataaccttttaggaatactcaagagattttgatatgccttacagtattgtcaaaattattttttctcaattatcttgtagttatgtcagttctgcatttcctccatggtacagcaaggtatacaaattattcagattgaagacaagactacaataatcaataatacaccatatcaaatattttataaaccacagctatctgtctgcaatccccattctggaaaggaggtaagcaaatcataacgattcttttgtctaagttttgataaagaaacaataaataggatcaacttctctttaacctatagcaaatgaaaagctaaccctgaatgtaggtaaagagaaattcacttatttttgttgtaattaaaaccatgaatgtcatggtcactgcttccaaggtaattaatgagcagaaatcctaccaagaaggaggccctgacacactgctggattagtcctgcctgtgccccatctgctcagaggctccagcctagtcctctagcatgctcactagactcctacaagcagagacatagtcatgaggactggctcctgggtcacatggaaaagcacatctgtctcacaggctgcagtgcctgggggagccatgcaggcaaaaggctagggcctaactgagccgtggatctgcgagcagtgagctctgtggttacaaggagaaaatgtggaaatgtactagctcatttatgttaacatcttgatggcagaatatatggaaaataaatctaagaatttcagttctttgaacaattaaaatgaatagttaatattttaagagaggagagatttttttttctctccattacatcttagatgttttccctttttttttttttaattatacttttaagttctgggatacatgtgtagaacatacaggtttgttacataggtatacatgtgccattgctgcacccatcaacccgtcatctacattaggtatttctttcttccctttcctccccctgcgacaggccctggtgtgtgatgtcccccctccctgtgcccatgtgttctgattgttcaactcccacttatgagtgagaacatgtggtgtttggttttctgttcctgtgttagtttgctgagaatgatggttttcagcttcatccatgtccctgaaaaggacatgaactcattcttttttatttctgcatagtgttctatgctgtatatgtgccacattttatttatccagtctatcattgatgggcatttgggttggttccaagtctttgctattgtaaatagtgctgcaataaacatacatgtgcatgtgtctttatagtagaatgatttatattcctttgggtatatacccagtaatgggattgctgggtcaaatggtatttctagttctagatccttgaggaattgccacactgtgttccaatggttggtttaatttacactcccaccaacagtgtaaaagtgttcctatttctccacatcctctccagcatctgttgtttcctgactttttaatgattgccattctaactggtatgagatggtatctcattgtcgtttttatttgcatttctctaatgaccagtgatgatgagttttttttcaggttttttgaccacgtaaatgtcttcttttgagaagtgtctgtgtatatcctttgcccactttctgatggggttggttggttttttcttgtaaatttgattaagtttcttgtagattctagatattagccctttgtcagatggatagactgcaaaaattttctttctgtaggttgcctgttcattctgatgatagtttcttttgctgtgcagaagctctctagtttaattagattccatttgtcagttttggcttttgttgccattgcttttggtgttttagtcatgaagtctttgcccatgcctatgtcctgaatggtattgcctaggttttcttctaggctttttatggttttaggtcttagtttaaatctttaatccatcttcagttaatttttgtataaggtgtaaggaagggatccagtttcagttttctgcatatggctagcgagttttcccaacaccatttattaaatagagaatcctttcctcattgcttgtttttgtcaggtttgtcaaagatcagatggttgtagatgtgtggtgttatttctgaggcctctgttctgttccattgttctatatatctgttttggtaccagtgtcatgctgttttggttactgtagccttgtaatacagtttgaagtcaggtagcgtgatgcccccagctttgttctttttgcttaggattgtcttggctatgcatgctcttttttggttctacatgaagtttaaagtagttttttctaattctgtgaagaaagtcaatggtagcttgatggggatagcattgaatctataaattactttgggcagtatggccattttcatgatactgattcttcctgtccatgagcatggaatgtttttccatttgtatgtgtcctctcctatttccttgagcagtggtacatagttctccttgaagaggtccttcacatcccttgtaagttggattcctaggtattttattctctttttagcaattgtgaatgggagttcactcatgatttggctctctgtttgtctgttattggtgtataggaattcttgtgatttttgcacattgattttgtatcctgagactttgccaaagttgcttatcaacttaaggagatttgggctgagttgatggggttttctaaatatataatcacgccatctgcaaacagagacaatttgacttcctcccttcctatttgaataccctttatttctttcttttgcctgattgccctggccagaacttccaacactatgttgaataggagtgctgagagagggcatccttgtcttgtgatggttttcaaagggaacgcttccagcttttgcccattcagtatgatattggctgtgggtttctcatgaatagctcttattagtttgagatatgttccatcaatacctagtttattgagtgtttttagcatgaaggggtgttgaattttatcaaaggccttttttgcatctattgagataatcacgtcgttttggtcattggttctgttcatgtgatggattacatttattgatttgtgtgtgttgaaccagtcgtgcatcccaggaataaagttgacttgatcttggtggttaagacttttaatgtgctgctggattcggtttgccagtattttattgagcattttcgcatcagtgttcatcagggatattggcttgaaattttctttttttgttgtgtctctgccaggttttggtatcaggatgatggtggcctcatgagatgagttaggtaggagtccctctttttctattgtttggaatagtttcagaaggaatgataccacctcctctttgtacctctgatagaatttggctgtgaatctgtctggtcctgcgcatttttggttggtaggctattaattactgtctctatttcagaacttgtttttgatctattcagcgatttgacttcttcctggtttagtcttaagagggtgtatgtgtccatgcattcatccatttcttctagattttctagtttattcgcatagaggtgtttatagtattctctgatggtagtttgtatttctgtgggatcagtggtgagctcccctttatcattttttattgtgtctgtttgagtcttctctcttttcttctttattggtctggccagcagtcttatctattttgttgatcttttcaaaaaaaaaaagcagctcctggtttcgttgatttttttttttttgaagagttttttatgtctttatctccttcagttctactctgatcttagttatttcttgtcttctgctagcttttgaatttttttgctcttgcttctctagttctgttaactgtgatgttagggtgtcaattttaggtcttttccactttttcctgtgggcatttggtgctataaatatccctctaaacactgctttagctgtgtctcagagattctggtatgttgtgtcttttttctcattggtttcaaagaacttatttatttctgccttaatttcattagttacccagtagtcattcaggagcaggttgttccatttccatgtagttgtgtggattttagtgagtttcttaatcctgagttctaattgcactgtggtctgagagactgtttgttatgatttctgttcttttgtatttgttgagtgttttacttccaattatgtggtgaattttagaataagtgctaggtggttctgagaagaatgtatattctgttgatttggggtggagagttctgtagatgtctattaggtcctcttggtccagagctgagtttaagtcctgaatatccttgttaattttctgtcttgttgagctaatattgacagtgggtgttaaagtctcccacaattatggtgtgggagtctaggtctccttataggtctctaagaacttgctttatgaatatggatgctcttgtattgggtgcatatatatttaggatagttagctctacttacattgatccctttaccattatgtaatgcccttctttgtcttttttgatctttgttggtttaaagtctgttttatcagagactaggattacaaccaccgttttttttttttttttttttttttttttttttttttttttgctttccatgtgcttggtaaatattcctccatctctttattttaagcctatgtgtgtctttgcacatgagatgggtctcctgaatacagcacactgataggtgttgactccttatccaatttgccagtctttgccttttaattggggcattagcccatttacatttaaagttaatattgttatgtgtgaatttgatcctgtcatcatgatgctagttggttattttgcccattagttggtgcagttttttcatagtgttaatggtctttacattttggtttgtttttgcagtgactggtaccagtttttcctttccatatttagtgcttcctttcaagagctcttgtaaggcagacctggtggtgacaaaatccctcagcatttgcttgtctgtaaaggattttatttcttcttcacttataaagcttagtttggctggatatgaaattctggattgaaacattttctttgagaatgttgaatattggcccccactctcttctggcttgtagagtttctcttggccgagagatccactgttagtctcatgggcttcccttgtgggtaactggatctttctgtctggctgcccttaacattttttccttcatttcaaccttggtgaatctgacgattaagtgtcttggggttgctcttcttgaggagtatctttatggtgttctctgtatttcctgaatttgaatgtcggcctgtcttgctgggttggggaagttctggataatatcctgaagtgtgttttccagcttggttccattctccccgtcacttttaggtacaccaatcaaatgtaggtttggtcttttcacatagtcccatatttcttggaggctttgttcgttccttttcattcttttttctctaatcttttcatgctttatttcattaagttggtcttcggtctctgatatcctttcttccacctgatcaattcggctattgatacttgtgtatgcttctcaaagttctcgtactgtgtttttcagctccatcaggtcatttatattcttctctacactggttatcctagttagcaattcatgtaaccttttatcgcggttcttagcttccttgcattgggttagagcatgatcctttagctcggaggactttgttattacccaccttctgaatctacttctgtcaatttgtcaaattcattctccatccagttttgttcccttgctggtgaggagttgtgatcctttggaggagaagaggcattctggtttttggaattttcagcctttttgtgctggtttttcctcatcttcatggatttatctacctttggtctttgatgctggtgaccttcagatggagtttttgcgtagttgtcctttttgttgatgttgatgctattgctttctgtttgttagttttccttctaacaatcaggcccctcttctgtaggtctgctagagttttctgggggtccaccccagaccctgtttgcctggatatcaccagcagagactccagaacagcaaagattgctgcctgctccttcctctggaagctttatcccagaggggcacccaccagatgccagttggagctctcctgtatgaggtgtctgtcaacccctgctgggaggtttctcctcatcaggaggctcgggggtcagggacccacttgaggaggcagtctgtcccttagcagagcttcagcactgtgctgggagatccactgctctcttcagagttggcagtcaggaacgtttaagtctgctgaagctgtgcccacagctgccccttcccccaggtgctctgtcccagggagatgggagtttgatctataagcccctgactagggctgctgcctttctttcagagatgccctgctcagagaggaggaatctagagaggcattctggctacagcggctttgcggggctgtggtgggctcttcccagtccgaactttctggaggctttgtttacactgtgagggagaaaccacctactcaaacctcagtaatggtggatgcccctcctcccaccaagctggagcatcccaagtcaacttcagactgctgtgctggcagtgagaatttcaagccagtggatcttagcctgctgggctccctgggggtgggatccactgagtaagaccacttggctccatggcttaagccccctttccaggggagtgaacgattctgtctcgctggcattccaggtgccactggggtatgaaaaaaaactcctgcagctagctcggtatctgcccaaatggccgcctggttttgtgcttgaaacccagggctcttgtggtgtaggcaccagaggcaatctcctggtctgtgggttgcaaagaccctgggaaaagcgtagtatctgggctagatagcaccatccctcacagcacagtccctcatggcttcctttggctaggggagagagttccctgatcccttgcgcttcccgggtgaggcgacaccccaccctgcttctgctcaccctccttgggctgcacccactgtctaaacagtcccagtgagatgagccacgtacctcagttggaaacgcagaaaccatccaccttctgtgttggtctcgctgggagctgcagaacggagctgttcctattcagccatcttgcccgggaattggtgtttttttcttttttttttttttgagatagagtctcgccctgtcacccagggtggagtgtaatggcatgatcttggctcacttcaacctctgcctcctgggttcaagcgattctcctgcctcagccttctgagtagctgggattacaggtgcccaccaccacacccagctaatttttgtatttttagtagagatggggtttcaccatgttggccaggctggtctcaaactcctgacctcgtgatccacctgcctcagcctcccaaattgctaggattacagacatgagccactggtacccagccgtaaggagaggtcttaagagaacttaaaaacagaaaatgttaagtggtatgctattgttttatactattgaaactgtcttataggaaagtattatctttctttacctttgtctgcacttttacctcctgctttcagctcctaaaaattatgttagattaatcaaataggataaaagtcttatacttttaagcttacaatgcattgtggtaaagtcagccctctgtctctgtaggttccatagttatggattcaaccaaacatagaccaaaaatattcaggaaaaaataaactaacaatacaacaatttttaaaatacacattttaaaatacaatataacaatcatttacatagcatttacatgttatcaagtattacaagtaatatagagatgatttaagttatactgtaggatggcacggttatatacaagtactacgccatttttgtataagggacttgagcatccgtggtattctcactgcttctaattatttcattaggacattctcatggggacaggattcataatattcccatgtccccaacccagcctctttctaaaaatacatagttatagatggtgtcttagaagatgtgctttacggggccaggcgtggtgactcacgcctgtaatcccagcactttgggaggccaaggtgggcggatcacttgaggtcaggagtttgagaccagccttggccaacatagcgaaaccccatctctactaaaaatacaaaaattagccgggcgtggtggcatgtgcctgtagtccctgctacttgggagactgaggcatgagaattgcttgaacccaggaggcagaggctgcagtgagccgagatggtgccactgcactcccgcctgcgtgatggagtgagactgtctcaaaaaaaaaaaagaaaagaaaagaagatatgctttaaaaagtttaattctgctgtattactgtagctaatgtgctctctgcatttttttttttttttttttttttttagtattttcgtgttccagacagtgctacttttagcatttgcccaggtggagagcagcctgctatgaaatccagctcccttccttgctgggacttgatgcctgacatcagtcagtcagtactggatgcatccctgcttcagaaacagatcatgctgggcttttctcctgccccaggtgctgacagctcacagtgctggagcctgccagctatagttagaccagagtttcccagacagagtgtggcagtacccctcgggaatttccgggaaaatggattctgtaccaggtattttatgtttatataaatgtctgttcttctttgcttgtcagtctagctgttcatctagatgccaagagagatacaatggtcgcagggctccccatatgtaatattaggctttatttttaattacttctagacattgtatacagtgggtcaagtgttataatcacatatggcttgtcccagcatactacttaagggatttttccccatatggagcttacgctggggggaaatgatggtacttgtaccacagaatgtcattatatgaaaagatcatatgtatcatcatacaaatagcatcgtatgaaaagatcatatcataatgaaaaaattacctgttatgagttcttagcctccataaaattataagaaataagggttaaaatatgagcaagtcaagttggaagacctttttcttttcccatattttacttttacttcaaaatggaatttttctcaaaaaagtcattaagagagataacttagataaacacaagtcacagaagactctgttctgtggtcgttcctgcacgcaagttgctccaattaccgattaccagttatgcaaataacaaccacagactcaaaccagagacatataatggtttgttcatactggacttctattatgtggttgtcttgcatgtaaaatgtcccttctgcagctgtcaagaataacttagtatatataacagctacaaaagaaaacatattgtgcccttatgataagtaccttattttcatgattatgaatttgtagactttatttgagatttagcaatgctaactcttttgatgtaatattttaaaagacaagagagatttttttaatagtaatattttaaataagttattcataatggtaaggttctgttctccacacatccctccttcgttcacagtattcacaaaatccttgattttacaaacatttgtcatcttttacactgtagaggagtggttatccttacattctggttggagatgttaagcatagtgagtttaagggtgttttttgaaagctatatgaacttataataaataaaacattttttaaaaaacaaaatttgaaacaaaacaatttggaaattaagcttaaaattctgataattacagtataatttaatcttatctataaatactaagctagatattggacagaaagtaccatacttgagtcctggccctagccttcttggctatcaaaaagaagttatctgagtttggctcgcctagctgttttaaaattaggctgggaaaggaactttgctgtttatcgaagaactatactcttaaaatgaatttattttgtgctgtcccatctcctcatctatttccttccctcaatccaaccaacagcacacattagatggtgtgattaatgtgcttttaccaaatgctaatggaccattcactttgacatttcacacaaatacaatctttgggaagtactcacactggcaaatgagatggatggcaaatggaagctttttagagcattattgaccccttttagtcagctgagggccacatttggcaaattgtctgatttctttgattaattttggcaatcattctatgtaatttaggcttcagagtaatttcattttcctgcttcaaagaaatattctttgtggtagtctgtaatctaaataggaaaatttctctctcttcatcacagaaggcaacctttactcacacagctggttttctagctccaaataatacagctttgctcctgctaatcaaaatgtacattttttaaggtgtgatgggcttgtggaaattgacagcaaacattatcagcctgcctacctctagaaaaaaaagagcaagcacccaaattctctagtagtccttttaaaagaaggtcagctcttatttttattttttattttttttgatacagggtcttgctctgtcacccaggctcgagtgcagtggcacaaacacggctcactgcatcctcaacctcccaggcttaagccaacctcccaggctccagccatcctcctcccacctcagccttccaagtagctgggaccacaagtgtgcaccacagcacctggctaatttttgtattttgctgtagagatggggttttgcccttttgctgaggctgggcttgaactcctgggcttaagcaattctcctgccttggctcccaaagtgccgggattataggcgtgagccaccatgcacagcctaccaagcacttttaaggaagaagaaagtaccctgcctggcgaaggagtttaacacacatatgcatgggggaagaaaagaacaacaggaaatattagcacaaggttagctatagttctctctgggtgatagaattattttgtttgcctttaaatattttttcacattttatgaatattataaatatgttactgttatcagaaaaggaatctcccctgagttataaaacagatattttcgagttctgaatgttgcaaatctaaataaacatgttccagaggagagagcattcattttttttcctaaacatttctgtcatttgacttgattctcttccagggctatagtgctgacatatcaagaacacctcggagtgacttatttaaccctctcagaagaccctagtcctcgagtaattatccacaatagatgtccagtaaaaatgcttataaaggaaaacattaaaggtatgttttatactatcgaatttagataatactaaatgtgtattttttctgggattttttgatttagtagttacctgtgatcctgtgaaaaaaatatttaaataaaagcattaatgatctctttttgagaagtttcttttgccacattatgttctgtcccccaagtctctgtctttaagggctaattctgcatatgccttttttaaaatttcagatattccaaagtttgaggtttattgcaaaaaaattccctccgagtgctcaattcatcatgagctgtatcatcagatttccagttatccggactgcaagaccaaagacttacttccaagcctacttttgagagttgaacctctagatgaagtaacaactgagtggagtgatgccattgacatcaacagtcagggaacacaggtcagtgagccatgtgttcctgccaagacccaaagaaaaatgcccttttctgaggttttgtcagttgcctatttttaaacataattttctaaatgctgaacatcttttctctgtgtgagagaacatgtgtatccatttttacgtcctcattaagttataaattctcaaactcaagtatgtatctgcaaagtagactacacaatcattgactagagaggagcactagtaaaagcaggcccatcttggatctaatccaaggttgaaatggaaatcaaattgttaggcttatttagatagaacatagttcagctgtacagattttagtacagtcataatacaaatcctcttttgtgtgttattaggataaatatgtgtattttaaaattagtaattttaaaattagtaaaaccccacaaatataagtacagttttaaaaacctgagcagataaaatgtcttgatttgtttctgtcttcgtctggatgttagtgatactaattttgttgaaaatggcataagaacttagcatttcctttcttctggacttaaaatttaccatttgttagtgtataatttagtgacattaaatatatttatagtgttgtataaccatcaccactatttctgaaacttctttatcatttcaaacagaaactctgtacccactaagcaataattccccattctcccctcctccatcccctggtagctctcttcttctttgtctctgtctctatgaatttgcctgctctaagtatctcagataagtagaatcataaaatattcatcattttgtgtctggcttatttcacctagcataatgttctcaagtttcgttcatgttttagcatggatcagaacttcatttgtttttatgagtgaataatattgtgccatacttttttaaaaagttcttccacatttattagttcatctggtcttcacgacaagcttgtgaggtaggctactgtaatggttacaaaccatatattaaagttacaaatgcatttacggtagtaataataatggttatcattgaataatcacttacaccatacgaggcattgtgctaagcactttacattcattctcatctaaccttgacaacagccatacaagttagtgactatcatctccacggagggagaagtagaaactaagacctccagaagtaccttggtctaatttgcatgtagtggaagcaaaaggcctggaattttatccagttttgccagactgcaaagccggtgctctgagcacaatgcatgctgtttccttacatgaaaccccttggaacccctctttcccagtcctcctggtgcattttttctcatctctcaagatttcattaaagctcctgtgaagtgtatttgtgaaatgtggaatgactgatctgctaagggagagaaggaaaaagagaggggcctgagaagagcagtagctgtggaaactggtgaagggcctggctggagacaggggaagggatggttgagtgcactggagggccacactcaccctggagacctgcgtttgtagtggccacaaactactcaggggtgtgctttctatcagctgtgttcaggggctgaacagtgaaaacccgcgggatctgtgcagcctcaggagatgctcccagtctcattaatttacaaaataaatattgcaagcttctcaagggtctctgaactcccctgcatgggtttgaagatttttgaaatcttgcttatatttgactggggaattctttacgatagacattcttcctgtcaaaccttattttggggattcccattcactctaaatttcctcaaaactttgtagtcagggatacttcaaagctaagaggaggtgctctttccaacacccttatcatctgtggtttgaggacccagcagtctcatgttcccattaatcttttaggagctgtgtgccatatgtcctgcagaccgtggtttacttcctactctggaggaagatttgtttcagaccctcaccgacatctcctcagtaatatcccagggcatataaatcactgggaagcaaaaggagctgtgtcctctgatgaaaggaaggagcagtccttctggaggagggagtttgtcttccaggaaccttcctcagccattggtctgtgaatttcaaagctgacctaaacaagcaaaatcaaaacaccataaaatgcccattatgctgcaaggaagaaaactcctttaacttttttcagtcaagccctctgcttccattgtataaataagatagtctcgtgttgtagaattttgaaatggattgcatgaggaaatatgcacataggagttgtatactctcacagagtattctttggaccaacagttattgagaagacctgctaacatgtaggctgcagaataccgattgtgaagttgctgtgggctttctgtggttgaatccctggctcacacctagtcaggagacatctcatggttattcaaccagagacctgaaggtggcacctggtgctcatacccatgatttgatagttagtggtagcctgactttaggacaaaaacagtctttaggtgctcaataaataaagtcataaaagtaagtttacaccaataattttaagtcataattttgatcctaccaggaaaatagttcagactcctgtcatagtgtataggattttaatttctgatactctgaaaccacttttgtcagaattaggcaacattattttgaaaaagtcaaaataaggaacaaagaaaacatagtagttaccacttaactaccaacaacattgagaagcctgcttcattcattcagtcaacaaatactgagtttctaacatatgccagacattataacttggtactggcaccatgtaaaatatactgaacaaaaatgtagcacagcccctgccctcaagtttacctgtggaggagatagataataagcaagtaattgcacgggtagttgtattataagcactacaaagagctatgcaggaaaggtacagttgtgctatgtgggtgtacagcagacaagtttgagaggtcaaggagggtgtctcttactgagagaccttgcctctgtgccttcaaggtgaacaggcactccctaggcaagagagtagggaatctttccaggtagaaagagcaatgtgtttgaagcttcagtgttcagagggcacgtggtcctttcagggaactaaatgccagtgcggctgtagcgccaaatgacagagggtcggagagagggctggtgaggcgatgagagaccaaacctggcaaggccccgtaggtcctatcaaggattttggttttgatcttaagagtcatgggaagtcattgcattgtttatgaaaagtacttgctgagccactgaactgcaaagaatgagtagtttgaaccccagaaagtgaattaaaatgacccctttgcaggtaaattcccttctgaaaagatccagtaaattctcatgatctttgactcttagcagacattcgtagtcgggtcagtgtcactgctgtttcttcgcaaatggattgttttgtggggaggagagaatgacagtccttcatgtttctacagctctgtgccatttaccaagtgttttcacaggcacagtctccattcttttattcatttgttcaaacttttactgaggacctatcaggtgccaaaccctttgccctaaataaggcacaattcctgccttcaaagacttgaataaccaataaatgcagtaaagggaagataaagcctttgatcactgcaaaaattctaagggcaataagttttatgtctatttactgatgagagatttgaggcttaaagagtaatcagctaggtgacttgcaactaagcaggagcaagccggagcctaaatctgctcccatgtggtctagtcctgtttttcctacaccaggctcaagccactgtctgtcctctgaagtcttgccttggctacaaatagtagctgcctgaaagttcatcaaagcacaggttagaagagattttctgatctccgcattcacctaatgcaagaatcccttccatgacatctcaccccagaaggctcccagtgtaatagtcattacttatccagtggtggctatgagaaattttcttcttgtatcaatctgaaaactattactctgtagcatccattcattcatctttgttttgccctctgggacatcacagattgtttatttcccctcaaatacagcaacgctacaattatttgaaggcagctccaacatctttcctaagtgttcccttatccaggccaaacatttctggttccttgaatcattccttcagtaaatgcaatttccacacccatcaccacagttacccttgtgtgaacactctagtgtgttatgttcccttttaaaaatctggcagccggaattacacacagtattccaaatgtggtctaaccagctattaactccctatgcttccattaataaagtaaaagatagagttagctttttattaatgagttcagactgtctgttattattgaacttgtggtcaaccacatcccccaggtctttatcatatgacttgctatacagttgactttttgaacccaaagacaggactttacatttatcccaaataaattaagtcttgttgatattggcctagtccagcttgttgaaatcactttttaaaaaattgtgatgctgtcatctaacatattaagtattcctggtagctttatgtcatccatagatgtggtgagcgtgcattctacatgttcatccaggtcattaataaatatgttgaacaggacaagttcatggttgacatactgcagtgaatcattagacacttcccgaatgcatggggtcaatcagccagactccactctcatctagcccatgtttcttaaataagaaaatgcatctaaaatcacttttaaactatacagtataagatattatctacaagaatatcagaacatactttgttaagtgccttgatgaaccaggactcaaatgtgtaatctgtccatttggtgcagatcacacagaggtaaccttgaacactaaagcttaaagcagcaggtagtaattttcagagttatgtctaccctccaattcaggaatttttataaagaaaaaaagtcagtgcaggtgaatatctgatttataaaatgtgtaatgcaggtattttgacttcttgcttacttcgctcaccttcccagtactccagggcacagtcgaacagataccagcaagttggcactgacttctgaatgtctgctaggtaccctggtctagagtctcctctgtgtttacagtttgttctggctgagtcacaactgtttccaaagatactcaggagtagtgatttccctaagatgtttttcaagaagtatacagtaggaaaaattacatccagaatatccactgttttcttttcatctctgtccaatccttcctaccttgatcaacttagaaattcatcttcctttcttctcttggatatctaattcacctcatagctttagctactgcctgtcacccagtcactcccagaaattgatctccgggccccatattactcccagtgtacaaatctgtgcttctgcctacccactagacatgtcagcctgaaaatcctacaagcatctgaaatcaacacatctgaaaccaagatgatcatttttcttaccccaagccagcttcttctagagtctctgcatcagttaatgtcatcactgttttcccagtacaaaaaccataaataaaatggattcagataatattgaatgcctgttttatctcaagctctctaaaggtatagtcattagtccctgtcacatcctttaaaagtagatgctacccaaagctctgagaggtgaacttgctcaggataaatggtcctgggattcaaacctgggactgtgtggtttcccagcctaccttctgcctactgcttctcagtgtcttcctttctctctgatcctccacacatccagtaggccaccagcttctatcagaaatatctcagaaacgtctctggaatctgcccctttcttctgtgactggggtctgcttcaggcctttggttcatcatctccctcccagattttagccatagcgccttaataggtctctccattgtcagcctctccaacctcaagtctctctctgtaactaacccccaaatgattcctaagacacagactccagcccagagaagagaacccagtccaccaggttgcttaaaacagacctccacctgagaccaatcaggccccgtctcactcctgttccccctctacaggccagggctcaatcacctcttcccgcctttcaaagtctaagtctataattcttccatagcatggtttcctagttaagatactcttttacaaaccacatatatagagatatcagtagtacattttaaatttattccttcccaaaatgggagatgatattttttgtaagaaatgacttttagcccaaagtcagctgcacaaataaaatgcctaagtagcatattttcagatcagtttagacatatcaacttgcagcaaaagatgagtgtgatactatctgcaacttaaatgttcaaaagtagggagactaggtgcaatggcttatgcctataatcccaacacttcaggaggctgaggcaggagcatcacgtggggccaggagtttgagacccatctgggcaacatagcaagaacccctgtctctacagaaattaaaaaaaaaaaaaatcaccaagcgtggtggtgcacacctctattcccaactactcaggatgctaaggtgggaggatcacttgagcccagaagttggagactgccttgagctatgatcacgccacagcattccggcctggttaacagagcaaaacccgtctctattttttaaaaaaacaaaaaacttcccactattttctttgtcaccttgtaattaatttacttagtaaaattgttataattctaaaaaatttgttacatataaataatcattcaaataaagataactgagtacatagaaaagcagaagttatattaaaatgcttcttgttagtaattgtggtagaagatattgtactaagtagaaaccagtatccaggcctcaaatggttttcttagacctaacatatgtatgatggggctgagcacagagacttatgcctgtaatcccagcactttgggagattaagacaggcagattgcttgagcccaggagtttgagaccagcacgggcaacatggcaaaattctgttgctatgaaaaatacaaaacttagctggacatggtggcaaacgcctgtaatcccagctactcaggaggctgaggtgggaggatcacctgagcccagggaggcggaggttgcagtgagccatgatcgtgccacttcactccatcctgggtaacagagtgagactgagaccctctctcaaaaaataaatatgatagtgtcttgctgactgaagtgctctaacacagattcaaatggcaaaacggtgagtctcttagtatatgtcacctagagccttccatgccaccccacctcaccctactagtgaagaaagtaaaaagaaccaaatgatggcattgatcaggactggccgggttattctgtgataacaaacagctgaaaaaaaaatccccttggccatcagtcattaattatttttttccccacacacagaacaaatcttccccgcaaggttggaagcagtcactccatcacccttgaagtctagcacttctaagcgatgctcagtctgtatgtgatgccctttgatctggagacctatggaattacctgctccccctttccctgctgttttataggacagggtaacagtaataacccctccactgtggaagggggaagaatgagagacatacggcagtctcttgcctatggcagttctgaatgttttctgggcacatattgtggggtctataccctggcagcaagaaatcagctttcactgagcactgtttctaatcctgaaggagctcttaccattgtccttcaggttcctggctccaccttctgggagatcttccttggacacttgaagtttgtgtttcatctcacataatcacagtctcttttactccaggtttgtaagtatatagggcagtggtaatttctcaactcagtagacttcttacctatttggttccagaaaattccctgtgccaggaaccatattcatggtccttaagacacatttctttgcttacttgcttccttcctctctggatttaagagagcttctacaggaaagttatacccttgatttacatttttttccaagtcaatataacagttaagttttaacagtgagtgtgttgcctatagtcagtcttaaggctgagtgttaatctgccttcgtgttcagaggctaagtttagaccttgctatttgaggctttatcttagtctgttcaggctgctatatcaaaatacctcagactggtagcttataaacaacagaaacttattgtcacagttctggagtctaggaagtccaacatcagggtactggcagattcggtatctggtgaggacccacttcctagttcatggatgaccatcttttcactgtaacctcacatgatggaagggatgaggggctttctcaggctttttttttttttttttgagacggagtttcactcttgttgctcaggctggatggagtgcagtggcccggtctcggctcactgcaacctccgcctcccgggttcaagtgattctcctgcctcagcctcccgagtagctgggattacaggcacccgccaccatgcccagctaatttttgtatttttaggagagatgaggttttaccatgtgtcagtcaggctggtcccgaactcctgatctcaggcaatccgcccgcctcagcctcccgaagtgctaagattacaggcgtgagctaccgcccccggcctcaggcttcttttataaggacactaattgcatcccaaagaccctgccttctaatatcatcacattggggggctagaatttcagcgtatgaattttgggggaacacaaacattcagaccatagcaggtttaaaattatttctaactttgcaaggttctacatttctggaatctctctattatcttccatttttatttgcaacctggccaattctttcctgagctcatctcttcataaaacaaaacgtaatgttccagacacaggcaacagcagccaacataacaccactgatgcttggttttcagacctcatcttctagagctacagatttatgaagtttatgatctacctctcaagtcatctcaagcaacagttttactgaatatcttaccacttcaaaacatatatgcccatttttatagctttcaatatcgatttctactgtctgaccattaagccagggtctcctgttgtaggattttgctagaacactacttctatcaacaatatctatattagtagtataagctcagttatgctgcctatcataagcctagaacttacctcttgttcatgctaaatgcctagtgtgtgtcctcagggggttttgttctacatggtcactcagggacccaggttgagggaaagtccatcatctcgtatcttcccccttgtaactaaccaccccaaaacctactggcttaaaagaagaatgattaacaacttctcaagattctgaggaagtggccaagtgacttttctgcaggatgagcctgggatcactcgtgcatctgcattcacctagagagttggctgaggtatgggtgcagctgggaagtctgggtgtctctctcaccattctgtctgtcctccttaaggaggctagcccagggtggcaagcaggaaaaccccaataagcaagctgtatcaagcttcttacttgctgatgtcatgttagctgaagaaagtcgcatagccacgcccaatgtcagtatgggaaggtactacacaagggcatggatactgggatgtacaattcattgtgcaacagtcttccacagctatctagagcaggagtcaacaaatatttttttaaggtctggattgtaaatattttaggttttgcaggccttatgttttcccgacttctcaatagatggagagatatgtaagtaaatgagcatgttccaataaagccttattcacaatagcaggcagtggaccagatttggcccaccactgagctgtggaacataaagcccttatttattctctagaaggaatacatgtcaattctgcctttagcccattggccaaaactagtcacaagaccatatctaactgcaggggtggcggggagtataatcctgctctattcccagaaggagagaagagctagacatgtgtggacactagaagtcaatacagcagaagccacattgagaagatgtatgttcagatcatcagctttatctttattgagtacccggcactggttgtaagtactgaagaaaacacacacaaaaccattgccctcatggaacttacacagagtccatgatggtgaatacactgagagggagacgcattttatacacctgtggtctggaattgttagttgtcatctcattgtttgtgtacttggctttttcgccaactaggctgtgagcagtgcgagggtaggattgcatcttctctgtgcctgatgcagtgactaattctttgtaggcactctttaagtgtttgtcaagtaattgattgttcaaaccattagaccaagataaggatttactttggacttgtggggaacctggatatagatgcctaattcctgtatcactcaggtacctaactatctaacccctagagctgccatcatgcaaaaggctacaaggtgtgagttgtttctctaaatgtgaaaagacaaggatagactaaagtctgtgtttcttccattcatagcagtgagtgaaagggacaacaagcaaaaatttccctccagagtctaggttttttgccagaagaagtaccgtgaaagttcagattaatttgcttgccttcagaaggcccttggggcatttaacagaaaccatcaccttaccttaggtttattatcttagaaagtgtaagtatcctcatttcataatgcctgaaaatcacttagagaagagaacagtaaatatttctctattcgcatcccctccctctctcctctaaggggtcctgaagttatggacggtgacttaggaaaaggaatatgagatgggagcatgggacttaaaaaggtttctactgaatggataatttcatatctttcaacctagtaaagaaaagcaattgatttaccttatgtatcatacaaagggatggtgtttatagataggaatatttcttaaagaatatctcttttgttttagattcatgagctgagccatttttaagccattaattatgtttattctcaaattttattgtaagtttaatttttaccttggaacaaatagggcaaattcagaatacaagtcttttgaaaaagatatttttgcaaaacagtccatttgggaaacgtgttcatagagaatacagatacaacaaatggactccatttctgctgtcaagagatttacaatctaataattgggtcagacacataagtaactgtagtacagacaataatatttttgatcaaatagaaatatggttaaaattgttttagaatgtagaagtaggtgtcagtccagaagggaacagaaaaattaaggaatggctctatggagtaagctatcctttaagctgtatgcaccaggacatacaggcttttgaaaggacttatatggagaaaagtatattctaggcgtggtgagtagtgagtggcaggcaagggcctcagctgaagcagaggctgtaaaatgaaaaagaaggcagcagtggaagaaccaggaagagctggaggggctgggctgcagcaaggagcagagggagaaggcagagatgacatccaggtaacctgcatgctgaagatggtcagaaattctgaatttctgaagtccatgagaaagccattgcatgagaaagaagaccagtgaccttgaagttgcttccaaataactctctggctttctcctgtggttctgtgtacactctggtgcttcttcatgtgatcaaaattagaatatattcattgttggtcaagcaagaggccacctttgttccgtcatccaggaattttcagtatgtctgattttatttgctgccctaataataacatagggcccagacttggactgaattgatactgcaaatcatcagaaccagccttcccaagcataaggaggtttttgcccctaccctcaggtaatcctggctgtgaacatgatgttcttggagttgttttttaaatagccctgttctgttttcaaatatttacccatttaagcaactcactatttaatactgaaagggtgtttgttccactgtctggcacctggatcctgaggtagagcttttttctaggtcttagtccatattctcatggtagaaaaattaattttttactccgagcaaattaacttatatctaacattcttgttacgagttacatgaaagaccctagaggggttgtgatatgctcctaggtgggttttgaggtatgtttttgtgtccctagcccagaaggacacccctatagaagtaagtcaacacccaagagcctgaaagttgtttgcacattgcacttcaagtcccaagttttagtttttttcccacaaagatccatatgcacacatatagtgggccccatgtctgaactccagcccacacagagttacttgccagttccaaagaagcagagaatgaagatactcatgccccatcatccatcatttttttctatgaaccttacagctgaatattgaaaaatctggttttgatcttttgggtattttttttcatttcaagtcaactgaatagcccgtacacatggatataaagaaatataaccaggaattgtttgtggtattgaatcagaactggagacatttgaagtcaagccacttcaatagtgtttcttatttctttttaatcagattttgaatattctttctgcaggttgtgttcctgactggctttggctatgtgtatgtggatgttgtacatcagtgtggcacagtcttcatcactgtggccccagaaggaaaagcaggacctattttaaccaataccaacaggtaggtttaattattttcccagtgacaacatagtaagtgttactgttacaaagttgtaaacttagtatttatctttgtcatctccacataatgtattaaagcttttggttaattatcatgtaatccataaaaaatatggttattagcactaaatcatcccttcaataggtagcaataaaccgtctttcctagataccacttgcactccttctgtggtagggttaacaaactgatttacaaactatgcatcttggaatcataccactattattagcatgaaatgcacattaatacctctgtgtctgcatgacagtgtagtaattaataataaaacttagcaattagagctacatcaaatataaatacgcctcttagagccatattttccaccccccactttgacctgaatgttgccatcaggttttaaaaacatgaaatagacaaagagttaatatccttaatttaaaagaattcacataattcaataggaataatataaagatggccttacagaaacaaaaataggggcaataggcatgaacagaaaattctaagaagaggaaatataagtaatcaaagaaatgctaatttatcaaattaacaatgatgttgtatcatatacagtcctggtgaaagtataaattggtactatttccaatttataagcactttggtaatacatattaagagctttaaaatccttttggcttagaaattccacttttaagtgtgttaggagtttcagagttaaggaaatggagaagtgggcaaagatatacacagagagatgtacacagtgagagatatcacacagttaattacaatggcaaaatattcaaagtaaaaatgcccatccatagggaaatagatgatacataattgtactataaatgttacaactgcaaaaagtagatctcaaagaattttaatggaatagaaaatgcatattataatctaaaataaaacaagtagaatataatattgaatatatatgatcctagttatgtgttatctgtacatacatacataagtacgcatgtatgtacttatacatacctacataagtacgcatgtatgtacttatacatacctacataagtacgcatgtatgtacttatacatacctacataagtacgcatgtatgtacttatacatacctacataagtacgcatgtatgtacttatacatacctacataagtacgcatgtatgtacttatacatacctacataagtacgcatgtatgtacttatacatacctacataagtacgcatgtatgtacttatacatacctacataagtacgcatgtatgtacttatacatacctacataagtacgcatgtatgtacttatacatacatacataagtacgcatgtatgtacttatacatacataagtacgcatgtatgtacttatacatacataagtacgcatgtatgtacttatacatacatacataagtacgcatgtatgtacttatacatacatacataagtacgcatgtatgtacttatacatacacagaaaacattcctagaaataagactgaaaagaaaaaaactcaaaattggtaacagatgtggggttaatgagttatttaatatgtaattattatttgatttctgtattttgattatttataatagcatttattttatgatcagaaaaaataacttaatattaaaatataaataccaccaactttcatacgtttgtttaaatctttcttttaaaaagctcattgcagccaggtgtggtggctcacacctgtaatcccagcactttgggaggccgaggtgggtggatcacctgaggtcaggagtttgagatcagcctggccaacatggcgaaaccctgtctctactaacagtacaaaaattagccaggcttggtggtaggcacctgtaatcccagctcttcaagaggctgaggcaagagaatcgcttgaacctgggaggcggaggttgtagtgagccaagatcatgccactgcactccagcctgggcgacagagcgagactccatcttggaaaaaaaacaaaacaaaacaacaacaaaaaaagtttattgcttctcatatatggttaagaactcattaatttggactctgctaatttgaatttataatatttcaaacaatgttggatagaatgttttctttgcccaaaagtgttcataaaaaattaatagcataacaaaattgaagacgaacttttaactagtatagcacaaaatttcgggtttattcaacaatttcagaaacattttatctagggcataaatgttaataacaatagaagcaaactttcatgagaaaggtacaagtatttcttggaatttcattcattcattcaacaaatgtttttcaagggcttattggatgcctagcatgggatgaggatacatccataaataaaaaggcccaatcccttccctagagaagatgactttctcctcataggcatggaattgggcaaggtgatggggggtgtagagagtaaacctaaaaagaaaggaaatgttatggtgcagtagaaggtcagcattctacagggatgaaaacagagctcagtaagaggggctggaagtgccagggccaagggactgggaaagtgtagttttaaacaaattggtgtaggtaagctgcactgagaagttgatgtttgggcggagactggaaagcagtagggggttagtaatgtgactatctgaaggaagaacttcccaggcagagggcacagccagttcaaaggcctgcaacaacatgcctggcatcaaggaggagcagggaagaggctgttgtgggcccagtggagggggtggaagtggaagtagcagtgcatgaggtccaggaggtaagagctagaaggagggagacctcatgggccattgaagggcttagctttaattctaagtgaaatgaggaactcattggatcatttttgaacatagaagtgacaccctgtgacttaaatttctagaagatcattggccgctttgttgaagtagactgtagagaaacaagggcacaagcaagcagggagactagttaggagaggattacagttgctcacattagagacactgatggcttagactacagtggtgtcagtggaagtggcagaaagagtcagattctggatatgcttctaaggaaaagtcaatgggattttcctaatacattgagtaatggctaaaaatagaggcatcaaggatgacaccgaaatttttggtctgagcaactggtaggatatggctgccattaactaagatgagagagactatctgcagatttaggaggaaagatcaagagattggttatagacatgataagctgagatgtcatttagacatctaagtgactgtgtggataggtagtttgatacacaagattggagttcagtagggagctccaggataagtatatactttggaagccatcaacatatagatggtatttcaggtcataagactggatgagatccccaaggaagtcagtgaagatgggggtgagaagaggaccaagggctgagccctaggcactttaagaggtcagggagaggaagagggatctgcataaataactgaggtcagagaagtagaagagctgagagaagacaggaaagaaaagtatttccaggaggagggagttgtcagcaatgtcatatgttgttagtatgtcgaataagcaaaaaactgaaagtccatcatttgatgtagccaaatggaagtcactgatgacgagttgttttattaggctggggatggaggcacaaaaggctgcttagagcaagccttaaagagcagggaaggagaggagttggagacagtgtgtatagaacacactttagagtttctgtgtagagaggatcagaaaaatgagtggtagctaagggagagagtggagtcatgagggattttttgagctgagagatgacagcatgtttacaagctgctagtaatgaagaaaaagatgatggaggaaaggggtgtgagttgctggagggatgtctttgagtaggtgagagcagagtgacttggtgcactttggagaggggttcacctgagacagaagcaagggtggttccgccccagaaatggagatggagaagagccaagcatggactcaggcacggttgatgggcagttgtggcaggaattcctgctaagttttcttctgctcacatcactttttcaatttagggagtctcagttactttattatctctttctgtcttgtgatcatcatgatagagaattagtacacaaagactagagggattttggggtaaaaatctggtgttgataagggaaacataaggaaacatgacaagagcttgtaatagtcccattgggaacatttcccaatactgttggagtgtgactgactccgtccagacacaatgtactgaaagttgagttcttatttgtttcttatgagaatctgatgtcccatcaggaggtatttaatagggtactgtcaataaaaaagaaagaagagagaaagaaaaggtgagtggggggactaatgttcttgtccctttctcctctagagcgccagagaagattgttacatttaaaatgttcatcactcagttaagcctggcagtgtttgatgacctcacccaccacaaagcatcagctgagcttctgagactcacactggacaacatttttctctgtgtggccccgggagctggtcccctccctggggaagagcctgtggctgcgttgtttgaactttactgtgtggagatctgctgtggggacctgcagctagacaaccagctttataacaagtccaatttccactttgctgtcttagtctgccagggagaaaaagcagaacccattcagtgttccaaaatgcagagtctcctcatatccaacaaagagttggaagaatacaaggaaaaatgttttatcaaactttgcatcaccttaaatgaaggcaagagcatcctctgtgatattaatgagttcagctttgaattaaaacctgctcggttatacgtggaagacacatttgtatactacatcaagactttgtttgacacctaccttcctaacagcaggttggctggtcactccacacacctctccgggggtaaacaggtgttgcccatgcaggtcacacagcacgccagggccttggtgaatcctgtgaagttacggaaactggtgatccagccagtaaatttgctcgtcagcatccacgcttccctcaagctgtacatagcctcagaccacactcctctctccttctcggtgtttgaaagaggacccatcttcaccactgcgaggcagcttgtgcacgccctggcaatgcactatgccgctggggccctttttagagcaggtaagaacacaagctgagggtctgtgatgagctagagcccgggtagaaatgacacgcttgggggtagcacctcatttcaagacctaaagaagcaattggcaagaggtgacacacctgagctctacagttacacagaactggatctaaatctagagcctgccactgttagctgtaagactttgggcaagttattgaaccttcctgagtctccatttcctcatcgataaaatggctttgaagatttctgagaggatcagatgaaagtacgtgaggtacccagcattttgcttgccactcaataaacattcaagcagtagtagctgttctgtaacttagaattttagttcagtttagcacacacttttttttagcaacttgcaggcacagagccctttcttagcacactagagcaactaggaaaactagcccaggtcttcagtccctcggcctaaaaggagtccagttctcgtttattttcttcattgctatttatgaatagcggtaggtgagaaattcagaggatttgtgtgcttgtaagatgcacattgagccctctatctacccagtgctgcactgcctgtctatatagctggcaaagggaaggctgtgagtgtgtcagcctctccacagacctgagctcaaagagaaggaatggcccatccactctctggggccaggcaggtggcctcttgcaggctgagggctgctgtttctcagggactcagtgggaaaagtaaggattcccttttcagtctggctggaaaagtctgcagggggtggtttgaacatgcatacaaaattttatagagggactactgtgtactagcaactggtggatagcaggcgcagtggctcacacctgtaatcccagcactttgggaggctgaggtgggaggatcacttgagcacgggagttcaagaccagcttggccaactggtgaaaccttgtctctataaaaaattaaagtttaaaaaattacccaggtgtggtgtcgtgcacctgtagtcccagctactactgaggctgaggtgggaggattgctcgagcccaggactttgaggctacagtgagctatgatcacatcactacactccagccggggtgacagagcaagaccttgtcccaaaaaataagattgagtggtgggaaccatgtggtctcagggtacgttatggtaatcggcatcacagtgtgtgttcttgagccaggttcactctaaagcagttttaatttgataattgggttcccagaaattcaagcaaagaacagcatccagagttagccttgtcagccctttccaataaagaacatggaaatcttactttctgaaagtaacagaggagagagcctttgttctatcctctttgtaaagttgtactttgtgaatgcgttcccatgtaagattaagattgcagcagtaaacgacctgtgttattgccatattggtcagattacattttctccataatgaaattcatagacttactagggttatctagactcttttataaaagataacaacaagatcagggagagggtcctgccagacctgttgtcttgatagcttgcacaacaatgaagaaaacatttccctattgctaaaaactcatttaaaaataagcagtccacatttcaagtttaatagatgggtgtatttataaacagttccagaaactttcccttcaggcagcctttgctttttcacataagaagcaggcacgtaggttactgagctccaatctgaggcctggcaaggacgaaggctcccattcagtctctgcacgacgcagcagtgcagtaagcagcagggaaactctacctgtggcaccaagtaacgggccctgcagcccgtgtgctaaaaacgagctctctttgttttggtttatatttttaatgagctttcacaagaacattctatttgaattttatagaattcacccaaaaatcctctaagctgccgttccaatctcactgtataccaagataagggattctaatatagagggccaagttttcagagcctgttggaaactctgtcactaaaaatctatggacaatctgaagaccatctgaaagaaagcagtgattgaaggagtaggaaatgggaagatgctggaggctccagactcccaggttagcatccttgtcgagggaagggagagagctggctgcaggtgggcaagttgcccacccacatctcacttgagtcagagtgcccctgcctgtcatggaaaacaccctgacctcatttctagggaagttgtggtatcaacttgaagaggttttaaaaataaagaaacaggccgggcgcagtggctcacgcctgtaatcccagcactttgggaggccgaggtgggcgaattgcctgtgctcaggagttcaagaccagcctgggcaacatggtgaaaccctgtctctactaaaatacaaaaaattagccaggtgtgggggcatgcacctgtagtcccagctacttgggaggctgaggcaggtgaattgcttgaacctgggaggcagaggttgcagtgagccaagactgcaccactgcactccaacctggacaacagagcgagactccatctccaaaaacataaaaaatatttaaaaattaaacaactaaaaataaaaaagtatgggtgggagaggcagaataaaaataaatagtaattggaaatcagtaactgaccctatctgaaggaaagcatgtggtctttatcctgaggcccctctctaacccaaagtctcagtttgttgggagccaggcagactcccttcttcaaccaatttccaaacgactgagcaaaagatagatttgcttttgaagggcaataaaggagtacccttggatctgtctgcccttttctgaccagctaagatgtcactgagatgtagctctggcctacacatagcccttctatcaggcagtggcttcaggattcaagggttccaaccccacgacaggggaggacctgccactggcaggagcaagaggccgaggcggattcccactccctctctacgcccacggcaccgacctgaacaggcctgtcgtgggggacactgcttggccatagctgctactcctttcttttatacatggactccgtggagagatggggaattaagatgtttctagaccaaccttctgccgttaggtacacccttacagccattcagggctaaagggaatctgctgtttctttacctccagagaaggccctccatggaggaatattccacagcctccccagctccctcgcctactctttgcagcctgagctcacagaagaaagaggtgggtgagcttcagaattaggaaaacctgggttggaaacccagcccacaggtggatcatccaggggactgtgagcagttggcttagtctccaagcctcagtctcctccttttcctgcctgtgaggccgtggaagcagtaccaccatgttgcattcacctctgcctcctgtgcctggtccattccctgacccagacagcagctcagtcaccagttagcctgcactgatttgaagggagagaatacttttcttgcagttaccgtgagaattaaatgtgttgaatgcctggcatccatagggcctctcatttgtaatctttatcttccagaaattattccctcctttgccctaaaccctagtgttatcatcctaacgttccagagaagggaggagggctcaaaatttaagagcgtccctctcttcgtgggctgggcatgggattcttcgggaccttggcgtggctgttgtaccctcaccttcctgatcccctcagatcgctgagctgaggatctctgtcacaggactgtcctcctcttcagagcctgctggtgaaggagggatggctcccacccagtcctgtccccacagccttcccattaccgggctctgagcaccaggctggggaggtcagtggcttcccggagaaagctgtcttttcagactcctcctctcctgggccctcacttgcccctccaattcttggggcctacagccccaaatccccaccccagagagccagggtaagggcagtgcctgccagactccacgcacagccgcgttcccatggggcagcagcggctgagtggcaggccagcttctggccagcccaagcttcaggaggaaaccagatccaaagctgccctcctgggacatgcacaagggaacactcccctctcactaacctcatcagaatgtccctgtcacagagttcaagaccagcctggcctacatggtgaatccccatctctactaaaaatacaaaatcagccaggcgtggtggcatgtgcctgtaatctcagctgcttgggaggctgaggcagaagaatcgcttgaacccaggagtcagaggttgcagtgagccgagattgcaccactgcactccagcctgggtgacagagtgagactcgatctcaaaaaaaaaaaatgtccctgtctctggtgtttacataaccggagcaggggttgaagggtccaagacatttgtctgggtctagctctgctccaaagggaagcactcaactcagtaggattgggaaagattaaaaacaacccctccattcttgtcagaagtttgcatcccctttgcgacatgccattgagcatctggccgcccctggccaggcatctcctcctatcctggtgcctccgctgtcccggggaggctttagagagaacctcccacctgcaaacacctgcaacccaagaaggcgcccttcctcaggtggtagcagagtgcatccccgccacatggacccccgttagcaggaatatgggaggcttgggcaaggcagtcatattaaagccatttgtggggccgtcagaggatcactttgatttataaagtatgaaagtttgccatttatgaattcacagagaatgacttatttcccttattttcttccaaagaaacagattactttcccaattctagtgtgaaaaatgaattgcagggaaaatgggtcactttttcacaaatgttgaaagttctgcatttgaggtttcaatcaccccttccctcttgtgcgttgcaggctgggtagttgggtctctggatattcttggcagccctgcaagcctggtgagaagcatcgggaacggggtcgccgacttcttcaggcttccgtatgaggggctgacccggggccctggagccttcgtgagtggcgtctccagagggaccacatcgtttgtaaagcacatctccaaaggtagcgggttccgttccttgtaataatgccttcactccttccctttttttttttttttaaagaatgtgctaaagttttaaatgcattcagattgcctctagctttgtttggccttttagcttgcagtgagagtttgggtttgtaacaaagctcatatataatgtcttatgttttgaacagatcactacttgcctctggtgtgtgaaaatgtttcagaaacttcagaattttaagcctcccattgggaaaacaaggattggctcaaatgttatttcatgtgataaacacagaaatattaaaggtgttcaggatttctgctaaacatcagaaaccctacactgtgttgcctcatcatatttttttaaatgtagatacagttgtcataactttcttaaggatatggatacattctgacatggaagcggatttgggggtgaaacagccaacttttctctagcacgccacgtaaacagtgccatcttgtggcccagacaggtcatcgggcatggaggccaaagtgcttcccgcaaggacagtgttttagttttatctgtgtgtgtgtgcttgatgttattttggtcaggttggcagagacttgggaactaacaagggccatctgagtccccttttcttctcagcaggaggcaaggaaaacagggcaaagggcttcttcccgtaaaaggcatctgactataggccataggacaggtctgtgaaagtctctggaaggcctcaaaagaagacttgatcttgaaataggagaatccatgatccatagagcgggtgagggactgtgggtgggagggctggcaagagaacagccagagtcataaaaacaaattccacggacaatgaaaaggacactcccccaggcctcaaatcatctgggaggactgggggctgagctgcagaaactcaccccatgagtcactggcagactgctcactcttgacactggaatctctgtggttctgttgtttttatgttaaaataagacaactaacacctgctaaattgaacctcagtggtattttcagcctactgactcactgaatgttttttacacttgttcttttcttctcttagcaaaatctttttggtttgttggcatccctatgtgtgtgcgcacacagatatttttcttttcagattactggtaaagatgcagctgcaaaaacgacattgagcatttcttcctgaaactggacctgcaataacagatgagctagtttgttagtgtccagatctgtccatgaaagtcgctcagtttcgctcactaagatgtgtgcagacctgctagaggaattgtggctattgtgagcaaatgctgaaatagcccttcttaggaaaaccagacagattcacggctctcacatgatttactccctttattcccctcactggtttttcagttaacatcctgaatatcaaaattgcacatattctccatggcacaataattacatcctcagaatggcaaatgataaggtttagtatctccccctttgttatgactgaagttatatggagggaataaaatttattcctaaagctgaagtatttctttataatctttctaaaacttagcaacataactttaccctttaaaatcacagcaggcagattttaaccttcaaaattgggcctcagtgaaggcatcaatactgttttaaccaaaccttgacaaattaaattatagtgaaggatagtttcatatgaaactctaggctgtgttctgcacctgcgattcttaccctttgaagagtgtcatcacccctgtgggcaagtgttcctctttacctcattttctttttcattttattgtatcttatcttatttgagacaaggtctcactctgccactcaggctggagtgcagtggtgcaattgcagctcactgcagccttgacgtcctgggcttaggcgatcctcccacctcagccccctgagtagctgagactacaggtgtgcaccaccacacccagctaattttttaacttttcatagagacagggttttgccatgttgcccaggctggtctcgaactgctaggctcaagcaatcctcctgcgctggcctcccacagtgctgggattacaggcgtgagccaccaccccagttgtttacctcttttcttaaggctctttcttcaaattgcctgagagggagccaccatcacttgccactgggcatgtccaggaggggccacaggtgctcccgctgcctctgaaactactgccttggggtccatcatgtatgcgacaaggaggctaaccccatgctcttgttccctcaggtaccctcacatccatcaccaacctcgccacaagcctggcccggaacatggaccggctctcactggatgaggagcactacaaccggcaggaggagtggcggcggcagctccccgagagcctgggcgaggggcttcgacagggcctgtcccggctgggcatcagcctgcttggtaaggggctgcggggcctcccacctgtctgtactccagcaggctgagatgcagggtctcccaggactgggcaacttcgccttctgcctgggaatgaccaggaaatgctcagagaaggtaaggcacttgctctgagttctacagtgcgtcccgccgggggctcacctgcacagccgcacatgcagcgcctgtgtttgctttgtgcatgaaatgtatcttgggcctcactgaagttcttaaaagaaatcctaatttgataggacctgctctaagcatagtggtgtctgcaagaggacagcagcatccagctgttggctttctgaagaacgtgatgggcaacgcttccgaagcactggctccctcactcccacacatgctgagccgcttcttttgtttgagaaacactagagcaacatgcaaatgtcacgtaaacttcagtgaggagcccactttgtcctttacttttttgagatcagcctgattcagagtaattattgtttgtagagcagccagatggtatagttagaggtgaagattgctctgcatatttcaaaatattacaaatgtttgaaaataagttgctttaaaaaatttatgaaaaggaagcttcagagctaaaagtttgcagggcaggattttcaaggatttttttgtttatttgtttgcaaaagaatttaaaactgtattgcttggcaatgtgccttccgcgcatctgaggaagtgtgtgcctcccagagatcaaagtgacccaaagcagtgcagagcaaagggtagaaaagatgagtttgaaaggactcgccctctctctgatcttcagttctctacagaactcctagattggcaactgcagctagctgaggctctgggaggaagtggtaaaatggtacaagttcaggttaagttgctggaaattatataggtaaaaacattcagtggtgtggggcactgtcatttgataatatgtggaaactgggaagctggtgacctgtggtaaacaagctgggtaagggagcaaccttcttgcttaactcagtaacccaaaggtgatggtgactcctttggggaaggtggtgtggcagtggaccctgccctcagaagccccagaccttgggctagggtgttcaagtcctttctttgtgacctcaggcaagttctcctctgaacctgagtttctcttttgtatattgggcctggtgataccattgttagaagtaacagtgggtagttatatggcagccaccatgctcatgtttggtaaacagaacctatcattatcatagtatggtagcaaatgaactgtaagagttgcctggtttccaagagtgcctcagcaaaaagaaatatttgagcaacggcagtaatattttcacttaatccaatggattaagtggctgtaaccagaggaagtgacaatgaggttatattgaggatctcaaggtcattgttttgcaattcgggacctgttgatgctattaattggagacttaagtaccactactctgctccaccccagcccttataggagcttctaggcaaagagagagagagagacccacccctgggctggctggtgtgtggctgtctccaccccaacccccgactcccttcctgcccgagggttccagtctcttcccagtcagagaaaccccagccaatgctccgttttcagtgtgtaagattgtacctgatgggaaaaatcagttgtgtgaggagtcacaaatcagccctgatgaggtcatctttctgggcgtgggtcctgttgaccgggtaagtcataatgctctgatctttggtgtagtcattgtgtcttgcatatccttatccatgtgagggaattcatttttggaaactgcagtgggctcatggggtctttctgcatatctggtaatttccagaagattattaattcttggggtaacataagcctcctctgtagatgctggctgcacctgccaacactggccagccccagtcccagcccagctcacaccctgagcagtgtgtccatgtcttgactctgcagagttcacagtgggcatctcaagcttggctcaaaccagcttcctttcctgtaagacttcaaggacttcctttgtttcatgtactctttgggttatctcaaaatgtctggtcctagaactaccaggtgtgtggcaagaagaacaaagagcggagtacagcaaactgaaatctcctcactttggaaagttatagattggccaccatttaattcttccccagaaatggtgtttgaaattgccacatacaatgcagtgcctaattgaagttagagccattatcacataataatttgaaatccaggccgggtacatggctcacacttgtaatcctagcactttgggaagccaaagcaagtggattgcttgagcccaggagttcgagatcagcttgggcaatgtggcaaaaccccatctctacaaaaataaaatgaaatacaaaaattagccaggcatggtggcacatccctgtgggcccagctactcaggaggctgaggtggatcacttgagcccaggaggtcaaggctgcagtgagctgagattacaccactgcactccagcctggtggacagagtgagaccttgtctcaaaataataatagtaataataatagttttaaacccatgccagtgaaatagatattctagttgctcagtttcttcaataaaaagacagaaacgttaaggacccagttaataaaaatatattaaaggaaaagtttagagttggcaaagcgttttcaaaggtgtcatcttatttgatcttcacaacccttcacaacttcataacccttcatagcttcacaactttggatgaggtaaagcgacttagccaggtcaaacctccagcaaggacaggagcctgggcctttccaccatgtcgcctacccctgtggggctccaggcctggaaacaatcaggatgtggggagactgaacaattgcaagttccagtgtaggaaaaacacatttcccccaaatgtttacgggttcggcgggccttcttgactctgcttcaccctcatggggacactatggagcattatgaggcccttgaaaattaaagcaagtctgcagctccatgcccagccgcactgccccaggtcagcagggaaaagtgtctgctggctgagagatgctgccgaggcctttggatgagctccatgacagttttccaagagcaacggcttttggaaaaactccgtttagcctgcagtattggcatcagccttgcccacatttaccagatctgttccccaacaccctcactttctactacactctggagcctgcactgagaaaggacgtgcagctccgcatcacagctgcattctgcgtttcctcccaaacctgatgccttctcatgaacaccaaagctaggatgtcaagaattgcttctctgacccccacttcttttgggatgcttcctggtttgtgatgcgctgctggattccccagagaccacctcctctctcttcatgggcactcttggctatgccatctggaatcccaacaaaacaggcctccgccaggtgaaatcagaaaagtcccctccgagggagtgactcaagagttgcacatcccaagagacagcccttaagagtcatccctccaataccaccatctgccattagcagactggtgtgtattatagtcagtgcggaatttaggaatgactggcaaagtgcttccttgttggtttgctcgtctgttctggtcaaaaaaaagaagcgctgagctggaatgtgcagtacactctatgggtctcgttactttctggaagggcgagctgtggcgtggtatcccattttatgcctgtccttctgatagtgtgacaaaaaattgccagaaacaaaattacaccacatggtaaaggcagcatcaaaacagacacatcaccaggaacttccatagcccagtgaccaagtagtttctgcccaaggcctaggagcaagtcacagaaagaggtaagggaaggcctggtggtttcctgctccacaatgaaggctttcctcctcctgcgccttccaaggcacaacaggcaatagctcctgtgtcctgcggggtgcagcactcactcagtcctggaaacccctcccagtcacgctcttctctcttcactggcttcatcagatcacagccatctccatgtggtcgcccaccccacgggcctgaggccagcagacaagtcttgggatcagtttccactcctgaaagccttcgagcagagtttaagtctatgacagtccataatttaccagttgtgggatttagctggatatacttcagaggagagccattccaggctctcagagaggctgcctctctcaaagcagggctgcagggaccatgaagtggctgctggtctcttagcctctctgttctccagcttgtgagcacagaggtagataaggcacctggtggctggtgaggtgttggtgtgtgtgacaggccagctttccccctcaaaggtctgctgctgagcccagggcaggtggttccacagctccctctctgactctcagaatctaacaccttgtcatgggactcaggctttccacttttggggggctgcccaaatagtcttatctgtcaaagccacagtaaccgaagccttcactgtggccagagaaaacggaagagcagaacagagggggcctcacctgatacctgcatgtgctggagcaggtggctgtcagcaccctgtgcgggtgaccgcagctggcccaggccccactctttgatttgatgctgttcactttgataatctgctgaggtgactggaagagaagacccagggttcctgcctgtccctcagtgtggccactatgacttctgatcttccaaatggagtggagcatcaacggcaaatgaggggtgctcccagctgagcgccaggcctgactgtctgtggtactaaaagagtgaccctcactcttgatagctggggtggcctgggcctgccgggagcagcttcctctgctcactcttggcatttctgtagaaggtttggcagcacgactctaggctgggaaacaggtctgttgcctcaggtcattctgaatctgtcaatgcataaacttaaatgtctctgtcaaaacctagaggaaaggagtccatgaagagcattccctttacaattgacgtgatatgcactaaaatttctaccaggggccagagcattttcatcactcctagcagttttgaattgaaaacagagaattctgtcaagaattgtaaagaaattttcccttctttctgagatagggagccctccactccatcacgaaaaaaaaatcagaatggtaagacttttctagctctcactgttggcctctcaaagcaggagtagcaaaggggccgtatccacaggactgcctgaggggctcctttcatctgtagctgcctcaggctcagtgcaggagatggatgccctgtgctacagctgtgggagcagagctccaaggggttttggtcgctattctaagtgaggagtaagtggccaaacctcaattccagtgagagagaaaggttttccaagattggcaaagaggaagagcctgttttataaatgggataagcgagtatcttggtggttaagagctatgctgtgactcaaactctctgtacacttaacagctgtgtgaccttgggaaaaaactccttaacctctgtgcctcagtgtccgtatttggataaaaacaatgtatgactcctaggaatatgaggatcaaatgatctcatacaaataaagctcttagcacagtccccagacctagtaagcattcaagatagattacctataatccaaataataattactatatcaataattactcttaagtattaatactactaaattatgactgttatcattattatcaaaagtggagagttagaaaggggctaaccccttccagtttttcatcctcatgaatcagtgcaaatgtattgggctgaacagtctttctctgctcctgaggaactgttagctcctctctctcaactttgttgcctgacttctgaggaaagatgtatggatgacactctgaatagcctgacaggtttgttaaattctgaactaaacttcacagatcctgactgtgtggaccaaactccgtctgaacattgtattttgatgacgataataaatgtctactgcccttggtgtacttagataactggtaaacaaatgggtagtaaagacctttataatgagggtggggactcattttcaatccagataaaactgtgttccagatggagcctttcattttccgaggattttaagcctctgtccttactgagggcttttgttattccaggtgcaattgctggtatagttgatcagccgatgcagaacttccagaaaacatctgaggcacaggcttcagcaggacacaaggccaagggtgtcatctcgggtgtggggaaaggaatcatgggggtgttcacaaagcccatcggaggagctgctgagctggtgtcacagactggctatggtaagtcggtggaaaacccatcaggccaacccagacgttactgatttgcatgcttataccaagggttccctaagatagtgtaacctttcacatggcagacagtggctatctttcttacctctctatgcttatttacacagagtagaattttactactaataataaaaccatagaatcaggaaaccagttactagtttcagtctatatgtcgtagaatctttttacagtacacttgatagactgtaacgaaaagtaaccagtttagaggttgagggcagaatggagaatacagcagagaaaagaattaagactttttcctatgataaatgtggaaggagagagaggctgtgggaagataactctaagaagcagtagagaatgagacagagtgtggatgtgcacatgggtctttgggtgtgggtggccttctcacccacagaggacatcctgcccctcgcagccaggctgggcagaaacaaagggtctgcaaccagaagccctttcacaaggcagacagctgggaagtgcgtggcgcatggcagtacctgcacttggatggggcgtgccggggcctctccccgtgcagccgcatgcacacacgagtaatgggtgcctgtgaaaggaagcacctcctcccaggcttattttctgtgttcttggcagagcacattcaagtgactttccataaacctgtggctggaactgttaccattttacctaaaattggtgtcatcattttggtaatgaagcaggttgtctagctagtatcacaaacgacagaagcgccctcccgtttgtcagacatgtgagcacactgtgtctgcatccgcatctggccataaagcccatgggatgtgtttctagggaggcatcctgctcctcagcaggcctgacaagaggcagccagatcggggcataaaaacaaacagcgtctgaaaggaagggagtggagatgaatgagtgcccacacttcaggcagccatccggagagcatccttaagagaccacacagacgccagcatgtgttcctcttcgctttcccctcctcgcccgcctcatttccctctccttctgtgaatgacatgttcactcacagggaaactgtcaataagatgtgctataacctataagtgagaaaagttacactctcccttatgatagggactccagtgaggtaaagtgaagtcatacttcataaattcttttggttttgaaaatgccattgtccctcaccgtgtttcccagggctgaagaatgctcccttatgtaagaggatcttagagcagagcttcacatggccgttttggtttccatcactcttgtaaaacttttattaccgaactgaaggttttaaaaccactaactcttagtctaatgactatgcgtcgtttgtaaacatttacaagccctcagaaagcacacatgctgtaccatctttggtgctggagagtctatgtaaaggcctatgtggctgctgctgggtgccctcatttggtgctggcaccagggagagcatgtcataaaccaggggccccaagcgtgctcataaatgtatatggattcgtgtttaacagccggattaagtcgcttagcatttaagtagtgtatctaggcaaagggtgtgcctttgtatatatctgtgtgttttttattttttgactagccttagcacagatacagaagtattaaggaagttaactaacaatctagacttttttttttagacacagggttttgctgtcacccaggctgacattcagtgacacaatcatagctcactgcagcctccaactcctgggctcaagtgatcctcccacctcagcctctggagtagctaggactacaggcatgcaccactatttattttttgtagagatgggggtctcactttgtttcccaggctggtctctaactctgactcaagcaatcctcccaccttgatttgacctcccaaagttctaggattacatgcatgagccaccacaccagacctatctagacttttttaacacatcaattaaaatgatgtctaggctattgttcatgaccagctactttcggtgtttttgcttcctctaattgctagtctatgcttggactgtgtaacacattcatattttagtttgttactaatgcaagatcaccaaggttaagagcattgtaatgtttaatgattatctatacgcttgcttccaaagatgtgacatcattttggatctgtaacattttatggatggctctgaacagatgacatcattgcagcatgaaactgttttccagaaaacaagtagtaaaactcccttacttctcttaccacaggtattttacatggagctggactttctcagcttcccaaacagcgccatcagccaagtgatctacatgctgaccaggctccaaacagccatgtcaaatatgtctggtaaaattattgagatacgtgctcaactttacatccatattgtatgttaatagctcctggcttgctctcaagctaatgggccatgcttccagggagcccaggagtagccattgttggcactggcatctcaggcagcacaagagcactgtagagggacaggaagaggctgctgttgccaggtttggggctggctgcacaactcctctgttccgtacctaaccactcaaggaaggtcatacattggcagagaaacccagtcttgctagagggcctgagattccctgtggaaccagcactctaattagaggtgctatttctaatggggagaaaaggagctaataagcaaaaccaagggaaatctttgttcccaggaggaagcaggttctgttaatcagaatcagtctgagaactgacaattacatttcaagctaaaatgggtaactggattggtgagggccctttgcccttgtggaggttgccccattggtaaataatgagcactgataagtgaccatcttttcacagctggcccctggcctcacttttctccttttaaacaggaaaatgcttcagtctctgggcagaccagaagtccacatggccctggacgtggttctggtgaggggctcaggccaggagcatgaagggtgcttgctgctgacatcagaagtgctcttcgtggtgagtgtcagtgaggacacacagcagcaggccttccccgtcacagaaatcgactgtgcacaggacagcaagcagaacaacttactcacagtgcagctcaagcagccaagagtggcctgtgatgtggaggtacgtttcagaaaacagggcaaccaagactagctggccagggaggttgaggagcaggctggtcactggtacctaggcatttctgagctgcagcctctggagtggctgctggagaccaaggagagctgctacccagaggaggaagtgtagaggccggagggccgctgcgaaagggcactgggaagcccccatccagatatgcacataagccctgtataggagaacccagcaggcggccagcaggactcaaggtctaaagctaagtaaccaagccaattgaacaaggctgatctggcttggccgtcatggggctggggtgctcgatggacaggaaaatggagttacaaaacgagtgggttggttcaggaagggccaggattggggcagcaattccacgcaactgctccacaaaggaggtcccctggtctgaaagcctaaagtcaggtccttggctgcctgaggcctgcaactggctgcagggtgctggaggtctgtgggtgctggaaaggaccaatgcagaagcaaggggcatcatgaaacaagactctccactccctcccctacccccaaacctggagacttcaagggtcaacattttgtgaagtggtctctctctcaaatccactgctttgtattctgtggctgtgttctctttcccacaggatagtttcccaccccctgagtaccacagaatcccccctggggatgatacttaaggctcttggggcagctccatggctggctcctggcctgcataaattaatgtggaacagatgcgcaggcaaggcatactgggtgtcaagagtcaagggggagccccaaccagacagaccccagcttcctgtagcccagcccagggtaaaaacaggtgcacccactggaaaattgctctctgcccctccttcctggatgatggcctgatccatgagatcctaattatttacctaaataatagacatctttttccacacagcaagatagtggtggatcagtggcaaactggagtctgctggccctaacctggggactgagtggccccagcaaaggacagcaaacctacctccaataggttctgcctgatccctcctttcattattctcttcctgggatgggggcgtgtatctccttcacgccactgtttgggtaaaattatctgagaagatggaaagcagccaaccacaacaactcttaagatttctctagtttcttggatcatgatcatagtcaggctttaagctagggtttggcaccaggactacattgctgcttcaagttgatgactttctgagaataaacagaggtcagatgtccaggctgactttattagatctgccagaatcttctgatcagttgagtaaagcagcggtgatttggctataggatttggcaagggataatatcattacgattaaatctttagtccttaatgagaaacctccaaggccctgtgaccatcatgattccttagctgcttgggaaatatttcagatcttaaactattaagactgcagatttcttttgctgttgaactgtcttcaactgtgatccttctcttgtatttttgtttgaggcaggtactgtggagaatcatcatagctggaaggaaacagacctcagtttccctaggggttgagatagtatctggagtcaccactcctaaaagttgctgagattattgggattgtggaatcagagaagcaacactgaagctctagataccattttcagcactgattttccactgctgtccagggctgaaagagggttgggattaaggaatgcctaaaacagaagtgggaagacatgactgagagcaggagcactgtgcctgcacagccaaggcccggcactggctggaaggtagatgggccagtgtgccttcagcctccacattctgctttctctattccactttctctctcctgaagtcattaataggaataactgctgccttaatcctatgtctataaccccaacctctcctactcacccccaagaaaactcaagctgcagagcgtctttgagactaaaccctcccaagtgctgtaatctagagtattttcaacatgagtgggcaggggagggtggccagcagcactgccttgtcagtgagctttcttgagctgtctggctcttagtgcatcccaacataatccacagacatgaggaagcctgtctgccgtgaacacttccagtgaagactaaaagtagtattttaagatctataaatgacttttctggtttttagcttttgcctagttcctttgaattttggaaggaattaatttgtagatgacatcatgcagtacatttaaatatggcaggattgagatttattttttaagtcagcatttgcttttcttggttaaatgcaaccagtttaggggtaataactgcttaatatgcctggcacattattgaaatcccttatgagtggctcaaaatgagtcagaaggtcaatttagtccttggctgggttcctttcacaacaggggttttcctgtgctgctgttcaggaggagcaattaaaactttttgtgtattcaaagctttccagctgaattctggccccatcaaatgatatcagagctctggcttttgcctggtggtgcagagctttcgtctgttagtgaatctttggggaccgtttttccccaagcttaaaaacacaagattcaaactctaagggattccttacttattcttctagcaagcctctttactatctctctgccatcgcacggactttctccagcttttaagacactttgatagcattgttactggaccacacgcagaactagaaacaagtctttctttaccacttcttccagagtagtcttgccaatgttcagtaggcaaaaaccacggaaagtttggtggctacctgagattcacaaatcagtggcttacaattgcaaacttcccactccacttgatctacacactagatagctaaaggacttcagggtaggaagaatttatagcttcagctgcctttgatgagcgctttctcagaaaatctcactgaagaacctagtgtatctcagttctatttgtgttccactgaagatgagccagacttttatgaacaataaatgtactttacatcctctttttttccataaaaatttccccttccgctgcccagcttctctattttctctggctttaaatcctaggatttagaaaagcagaaaatgttacagttcaaaaggttttttaatgctccgtccaaagccactggtttgaaagaggtgttctccactttaagacgttctatctgaagaggtttggggagctaggcaaacagagcttttatttcagtgctgagtttaatgttgaatagatgatttatgtggaggaaagatttttctccttttttcttgggctggctgctaaagaacaatgacagatgttttaatggtgagtagaatgttatcaaatcgtcaacttcaaacatgggaattttatgcaacaccaaatgcttattctaaggaggctgtcctaagtctcatgcacaactttcagttatactgctaaaactgcattgttatcgttgccatatctcagaggaaaaaaggaaacattctggattaatggctttaatagatgacctaaaaggcataatgtacaaatatatcgaggcaaaagaactaattttgttctggaactctcgtaagggtctggcaactaatctttattatttttggatcctaggtagatggagtccgagagagactgtcagagcaacagtacaacagactggtggactacatcacaaagacatcttgtcacctggcccccagctgttcttccatgcaaataccatgccctgtggtggctgcagaacctcccccctccactgttaaaacataccattacctggttgatccacattttgctcaggtcttccttagtaaatttaccatggtgaaaaataaagccctgaggaaagggtttccttgagtcccctctgaggtgtttattcctgcttgtgtgatttagtttttgggtttctttgagacagggtctcactgcattgcccttgctgacctcaaattctggggttcaagcaatcctcccacctcaacccacaagtagctacgactgcaagcacctgccaccataaagggctgcattttgccaccataaagggctgcatttttttaaaaagcctaggcagctctaacatcatctgatatggacacaaggccaacagtttccttatttacatccttacctctaaaagatacttcaaagtgacaaaaacgtgttccttccccacttagagacaatgattaacagggccctatatgttcttaccacatacagaggatgcatttatttttgctctatgacacttgcaaaaatctctactgtaattaatttgggtctattattaactctctgttccatcatagaatgtggccaggccttacaatggagagccagagttaaaacttcaagttgcatctgtttttgggctgagtcaccacctttgcctcatgctcctttgtctgcaaaggcctaggattctttctttaaatgaaatgcttaggactttgtggcttgttacatttgtcatttaactgcagtgctattctttgaaagctgctatgtgtattttctctgaagtctgcattttactaaaatttacaacagtctgatgattgattgattactgtccaggtacattttagaaaaagtgttcttcttccagtttgttttactaagcaaactttgagtaaatcctttgtcctatattgaatccagtcccaaagtgttcaggtgagtttctctagttccataaacaaaacatacatagtgggaactccctggtatgccatagagcacacaagaaccccaatattaatgctaacaattataccagtccattttgtttattctgtggaattgacttgacaaagcatgaagatattcccagtgtctgtctgataatattttgcatctaagaatgggtttgactcaagatcttgggttaccaagatgtcttaaatgttcagtaaatatctttcttacagtccagtagcttagagcatgtttgctgattgatattacatttaaacttggggctacagcttgttacctagaattttgagatactaagagaatgcaattttaaatgcccactggttttatttgttttggagagagggtctcattctgtcacccaggctagagtacagtgggaacagtcatggctcactgcagcttaagctcactgcctgggctcaagtgatcttactccagcctcccaagcagctgggactacaccaccacaggtatgcaccaccatacctggctgatttttaaaattttttctagagatgaggtctcactatgttgcccagctggtctcatactcctcagttcacgcattcctcccacctccacctcccaaactgctgggattacaggtgtgagccaccatgcccaacacccactgatctttaactctcacatgttgggcataagaagtcactatataattgttactggaaagcaagacttaacgaacaattctgactatgaaaaatgtctctttcagtttgttctgtaaatatttagaaaagtgacagctgtcaacctcagagtaactatttctaaaaatgtaaatatgtattaatccttgtatcttttatggtaattttgcatattgatatgaattatataaaattgtttaaaataaaaggtgtccttgaattactgaccacccatagatgtctactgttaccaggttttacaatgcaaattttcactaatacctgggtttaatacagctcacatcactgaatgttacacatgagtttaaatgggtaatatacaggttttgttataataaagttactgattaaattagctttg

SEQ ID NO: 2154 - DNA, 108494 bp, Homo sapiens
  source 1..108494: mol_type = genomic DNA
ggcgcggtacaggagcagcactgccggcgggggcgggtgccagggacttggaggtggaggggacgcggcggtactctggcgtgtgagccgagggtggagtgcagagggagcgggagcgggacgggaggtcttctagctttggttctatggtggcagatccggctgggttccgggaagcgagggcctcgcggggtggctgggttggtgaagggctactgcggccgaaggggagcccgcctcacttcattcttccactctgagggacccgctctcttctggtcactacgtcttcctccctcacttcgcttggcgaagggtgttgtacttgtgaggaagtcgcagctggagctgggagtccgctggagtttttctctgtttctaagaggaggcgaacggccgctttggtggggacttactgctttcggcctgagataacgaacgctctttccttcactctaccgccgacttctaacgtttctgtctactcctttcagcttccgacttcgactccttaccttaaaagatgctggagtcatatgtaactccaattttaatgagctatgtgaatcgctacatcaagaacttaaagccgtcggatctacagctttcactatggggtggagacgtggtactcagcaagctcgagttaaagttggatgtgctggaacaggtaagctatttagctgtcattaactggaaacagttttcagcttgtttagacggtaatctattgtttcctaagctttgactttatgctgtaaaaacgtaacttttctactgatgtattttgagctaccctgaaacaagggggctttattttacactattttctttttctttctttctttttttttttttttttttttttttgagatggagtctcgctttgtcgcccaagctggagtgcagctgcgtgatctcggctcactgcaacctccgcctccgggactcaggcagttctcctgccgtagcctccctaatagctgggattacaggcgcgcaccaccacgcctggctaatttttgtatttttagtagagacggggtttcaccatgttggccaggctggtctcgaactcctgagcttaggtgatccgcccgcctcagtcttccgaagtgctgggattataggcgtgagccaccgcgcccggcctgcataatttttaaaaatagtttgttcccagttttggtatattagaatgggattacttaaagttgctttgacagaaagacgatttcattgttcatgtcagaattgttcggtctacttactcaattttcaagcattatgaatgtgctaatttatgttgtcaaaattctgtatgagcctggaaaacatcacattctcattctcctttttgggcaatggaagggtttgaaagccagcaggaagggtggctggcttgtgggggtcgaggaaaaaaagacaaaaaaaaaaaaaaaaaagagcagattcagatcatgaggaaagatgacatttcccacggcatcctcagagtgttgagtagatacattgagaatggcagtaaaattggaaacttctttattaatcgttttagtttcttttaacatgagatttgtctgatgcaaaagaaccgtaacttcaaagatcacatattcattaattcatttattacatttattagtaacatgccaagaaattctgttaggcttgaggatctgtgcaagctcagaagagtcagagaccaactgctttttaggagataagggaagacttaatctgacagtgatggttatttataatttttagttatagtccacagcctcttttattactcttttattaagtcaatctagacttagcactaagaaataatactcctggctgcttctttttcctcttcccaaggttagttgagtggcttaatatttaatattttcattttattttattttttaatgagcacaaatcccaagtgtaacagctcaatttttttttttttttttttgagacggagtcttgctctgttgcccaggctggagtgcagtggcacgatctcggctcactgcaagctccatctcccgggttcatgccattctcctgactcagcctcctgagtagttgggattacaggcgcccgccaccacgcctggctaattttttgtatttttagtagagatggggtttcaccgtgttagccaggatggtctcgatctcctgacctcatgatccgcccgcctcagcctcccaaagtgctgggattacaggcatgagccaccgcgcctggccaacagctcaattttaaaatgttttacacctgtgcaactactgtccaataaaaaaatggaatgtttccagcaccccaaaaggctcacctgtttttgtaagtactccaggccgggcacggtggttcacgcctgtaaccccagcactttgggaggccaaagcaggcagatcatgaggtcaggagttcgagaccagcctagccaacatggtgaaaccctgtctctactaaaaatacaaaaaattagctgggcttggtggcatgtgcctgtaatcccagttatttgggagactgaggcaggagaattgcttgaacccgggaggtggaggttgcagtgagccgagatcatgccactgcactccagcctgggtgacagagtgagactccatctggggcaggggaacgtactccccactcctaaaagaggcgactggtaatctgacttctgtcaacatagataagttttacctggttttgaacctcaaaaaaattggaatcatttatgtttggcttttttctttcaacctttctaagattaacccatgttgttagaagagtttgtttttcgtattgtcagtactattccattgcataaagattccacaatttacttactcattctcctgttgatggacacttgggtttttaatatttttggctggtgaagaaagcttccataaacattccagtacatctatcttggtaacgtaagtattaatttctcttaggtgtatacctagaaggtaggcctgtgtttagcctgtgttttcattttatattgccaaatagtcttccaaagtggttatatcaattccagtcttaccaacaacttataagcattccaggtatttcacatttttgctactacttgttatgtttgttattttaatgttagcctttctagtgggtgtgtagtgataacctcattgtaattttaacttgtattttcctaatgactaattatgtttttatattcttattggccatttagctatctttttttttttttgtgaagtctaagtcttttttccttttttaaaaattgagttttctgtcttattgatatataggaattctttttttttttttttttttttttgagacggagtctcgctctgttgcccaggctggagtgcagtggtgcgatctcggctcactgcaagcttcacctcccaggttcacaccattctcctgcctcagcctcccgagtaactggactgcaggcgcccgccaccatgcccggctaattttttgtatttttaatggagacagggtttcaccatgttagccaggatggtctcgattccctgaccttgtgatcctcctgtctcggcctcccaaagtgatgggttacaggcatgagccactgcgcccggccaggaattctttatatattttggaaatgagtcctttgccagatagatgttttgcagtatttactctcagtttgtggcttgtctctttactcataaaggtgtcttgatgaataaaagttaataatcttactgaggtccaatttatcaatcttttcccttgtggttagggtttttctagtcttgtttaagaaatcttagcttacaccaacatcgtgaaaatattcttttatatttcttttaggagctttattgaattccatgattcatctcaaattttttttctgcatatgagtaatagaggttaaggttaatttttttccattgatagtcagttgatctataccatttgttgaactcttctttccctactcaattacagtaagcctttgctgtaaatcaggttgccatatgtgtgtggatttgtttctgaactctttattctattgagtggtctatttgtctattcttgtgtcactccatatggttactgtagcttttataataagacttggttggtatctcagtgtaattagtacaactttgttcttttctccttcaagattgtcataactattttaggtcctttgtatttccatatacattttatttttttatttttattttttgagacagagtcttgctctgtagcccaggctggagtgcagtagtgtgatctcggctcactgcaacctccacctccctgtggagcaattctcctgctgcagcctccgtagtagctgggattacaggtgtgcaccaccacgcctggctaacttttgtatttttagtagagacggggtttcaccatgttggccaggctggtctcgaactcctgagctcaggtgatccacccgccttggcctcccaaagtgctggattacaggcatgagccaccacgcccagcctatcatatacattttaatttcaacttataacttttagaattaatttctaaaaaggaaagctgttagtgttttttgctgagattacattgaatctatcgatcaattttggatgaattaacatattaacattgagctgacatagttttgagtttttcaattcatgtacagagcattgcttttcatatttttaggcctttaatttctctcagcaatgttttgaactttttagagaaattttgcatgtatttcattaaattttacctctttttatggatgtttaagtagcattttaaaaacctctattttctggttaggtgtggtggctcttgcctgtaatcagtcacagcactttgggaggccaaggtgggtggatcacttgaggtcaggagttcgagatcagcctagccaatatggcaaaacctcgtctctactaaaaatacaaaaattagccaggtgtggtggctcacgcctgtaatcccagctacttgggacgctggggcacaagaatcacttgaactgggaaggtggaggttgcagtaagctgagattgtgccactggactccagcctgggcgacagagtgagactctgtctcaaaaagcaaacacaaaaaaacctctatttttaaataatttgttaccagtacaggaaataaaatcaattttagtatgtcgacctatccagtggcccaacttgtctaacagtttttggtaggttcttttggattgtccatgttcaatcatgtcacctgcaaataatgacagttttacatctttctatccaatacttgtatcttttatttcatttcatttcattattgcagtgggctaggaccttttatataatgtggagtagaggtcatgagaatagacatccttttttgtttctaatttcagtgggaaagtattcaatgttttactattaagtatgttgttagctataaataacctttactgagttgagattcttttctattaatgattttccaatgagttttaaaaaatcataaatgaatgctgaatttgatcaaatattacacttaatgagttgatatatgatttttctcttttattttgttaatgtggtaaattacattgttttcaaatctaaaccttgcattcctggaataaacctgattatatattatcttttttacatattgttggattcaatttgttaaattttgattgattttgttgtgtctttgcttataagtgatactagcctatgattttcctttctcgtaatgtgattacctggttttgaatgtcatatatatatattggccttattgatttatttgtgaggtattccctctttttataatctctaacagtttatgtaagatcaatgttagtggtttttttaaaattgtgatagaatatgtataatacaacatttatcatcttaaacatttttttttttttttttttgagatagagtttcactcttgttgcccaggctggagtgcagtggtgcgatcttggctcactgcaacctctacttcctgggttcaaatgattttcctgcctcagcctctcaagcagctggcattacaggtgcccacgacaacacccggctaatttttctgtatttttagtagcgattgggtttcaccatgttggccaggctgatctcaaactcctgacctcacccaccttggcctcccaaagtgctgggcttacaagcatgagccatcgtgcctggcccattttaatcatttttaaatgtacgattctgtggtattacgtatgtttacattgttgtgcaaccatcactactactcatctctagaatattttcgtcttcccaaactgaaattctgtatccattagacaccaactccctattttcccctgttcccagccccttggcaaccaccattctactttatgactgtatgaatttgactattttaagtacttcatataagtggaatcattcagtgtttgttctttcgttattggcatatttcacttagcacaatgtctcaaaaagcttatctatgttgtagcatatgccactatgtcctttgtttttatgtctaaataatctattatatgtacatgccacattttgttcattcatttattcgttgatggatagttgggttgctttcatcttttggctataatgctgatatgaaggtaggtgtacaaatatacctgagactgtgcttttaatttatttgggtatatacccagaagtggaattgctagatcacgtgataattctgtgtttaattttttgaggaatcaccatactgttttccacaatgattgcattgttttacattcctaccagcaatgtgcaaaggttcgaagtgctccgtatcgtcactaacacttgttgttttacgtgttttttttttttaaatatagctatcctaatgggtatgaaatgatatctcaatgtggttttaatttgcatttctcaaatgattagtgatgttgagcctcttctcatgtacttattagctatgtttgtcttctttggagaaatgcctatttgagtcctttgcccaattttgaatcgggttctttgttttttgttgttgttgagttataggagttctttatgtattgtggatatcaatcccttagcagatacatgatttgcagatattttctcacatgctgtcagtggcatcttactctataatagtgtcctttgatgcaccaaagtttttaattttgatgaagtccaacttagctatttctctcattcattgtctggatttttgctgtcatatccaagaaatcattgtcaaatctaatgtcatgaaggttttctcctatgttttcttctaatttttttgttcttacatagtataaggtagtgttgcaacctttctctctttttttaaaatgtggatattcagttttcctaacaccatttgttgacatctgtactttcacattgaatggtcttggttcctttgtcaaaaatcatttgaccatagatgtgagagtttatttctgggctctcaatcctattccattgagtaatatgtctgcctttatgatactatcacactgtttggattattgtagcatcgtagtgagtttcagaatcaggaagtgtgagatcaccaacttctcagttttttaagtgttaggaagaattaaacatgaagtcatctgggtaatgatgtaaagttataaactgctgatttaatttaagacatataggatcatttagacttttatttctggtgttgtcagttttggtgagttgtatctttcaaggaatttccctatttcttgaaaattagggatcagcaaactgtgtcctgggcctgcttttgtaaatacagttttattgaaacatagctattcattttgtttattgtctatggctgctttcgccctaaaacagaaggattaagtagctaggacagagattgagtggcttgcaaaagcctaaagtatttactgtctccctctgtactgaaaaagtttgctgtcctgctctaaatcgttatatgtaaggaataaagttggtttttttgttgtttactttttaattttttgagccaaagtctcactgtggctgggcacggtggctcatgcctgtaatcccggcactttgggaggccgaggcgggtggatcacgatgtcaggagttcgagaccagcctgaccaaactggtgaaaccctgtctctactaaaaatacaaaaattagctgggtgtggtggcgggcgcctgtaatcccagctactcaggaggctgaggcaggagaattgcttgaacccaggaggcggaggttgcagtgtgccgagatcatgccactgcactccagcctgggcaacaaagcaagactccatctcaaaaaaaaaacaaaaacacaaaaaaacaaagtctcactctgttgcacaggctggagtgcagtggcatgatcatagctcactgcagtcttgacctcccaggctcaagctatcttcccacctctgccccctctgagtgccagtgccaccatgcccgaataatttttatactttttgtagagacgaggtctcacgatgtttcccaggccagtctcaaactcctgggctcaaatgatcttccaacctcagcctcccaaagtgttgggattacaggcgtgagccccttatgcccaggctggtgtttattataaagctgcctgatttacaaaaatgtatctataggatctgctgtgatatcttcttttcatgtctgatgctcgtaatttgtatttttttcatcgatattgctagggtcttattaattttattaatattttcaaagaactaatttttctttttgttgattcttttttgaattgtacttgtgctttctttgtcatttatttttgttcttatttttataatttctttcactttttttggatttggtttacttttcttttttctagtttcctgagttggaaacttaagtcattgctttttttcagtctttttctactcaaatatatatatataatgctataatttttttctctaaccatatatttagcactgtcatgtgggatttcatgttgtcttttcattaagttaaaaaaattttataatttccattttgatttctttaattattgggttattatttggcttacttagaagtatattgcttaatttccaaacatttaggaatttattaattatctttctgttactgatttctaatttaattccactgtggtcagcagcacattgtctgtatgattttaatttattaaaatgtataaatatatagtctgtttttgtaagtgtttcatgtgcaattgataaaaagtgtgtattctgcacttgttgctgtagcattctgtaaatatcacttaccagaaattggtcattagagttcttcaaatcttgtaaatccatatggattttcattgtttgcttattctgtcagttactagatgatgaggtatgtctggagatatggagattgtgaatttgtgtatttctcatttttagttttgttagttttcactttatatatcttaaagttatgttattaagtgtatacaaatttagtatcatgaatctcattgtttaatatacttgaaaaaaatcattctgaaaagtgtccctcttttttttctttttggtattgtggtccctctttttccttgttttgggttgggtttgattttgtttttctactctcaaggtggacattttaggttattgatttgagatctctctcttttcttttctttttttttttcttttggacaaggcgttgccctgttgcccaggctagagtgcagtgttgatcattgctcactgcagcttcgaccacatgggctcaggtgattctcttgcctcagcctcccaagtagctaggaccacatacatatgccaccattaaccatctctcctgcttgcccctcccaccccttctacccttcccagcctgtggtccagctgtaattttgtatctgttaataaacatcttcctagtccccattttttctttaccttcctagtatctagtaaccactgttatactctctacttctatgatatcaactttttcagccctatgtatgagaatatgcaatatttgtctttctgtgcttgacttatttcacataacataatgaccttcatttccattcatgttgctgcaaaagacaagattttttttctggcataatagtattccgttgtgtgtacacaccacattttcttttctttctttcttttcttttttttttttgagatggagtcttctctgttgctcaggctggagtgcagtggcgcaatcttggctcactgcaacctctgcctcctgggttcaagcgattcttctgcctcagcctcccaagtagctgggactacaggtgcacgccaccacacctggctaatttttgtatttttagtagagacagggtttcaccatattggccaggctggtctcgaatgcctgacctcgtgatccgcctgccttggcctcccaaagtgctgggattacaggtgtgagccactgcacccagcttataccacattttctttatccatcattcctttgtagatggatagttaggttgattccatatccttgtattgtatatagagctgcaataaacatggaggtacaagatatctctgtcatactaattttatttgtatgtacacccagtagtgggattgctggattatatctagttctattttcagctttttaaggaacttttgtggtgttttttataatggctgtactaatatatgttcccaccaaaagtgtgtaagtgttctcttttctttatatcctcagcagtattttgtttgtttgtttgtttgtttgggtaatagctattctaactgatatgataccttattgtggtttttatttccattttccctgtgattagtgatgttgaacatttttcatatacctgttggccatttatgtgtcgccttttgagaaatgtctactcagagcaattgcctattttaaaattggagtctctttgtgcgtgtgtgtgagagcgtgtttgtgtgtgcatgcgcacatgtgtgctattgagttgtttgagttccttgtgtattatggatattaacctcttataaaatacaataaaatatttgtctagaccaaagtcccaaagcattttctcttatgttttcttctagtagttccatagttccaggaattacatttaagtctttagtccatcttgagttgatttttgtatatggtgagagatcgggatctagtgtcactcttttgcttatggatatccagttttcatggcaccattgattggagagactgtcctttccctaatgtgtgttcttcatgcctttgttaaaaatccattggccataaatatgtgggtttgtttttggttttgttgttctgttctcctggtctgtatgtctgttcttatgcaagtaccatgctgttttgattactatagctttgtagtttattttgaagtcagaaattgtgatgcttgcagatttgttcttttgctcagaattgctttggttattcagagtctagtagccaaatacaaattttatctttgcttgttatgtatctgtaaagaatagcattgataatttaataggaattgcattgaatctgtagatctttttgggtcattttaacaacagtttttccaattcatgaacatgagatgtctttctaatttctttgtgtcttcctcaatttctttcaccagtgtcctgtcatttttttttgtagagatcttttacctccttgattaaatttattctaaggtattttattttttgtagctattcgaaatgggatcactttcttgatttctttttcagctagtttgttatcgttgtatggaaacactactgatttttgtagattttgtatcctgcaactttactgaatttatcagttctaagagtttttttgatagagtctttaggtatttctgcatatgagatcttgtcttctgcaaatagggacagtttgactttttcttttccaattttgatccctgtttcaaaaaatttttttcccttgcttaattactctggctgggacttcagtactatgttgaataagggtggtgaaaatgggcattttgtctttttccagttcttagaggaaaagctttttggcccattcttgcattcctgggataaatcccatttaattatggtgtataatcattttgctgtgctattagatttggtttgctagtattttgttgaggattttgcatctatgttcatcaggcatattgtcttgttttctttttctgttgtttccttgtttggttttgttattagggtaatactggccttgtagaatgagttaggaaggattttctatccttcagttttttggaatagtttgagaagaattggtattctttttcaaaagtttagtggaattcagtagtgaagccattcagtcccaggcttttctttgttgagtgattttattactgattcaatctcattactcggtattggactgttcaggttttctgtttcttcttggttcaattttggtagattatatgtgtccgggaatttatttgtgttctctaggtatactaatttattggtgaatacttgttcataatggtcactaacgatcctttgtatttctgtggtttggtctctttttttcttagtctgtgtaatagtttgctgattttgtttatcttttcaaaaaaccagcttttcattttgttgatcctttgtattgtttggtctctatttcatttattttgttctgatcctcataatatctttccttctactaattttgtgtttgttttgttcttgcttttctaggtccttgacatgcattgttaggttgtttatttgaaatctttcaacttcttgatacaactgtttaatgctaaaaactgtttgtactgtttttgctatattccgtaggatttgctatgttgtatttctattttcatttgtttcaagaaattttaaaatttcttgtttaattttttattgatccattggttgttcaagaacatgctgtttaattttcgtgtatttgtacagtttccaaagtgtacttgttactgatttttagttttattctattgtggttagaaaagaaacttgatatgacttggacttttaaaatttttggagaatttttttgtgtgctaatggcaagaatgtatcccgcagctgttgttctgtaaatatctgttaggtctatttggtctaaagtgcaattgaaatttgatatttttggctgattttctgccagcgatctgttcaatgctatgagtggggtgttcaagtccccaactattattgtaatggagtctatctctctctttagatctaataatatttgctttatctatctgagtgttctagtagtgagtgtgtatatatttatagttgttatagatgcttgccaaattgacttcattattattatatgatgaccttctttgtctccttatatagtttgtgacttaaagtgtattttttctgatataaggataactactcctattcatttttggtggaacttttttcattttttcattttaagtttatgtgtatgtttacagaagtgagtttcttataggcagcatatagttgggtcttgttttatttattttttttttcccccgctccgagacggagtctcactctgtcacccaggctggagtgcagcggtgcaatcttggctcactgcaaactctgcctcccaggttcaagtgattctcccgcctcagcctcctaaattgctgggattacaggcacccaacatcatgcccagctaatttttgtatttttatggagatggggtttcaccacgttggccaggctggtcttaaaactcctgatctcaggtgatctacctgcctcggcctcccaaaatgctgggagtacatgtgtgagccactgtggccagccaggtcttggttttggtaatccattcatccagtttatagcttttaattgaggattatagtttttaatttggggtttttatttgtttacattcaaggttattattgataggtgaggaatttctgttgtcattttgctaattgcctttttttttttaaatatatatccattcttccttccttactttcctattgtttatctttgcagtttggtggtttctgtggtgataagttttacttctctttctcatttgtgaatctgcttcatcagtgagattgacacttcttcatgttttcatgatggtagttatagtctgttcgctttcagttctaggattcccttaatcatttcttctacatctagtctagtggtgataaattacctcattttttgcttctctgggagattttagttttccttcatttctgaagggtagttttactagatatggtaatcttggctcacagtttgttttctttcatcattttgaatatggcatcccattgtctcttggcctatgtttctgctgagaaatctgctgttagttttttttatttttttatttttttattttttatttttatttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttaagattagggagtggtgatgactcttaacaaagcacatcttgcaccgcccttaatccatttaaccctgagtggacacagcacatgtttcagagagcacagggttgggggtaagatcacagatcaacaggatcccaaggcagaagaatttttcttagtacagaacaaaatgaaaagtctcccatgtctacttctctccacacagacccggcaaccatccgatttctcaatcttttccccacccttcccgcctttctattccacaaaaccgccattgtcatcatgacccatccccaatgagccgctgggcacacctcccagacggggtcgtggccgggcagaggggctcctcacttcccagtaggggcagccgggcagaggtgcccctcacctcccggacggggcggctggccgggcagggggctgacccccccacctccctcccggatggggcggctggccgggcggggggctgaccccccccacctccctcccggacggggcggctggcggggcagaggggctcctcacttcccagtaggggcggctgggcagaggagcccctcacctcctggatggggcggctggccgggcggggggctgacccccccccccacctccctcccggacggggcggctggccgggcagggggctgacccccctcccccctcccggacggggcagctggccgggcggggggctgaccccccccacctccctcccggacggggtggctggccaggtggggggctgacccccccacctccctcccggacggggcggctggccgggtggggggctgacccccccacctccctcctggacggggcaactggccgggcagaggggctcctcacttcccagtaggggcggccgggcagaggagcccctcacctcccagatggggcggctggccgggcggggggctgaccccttaagttagcgcttatgggggctgaccccccccacctccctcccggacggggtggctgccgggcggagacgctcctcacttcccagacggggtggctgccggacggaggggctcctcacttctcagacggggcggctgccgggcggaggggctcctcacttctcagacggggtggttgccaggcagagggtttcctcacttctcagacggggcggccgggcagagacgctcctcacctcccagacagggttgcggccgggcagaggcgctcctcacatcccagacagggcggcggggcagaggtgctccccacatctcagacgatgggcggccgggcagaaacgctcctcacttcctagatgggatggcggcggggaagaggcgctcctcgcttcctagatgggatggcggccgggcagagacgctcctcactttccagactgggcagccaggcagagggctcctcacatcccagacgatgggcggccaggcagagacgctcctcacttcccagacggggtggcggccgggcagaggctgcaatctcggctctttgggaggccaaggcaggcggctgggaggtggttgtagcgagccgagatcacgccactgcactccagcctgggcaccattgagcactgagtgaacgagactccgtctgcaatcccggcaccttgggaggccgaggctggtggatcactcgcggttaggagctggagaccagcccggccaacacagcaaaaccctgtctccaccaaaaaaaaaaacgaaaaccagtcaggtgtggcggcgcgcgcctgcaatcgcaggcactcggcaggctgaggcaggagaatcaggcagggattttgcagtgagccgagatggcagcagtacagtccagctttggctcggcatcagagggagaccgtggaaggagaccgtggaaagagggagagggagagggagagggagacggagagggagagggagagggagagggagagggctgttagttttatggagagtccctggtatgttacttcacacttttcctatttttaaaattctctttgtgtttgaattttgacagtttcactataatgttcatcttttctcagtttgactataatgtatcctgagaggacctttttgggttgagtctatttgggaaactttgagcttcctggacctggatgtttatatttcttccgtgacttgagatgttttcagcaattatttatttaaataggttttatatgctttgtctgttctcttcttctggatctccaaaaatacatgcttttttttttttttttttttacttaatagtatcccataggccctgtaggcgttcttctcattctttttaattatctgttttttttgtttttttttttcggctaacctgggtacagcaggacctcaaaataatgttcagcgttgtttagttataatgttgctgagacaaaaatgatttctggttaggacctctgtctttatggagtttgcttgttctccccatgtctgcatgggttttctccggatactctggtttccttctgcttcccaaagatgtgaatgtttggttaactggtatgtctaaattgtcccagtatgagtgagtgagtgtgtgtgtgtgtgtgtgtgtgtgtgtgtaccatgatgtaatggtgtcctgtccagaactggtttccactttttaccctgagtgtctggataggcttcagccacctgtgacactgaactggaataagcaggttggaaaatgaatgatcacgttactataaaataaaaatgcgtaaagtatatgataatcatacaaatgcacaatatattatgcgttcagaaagcactcagtgatctcaccatattcattgtttttttaactgtgtggcattagaggatgctcgttttcactttgcaaacatttatttcatgatttcattcataaccattgtgacttctgtcattcgccaattcataaatttggtaaatatttattaatcttaattttattaatttagtagtgtactaatttgatactaatttaataatttcattaatctttcttaaatgtacatataacctacatctatttcagtatttgatattagaagtggtttgactctttacaatattggtgatgtttttgtgactagacgtaggctgtaggaacttttgtttatatcagttagcctaggtaaaattagttttgttacatgttgtttcatttaaatcacagtttccaagaacccactgatgatgtcaggtgaagatttcctgtatttcaaaagacttatgttcaagttcacaaattcttctgcttgatctagtgtattgccgaagctttcaattgtattttttaattttattcactgacttcttcaatgccaagatttctgtttggttcttttttatggcatatatctgttcgttgaatttctcattcagatcatgaattgtttttctgattttgttgaattaactatctgtattcttttgtatttcactgagtttccttaagaaattactgtgaattcttttcaggtattttataggtttgtcttccttggggtatgttattagagaattactgtattcctttgaggtgtcatgtttccatgccttttcgtgtttcttgtgtccctagcttgatatctgtttatctagaggaacaaccacctcttccaattttatgaagtagttttcgtaggaaaaaactttttcctgtagatttgacttacagtactggttgagtagggtgtttaggcttttttcctcattgggtgcagtagtgtaatttctatgtgatttcttcacccgtcatcaatatcagcattttctgtgagtgcctcagtgggctagattgtgggtgtttgtggaggcagtggtgtggctttgcttggggtgaggaatgctaggcaggctggtccttagtccctgagaaatggctgctatttctcagctgccattttctgattacagtgtccaagggatgtagagatgccagggctattgagccccaaggcagaatgcactccagcagttgcttcattctccaaatgatatagtactgcagcaacttggatcctgaggaattcagtggatcaaatgcgaattctctctttggagcaatccagccttatggacctcaggtagctccctatactggactcagggcttgtgaggactgtggaactgccctgtagcttggattgcaagtatccacagtggtcatggggactgctgaggatgtcttgcttaacttttctcgtcaatagggagtcccttctggctccaggctgatcttggccaggtgctctcctttcccctttatgctgacatgtggagtttctgtacctcagaagatcttcattacttcctgatgagttccattgttctcccatagacactaaactcaaactgctctatttgttgttttggtttttctttgtggaggagatgaacattgggtaccattttgattgaagtttttaatctgttcacttctaatttttattcatatgattggatttacatttatcattttgctattattttctgtgtgcctcatgtcttttttgttcctctgatatttattaatttcttttgtaataaattgatatttttgatgttctattttaattcctttattgattttcaaattgcttttgaattactttctttctttcttttctttttttttttttttgagacagagtctcgctctgttacccaggctggagtgcagtggcgcgatctcaactcactgtaagctccgcctcccgggttcacgccattctcctgcctcagcctcccgagtagctggaactataggtgctcaccaccatgtcgggctatttttgttttttttttttgtatttttagtggagacagggttttacgatgttagccaggatggtctcgatctcctgacctcgtgatccacctgcctcagcctcccaaagtgctgagattacaggtgtgagccactgcgcctggcccgaattattttctttgtgattgcttgggggattataatatgcatctgatttactgcaaactagttgagattattgataactttattccattaaaatagagaacatttctctactatagctccattttcttctgctgcttgtgctgttattgtcacatatattgcatcttgttaaaagttcaactatacaattttatcattattgttttatgcaatttccttttaaaccagaagaacaaaggagaaaaaagcatttatactgtcctttactagtcaccaacataattacctgtatcgttttgttgtgtgaatttgttgtgtgaagtagctgttgctacttcctttcagcctaatgaacttcctttaatattctgctaggaatcaattatcttattctttatttgagtatattttaatttgcttgcattattgaaggataattttgctggatatagaattcttggagaaattaggtgttaatctactaaaagtttccttgtacctgaaaaattatttttgtctttctgctctcaatatctatatattttttgtccctggctttctgcagtttgactatgatatatttggatttgaattcactgattcttttgccaattcaaatctgctgctgagcccttctagtgaattttttattttgttgattgtactttcaactccaaaattttcattttttttgtaatttgtttttattgacattttctaattgatgaatcactgttgtcatatgtttctttaattatttgaatatgaggctgggtgcggtggctcacacctgtctgtaatcccagcactttgggaggctgaggtgggtggatcacttgaggtcaggagttcaagaccagcctgaccatcatggtgaaaccgcatctctactaaaaatacaaaaattagctgggtgtggtggtgggtgcctgtaatctcagctattcgggaggctgaggcaggaaaatcatttgaacccgggaggcagaggttgcagtgagccaagatcatgccattgcactccagcctgggtgacagggtgagactccatctcaaaaaaaaaaattatttgtatatggtttcccttatttctttgaacatatttggaattgatgttttgaagtctttgtgtaccaagtcctgtatttgatctccttcacagatagtttgtttctattgactatttttatttctgtacactttgcatgtgtcatagttgtttgttgtaaattggacattttgtgtaatatattgcagcagctttggattttgatttcttctcccccaggagatggttgttgtttcaggattatttgtttattgacttgcctcgactaattttgtgatgtctgtttcgtgtgccttctgatttctctgctcattaaaacaaattctcttttctatttttaagcctggcattctaggaatttcgctgggttactataacttagtcatcagccagtgattgtttggaggttgtttaaacctttgagctagttaggtatttactctttggcatgggatatatacatttattgggtaatactttcaaagtcaggagattataagtctgttttttttttttttaaattctctatgttcatgaggcctcatggttaactcgaaatgagtagcttgctagttactgccctctctttgtggttgcttaggggattatatctgtgtatctggtggaacaacagatatacagtcttctgagtaagtactatcttgcacatgcatacaactttctagactaccagtaatatatatgtgagaccctggcaagaccctgttgggctatatcattttccagatttctctgttaatttttgggctggtttgctgttttgttgcctgacccaaattgtattgtgaccctatgctagccttactcttattgctgctgagctgtctgttgtttttgacaactttgtcctgttttgtcattgctttttggggagaggatttgccgagctcctcattcagcactcttgaagtcttgtcgcatgcgcgcgcgtgtgtgtgtgttcctgtagtaacaaacatgtgacataaaatttgtcattgagactgggcatggtagctcgtgcctgcaatcccagcactttgagaggctgagatgggaggctagcttgaagcccaggagttgaagacaagactgggcaacatagtgagactcatctgtgccaaaaattaaaaaaattggttgggcgtggtgacgtgcatataatcctagctacttggcatgctgaggtgggagagcccaggagtttgaggtttcagtgagctgattgtgccactgcactccagcctgggtgacagagttagaccttgtttcttaaagagaaatgaccatcttaagcacttttaagtgtatactatattactattaattatatgcacatccttgtgtagcagatcttcagaacttttttgtcttgtaaaactgaaactctctatctattgaaccaatgactccctttttacctttcccctgccccagcccttgacaaccaccagtctactttctaagagtctgacaatgttagataccttatatatgtggaatcatacagtatttatcttttcgtaactggcttattttatttaccataatgtcctcatgtttcatccatgttgtggtatattatgggattggcttatttttttaaggctgaataatatcccattgtatgtgtgtattacattttgcttatccattcatcctaaaatgagtattagagttgcttttactttacagctattgtgattaatgctgctttgaacatgggtgtgtgaatatctccttaagattttcttttaaattattttgggtatatacccagaattggggtttctggatcattgtaattctgtttttgatttgttgaggaacctccatattatgttctgtagcagttgtaccattttatgtttccactaagagtgtataagtattccattttctcaacacttactatgtttttgataatggccattgttatggctgagagatatctcattgtggtttttttatttgtatttccctaatgagtagttatgctgagcttcttttcatatacttattggccatttgtatatcttttttgtggacatggcttcaattcctttgtccattttaaaatagaattattgttattttgttgttgattagtcataggacttgtttatatattctagatattagtaccttatcagatagatggtttgcaaatatttttgtccatttcataggttgtcttttttactctttttcctttgttgtgcagaagttttaaaatttgatgtctcatttttctatttttgcttttgttgcctgttatgttcattttaaaagtatcccttttctctgttattttataataccttacctagaattagatttttgagatatattcaactctgttctgaaattctttgctactaatatcctttgcattatcatagatgttctgattttagggatgcattttacatgatgtattaactaaaagttatacataaataaagtatttttaagttgtagacatatatttcaagaagggaaaagaatgaaaagaaaattccttttttggttatcttaaggaagatccatttgttataacaatcatcatttgtgtttcaccttttactatatatgtatgttgtttatttttccttcctctgtgattttgaaattgaaactatcttgcttatagtcagatcatatggctcaaaattccatgttctaatccagaaagccacctcttgtgttactgtttggttagtagcattctgatgatactaagttcttgagtttgattcaggtgtctttaaacatttgtactctgagaactctgagacaatctgatttatgcccttagactgcaactttggtagccattttgcaaatatatcattgttacacaaggcgtagggtggtagaggtggaattgtaatgtgctcattgtccagttagatagataaatagccagtggaaacattttcagtgctgataatggaagtatagaggcagtattatagtggttaattgccatggctgtggaataatatttcttaattttgagtccaggctctcctagatgactcgttttgggaagattcctgacccttcatgtctcagattcttcattgtaaaatggggataatgctatttacattttgtgattcttaggaggagtaaatgattgtatacgagtaaggtgcttagaatagcgcctggtacatactcagtgcttattgcttttgttacaggcactgatcaatatataatcttgtgctagctgaacaatgcttgaagaaattaatgcattttaaaaatactgtgataatgacaaatatctaaaaattgtaacattccattagcatagagtactaacaatagacttaatagctgacctttaaaaaaaaaccctctggttgaagaaacaaattaggcccacacttttgtaataataataataataataagcacctttataatgatttctctgtgaggaaggtagtattctaagctttatatagattaatataatattcaaaatgtagtctttttatacaaattttacagataatgaaactgaggcacagatacaataaactgtctgctggctgcagagttattggtcttaatcactttgctatactgtctgtatttaggcatattgttactgtgttgctgaaccaactaggtagactaaaatgtgaatgaataagcttaatatttttattaactttcacaaatagagttacaataactaaaaatgtgatagaaatacatttttttcttcctcctttgttgatttgtaaacaaattatatctagaagtgagacaaatgagcataaagcaattttggtgacatttttcatgcctaaccttttatctaatgataatgaaaagcagtcagaaaacatttaaaatttatgaccaagtagtatccagttcaattttacattaggtgaagtggaatactttttttttttttttttaagttgatcagttttcattttgtcaggttattttcaaatctccaattgagctcccctttcaacttgacttagaatactgttctattagtttaaaatatattttgaagacatatttttagatggagacttaaaaaattacatcatttcagttatttgaagtactgctgctatatactgttgcactatcatatatcagccttcatcatgtactgagtattatatattatttccattcagcaaagtaggagacaggcctagagtgcttaaggaacttattaaatgtaacttgtaccataaattattgttatttatcattaactatggcctaacaaggtatttgatgctactttttgataaacagtaattctgaaaatatttttgtgttggacattttatttctcttttaagaaaggaatttgtatattagaatgaaaaatattaagcactaaacaataagtctctgaatattcttgtgttggaaattttattttttaaaaaagaaatttgcatattataataaaaaatattaagcacttactaatttttatgtaatgttttgtgttttaaggaactgaaattaccattcacttttttaagtggacatattcatgaattgaggattcatgtaccatggacaaaactgggttcagaaccagtggtaattaccatcaatactatggaatgcattttgaaacttaaggatgggatacaggtaagaaattattgaaccaagttgtttatgttaactaattttagtagtatttgacatttctttaccttttcaaatatgccaactgttacataaacatatcttagcttatatacttttttttttttttttttttttttttgagatagagtcttgctctgttgccaggctggagtgcagtggtgcgatctcggctcactgcaacctcctcctcctgggttcaagtgattttcctgcctcagcctcctgagtagctgggactacaggtgtgcgccaccacgcccagctaatttttatatttttagtagagaaggggtttcactatgttggccaggatggtcttgatctcttgacctcgtgatctgcccaccttggcctcccaaagtactgggattataggcatgagccactgtgcctggcctttaatttgtatatgcctgtttaagtgacatgactatttgcaaagtcatttttaaatttgaataaagtatgtaaaggttgttttcatacagattttactttgtcatagctctactagggaccatgcagattgcttattacttacatctacaatgaaagtgcagcctaattgtgtccgatttttacattaacatttttagatttttgcaaaggacctgtatgtattttttctttacataatttttctaaatctgaagggaatttctcaggttattttttgggaagatgaaaatatatttacaccaaattttataattgtttttgaagttttggtataagaaactgattttttcttttttcagatttatttatttcttctctgacccatcttacatttcttgctagtgtttttttgcagatgtaatattggttttaaagagtttctaccaaaaattttccaatctaggaaagcaaaataggtcaggaccatagcttattgtggagaatgtttccactttcaccttgcagaagagtagtgtgtctgtcattcatttttattaggtttttttttttttttagcacccacttaatatttaacttttagttttaaggaagattggctataatcaagtaaattgataagtattattaaaatgacttcatatgaatctgtaagtttaacgtattctaaatgtaactttaatctttgtgaagttagggttatgtatgaactgttaaaattatttcctattttaagtggatgctttgagtgccatatcaacccagtggactcagatcttttttccatttatgaaatctttgattccaaacacgtattatccaatttaacttaatatagtttctagaagttaatagaccaatgttatattctcatgaaaatgaaaagttactttgtgaacttctaatatttgagagattaatttagaaatctgtggatagttacattacaacaaagttttactttccatttatagttggtaatacttaaatgttaagtggttcttaattattatcttttcttggaatttattttttttcaaagtctggacttggttataccacccatgcagtgttccatattaaaagagaaaaaaaaaatccagacacttaagtacttttttcattgagaaggtagaagtttcaaggccagatgtcccttaagaaacatgttttaacagaggcaaattacaactaattatagaggctgcagaaaaagacttgtaacacatgacttagtgcaacctagaactaatacttgatattggactatgcagatggctactgcaggaatgatcagatttcctgcttgcatggtatttgggacttgaattttgtggtttgtacagcaaaaggttaaatgtcatgaatgtaaaccactctcaaaacaagtattttttacagatgtttaaaattttgggttagaaaggatttttgaaaattgcagttgacatttggacaaattatttagcagtgtacacctctggagagtaatgcttgggtttatgctagtgattggaattaaattttgcgtaaaaacattgtagatgaaacagattttaaaatagtttattttcctgttttaagctttgattagtatagtatgtaattaagcaggtactagtaaaactgaattagtttatattcaaagtatttcaagttattacattgtagaatcaccacgaagaaaagacgtattttctaaataaaattgtggttggaatggtaggttcagtgaaggggccttttagagttacaggtactcaaagatatgaatctgttaaaaaaaactattatgcataggaatgtattgaagtatgattaaaaggtaggaatatgaggcttaaatcagataagatcattccaaaaataagattttgttaaatgccttgataagaaggcatgtcttgtttgtgaaggtcaatttaattctaccaacatttgttggttgtctactctgtactgcactgaaaagcattgctaaaatatttatataatctcagcaaaagacacttagaaaaagagattcataatgattgtgattctagtggtcatggttttaatatactgccttaacatatccttacaatcagttttacttatagagatttttaggatgacagggtgaccgaattgttgtgttaggtaaaataaagtccatcttgatgtttactctgaattttaaaaaatatattgaaacttcactcatgaaatagttgttaatgatttcctattcactctgagagatgtatctatgtcagtcattgccctcacttttaaatcttgcagagttactacttgtaaactgtttatcctgtttttgatttcagatacacagtttttgattcatgacacatcatgtccatgctaatctaataaatacttgttaacataactcaagagctaaaacattatcagtaacttccatttaactatgtgctcctctcctttttcatattcttttttgttcagcctctaggggcctcatctgtaaaacaggacaagacttgctatacaatttaaaaaattatatgattgatgtgctttctttgatcattgaattaagtcttggctgggcatggtggctcacgcctgtaatcccagcactttgggaggccgaggcgggtggatcacgaggtcaggagatagagaccaccctggctaacagggtgaaaacccgtccttactaaaaatacaaaaaattagctgggcgtggtggccggcgcctgtagtcccagctactcgggaggctgaggcaggagaatggcatgaacccgcgaggtggagtttgcagtgatccgagattgtgccactgcactccagcctgggcgacagagcgagactctgtctccaaaaaaaaaaaaaaaacttcttcaacctaaagagagtaataaatctgtttctaaaccacctattctggtttttgtaccacctggaacataaatgttaaatcttttcatctaataaatgtaactatttgtaaggctgtttatagaagtaatacttatttttcttaaaaaatttgaaaagtgggaggctgaggcaggagaattgcttgaacccaggaggcggaggttgtggtgtgcagaggccgcgccattgcactccagcctgggcaacaagagtgaaactccatctcaaaaaaaaaaaaaatttgaaaatcatcttttgaacctaaaaatctgagattatcttctaataggagaaatacttgtagtttcactccagattaaacttatttttatgtatatattcttaccatctttctcctttttagcttaacttcttttaaaatcatttttgcaagtttcattttatttctttactgtcattaaccttttaccacctttctcctttttagcttaattttctttaaaatcatttttgcaagtttaattttatttctttactgtcataaccttctaattgttgatatggctctttaagattacaaaaatattctgtttgaaaacctaaggtgattttatccttttatctcatgtacctacaggtttagctagattttaaacaagaaagtgaaaatatttgtatatgtagtattttaaattcagagatagttttctgtttcccataagcacggattcctttcttaaacattttaagtcagataccagtaagccactttttgtttgttttgtttctgtttttgatactgcgtcttgctgtgttgcccaggctggtctcgaactcctggcctcaagtgaccctcctgccttggcctcccaaattgctggaattacaatcaagagccactgatttccagtattaataagaaaaaaattttggtcctgacagcccatagatttaggtgacctgatcaaaaagtgatatgttattactcttgactgtggcattttatgtcaactctttttatagtttcatcttgtactttatttttgtttttctacaaagtctgtgtcagtgtaattagacttaaagatctgaggcagctgttttgatttgaatgtctaattctgatgaagggcttcagaattattttttccactgtagagcagggaaataaagctttctttgattggacaccagcacctatctgctctatctagcagaacttttctgggatctagagaatttccatactttcacaggacgaagtttttttttgttttttgttttttttaattttgtttacatttagataggattttttatttactggatggtcatttgatctggccatcaatgtgctctgtttaccatcagggatttgatggatttacttgtagaaattttacatgtgatcattggaattttaagtgtggattattatgaattagtacagttgttttggtagactattaataatcagtctctattaattgattttaaaaatcaattagttagaatttgagattaggaggcctacaagagaggtatcacctctctcttagcttggctgaagtctgtgtttatcgtcactgttattggtgaggtcattgcttgaatgttataataaatggccttctaattggactgactctagaccattactcttctacacacactcacaaatatctcttatttttttgaagctcatgtgacctgactatataatcatttgtggtcctctgatagctatcatccattgattttgtggtccctcccccactgtgactgaaaattttgttacctggttcacagacttttttttttccaattgaagttcatccatcttgggtcatttcagtgtccatatggattcttacataactctctagcaacacaattccttgatttttaactctgtcatccttatttctgttccatttcagccaatccctttatggttatgttgtggagtttgctgttccttgaagcattctctttattgtggatcctgtctctgtatcttaagtatctcactttaacagtattccttcacttcaatctctcatttgatttattggcactttgctatcatttaaagtgcttatttctctgctacattttggggaaatactttcctgcaaccatgtttccctctctagcttcttttcttttctttataaccacatcatttctttttttttttctttctttcttttttttttttttttttgagacggagtctgctctgttgcccaggctggagtgcaggggcgcgatctcggctcactgcaagctctgcctcccgggttcacgccattctcctgcctcagcctctggggtagctggggctacaggcgcccaccacctcaaccagctaattttttgtatttttagtagagacggggtttcaccatgttagccaggatggtctctatctcctgaccttgtgatccgcccacctcagcctccgaaagtgctgagattacaggcttgagccaccgcgcccggcctctttttttcttttttaaaataagtcaatgtttgtgtgtgtgtgtgtgtttttttaattgaaacgaaattcacataacatacaatcaaccattttatttttgtttatttatcttttaaatttttttatttctataggttattggggaacaggtggtgtttggttacatgagtaaattctctagtggtaattcgttagattttggtgctcccatcacacaagcagtatacgctgtaccgaatttgtgtcttttatcccttacctctttcccccaagtccccaaagtccattgtgtcattcttattcctttgcatcctcatagcttagcttccacatatcagtgaggacatatgatatttggttttctattcctgagttacttcacttagaatgatagtctccaatctcctccaggtcactacaaatgccattaattcattcttttttattgctgagtagtattccattttatacacacacacacacacacacacacacacacacacacacacacacaccaccccccgcccccacggtttctttatccgctcgtcgattgacaggcatttaggttggttccacatttttgcaattgtgaattgttttgctataaacatgtgtgtgctttaaacccatgtgtgcaagtatcttttttgtataatgacttcttttccactgcgtagatacccagtagtgggattgctggatcaaacggtagttctgtttagttctttaaggaatctccacaccattttctatagtggttgtactagtttacattcccaccagcagtgtagaagtgttcctggtttactggagccatgccaatatctattattttttgatgttttgattatggctattcttgcaggagtaagttggtatcacattgtagttttgatttgcgtttccctgattattagtgatgtgaacattttttcatatgtttgttggccatttgtgtatcttcttctgagaattgtctgttcatgtccttagcccactttctgatgggattgttttttttttcttgctaatttgcttgtgttcgttgtagattctggatattagtccgttgtcagatgtatagattgtgaagattttctccgactctgtggattgtctgtttactctgctgactgttccttttgccgtgcaaaagctctttagtttaattaagtcccagctatttgtttttattgcatttgcttttggggtcttggtcataaaatcctcgcctaagccaatgtctagagggcttttctggtgttatcttctagaatttttatagtttcaggtcttagatttaagtccttgatccatcttgagttgatttttgtataaggtgagagataaggatccagtttcattctcctacatgtggcttgccaattatcccagcaccatttgttggatagggtgtcctttccccactttatgtgtttgtttgctttgtcaaagatcagttggctgtaagtatttgggcttatttctgggttctctattctgtttcattggtctatgtgcctatttttataccagtaccatgctgttttggtgactatggccttatcatattgcttgaaatcaggtaatgtgatacctccagattttttctttttgcttagtcttgctttggctaggcagactcattttttggtttcctacgaattttaggatttttttctagttctgtgaaggatgatggtggcatttttatgggaattgtattgaatttgtagattgcttttggcagtatggtcattttcacaatattgattctacccatccatgagcatgagatgtgtttccatttgtgtcatctatgatttcttccagcagtgtttgtagttttccttgtagaggtctttcacctccttggttaggtatattcctaagtattttattttatttttgcagctaatgtaaaaggggttgagttcttgatttgattctcagcttggttgctgttggtatatagaagagctactgatttgtgtacattaattttgtatccataaactttgttgaatttttttttttatcagttctaggaggtttttggaggagtcttgatagggttttctaggtaaacaatgatatcatcaacaaacagtgacagtttgacttcctcttggccgatttggatgccctttatttctttctcttatctgattgctctgggtaggacttccagtactgtttaagaggagtggtaagagtgggcctccttgtcttgtcttccctaaaagaatgctttcaacttttccccatttagtattacgttggctgtgggtttgtcatagatggcatttattacattgaggtatgttacttgtatgccaattttcctgagagttttaatcataaaaggatgccatattttttttgaatgctttttctgtgtctaatttttgtttaaattctgtttatgtggtttagcacatttattgactcgtgtgtgttaaaccatccctgcatctctggtatgaaacccacttgatcatgggtggattatctttttgatatattgttggattcagttagctagtattttgttaaggattttagcatctatgttcatcagggatattggcatgtagttttcttttttgttatgtcctttcctggttttggtattagggtgatatcggtttcatagaatgatttagggaggattccctctttctctatcatgtggaatactgtcaataggattggtaccaatccccctttgaatgtctggtagaatttagctgtgaatgcatatggtcctggacttttttttgttggtaattttttttattactatttcagtcttgctgcttgttactggtctgtccagggtatcaaattcttcctgatttaagctaggaaggttttatcttttcagggatttatccatctcctctaggttttctagtttgtgcatgtaaaggtgttcacagtagctttcaatgatcctttgtatttctgtcttgtccgttgtaatatttcccgtttcgtttctaattgagcttatttggattttctctcttcttttttggttaatgttgctaatggtctatctgttttacctacctttttaaagaaccagctttttgtttcatttatcttttgtattgttttttgtttcagtttaatttatttctgcactgatcttggttatttcctttcttctgctggctttgggtttggtttgttctcgttctctagctccttgaggtgtgactttagatcatctggttgtgttctttcagactttttgaggtaggcatttagggctatgaactttctttctttccttttcttttttttatttttgagatgaagtcttgctttgtcacccaggttggagtgcagtggtgcgatcttggctcactgcaacctgctcctgtggggttcaagcagtttttgtgcctcaccctcccaagtagctgggactacaggcacctgccaccatgcatgactaatttttgtatttttagtagagacgtggtttcatcatttttgccaggctggtcttgaactcctgacctcagtgtatccacccaccttggcatcccaaagtgctgggattacaggtgtgagccactgtgctctgctctatgaactttcctcttagcaccacctgagctgtatcccagaggttttgataggtcgtgtcacaattgtcattcagttcgaagaaatttttaatttccatattgatattattgttgacccaatgatcactcagaaacagtttacttaatttgcatgtatttgcatggttttgaaggttccttttggagttgatttccagttttattccactgtggtctgagagagtgcttgatataatttcaattttcttaaatttattgaggcttgttctgtggcctctcatatggactatcttggagaaagtttcatgcactgaggaatagaatgaatattctgcagttgttggatagaatgttctgtaaatatctgttaagtccatttgctccagggtatagtttaaatccattgtttctttgttgactttctgtcgtgataacctgtctagtgctgtcagtggagtattgaagtcccccactgttattgtgttgctgtctatcttgtttcttagatctggtagtaattgttttataaatttgggagctctaggctgggtgaggttgctcatgcctgtaatcccagcactttgggaggccgagacgggcggattaccagtggtcgggagtttgagaccagcctggccaacatggtgaaaccccttctctgctaaaaatacaaaaattagctgggtgtggtagcgagcgcctgtaatcccagccactcagggggctgaggcaggagaatcagttgaacctgggaggcggaggttgctgtgagccaagatcaagccactgcactccaggttgggtgacagagcaaaactctgtctcaaaaaaaaaaaagaaaatttgggagctccagtgttaagtgcatatgtatttaggattctgatattttactgttggacatagccttttatcattatataatgtccctctttgtcttttttaactgctgttgcttcaaagtttattttgtctgatataaggatagatactgccttttgcttttggtgtacatttgcatagaatgtctttccacccctttaccttaagtttatgtgagtccttatgtggtaggtgagtctcttgaaggcagctgatggttggtgaattctatccattctgcaattctttatcttttaagtggtgcttttaggccatttacattcaacattagtattgagatgtgagataccattccatttatagtgctatttgttgcctgtatacctttttttttttcaaattgtatttttgttttataggtcctgtgagatttatgctttaaagaggctctgttttgatatgtttccaggatttgtttcaagagtcagctccccttttagcagttcttgtagtgctggcttggtagtggcaaattatctcagtatttatttgtctgaaaaagactctatctttccttcatttatgaagcttagttttgctggatacaaaattcttggcagataattgctttgtttaaggaggctgaagatagggccccaatcccttctagcttgtagggtttctgctgagaaatcagctgttaattcaataggttttttttttttctttaataggttaccttgtgcttttgcctcacagctcttaagattcttttctttgtcttaactgtagataacctgatgacagtgtgcctaggcgatgatctttttgtgatgaatttcacaggtgttctttgagcttcttgtctttggatgtctaggtttctagccaggctgggcaagttttccttgattattccccctaacatgttttccaacttttagatttctcttcttcctcaggaatgccaattattcttaggtttggtcatttaacataatcccagacttcttggaggctttgttcatattttcttattctttttcctttgtctttgttggattgggttaatttgaacaccttgtctttgagctctgaagttctttcttctgcttgtttgattctgttgctgagactttctggagcattttgcctttccttcttttatttttttttaacttttgtatttttatttttttatttatcttttttaaattatactttgagttttagggtacacgtgcacaacgtgcaggttagttacgtatgtatacacgggccatgttggtgtgctgcacccattaactcgtaatttaacattaggtatatctcctaatgctatcgctcccccctccccccaccacacaacaggccctgctgtgtgatgttccccttcctgtgtctatgtgtgctcattgttcaattcccacctataagtgagaacatgcagtgtttggttttttgtccttgagatagtttgctgagaatgatggtttccagcttcatccatgtccctacaaaggacatgaactcatccttttttatgggagcatagtattcaatcgtgtatatgtgccacattttcttaatccagtctatcattgttggacatgtgggttggttccaagtctttgatattgtgaatagtgcctcaataaacatacgtgtgcatgtgtctttatagcagcatgatttataatactttgggcatataccaagtaatggatggctgggtcaaatggtatttctagttctagatccctgaggaatcgccacactgacttctacagtggttgaactagtttacagtcccaccaacagtgtaaaagtgttcctgtttctccacatcctctccagcacctgttgtttcctgactttttaatgagtgccattctaactggtgtgagatggtatctcactgtggttttgatttgcatttctctgatggccagtgatgatgagcaagttttcatgtgtcttttggctgcattaatgtcttcttttgagaagtgtctgttcatatgctttgcccactttttgatggggttgtttttttcttgtatatttgtttgagttcattgtagattctggatattagccctttgtcagatgagtagattgcaaaatttttttcccattctgtaggttgtctgttcactctgatggtagtttcttttgctgtgcagaagctctttagtttaattagatcccatttgtccattttggcttttgttgccattgcttttggtgttttagacatgaagtccgtgcccatgcctatgtcctgaatggtattgcctaggttttcttctagggtttttatggttttaggtctaacatttaagtctttaatcatcttgaattaatttttgtataaggtgtaaggaagggatccagtttcagctttctacatatggctagccagttttcccagcaccatttattaaatagggaatcgtttccccatttctggtttttgtcaggtctgtcaaaggtcagatgattgtagatatgcggcattatttctgagggctctgttctgttccattggtctgtatctctgttttggtaccagtaccatgctgttttggttactgtagccttgtagtatagtttgaagtcaggtagcatgatgcctccagctttgttcttttggcttaggattgacttggcagtgcaggctcttttttggttccatatgaactttaaagtagttttttccaattctgtgaagaaagtcatcagtagcttgatgggaatggcattgaatctataaattaccttgggcaatatggccattttcacgatattggttcttcctacccatgagcatgcaatgttcttccatttgtttgtatcctcttttatttcattgagcagtggtttatagttctccttgaagaggtccttcacatcccttgtaagttggattcctaggtatttcattctctttgaagcaattgtgaatgggagttcactcattatttgtctttctgtttgtctgttactggtgtataagaatgcttgtgatttttgcacattgattttgtatcctgagactttgctgaagtcgcctatcagcttaaggagattttgggatgagatgatggggttttctcgatatacaatcatgtcatccacaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcaatatgatgttggctgtgggtttgtcatagatagctcttattattttgagatatgtcccatcgatacataatttattgagagtttttagcatgaagcgttgttgaattttgtcaaaggccttttctgcatctattgagataatcatatggtttttgtcgttggttctgtttacgtgatggattacgtttattgatttgcgtatgttgaaccagccttgcatcccagggatgaagccaacttcatcttggtggataagctttttgatgtgctgctggattcggtttgccagtattttattgaggatttttgcatagatgttcatcagggatattggtctaaaattgtctttttgtattgtgtctctgccagactttggtatcaggatgatgctggcctcataaaatgagttagggagggttccctctttttctattgattgaaataattttggaaggaatggtaccaactcctccttgtacctctggtagaattcggccgtgaatccatctggtcctggactttttttggttggtaagctattaattattgcctcaatttcagagcctgttattggtctattcagagattcaacttcttcctggattagtcttgggagggtgtatgtgtcgaagaatttatccatttcttctagattttctagtttatttgcatagagatgtttgtagtattctctgatggtagtttgtatttctgtgggattggtggtgatatcccctttatcatattttattgcgtctatttgattcttctctcttttcttctttattactcttgctagcggtctatcaattttgttgatcttttcaaaacaccagctgctggattcattgattttttgaagggttttttgtgtctcttatttccttcagttgtgctctgatcttagttatttcttgccttctgctagcttttgaatgtgtttgctcttgcttctctagttctttaattttttaattatttaattatttatttattttttatttttagtatactttaagttttagggtacatgtgcacaacatgcaggtttgttacatatgtatacatgtgccatgtttgtgtgctgcacccattaactcgtcattaagcattaggtatatctcctaatgctatccctccccgctccccgcaccccacaacagtccccattgtgtgatgttccccttcctgtgtccatgtgttctcattgttcaattcccacctatgagtgagaacatgcggtttttttggttttttgtccttgcgatagtttgctgagaatgatggtttcctggttcatccaggcccctacaaaggacatgaactcatcattttttatggctgcatggaatactatgcagccatcattctattatactttctgtttctatgattttgagtattctaagtacctcaagtaagtggaatcatacagtttttgtcattttgtgtctggcttatttcacttagcacagtgtcctcaaggttcatccatgttgtggcatatgacaaggttcctttttttttcctttttttttttttttcttgcttacaactcttttttttttggttttgatacagaatctcacttggccacccaggctggagtgcagcggtacagttccagttcacttcaacctctccctcctgggttcaagtgattctcctgcctcagcctcctgagtagctgggattacaggcgactaccaccacccccggctaatttttatattttttagtagagactgggtttcaccctgttggccaggctgatctcaaactcctggcctcaggtgatcctcctgcctcggcctcccaaagtgctgggattacgggcgtgagccaccacgcccagcccagggtttccttttttctagggctgaataatatttttttgtgtgtatttaccccatttggtttattcattcaccgatggacacttgggttgctttcatcttttggttattgagtataatgctacaatgaacatgggtgtgcaaatctctctttgagaccctgctttcagttcttttgcatatatactgagaagtagaattgctggatcatatagtaattctgtgttcacttttttcaggaatttccatactgttttctacagtggctgtaccattgtattctcaccaccagtgtacaaaggtttcagttttgccacatcttcaccgacacttattttctgttctttggatagtgtctatcttaatgggtttgcaatctttgaccattttaaaattcaattgtttgtctttttgtttgagttttaagagttccttttgtattcaaggtagtagagtaggtccttagcagattatgattttcaaatattttcatccattctgtaggttgtgttgtcacattcttgagaatgtattttgatgcacaacgtatttaatttggataaagtccaatttgcctatttttaacttttattgctagtgctttcggtgttatatctaagagttcattgctttatctaaggtcttgaagatttccccctatgttttcttctaagagttttaaagttttagctcttatatttaggttgttgatccatattgaattaaattttgtatatggaatgattaattttatatatgatatgttgtatatgggttcaacttcattctatggttatttggtggtccaagcactatttgttgaagagtcttttctttgcccactgaatggtcttgtcactcttgttgaaaataaaccctataggcctatgctggccatagggtttatttctggactcagcattttattccattggtttgtgtgtgtgttcttaagcctgaacaacactattttgattattgtgctttgtagtaagttttgaaataaataagcttcctattttgtatttctgttttttttttgtttttttttttgttacagggtctcactctgttccacaggctggcatgcagtggcatgatctcagctcgctatataacctctgctttcgtgcttaagtgattctccagccttaacttcctgagtagctgggactataaacatgagccagcatgtttgtctaacttttgtatttttggtagagacaaggttgtgccatgtcgcctaggctgatctcgaattcctgagcttaaagcaatctgcctgcctcagcctcccaaagtgctgtgattacaggcgtgagccaccatgcctggccctattttatatttctttttcaaaattgttttggctctttgcagttgtatatgaatttgaagattagctttttcagtttggttcaaaaggccattggaattataatagggattgtactgaatctgtcaattgcttggtagtattagcatcttaacgatgttaagtatagtgatccatgaacatgggatgcctttctatttatttaagtaatctttaattgtgtcagcagtgtattataattttcattgtgtctttcaccttcttagttgaatttattcctaggtatattattattttgggtgctattgtatgtagaattgttttcttaatttccattttggatcatttgttgctagtgtacagatacaccaccaattttggtgagttgatcttttatttatttatttttgagatgaggtcttactttgtcacccaagctgcagtgcagtgatgtgatcatggctcactgcagccttgaccacctgggctcaagcaatgctcccacctcatcttccctagtagctgggaccacgggcacatgccacagtgcctggctaattaatttttttttttttttttttttttagagagagggtcttggtatgttgatcaggctgatctcgaacttctgggctcaagtgatcttcccaccttgtcctcccaaggtgctgggattacgggtatgagccaccatgcttagctgtgagttgatcttttttgtttgtttgttttttttgagacaggattttgctctgttgctgagggtggagtgcagtggtgtgatctcagctcactggaacctccatctcccaggcttaagtgatcctcccaccccagcctcccaagtagcagggactacaggtgtgcgccactatgcccggctaattttttttgtgtgtttttgtagacatgggttttcatcatgttgcccaggctcgtcttgaactcctgggctcaagcgatctgcctgcctcagcctccaaaaatgctgggattgcaggcgtgagccatcatgcccagcctgtgggttgatcttttatcctgcacatttgccagattcgtttgttagctgtagtagtttttggtggattctgtgggattttctatatatagagtcatgttatctgaaaatatatagagatagttttacttttctgtctccaatttggatgccttttcttccttgtcaaatttctttgtctaggacttctagtacagtgtttaatagcagtggtgaaaatgggcatccttgtcttgttatttatctttgacggaatgctttcagcctttaactattggatatgatgttaggtgtgtgtttttcatagaagtttccttctattcctcatcctcattcctccatccagtggaggtggcagggggtgaaatggactctgtgagggtcatccttagttttggttgtttaatgctctatctttgtgctggttggccttaaacatgtagatgaatttcacaggaatatttttactgtgttgagtcttacaatccatctacacagtacgcttctctaattatttagattcctttgtatttctttcatcagcattttcttttttcagcatgtaagtcctatatatgttttgttagatttatacctaaatattttatttcctttggggcatttttaatattatcatatgtttaattttttattttgattgttcattgttaagttatagaaatgcaatttatttttctgcattgatcttgtgtcctgtgaccttgcttaactgtttaattttaggagttttttgggtggattcctttagatttcctccataaataataataccacctacatagacaataatatcacccacaaaaagtatttttttttttgtttccagtctgtatgcctttctaccctttttaaacttataagttaatatttatacctcatggattctgcctccatgatgccgttgtaagcactttggcagagctcattagtaacatcaagcttaaaaaatccagtgtattcttttcatttattttttgattctcatttacctttgccatttaatacttgtcatctctttccaaaaacttcactttcttggctcctctgattctttccctacatctttggcaccctgtctctggctcctgttgttacttttctgctacctatcccacatttaaataggagttttgtaggttttcgttattttagtgctcactctccttggataattttattcccaatggatttagttatcattatatattttttactcacaaaatgctattttaggggtcagtcttttttttcctgaactccagcataagagctaaatgggccttcacctatatgtcccatagaatgttccaaactgaaatcatcttaaacctcaaatcctttcctctttatgtattttctgtgtcagtgaacaattccactgtgtgctttcaatccaaaccaggaaccctgaggtcgtccttaactttacccatcccttatatcaattattcatcagtctgttttctactgctttcctatctcttgagtgtatctattagctttcattggtacttcgaatcatttttcacactgtctctagacatgatattcttaaatgtgggtcatttcctcaaaacttcttttctagttcagtgattttctcagatcataaacttatgtgcaactcataagaaagagactgaaattttttgtaatctagttgttttcgaagtgtgatctgaagacctccaggtgttcccaagttttttctttttatatacaaaatcaacattatttttctaatactaagacatgattcatgatttacttttttcaccctcattttctcatgaatgtagtgtggaattttccagaggttatgtatggcactggaacagactgacggcagaagcaaatatgagaatgtagctgtcttctcttaagtcagatttaaaaaaaaatataatgccccctttttttatttttgttttagaaaatatagctatttttcataaaatatgaaaaccctaaaatctatcatttattttaaattatccataatataattataattaacaaataatggatttatttaaaaataagtcataaaatatataaacatatatattagaatttttttcttttgtatttctactatggtaaatatgtgattctcagtaatttttaacacattaagaggtcctgagattaaaatatatcaggattgctggtctcatgcatattaatacatagcaatcaaaattgaattattttaaattggcaagcaacttgactgaatttataattttggaagttgacttttttcacagtggaggggaagggattggaggaaataatttcagagaattagttagattctttttgccatattttagaagaaaagttatggagcccagatggaactaagtcattgtctgtggcattggagaggtggtgataggttgtgaaggaggatatacagaggaagttctgggatgacttatggaattttactttaggatgattggtgtggattttggtgctgttgatttagattcttttcagacttgtctgtctagctcatcatatgctaacattactagtaattagatctcactgaaggataatacagaaagtaggcatagtacattgtgtgtaaaccacatagaaaattaccattttagtacttatttcctttctttgaaggaaaagttgaaaagttctttattcaacacatgcttactgagttttataacactgtactgaatgctatggatatagtagttagtgatacagacaaaaactttctcttcttttggagtttatgtctttttgagagaaggtctcactctgttgcccagcctggagtgcagtggcttgatcttggctcattgcaacttctgcttcctgggttcaagtgattctccagccttagtgtcccaagtagctggtactacaggcggaagccaccaatgcccggctaatttttgtattttttgtagtgatggggttttgccctaatttttgtatttttggtagagacggggtttcgccatgttggccaggctggtctcaaactcctgagctcttagctattttcccaccttggcctcccaaactgctgggattacaggcatgagccaccatacccagcctctttttggagttttaagaagactgtatcaattgatacagtctgccctctgtaccacggatgtgaagcccatggatgcagaaggctgactgtaaggtatttgagcatccacaggggtcctagaaacaatctcctacagatactgaagtatgactatctatcatgagtggtttatgattttaattttaacatgaagtattgtttgtaatcttagaatcattggatactaaacttttgttttaggtttagcttctgcttttttttttttttttttttgagacagggttttgctctgtcacccaggctgcagtgcagtggtgtgatcttggctcaccacaacctccacctcccaggttcaagcaattctcctgcctcagcctcccaagtagctgagattacaggtgtgcgccattatgcccagctaatttttgtattttttttcgtagagacggggtttcagcacattggccaggatggtcttgaactcctgacctcaggtgatccgcccacctcggcctcccaaagtgctgggattataggcgtgagccactctgcaggccaaggtttagcttctttttgaggtgaaataattggggtcatttgagaacattattgaaaaagaagtaaaaaaactacaaaccacacactgatacttgtagatggatgacagtgtaggtaaatttttttcaaattgtattgtgttccctgagagtttgggaacacaagaaatcatggtttcttgaacttcagcttgtgtctagatcctagaagtaatagaggattctttttagttagctatttgggagatatagtgtgttataaatgtttgattctttaaaaatacataaattgggctaggcgtggtggttcacccatgtaattccagcactttgggaggctgaggcaggtggatcacttgaggttaggagttcgagaccagcctggtcaacatggcaaaaccccatctctactaaaaatacaaaaattagccgggtgtggtggcaggcacctgtaatcccagccactcaggaggctgaggtgggggaatcacttgaacctaggaggcggattttgcagtgagccgagatcacactactgcactccagcttgggtgatagagcgcgacttcatctcaaaaacaaaaaaaaaaattgatttaaataatataatcttttattatatgatgtataatcctgaaatttatggcatatgaaaatgaaacttggcataaagtggattttttagttcaataatacttttttttaacttattgaggatgttttagttcttgtttgccataagtgaaactttttggaattctgtatttgtttcacaattgggaagatttttttttctttttgagctgaaaaaggtatattttatttttagtctgtcaactattttaagtaagaagaaaacatttagatcaagacaaggaaggctttagtttcatcagggactttctaagaatgttatgaatgagtgaaaatatggggttgtaacagaagtgcaaatataaccttaattgtagtgttcagtgcttttgacactataatttatgtctaaatgctgcaaactgaaagaaccttagtttgaaactttgaagttgatggtggttgcaggttttctttttcccttcagttttatgccatctcaatgtgttatctggcattaaagacataaggaacacagattgcagcttccatttttttggcatgtttttgatttctatttgattcatatgctctggaggttccttttgaatctataaaatgcaacagttctctgattttgttttgatgattagatgctgctaattttcttttttttttttttttttgaacttgttcattttgccatgactattttttgaaacttgagatgtctggtatttagaaactgtactgagactttagtttttctatctgacctgagttttctatggacagattatagtggggtcttactagtctgacaattcctgactattcattggagtgtttacttttatttagttctaaatgtggttaggtttaagtttaatgtcttcatattttactggtcccatctgatttttgttcctttttttcttttcctgccttctttgggattgagtatattttagcattctattttctcttcattattaattaaccatactttattttttagtaattgctctagggttgacagtatgcatgtttaacttatcaatgtctactttgaaataatattataaaataccactttataagtaacgtaagtattatcccttacctagaatgtttatgacagtatgctcctcttcatgtcctgtcatgatttgtgctaatgttgtcataactcttacttctgtatgttacacactcacaatggtcaataataataactattactgctttgaataatttttaagaaattaaaacaagagtgtttgttgtgtttacccacactggattttaaggagtgaatcttgtttggtgttcgttgttattttgtgcttctgtgtacacaaaggtgcctatgatgtttcaccttagttgttaaatacttccttaagtcgaagctcatgtctcaacagtatactgttcagccctcctgggatatgtttttgcttccttcaacttgtctaaatccacatattcccccgaagttagatcgattctcaacttcagtatcttatttagtaaaaccattatttgcttctgattccctatgcgttttatagggaagataggacatgccatttcctgtaaataagattagtctaacatttataatacaaatgccaatgctacaaaagggaaaactgttcttatttagggttctgtttatgtagcagttcatacagagaattttcatgtgcgtcaaaaccaataagagattagatatgcctttacaaaacacaataaattatcattattcttttcttttattcaaataagacaacctttcaactgttgaagagcatgggccctgaaaaataactttattatatgtttattttttttgaggcagagtttcgcttttgttgcccaggctggagtgcatgggcgtcatctcggctcactgcaacctccgcctcccaggttcaagcgattcttctgcctcagcctcccgagtagctgggattacaggcatgcgccaccacgcctggctaattttgtatttttagtagagatggggtgtctccatgttggtcaggctggtctcgaactttcgacctcagatgatccacccgccttgtggatcccaaagtgctgggattataggtgtaagccaccacgcctggcctatgtgtttaatttttaattccttaatacataagaatacattattctcttataatagtttaaggtattcagatattttcttaaccattactgaaagtatctgtggatatagatgggcactcaagtatagaatagatgttagaggattgcaactacaaaataaagtatttcttaattattttaaaaatgaatatagtaaacattatggccttttttcctttatttacttatttttaaagcaggatgcatttttttaggagccagagtctcttttatagcaatagtgaaatgaattattgtaatctgaacacttaacaatccataaattgactcttccaagatggcccagtaggaacagctccagtctgcagctcccagcgtgattgacacagaagacgggtgatttctgcatttccaactgaggtacctggttcctctcattgggactggttggacagtgggtgcagcccacagagggcaagccgaagcagggcggggcgtcgcctcacccgggaagtgcaaggggtcgggggatttccctttcctagacaagggaagctgtgacagacggtacctggaaaaacaggacactcctgcccaaatactgtacttttccaatagtcttagcaaacggcataccaggagattatatcccatgcctggcttggtgggtcccatgcccacagagccttgctcactgctagtgcagcagtctgagatcgacctgcaaggcagcagcctggcagggggaggggtgtctgccattgctgaggcttgagtaggtaaacaaagcagccagggaagcttgaactgggtggagccaaccacagctcagcaaggcctgctgcctcatagactccacctctggggacagggcatagctgaacaaaaggcagcagaaacttcttcagacttaaacgtctctgtctgacagctctgaagagaggagtggttttcccagcatggtgtttgagctcagagaacagacagactgcctcctcaagtgggtccctgacccctgtgtagcctaactgggagacacctcccagtaggggccaactgacacctcatacaggcaggtgcccctctgggacggagcttccagaggaaggatcaggcagcaatatttactgttgagcaatattttctgttctgcagcccttcgctggtgatacccaggtgaacagggtctggagtgaacctccagcaaactccaacagacttgcagctgagggaccagactgttagaaggaaaaagaaggaaaactaacaaacagaaaggcatagcatcaacatcaacaaaaaggacatccacaccaaaaccccatctgtaggtcaccaacatcaaagaccaaaggtagataaaaccacaaagatggggagaaaccagagcagaaagctgaaaattctaaaaaccagagtgcctcttctcccccaaaggatcgtagctcctcgccagcaacagaacaaagctggatggggaatgactttgaggagctgacagaataaggcttcagaaggtgggtaataacaaaattctctgagctaaaggaggatggtcgaatccattgcaaggaagctaaaaaccttgaaaaaagattagacgaatggctaactagaataaacagtatagagaagaccttaaatgacctgatggagctcaaaaccatggcatgagaactatgtgaaatatgcacaagcttcaatagctgattcgatcaagttgaagaaagggtagcagtgattgaagatcgaattaatgaaataaaatgagaagagaagtttagagaaacaagagtaaaaagaaatgaacaaagccttcatgaaatatgggactatgtgaaaaaaccaaatctgcttttgattagtgtacctgaaagtgatggggagaatggaaccaagttggaaaacactatgcaggttattatacaagagaacttccccaacctagcaaggcaggccaacattcaaattcaggaaatatagagaacaccacaaagatactcttcgagaagagcaactccaagacacataattgtcagattcaccaaggttgaaatgaaggaaaaaatgttaagggcagccagagagaaaggtcgggttacccacaaagtgaagcccatcagactaacagctgatctctcagcagaaactctacaagccagaagagagtgggggccaatattcaacattcttaaagaaaagaattttcaacccagaatttcatatccagccaaactaagcttgataagtgaaggagaaataaaatactttacagacaagcaaatgctgagagattttgtcaccaccaggcctgccctaaaagagctcctgaaggaagcaataaacatggaaaggaacaaccggtaccagccactgcaaaaacatgccaaattgtaaagaccatgaatgctaggaagaaactgtatcaacacaacaaaaaaagagaatttcaggttgatatccctgaatgaacattgatgcgaaaatcctcagtaaaatactggcaaaccaaatccagcagcacatcaaaaagcttatccaccacgatcaagtcggcttcatccctggcatgcaaggctggttcagcatacgtaaatcaataaacataatccatcacataaacagaactaaagacaaaagccacatgatcgtctcaatggatgcagaaaaggccttcgacaaaatttaacagcgcttcatactaaaaactctcaataaactaggtattgatggaacgtatctcaagagctatttatgacaaacccacagccaatatcatactgaatgggcaaaaactggaagcattccctttgaaaaccggcacaacacagggatgccctctctcaccactattgtgcaacatagtgttggaagttctggccagagcaatcaggcaagagaaagaaaggaagttgtattcagttaggaaaagaggaagtcaaattgtccctgtttgcagatgacatgattgtatatttagaaaaccccattgtctcagcccaaaatctccttaagctgataagcaacttcagcaaagtctcaggatacaaaatcaatgtgcaaaaatcacaagcattcctatacactaataacagacagagagccaaatcatgagtgaactcccattcacaattgcttcaaagagaataaatacctaggaatccaacttacaagggatgtgaaggacctcttcaaggagaactacaaaccactgctcaatgaaataaaagaggacacaaacaaatggaagaacattccatgctcatggataggaagaatcaatatcgtgaaaatggccatactgctcaaggtaatttatagattcaatgccatccccatgaagctaccaatgactttcttcacagaattggaaaaaactactttaaagttcatatggaaccaaaaaagagcctgcataggcaatacaatcctaagccaaaagaacaaagctggaggtatcacgctacctgacttccaactatcctacaaggctacagtaaccaaaacagcatggtactggtaccaaaacagatatatagaccaatggaacagaatggaggcctcagaaataacaccacacatctacaaccatctgatctttgacaaacctgagaaaaacaagcaatggggaaaggattccctatttaataaatggtggtgggaaaactggctagccatatgtagaaagctgaaactggatcccttccttacaccttatacaaaaattaattcaagatggattaaagactttaatgttagacctaaaaccacaaaaaccctagaagaaaacctaggcaataccattcaggacataggcatgggcaaggacttcatgtctaaaacaccaaaagtaatggcaacaaaggccaaaatagagaaatgggatctaattaaactaaagagcttctgcacagcaaaagaaactaccatcagagtgaacaggcaacctacagaataggagaaaatttttgcaatctacccatctgacaaaggtctagtatccagaatctgcaaagaacttaaacaaatttacaagaaaaaaacaatcccatcaaaaagtgggcaaaggacagacacttctcaaaagaagacatctatgcagccaacagacacatgacaaaatgctcatcattactggtcatcagagaaattcaaatgaaaaccacagtgagataccatctcacaccagttagaatggcaatcattagaaagtcaggaaacaacagatgctggagaggatgtgtagaaataggaacgcttttacagtgttggtgggagtgtaaattagttcaaccattgtggaagacagtgtggctattcatgaaggatctagaactggaaataccatttgacccagccatcccgttactaggtatatacccaaaagaatataaatcatgctgctataaagacacatgcacaggtatgtttattggggcactattcacaatagtaaagacttggagccaacccaaatgtctgtcaatgatagactggattaagaaaatgtggcacatatacaccatggaatactatgcagccataaaaaaggatgagttcatgtcctttgtagggacatggatgcagctggaaacaatcattctgagcaaaccgtcacaaggatagaaaaccaaacaccgcatgatctcactcataggtgggaactgaacaatgagaacacttggacacagggcggggaacatcacaccctgggtcctatcatgatgtggggggcagggggagggatagcattaggagaaatacctaatgtaaatgatcagttaatgggtgcagcaaaacaacatggcacatgtatacctacgtaacaaaactgcacgttgtgcacatgtaccctagaacttaaagtataacttaagaaatccataaattttggaatgccttggacacaacagcaacaagaatctataaatattatgcttgctaatagtataatgtataatttaacccttttaacctttacttcaattccttaaagtctttaaaatctcagttggcatcaaaagtattactgagaaaattcttttgtgctttaccgcaaatttatctgaaatgcattcttttcttcttatacattgaatactctcggagttcgttgttttggaattatatgtgattataagatatttcctgttttttcctcccatgctcccattgttttcccatgacacttttagatatttatcatgttggctagatttcgccttttacttttgcatatgtttggaatatgctattttatattatgtagctcttacgtgtattatttattttccgaaatatttgtatttttcttctcccttgagcctctttatcttcttcagcccattttcttacagatacttcctttcctttcctttcttttcttaaccctttagtctttcattagaactgttaaggaataacagaagaaataccttgtcttctttccagtacttttgccaagcataaattttgtgcttttttcttccctagctgttttatagattttcttataattcagacatatttgtggtctgaactttttgccttttataatgaaatcactaggttacaaagcatttataagttgtgtagtttattctgtaaatttttaataaagacagatgatttagagtaggggtaatcaaactatgccccatgggctcactgcctgtttttgtaaatacaagttttttggaacacatccactcttacttgtataaatattgtgtttggttgctttcatgctccaatggcagaattgagaagttgcacatattaggccgttttcacactgctatagagaactacctcagactgggtaatttataaagaaaaggtttaattgactcacagttctgcattgctggggaggcctcagaaaacttacaattatggcagaaggcgaagggaaagcagggcacatcttaggtggcagcaggggtggggggaatgccacactttaaaggccattaaatctcatgagaactcactcactatcacgagaacagcatgggggaaaccatccctgtgatccagtcacctcccaccaggtccctcatttgatttgtgggaactacaattctagatgaaatttgggttggtacacagagccaaaccatattattttgataaagcctaaatggcttgcaagcctaaaatatttattgtctggccctttacagaaagtttgcctactcttattttaaagtatatgatcatttaaaagtgacatttaattctattaaaagtaaaagcataaaataatttaaaaattatatatatttttctagattgttataggaatttgcatgttggtaattgctaaaatttgataacataatacctacataatttgagcccttaaataaatggagtcaggctgggtatggtggctcactcctgtaatccctgcacattgggagcctgaggtgggcggattgcctgagcccaggagttagaaacctgctggggcaacatggtcaaaccccatctctacaaaacagtacaaaaattagctggacttggtggcacaagcctttagtcctagctactctgaaggctgaggcaggcagatggattgagccaggaaggttgatactgctgtgagctgtgatcacaccactgccagcctgggtgacagaacaagagcatgtctcaaaagaaaaggagtcattttgtgattgagagacaaaagaacaagttaataatgacgtttgtcaattattagagtatgtagttatctaataagttattagggtgtgtgtatatatatgtgcacatacattttctaataatttgtgtatgtatgcatctgtatacacagatatttacatgtctagatttcacagtaggttgatctgagaatgacagcatgatctactattactgagtaaattatcattaccattcagggttatgattcttggaaattatattcagaatggcctaagagaggttgttatattcagtgtgttgaacttgagaaggaaattggaagagtattggcagaaaactttagagcgcatatagtttacttttaaaaattctaaatacatttgaaaaaaattctcttgctcctttttccatgaatttttaattgttttaattaaatttttgaaaaaagttttaaagtttttaaaaacaattttagacaagatcttgctctgtccactcaggcaggagtgtggtggcacagtcacagatctctgcagcctcaaactgctgggctcaagtgattccccccgccacggcatcccaagtagctagggctatagacatgcaccaccatgcccagctgatttttttaatttttaattttttggtagagactaattctcattgggttccctaggcttgtcttgaaatcctgggcttaagcagtcctcctgccttagcctcccaaagtgctgggattacagacgtcagccaaagcacctggccccatgaaattttttttagttcttcgattatcttaaaatatgtgatctgttatatcctgttagtaggttattaacatcctaaagtactaagaaattttctatccagtcagttaaatattttgaagtgttttggaatggatgcatgaaatttttctgtgaaaactttaattctttctttgtattatagtacatactttgggaattatatcctgagttttctagaacagttccaatttcatacttattgaaattaactacaactgcttgagattaagtatttgactgcttatggctgccatgaaagtaatgcttgttgcaaaataattcaaatggtacagaagtaaataagtagtaaaagttaatttttttctctttgttttttgtttttctgatactccccttcagagacatatattatctataggtttcctctccactgtctacattaccttcttttctcgaattttatttcttagttttctcattctgcatactgtatttattgttcaaactgttacgtcattgagtattatttcgagatcttgtggctgtgcttcagtcttccattattcttttttcttttgtctcctgtatgtattttcaaatagcctgttttcagtctcactaattctttcttctgcttgattaattttgccattgagaggttctgatgcattcttcagtatgtcaattgaatttttcagctccagaatttctgcttgatttccaaaaattattttaatctttgttaaatttatctgataggattctgacttccttctctctgttatcttgaagttcgttgagcttaaaaataagtattttaggttctctgtctgaaaggtctcatatctctgtctcttcaggattggtcattggtgcttcatttggtttgtttggtgaggtcatgttttgctgtatggccttgatgcctgtggatgtttgttggtttttgggcattgaagagttaggtgtttattgtagttttcacagtctgggcttgtttgtatccgtccttcttgggaagactttccaagtgtctaaagggaagtgagtgttgtgatctaagtctttggttgctgcagctgtatcgcactgggggcacctgaagcctagtaatgctgtgactcttatagacttgcagaagtattgcctttgtggtcttcagtaaggtccaagagaatttcctggattaccaggcagagaataccctggattactgagctccatgctgaactgcttcaggcggggaaaaaggtgacacaagcatccatgtggccaccaccactatgactcgttgggtcagacctgaagccagcatatcactgggtcttgtctaaggcctacagtgaccactgtgtggctactgttgttgttcatttaaggcacaggctcttttggcagcaagtggaaaatccagccatgcttgtgtctttcccttcagagtggcaagttctcctgtagcccagggtgggtctagaaatgtcatctaggagccagagcctagagtctgggaatcttagaaatctgcttggtgttctgttctactgcagctgagctggcacccaagccacaagacaaagttcttcccactgtttcctctccttttcagaagcaggagactctcattgtggccatcatcaccccaggtctgcagtgaatactgcatggctaccagtgatgttcattcaggggccaaaggtttgtcagtcagcttgtggtgattgcttccaggcctgggtctgtccctttagggcagtgggctcccctctggcccaggacagacccagaaatgccatccagaagccagggtctggaactggggaccctagcagccttcttggtgctctgcgattttgtggttgagctggtgtacccaggcagcaagacaaagtcccctttatccttcctctccttccatcaagcaggaggagcctctccttgtggccaccacagctgggaatacgctgggtcacacctgatgccagcacagcactgggtctcacccctagacccacggtgagtactacctgattactgctggtgtttatccactgcccaagggctccttagtcagcgcgttatgaatcctgccaagactggttccttcccttaaaggtagtgggttttcttctggcccaggatggtctagcaatgttatctggcagctagggcctggaatggaggcctcgaactcttcctgatgccctatgctactgtggttgagggcatccaagttgcatgacaaagagctctttagttttccctctcctctcccactcctcaagcttaaggcaggaatgtctcctgggagcttgtttggcaggtggagccaggggtgcggggccgaggtggtataggcactcccctggctgggtggtttaacataataccattcgtgtatttctgtttttattgtttggggttttgaggtcataaccgtaaaatctttgcctagatgagtgttctgaggtgtttctcctgttttcttttagttttaatagttttatagtttcaggtcttaaggttaagtctttaatccattttgagttgatttttgtatgagttgggagatagggttccagtttcattgttgtgcatgtggatattcagtttcactgcaccatttattttagaagatgtcctttccccagtgtgtgttcttggttcctttgtcaaaaatcaggtggctgtaaatacatggatttatttctgggttctcttttctgtttcattggcctgtatgtctgtttttataccaatattgtgctattttggtaatgatagctttgtagtatatttcaaagacagtgtgatgcctgtaggtttgttctttttgctcagggtacccaggcagcaagacaaagtcctctttacccttcctctccttctgtcaagcaggaggagcctctccctgtggccatcacagctgggaatgctctgggtcacacctgatgctagcacagcactgggtctcacccagtgctttggctattcagagtcttttgtagttccagattaattttagggctgtcttttctatttcaatgaagaatgtcactggtatttcaatagggattgcattgaacctgtagattgctttgggcagtatggccatttttaacaatattaattcctctaatctatgaacataggatgtcttttcatttgtatccttttctgtttctttaatgagtgtttcgtagtttttattgtagagttattttttaccttttctgttaaatttattcttagatatttaatttttttgtagctattgtaaatggcattgctttcttgagttctttttctgaccatttttggtgtgtggagatactgctgatttttctatgttgattttgtatcctgcactgaatttatcagatttaagagctttctggcagtctaggtttttctgtatataagatcatgttgtctgcaaagcagagcagtttaacttcctcctttccatttggattttctttccttttttttttttttttttttggtgtggaaacccaggactttcttttctttcttttattttttgtttctttctttcttctttttttttggtcataaagtttcactctgtttccccatgctggagtgcagtggtgcgatcagggcccactgcagcctcaacctccctgactcaagtgatcctccgttctgaggctcccaagtagctgggaccacaggtgtgtgccaccaggcctggctaatttttttattttttgtagagatagagtctccctatattgcccaggctggcctcaaactactgggctcaagtcctcccaccttggcctcccaaagtactgggattacaggtgtgaaccaccatgcccagctgtctttattttgcctgatagctctggctgggaccttctgtactgtgttgagtaagaatggtgaaaatgggcatccttgaaagcctttcagtttttctcatttcagtatgatagtagctgtgggtttgtcatatatggcctttattatgttgaggtgtgttccttctatccctaatatgttgggaggttttatcatgaaggtatgttggattttatcaaatgcatttttagcaccaattagatgatcatatggtttttgtcttgattctgttaatgtgttgtatcacgtttattgatttgtgtatgttgaatcgtcctttcatcccttaagtaaatcctacctgattaggagaatggcgtgaaaccgggaggcagagcttgcagtgagccgagatcgcaccactgcactccagcctgggtgagacagtgagactccgtctcaaaaaaaaaaaaaaattctacctgattatagtatattatgatgcttatttgttgttgggttcagttggtttgtattttgttgagaattttaaatctatgttcatcatggataatggcttgcaggtattttgttgttattgtttgtttgtttttgagacaatcttgttgctcaggctggagtgcagtggtgcaatctcagctcactgcaacatctgcctcccaggttcacacaattctcctgcctcaatctcctgagtagctgggactacaggtgtgtgccaccacacctggctaatttttgtattttttggtagaaacagggtttcaccatgttggtcaggctggtctcgaactcctgacctcaaatgatcagcctgcctctgcttcccaaagtgctgggattataggtgtgagccaccactcctggcctgcagttttttaattgttgttgtgtccttgtctgtttttggtgttagagtaatcctggccttgtagaacgagttagtaagcttcccttctcatcatttttttggaatagtttaagaattggttcttccttgtaagcttgataaatttagcagtaaagccatttcatcctgggcttttctttttagggagagtttttactactcattgaatcttgttacacattattgatgtgctatactattcttgcgatgttataaaggaatacctgagactaggtaatttataatgaaaagagatttaatttgctcacagttctgcaggctgtatagtcatgtagccggcatctgcctagcttctggggaggtctcagggagcttttactcatagcagaaggtgaagcaggaacaggcatgtcacatggtgagagcaggagcaagagagagtgctggggaggtaccacacacttttaaaaactcagatcttgcaagaactcactattgtaaggataattccaagggtacagttccaaaccattaatgggcagtttttccccatgatccagtcacctctcaccaggcctcacctccaacactgggggttacattgaggggccaaattcccaagctatatcaattggtctgttcaggttttctgtttctttctggttcagtcttaataggttgtatgtgttcaggaatttcatttcctttaggtttttaagtttgttagtatacggttgtttattatagtctctagtgaccctttgtcattttgtagtatcagttgtaatgtcgccattttgtttgtgattttgttcatttgggtctttgctccttttaacatggttagtctagctaaaagtttgttgattttatcttttcaaaaagctaactttttgtttcattgatcatgtatattgtttagtctctagttatttctgctctgatctttattgtttccttgtgctagctttgtgttggtttttcctcttctggtttcttgagagtcatcattaggtggtttttttgaaatctttctacttttttgttgtaggcatttattgctataaactttcctcttagtatcgcttttcttgtatctcatgagttttcgtatgttgtatttctatttttgtttaatgaaattttttaatgttttaaattactttattaatggagtcattgatcattcaggagcatgttgtttgatttgtctctatttgtacagtttccaatgttcctcttgttactgatttccagttttattcttgtggtctgagaacatatttgacatgattttgatttttaaaaatttgctgagacttactttgtggcctaatatatgatttacactggagaatgttttatgtgctgatgagtcgaatgtgtattttacagctgttggatgaaatgttctgtaaatatctgttaagtctgtttggcttatagtgcagtttacatctgatttttttggttgattttccatgtggatgatatgtcccatgctgagagtggggtattcaaatgccccactattattgtattggagctatctctccctttagatctaataatatctgctttgtatatctgagcattctggtattaggtgcatatatatttagaattgttatatcttcttgctgaattgatccttttataattaatgactttgtctttttttttttttttacagtttttcatttaaagtctgttttatctcatctaggtgtagctacttctgtttgcttttgttttttgtttatatgcaatatctttttccattcctgtacttctagtctatgtgtatttacagttaaagtgagttatttataggcagcatacagtttggtctttttctttttaaaaattcattaagccagtctatatcttttatcaggggaatttaatctatttacattcaaggttattatttataggtgaggacttatttctgtcattttattgttttctggttgttttatatatcctttgttcctttttcattgtttatttttgtggtttcgtgtttttctgtatttgtaatgtttggttcctttctctttctcttttgtgtatctgctctaccagtgagttttatactttcatgtgttttcatgatggtggatattattctttcacttctagatgtaggactcccctaagcttttcttttagggtggtttagtggtaatgaattccctcagtttttccttctcttagaaagatgttactgttctttcatttttttttttaaaaggagtttcacgctggttgcccaggttggagtgcaatggcgcgatctcagctcactgcaacctccgcctcccaggttcaagtgattctcttgcctcagcctcccgagtaactgggattacaggaacgtgccaccacacctggctttttgtacttttagtagagacaggttttctccctgttggtcaggctggtctcgaactcccgacttcatgtgatctgcctgcctcggcctcccaaagtgctgagattacaagcttgggtccccgtgcctggcctgctctttcatttttgaatagcactttgctggaaatagttttcttggtgggcagtttttttcttttaatattttgaatatattatctcattctctcctggtcttaaggtttctgcttagaattgtgattttagtctagtggggatttctttatatgtgtgttgacacttttctctcgctatttttagaattctctctgtgtcgttgattttgatagcttgagtataatgtaccttggaggactttttctggtagaatccgtttggggttcttgagcttcctgtattgaaatttgtatggctcttgcaggagttggaagtttttagctattatttcattaattaggttttctatgcctttacccatctcatttccttctggattttctaaaattttctgaattttctaaaatctagttagatatttaaaaaagaaaaaagttatcttaaaagacttgtcttcaagtttagaaattctttctgttgcttgatctattgttgaagtgctcagttgtattttttattttattcattgagtttttcagttatgggattttgtttggttgtttttttaatgacatctatctcttttgaatttctgattcatgaatttttttttataaccttgtattatttatgtgttttctcctgtttctcactgaggctcttcgttatcatttcaaattctttttcctttttctttggatctgttactagagaattagtgtgttgctttggaggtgtcatgtttccttgcttttttatgtttcttgtgtctttatgttgatatttgtgcatctagtgtaccgttcacttcttctagttttgcggattgtcttttgttgggaaagactttttttcttatagatgcatctattatgttgcttttgtagggtgctttgtctttgattcttggtgggtgaagtagtatagtctgcatgatttctttggctggaatcaggattagtcttgtctgtgatttccccagtggcttaggctgtggttcttaggtaaaggctttggtgtggctttttcttgggaggaggaagacaggcagactagttctcaggcaccactggtggcagtgatgggctgcgcatgacagtccttggtgccctgtgtggcatatgcaggtgattgtggtgatgggtctagatgggccaaactttggttgtccaggcagcttttctgggtgccagaggtagaagtggtatggtgagtctggtgggtcctcagagtcttgggtagtgtgatggcattggtggtagcaatagcggtggcaggccaaccattgggtctccagtggcaggccagcagtggtgttgggctgggtgtgccggtccccagtcccctaggtggtatgcataggtgagtgctggtgatagtggcaaactgagcaagttggtatataggcccctgggagatgcatgctggtgccagcagtggccatggtgggtgtctgtctaggcccgcagatagtgcacatggtaaaggtggctgtctgggcagattcatcctcaggctgctggaaggtgtgtatgggttctggcagtggcaggccggtaggatcaatctccaggctcccagatatcaggtgccagatgtggtgagtcagtctccagggctctggagaatgggcgtaggcaatgttggtgggcacggctggtctgtccccacaggttggatgggttgatccccaggccccagatggtgtgttttgatggcagtagcggtgggttgggtgtgcctgtcctttgattcctggatggtgtgtgcaagtggtggtggcaggtggggtggtcttgttgtcaggcccccatcatggtgtgtctgattatcaatgacagcaggttggggcagatcaattcccaggcctccagatgacacctgtggctgtggtggcagtttgggtgggctagtcctgtccttactcccacctccccaaaattgaatgtggttgtggtggatgtggacagagcaggttgatacctaggccctggttggcatgctatccatgttgatattttactctagtttataaatgttaactgctgtatagtatagtgtttaatgaatattaaataatgatcctactatgaattttttttatttctccttgtgtatagattttagagttctaaagtggattgttgagttgaagtttatgtacattgattttccccttaatataaaattgtttttttaggttacactgtaagagaatttctgtttgtctatagtgaaatcaatacttgatagtttcatacttgaattttgccagttgagtggttttgaaatgttagctcatcatcatttttacttacatttttatcataaaaagtggttttccgggaggctgaggcaggagaatcgcttgaacccgggaggtggaggttgtggtgagccgagatggcgcccctgtgctccatcctgggcaacaagagcgaaactccatctcaaaaaaaaaaaaaagtagttttcattttaaaaaaattgcctgttcaagtttttttagttttcttaataatgtatcatattataattaataatgtgtaaatatatacttgtgtattatattgtatattatctatatcatataaattatatataacattaatgtttcttttattttgtctttttcttactgcaggggtcattattcagaatacttaattttgttgcatgttaggtgtattgcaaatatattctgtcactctttggattttcctttaactttctttagtgtgtcttttgtgtagaatagcttatttttgtcttaatgaagttgggtttttctggtttttgtatttttcttgcttttgtattttttgcttttttgtttcatgtgaaattttcaactgacctgtggtcataataaaatttcctatggtttcttgtagtaattttaaacctttattttttaatttatatcttttaatcagtggggtttgttttcctgtatagtgtaaggtatggcactttatatgtctaactggttcttcctgtaccatttgaattgtttctcttcccctctgatttataatgctacctgtgtcatattccatgtatccatatatatcacgatctgtttctgggctctcctctgttccattggcttgtttaaattattatggttctaaaataaatcataatgtggggtggaggtaatttccccacttactttatattttgtgtttgtttgcatagatattattcaagtatctctgagaatcctaaacacaattgttgtaagattgtttaaggctgttctagaagattaattttattgtgacttaattttgttgatttccttagctgtcttagcattagatttcttcgtgtgctttagaatggtggtttgtaaggttatttttaacagaaaggtcattatctctctatttcaccatcttcttcttgtcttactcaagcccttcctctgctcattgttagtgttatagttacttcctctggtctatggtctagaatccagttttaccttgacagttcaaggctcttgcattgctgtattgggtgatagcaaagcattgcttatttcgtttttcatgaggtttgtttacttctgacaccctttatacataacttcatgttaaattctaggcagtggttggcagtaagttttttctgcctccttcaaaattggggattcactctgttactggttttaagcgttgagcttggtaacagtctcccatccttacatgacaattttcagttctctttattcttcatctgcctctgccaggttttacatcttttgcatggccacctgtctttctcaatctgactaaatgctttgagtctggttaaaatttttctcttttttatgttattgctagtatttcttgtcctcccccatcctcaatgtttttatctagtcagcctttatcagaagtataaatccttttttctttttattggaaatctaaaagcttcaaagattactttttttattatactttaagttttagggtacacgtgcacaacgtgcaggtttgttacatatgtatacatgtgccatgttggtgtgctgcacccattaactcgtcatttaacattaggtatatctccaaatgctatccctcccccctcccccaaccccacaacaggcccccaccccacaacaggcccccaccccacaacaggccccggtgtgtgatgttccgcgtcgtatgtccatgtgttctcattgttcaattcccacctatgagtgagaacatgcagtgtttggttttttgtccttgcgatagtttgctgagtatgatggtttccaacttcatccatgtccctacaaaggacattaactcatcattttttatggctgcatagtattccatcgtgtatatgtgccacattttcttaatccagtctataattgttggacatttgggttggttccaagtctttgctgttgtgaatagtgcctcaataaacatacatgggcatgtgtctttatagcagcatgatttataatcctttgagtatatacccagtaatgggatggctgggtcaaatggtatttctagttctagatccctgaggaatcgccacactgacttctacagtggttgaactagtttatagtcccaccaacagtgtaaaagtgttcctgtttctccacatcctctccagcacctgttgtttcctgactttttaatgagtgccattctaactggtatgagatggtatctcattgtggttttgatttgcatttctctgatggccagtgatgatgagtatgttttcatgtgtcttttggctgcataaatgtcttcttttgataagtgtctgttcatatcctttgcccactttttgatggagttgtttgttattttcttgtaaatttgtctgagttcattgtagattctggatattagccctttgtccgatgagtaaattgcaaaaattttctcccattctgtaggatgcctgttcactctgatggtggtttcttttgctgtgcagaagctctttagtttaattacatcccatttgtccattttggcttttgttgccattgcttttggtgttttagacgtgaagtccttgcccatgcctgtgtcctgaatggtattgcctaggttttcttctagggtttttatggttttaggtctaacatttaagtctttaatcatcttgaattaatttttgtataaggtgtaaggaagggatccagtttcagctttctacatatggctagccagttttctcagcaccatttattaaatagggaatcgtttccccatttcttgtttttgtcaggtttgtcaaagatcagatgattgtagatatgtggcattatttctgagggctctgttctgttccattgatctacatctctgttttggtaccagtaccatgctgttttgcttactgtagccttgtagtatactttgaagtcaggtagcctgatgcctccagctttgttctttttgcttaggattgacttggcaatgcgggctcttttttggttccatatgaactttaaagtagttttttccaattctgtgaagaaagtcatcagtagcttgatgggaatggcattgaatctataaattaccttgggcagtatggccattttcatgatattgattcttcctacccatgagcatggaatgttcttccatttgtttgtatcctcttttatttcactgagcagtggtttgtagttctccttgaagagctccttcacatcccttgtaagttggattcctaggtattttattcctttgaagcaattgtgaatgggagttcactcatgatttggctctctgtttgttattggtgtataggaatgcttgtgatttttgcacattgattttgtatcctgagactttgctgaagttgcctatcagcttaaggagattttgggtgagacgatggggttttctagatatacaatcatgtcatctgcaaacagggacaatttgacttccccttttcctaattgaataccctttatttccttctcctgcctgattgccctggccagaacttccaacactatgttgaataggagtggtgagagagggcatccctgtcttgtgccagttttcaaagggaatgcttccagtttttgcccattcaatatgatgttggctgtgggtttgtcatagatagctcttattattttgagatatgtcccatcgatacataatttattgagagtttttagcatgaagcgttgttgaattttgtcaaaggccttttctgcatctattgagataatcatatggtttttgtcgttggttctgtttacgtgatggattacgtttattgatttgcgtatgttgaaccagccttgcatcccagggatgaagccaacttcatcttggtggataagctttttgatgtgctgctggattcggtttgccagtattttattgaggatttttgcatagatgttcatcagggatattggtctaaaattgtctttttgtattgtgtctctgccagactttggtatcaggatgatgctggcctcataaaatgagttagggagggttccctctttttctattgattggaatagtttcagaaggaatggtaccaactcctccttgtacctctggtagaattcggccgtgaatccatctggtcctggactttttttggttggtaagctattaattattgcctcaatttcagagcctgttattggtctattcagagattcaacttcttcctgggttagtcttgggagggtgtgtcgaggaatttatccatttcttctagattttctagtttatttgcgcagaggtgtttgtagtattctctgatgatagtttgtatttctgtgggattggtggtgatatcccctttatcatattttattgcgtctatttgattcttctctcttttcttctttattactcttgctagcagtctatcaattttgttgatcttttcaaaacaccagctcctggattctttaattttttgaagggttttttgtgtctctgtttccttcagttctgctctgattttagttatttcttgccttctgctagcttttgaatgtgtttgctcttgcttctctagttcttttaattgtgatgttagggtgtcaattttagatctttcctgctttctcttgtgggcatttagcgctataattttccctctacacactgctttgaatgtgtcccagagattctggtatgttgtgtctttgttctcattggtttcaaagaacatctttatttctgccttcattttgttatgtagccagtagtcattcaggagcaggttgttcagtttccatgtagttgagtggctttgagtgagtttctgaatcctgagttctagtttgactgcactgtggtctgagagacagtttgttataattactgttcttttacatttgctgaggagtgctttacttccgactatgtgatcaattttggaataagtgcggcgtggtgctgagaagaatgtatattctgttgatttggggtggagagttctgtagatgtctattaggtctgcttggtgcagagttgagttcaattcctggatatccttgttaatttctgtctcgttgatctgtgtgatgttgacagtggggtgttaacatctcccattattattgtatgggagtctaagtctctttgtaggtctctaaggacttgctttatgaatctgggtgctcctttattgggtgcatatatatttaggatagttagctcttgtcgttgaattgatccctttaccattatgtaatggccttctttgtctcttttgatctttgttggtttaaggtctgttttatcagagactaggattgcaacccctgcctttttttgttttccatttgcttggtagatcttcctccatccctttattttgagcctatgtgtgtctctgcacatgagatgggtttcctgaatacagcacacttaatggttcttgactctttatccgatttgccagtctgtgtcttttaagtggagcatttagcccatttacatttaaggttaatattgttatgtgtgaatttgatcctgtcagtatgatgttagctgattattttgttagttgatggattttcttcctagcatcgatggtgtttacagtctggcatgtttttgcagtgtgtagtactggtttttcctttccatgtttagtgcttccttcaggagctcttttagggcaggcctggtggtgacaaaatctctcagcatttgcttgtctgtaaaggattttattctccttcacttgtcaagcttaatttggctggatatgaaattctgggttgaaaattattttctttaagaacgttgaatattggccccactttcttctggcttgttgatttctgccgagagatcagctgttagtctgatgggcttcactttgtgggtaacccgacctttctttctggctgcccttaacattttttccttcatttcaactttggtgaatgtgacaattatgtgtcttggagcaacaattatgttgctcttctcgaggagtatctttgttgcgttttctgtatttcctgaatttgaatgttggcctgccttgctagattggggaagttctcctgtataatatcctgcagagtgttttccaacttgtttccattctccctgtcactttcagatacaccagtgagacatagatttggttttttcacatagtcccatatttcttggaggctttgttcatttctttttattcttttttctctaaacttctcttctggcttcatttcattcatttgatctcccatcactgataccctttcttccaattgattgaatcggctactgaggcttgtgcattcatgatgtagttcttgtgccttggttttcagctccatcagatcctttaaggacttctttgcattgattattctagttagtcattcgtctaattttttttcaaggtttgtaacttctgtgccattggttcgaacttcctcctttagctcagagtagtttgatcgtctgaagccttcttctctcaaatcgtcaaagtcattgtccgtccagctttgttccattgctggtgaggagctgcgttcctttggaggaggagaggtgctctgatttttagagtttccagtttttctgttgtgttttatccccatctttgtggttttatctacctttggtctttgatgatggtgatgtacagatggggttttggtgtggatgttctttctgtttgttagttttccttctaacagtcaggaccctcagctgcaggtctgttggtttgctggaggtccactccagaccctgtttgcctgggtatcagcagcggaggctgcagaacagtggatattggtgaacagcaaatgttgctgcctgattgttcctctggaagctttgtctcagaggagtaccgggctgtgtgaggtgtcagtctgcccctgctggggggtgcctcccagttaggctactcgggggtcagggatccacttgaggaggcagtctgtcggttctcagatctgcagctgtgtgctgggagaaccactactctcttcaaagctgtcagacagggacatttaagtctgcagaggattctgctacctttgtttggctatgccctgcccgcagaggtggagtctacagaggcaggcaggcctccttgagctgtggtgggctccacccagtttgagcttccaggccgctttgtttacctactcatgcctcagcaatggcgggcgccccctcccccagcctcgctgcccccttgcagtttgatctcagactgctgtgctagcaatcagcgaggctctgtgggcgtaggacccacccagccatgtgcgggatttaatctcctggtgtgccgtttgctaagaccgttggaaaagcacagtattagggtgggagtgacctgattttccaggtgccgtctgtcacccctttctttgactaggaaagggaattccctgaccccttgcacttccagggtgaggcagtgcctcaccctgcttcggcccacgcttggtacgctgcacccactgtcctgcatctactttctgacactccccagtgagatgaacccggtacctcagttggaaatgcagaaatcacctgtcttctgcatcgctcatgttgggagctgtagactggcgttgttcctattcagccatcttggctccacccactgtttttttgtttttttttttttttatagactgggtctgtttatgtagcccagcctggctgccaattctttggttcaagcagttctccaccctcagcctcctgagtagctgggattataggaatatgctacaaagccctgtttcaagtataacttgtattttaaatgagtcctaagtctttatataactgatctctttcagtctcttctagtacacattcagctttcctgtgcacatatataattgtatgtcatgcctttactagaaataccacctatcaaaaattgaatttattaggctgggcgcagtggctcatgtcggtaaacccagcactttgggaggccgaagcaggtagatcagttaaggtcaggagttcgagaccagcctggccaatatggtgaaaccccatctctactgaaaatacaaaaattagctgggcgtggtggcatgcacgtgtaatcccagctactcgggaggttgaggcaggagaattgcttgaacccccgaggcagaggttgcagtgagccgagattgcgccactgtactccagactgagtgacagagtgagaccctgtctcaaaaaaaaaaaaaaaaaaaattgaatttaccatttaaccttaaatatcagatcttaaaaaaaaaatcaattggtaatttcctgggtagtgtagagcttagagattagtgttgtcttatatgactcatggtcaggcatctgtttttctgttctgaaatttgcagatctcattagcatcattttgcaatgttagagcagacataaaagttagattatattcttctttcttaggagactgagaagataatagtgtcattaactgaattagggaataaaggacagaggattttgggggaaacaatgggagaaggggaaaaaggagctgaatcagttgcagagttatgagttttgttttagacgtgttcaatttgaggtgctcacataaaaaaattttttctcagtgctacttccctcattatttaatttctaaacttttataataatctattgctaatgtttctgcttttgctcttggccaaatactcagaagagtcttcttcctaaatgaaatacttcatctttttattctcccattcataagtttaattggcttgtttaatatatagaataaagtttaaatttcttggactaataggccctctgccatttgccctagtttctttttacagcttgatatttcactgctctctatttaacctaaattgggctatccattatcatttcagtaaggcatgttaccttgccttgttcaacttttcctttttcattcctgcaggtacagtcttttcaaatctcttgttctttgtgatgttttcctgactactcaatctcactctgatttttcttttctcaggataaggaaaggttaggttggataggttaggaaaggataggttgttaatttagtattatatttttcagttccctttttctcatagggaggcagtagggcaaagtggttagtattgggcatttaatagctgtgtgattttgaagcatttaatctctttatgccttcgtttcttcatctataaaatgaggatattcttgcattcatagagtcgattaggaggattgagatatgaacataatgtctttagcagtatgtgacatattgaaagtgttacaatgttttttctgtttgtctctttttcatccatccctgccttccttccttctgtttgtaaaccaaaaagcatttgagacaagtctcaatttagaagtttattttgccaaggttaaggacaagcctcaggacgtcctgatgacgtgtgcccaaggtggtcaggctacaccttggttttgtgcattttatggagacataagacatcaatcaatatatatcaaatgtacattggtttggtctggaaaagcaggacaacgttaggaggaaggggcttccaagtaataggtggaatcaaagatttgcagttggttgaaagaatttatctaaagacctggaatccatagaagggagtgtctgagttcagataagggattgtggagaacaaagttcttattatgcagatgaagtttccaggtagcaggcttcagaaagaatagattgtaaatgtttcttaatcacacttaaaaaggtgccagactcttagttaattctctcctgtatcagagaaaagaccaccaggaaagggaaagggattctctacagaatatagattttccccacaagagacagctttatagggccatttcaaaatatgtataagggttatactttgatttctttcagggcctgtgatctgtcatgtgatgcaatactagagtcagggtagaatttggtgtcttattgctacaaaaagtcttaagatttctgttttaatgttaatactggtcagttgtgcctgaatttcaaggagaggcgggtataatgaggcatgtctgacctcccactcccatcatagcctgaagtagtttttcaggttaagtttggaatgcctatggcttgagcggaggggtccattcagatagttttgggggctaaggattttatttttagtttatgcctactctccacttttcttaagagaagctctacttttcttatccttgaaatacttgctgcctagtaactgctatttctttgtgacatgtataatcataaacttttttttttttttttttcacacagagtctctctctgtcacccaggcaggagtgcagtggtgcgatcttggctcactgcaacctctacttccctggttcaagtgattcccctgcctcagcctcctgagtagctgggattacaggtgcaaagcaccacgcccagctaatttttttgaagttttagaagggacagggttacaccatgttggccacactggtctcgaactcctaacctcaggcaatccacctgcttcccaaagtgctgggattataggtgtgagccaccatgcctggcctgattaactcttaaattactaactttttagtgtttacataggttttgttatttgagtaaataggtaaaatacttagataaaggtatcaattttactactttttttaaatttttttttcctgaaggtgcctaacacatacttttctttgctcagacatcttttgctgagggaagttatatacaagaaaacaaagtgcagttaaattaatctgttcaataacccagttccccccagtgaatttggtaaaaattagatggtagaatgtggtttagaccagagtagttctgtatttactttttttttcttcctccctgaatttctgcctatttcaccttctaaatcttagagtggatctcacagtttcaattctgtggtttaaaaaaagtgggagagggaggtggcaatcggatacacacccacatacccaccaatatgaaggaaaggaatgtcataggtagcaataaagaacaaatttttcataacatgttttgcaatttctctgatatatgttctggcatagtttaatagtttgattattctgtggctggggcagtatcatgggtcgggggctatgtgggtgaaaagaaggcagaggagagatggctaatggttgagtcatctgggaaaatgactctggtccttttactgagtagcatgggtctcagagattagaagagcagagattagaaaagcacatagaagtgttcacagtgaatatggtgatctcttttattgttaaaatgtggcccaatgaatgttcagcttttggtcattaaggttagttatatcttcctttgagatgatcaaatgaaaagaatacaagggagggtcatttctttttcctttttccagcctgtcataaccccttttttccacccttgatagaagatggaaacagcctcccttgtggactaaagttgatgtgtgaagagattggtgctatatattcctctttatttaagcatgcttgatatatatattttttatgactaaagttaaggttttaaatattgctgttaaggtagagttgagtcagatttctatttttaccatgaaagttagtgaatgtgttttccctggctctctcttgtgctctccaagtgtacctctgagtaaatgactttatttagctttctgtctttgaagtgtgcagtattactctcagagattctttattgcatctggctgttgtcattgtacttgctactggagaggatagaggtgaatgttcctaaaagccttgtagcagttcatttctaagcccctttggtgaccagagctgacaggtgagtcttagttcttttctgcttgcgaagtttggtgccacagggttgaagagcataaagtacatcacctcttagtttcactgtccactttctccttcttcagctctttcctgcatcttaacctcttgctctgtagttttagacaaggacttcaatgatgtagtcacttgttttcagttttattctaaatgttattcacactattgtgaatctgggagttgatggttttctagttttagttgacaaaccctgtgagggacagggagaaaagtgagtaacatgaactcatgatctgtcagtatgaaagtaatggatctgtttacgtgcagtgtttgccacacatttttcctctgttaggaacttttgtaaggaaatgacattcttgcttgtttcatgaggagcaaatggcagtattttcagaaatagctatgtggtccccaagagaaaacattctttggccatgaaatatacttaccagacattttggaaaattgcaacctaaataagatatgactgtaatgcttttggtgttaaagattatcttaaaatattttagctggtatttttgagaacagagtttcttttattagtaattaagggctttcaatgaacgaaaactgtgtaatggtccacagtgatgcctactggttaaaagcagatgatgaattcaaaactaatggaagtaatttcagtcttaatagtaaatattataattattcttattttgctttatttttatttatttaatttgattggggcatgatttgaatggaaactcacttttatttgatacaactaaaatgtaattgaaatgaaagcaagttcaaatcattgaaaggattaatttctaattatagtatatacattgtcaaagtttcctaaccataattaagaaagaagtgtttacatgtttggtaatgtttggtttatagtatatattcctatgagtaccatgattaatgctcattttttaagcacaccaaaatttcaagtttttaaaataaattttgtttaggcaaataaagttatttagtttgtttttcttttgaataataaatacatgtagtttgcagggaagctttactcactttttttttttcagtgctatcattatttaattgctatgtattatatacattttgtatactttggtatattttatattggtaaaatcaatggcaccacaaattaaatatgtcaagcacttatttttaaaattacactgaatgactcctaaagatgtctatacaaataatattataaattttatgatgtagagagataattaaatcaatcaaatacagtatctttaattaagacaacaggaaaaccccaaagaggatttggttactggaaagaacagcacttgaaaaagaacagcctcattaagaaatgtgaaagttatgaagagttaaatacaaaagtggacaaacatatctcacttagagttctttacactgcatactctgggagtctatgctattcaaagcacctcaaatttggaaatttttttttttaaattttttttatttatttattattattatactttaagttttagggtacatgtgcacaatgtgcagtttagttacatatgtatacatgtgccatgctggtgcgctgcacccactaacttgtcatctagcattaggtatatttcccagtgctatacctcccccctccccccacctcacaacagtccccagagtgcgatgttccccttcctgtgtccatgtgttctcattgttcaattcccacctatgagtgagaatatgcggtgtttggttttctggtcttgtgatagtttactgagaatgatgatttccaatttcatccatgtccctacaaaggacatgaactcatcgttttttatggctgcatagtattccatggtgtatatgtgccacattttcttaatccagtctatcattgttggacatttgggttgagagaatactacaaacacctctacacaaataaactagaaaatctagaagaaatggataaattcctcgacacagacactctcccaagactaaaccaggaagaagtcgaatctctgaatagacctttactcacttttttttaacaaaaatttgaaaactcatcgttttcatttaatcccattttgctgctaataatttttaaaaaatagagtaaaaataacttgttctttcttttgctttaaaatgtttgtcatctcacatatgccagatttattggactgcagtagttttagtgcattttggctggaatgtttattatgacatcaccataatctatatacagtatgtgatttcagatggtttcagtgttaaatattttcataattatgctagttttggcagttcacttggaactttttcacatctttttaatgaacatgttttacttctgggcttctgagacaaccatatgtttcaaaaattaataatgtgcttttaatgttaatgttgtgcagaagtgtatgactatggacatttttaaggatttaagttgaactaaaagtaattacagtgaggctttattcacagtagtagtcttttagtatttaagactgtaacatcccccaaataacagaagatgtctttatgaatattgaatagtgaagttattttgtggaatgaaacctgtgatgtttgtttttcattaacttaaaatgaacataagttcatgagaaaattttcagtgttgtttatggttgcaagtctttttgcttgtatgaagtttcaaacaaatttttttctaacgtatcactaccatctgaagccatgctgttttgtaaaacaccttttattgtatatttctcttagtgtgatagtgaataaaagttttcttaaagaggtcttattgtcgttcttatttgcctctagtaccctgttagtttggtaaactagtgatgattattcttttatatgctcttgaaattttcccttcaaatatataaagtagaaaaactaaatttaataccattcttgtaagtattataaaatagtgttattattgattaatgaattcatggtgcgcaatgcactctcagctaccctttgtgttggtatctttgatctctcactccacatgtgcatctttacttcaagcaaaaatgtattcttttatccttaaaaaaggaacaagaagttagttgccagctgatcttccctcatgttactactctacctattttctcttcgtaatgcctatcttcgtgaaagagcaatttattttaattgactccatggtaacttctcattcactctgagctactcatttactgctcccacttctctccctctgtgggaactgctaaatcacctttctaataggttagtggcagcctcctcctaattaccaaatcctgaaacaggtcaactagaatgaggactaagaatatctctatagttgttaacattaccccatttttattgaaaggtctgtgcctttaacttcttccatcttagacactgtatactctggccttatttgactaatcatcattctttgtacgtgctacatacgttgatactgttttgcttttgcttatggttcctcccaccacccctcatttagccccagtctaaacctaaaacatttctacatttgattttgaatggcctgatctttctagttcttccaaacagaatgactctttttatactccttattacttaaaaacaaacaaacaaacaaaaagtattgcttttgtagaattagttatacatgtgttcgatagattctgaagtccctaaggacaggatacaaagataaatatatctaatttatccttgtaaatccagcaatttggcatgtaagagtattatatacatgttgaatcaggacaggaaaaaagtactcatttgcagttataaatacagggataaatttcaaaaatatgtataatttatttgtttctgttactcatattgaaacccagttaaaacttatacctaacatgaatgataatttagtatacattgtttagtatacattgtttaggagaggattataaggattattaagattaatcattaaagatgaccaagatagcttggattgaaaatagtgttttaacatataaacaacaaatggggaaaaattaagaacctttttatttattttgcacttacatagagatggatgttgtttaaaggctttcattaagtcattttttcttttgctagagccataaataagaattctttggagattgtcaagtagtttgttttgatatcagctaaagaaagaagaatttatagttttaaactatgagttattaatattttttaaatgctgtttgagaatgcaaattatgaaaattggttatgtagtttttagagctaaaaaataaaattatgttgatcttatctcctgtagctaccataaactgcatatattaaaaaattttttttcttaattcttgagtatgatcgatggttttctttttctttctttaaaataaaaataggatgaccatgaaagctgtggttctaattctaccaaccgtagtactgctgagagcacaaaatcatcaatcaaaccgcggagaatgcagcaggctgctcctacagatcctgacttaccaccaggtaacttctaatgggatcaataaaaccaaatttcaatttttggccgggcatggtggctcatgcctgtaatcccagtgctttggggggctgaggcgggtggattacttgaggtcaggagtttgagaccagcctggccaacatggtgaagccatgtctctgctaaaaatacaaaaattagccgggtgtggtggtgtgcacctgtaatctcagctactcgggaggctgaggcaggagaatcacttgaacctgggaggtgggggttacagtgagccaagatcatgctactgcattccagcctgggtgacagagtgatactctgtctcaaaaaaaaaaaaaaaaaattgatcattgttttagtactttgtagaatatatatttttagtatcataaaacttttaagctatatgtgcatatgtacttgctacatgacttcagaacaaattgggtcctgggattacaggtgtaaaccactgtaccaagcccaaggtacttttatcttgagactctggtatcttttaggccagactttggattctgctgctttcagccttttcaagaggaaagagtctggagaagacctatctgcttcttaatatccccaggctggaagtgatacatattcctctgatcaaatttcattgaggagaactatttgcagggatattacttatgacttagaagttaaatctcagtagcaattccacattcctgaagtgggagcacaaattattgatggatagctagcttctctgccatacaggtgttctttcttattaatgtatcaatccattcttaaatggattatgcttcaaagtattattttgttaataaccttcaagatagctgatgtttatattttattacagaaaacgtgatcattagagagcctttatttcattttaatttgactgaatttcaaattattgtttagtggagacaggctgtttatttccctaaatgtgtatcactatttgaataatatgctagagcagctcattgagggctatttttgccctcaaagagttaactgtttaggataggagccttttaaactatcaatcacagtacaaagccaaaggaagatgagctctaatgaaccacaagtaatatcttttgggcactaaaaggagggagttgtcatgtccaggtgtgtgtggcttctgaacacacacatgaaacagaggcaagacagatcaaaaatgaaagtatgggagataatataagagacaaatagtagccaaaaataaatctgtatctttcatataaaaatgaggcaaaaataagaaaactaaagacaaaaaacattaatggagataggtaataaagatactaaattataataaaatatatagttctccagaagatacacattgactttgtatggacctaacaatgtgactttgaaatgtcataaatcaagcagggaaaaaaaatctccagattagttcactggatatcaaaattttgttttagtagatacatgtaaactctgcactaggcacataagacagtatacatttcttttgatgcacacattgagtatctacagatattaacaaagacttggttgaaaaggaagtcttgagaaatttcaaagcatcactatcatgtatctttctctctgaccacaatgtgattaaattagattataattattgatgtggttgtatttacttctgccatttcatttgttgtttttctttgttcactctgttttttgttcctgtttcccatctcatgcctactatttactttttaagagccctgaagtagctgctccatacattctctccaggttttatggcttcagtcactgggaaagacagggtggagtgtttactttatcttatccagaactgaaaccggttaacattgtggtgtacaaccttttagagagtcttttcttcctttacacacacacactcacacatatgcacacaaaaacaatttgttataacctaaatttttcatttaatgttatgccaaaaacatgtttccaggccattcacattttttacgttgttatttcaatcagtggcatacaatcctgttgtataactcttctacagtttatttaaccagtcctttttttggtttgatatttaggttatttgttatttttagttttgtaaaatgctttagcaaacatatgtaggtaagtctttgcatacacctctgcttatatctttaggaaaactcctttccaatttatagagtcaaaatttgtgagcacttttaaggtttttggcataaaatggctaaattactctgtggaaagtttgtaacaatactttattccaatcacatttttagtgtaatgctgttttttattattaaaaaaatctcttaaaacttttataggtggaaaatgctatcatacattttattgctaattgggatttccatctttaccattttctttttatacttttttgttaggaaagctaatttttatattttgttagctgaccagtattcagtattttttagtcgcttcttttggagtttctatataaaaagtactgtcatctttgtgaaatgacttttttccctcctttgcaatacttatacactaatttctcttttttccctttatttcattgtctagaacttctgtgaccatcttaaataatatagtatcaccaactcacatcggtttttttagctcctacagtaattgcccaaaattattatctagttattaaatctgatgtttttaattcatattttattgggcctgtctataacattgacagtaaagattttttattcttgcccttttaacaaagtttttattttgaaacaatttcagcatttcataaaagacaagaacattctaaagaacttattttccctttaaccatttgagcataaatttcctatctgatgctacataatgctcaaataaattttacaccaaaaacttgactacgatgtttttatgtactgtaaccaagtcatcaaccgtggcatttctgattatgagcagcttggcttcccagtgaccacatcaagatgaatcaattgcagatggtgtctctttgtaaccaaaattttttgatacatgccatttaagactatcagagaaataaataagatacagtcttttttctctaggacttcacagtttatcagagaagataagcatacatatacataaaaaatgactaatagtaacataagcccaagaaaagtggtagagacatttctctttaatgttgaggtgtaggatggaggacattggagaagacaatataaggcagaggaaaattatactgcacctgaacaagaagtgcgaatggacaaaaagtattgtaaaaaggaggaagaacacgagtaaagttagtgaaaattagtgttttcatctgggcctgtggatatagatgtatgtttggaagaaggggttatatgaggtatggggagaggtagataataagaatttctggagaaaggttgactagtagcaggctgttttagagccatctaatattacatcttgtaggttctcatccttagtgtgactttctattttcagatgcgtgtggagtagacccggatgatgaacaaatatactcccagggagtctctaagtatggagtgatgagagctattagatctacttgacactatcttgtaccttgcttagaactaagttactgtgagggattatagagacggtttgtcatttattccactgataagtttctgttacttattttgacattgcatttttagtaaggaaacagtgatagtcttctacagaagtagttctttcgatatttgattcttttactttggtgaagtggcttattcatctcaatttgtatgtcagttttataatacaaaatggaaagaaaaaaaaatatatatattttgagacacggtttcactcctgtcacccaggctggagtgtgatggtgcaactttggctcactgcaacctccgcctctggtgctcaagcgattctcttgccttagcctcctgagtagctgggactaaaggcacatgccacgacacccagttaatttttgtatttttgtagagacggggttttaccatgttgcccaggctgatctcgaacccctgagctcaaatgatctgtctgcttcggcctcccaaagtgctgggattataggtgtaagccaccatgcccagccagaaaatatttttaaaaagatgaacaatccatcagtagtgttctatcagttaaaatacatattgtgttttgtttctattactttgcattatacttctatgctatttttgatactgttttaaagataataaaaactcatgaatgcttacgtggtttttaagagtactgtattggccaggcatggtggctcatgcctgtaatcccagtactttgggaggccaaggagggcggatcacgaggtcaggagttcgagaccagcctgaccaacatggtgaaaccccatctctactaaaaaaaatacaaaaattagcctgacgtggtggcacgtgcctgtaatcctagctactcaggaggttgaggcaggagaatcacttgaacccgggaggcggaggttgtcgtgagttgagatcatgccattgcactctagcctggacgatagagagagactagtctcaaaaaaaaaaaaagttccctgttcatgacaggtttttgagaaatagggaaaccaatattagtcatgctcacttgacttcttggaaacatttttatttatttattttttagatggagtcttgctctgtcgcccaggctggagtgcagtggcacgatcccggctcactgcaagctccgcctcctgggttcacaccatcctcctgcttcagcctcctgagtagctgggactacaggtgcctgccaccacgcccggctaatttttttgtatttttagtagagacagggtttcaccgtgtcagccaggatggtctccatcttttgaccttgtgatctgcctgccttggcctcccaaagtgctgggattacaggcgtgagccaccgtgcttggccccatttttgtttttaaaatctgcattgagtagtaataatatggggttatgtacattctaaggttaaaatgttgatacttacaatttcttttggaggtctcatttattaagaattattttagcatctactcatggaagagtaattgttactttaaatctattaatattttgaatgttaattttatagcatgtgataattggcactctaaaagctgctaatagtttctatataggagaaaacctcgaatctaagttgtattacatttctttcctatttgcatcattgggaatgaatgaaggagttgggttttgcacacgttatggttgaatagatttaagtaagtcttctctcagcaggctttagtgtaggtgttaacaatgtcagatgctgacagaagttgattatgttttgtccagtaaaattctgggttaaagaatacaaccatatggttatttcatgaaatagctaaaattttaattaccttttaaatagttttctttaatagtggaaatgcattaccttttagttagctttttacagtggaaaagattaatttttttttctcctggcttttaaaatgctttttataaagtgttatttatatttttaactaaattactcaataatgtatccatgtacacacttacatgagaaacataagtgagattatggagtattcctcagtagcatgaaattaaaagaaaaattttggagattctaagcaagccatggagaaatagaatgttcattaattacttttagtgtttggagttaacctgtatttctgtttctttttcctatttccctgtgttcttattctacttttatacattctccttccttccatacttttgttttttcatttttctgtcttcttcatggtagtattttaaaaatatttctttaactcttcctgtctacattttcttcttcattcatattttcccctctactctattttaacattaaatattagtaagtgagtagagttgaatccattatgatggtcatgtttcttctatccgaggcataacttttaaatatttttatggctaaactaggaagagatgaaggtagctggtttaaaaagaggcttaagcttaaagaagaccatcttctaatatactgtataatcagcatatagtaacattgcttcattttggaaaatgtttatataatacaataagcaaaaatcaaacaaagtacttgtagaataggataatcattgtatgggatctaatattatgttatcaaaaatatatatggtctttgtggtttctcttagtatatgaatacttcactatagaacttcttgataatgacgtttgttggggtcgatctgctacttattacctgtgtcactttggcaagccttttaacctatctgaacttcagtttctctttgggaaatatgctaaataataaccacctttctcatacattaagttcaataacactttaagaaataattatttactgagagatttgtggctaattaaattctttttttctattttataggttatgtgcagagtctgattagacgagttgtaaataatgtaaacattgtgataaataatctcatactaaaatatgttgaagatgatatcgtcctttccgtcaatatcacttctgcagaatgttatacagtaggtgaattatgggatcgtgcattcatggatatttctggtgagtaaatatggagaataccgtatatttttccataattgaaacaattaccttaactcttaacccttctttgggccaactgagttgctggtaaatgttatcaaatcttcatgcctccagtgtgggaaaaaaatgcacatatacaaaatgttgcatataattacaggaggttagtagacactccaaattcagaaatctatacttgtggtttttgtttgtttgtttttgagacagggtctggctctgttgcccaggctggagtgcagtggtgtgatctcagctcactgcaacctctgcctcccgggctcaaacaatcctctcacctcagactcttgagtagctgagactacaggcacatgctgctatgcccggctttttttttttttttttttttttgagatggagtcttgctctgtcgcccaggctggagtgcagtggctcaatctcggctcactgcaagttccacctccccgggttcacaccattcttctgcctcagcctcccgagtagctgggactacaggcacctgccaccatgcccggctaattttttgtatttttagtagagatggggtttcaccatgttagccaggatggtctccatcttttgaccttgtgatccacccgcctccgccttccaaagtgctgggattacagatgtgagccactgcgcctggccaaatttttgtgtttttttgtagagacaaggttttgccacattgcccaggttggtcttgaactcctgagctctagcgatttgcctgccttggcccctcaaagtgctgagattacaggaatgagccaccatacctggcctatacttgttttttaatacttttaattttcattctttcttacttgccacatgcttgtttcaaatgtgatgtataatacagtcatgcattgcttaacaacagggacatattctgagaaatgcatcttaggcgattttgttgttatgcaaacatcatagagtgtacttacacaaacctagatggtatagccagtacacaacctcaggtatatggtattggctattattgctcctaggctgcaaacctgtacagcatgttactgtgctgagtattgtagatagttgtaacacagtggtatttgtgtatctaaaaacagaaaaggtatagtaaaaatatagtattataatcttatgggacagccatcatagatatatagtctgttgttgacttaggtattgttatgcagtgcatgactatattttatagtgccatgggttgtagcaataaaagttaaatgatatttagtttgaattgtttatgtttttgaaaggtgaaaggcatcatgtttcatttacaaagcttggtgaaggcaaggcaatatatctgattgatttatgttttaggcttgtgtgttccaaagcacatttggaatttcttccttcttttcctcccctctccccaccgtcccccctcccctctccctttcatcctcccttccctttccttgcttctcccctgcccctttccctcttccccctttcctttttgagaaagggtctcattctgttgcccaggctggagtgcagtggtgctaccttggctcactgcagcctcgacttcctgggctcaggtgatcctcccatcttagcctcccaagtagctgggaccacaggcgtgcactaccatgcctggctaatttttgtatttttttgtagagatggggttttgccctgttgcccaggctggtctcaaactccttggcttaagtgatccacccaccttggcctcccaaagtgttgggattacaggtgtgagccaccatgatagccctggaatttcttgattatcctgaagcctgtttttatctctttttaatgtttagtcatatattcctttattcatcataaatcccagttaaagggttaaagcaaagtgaaattgagtctcaagagtatttaacttgcctgattaaggcatacaactaggaagtagcagaactggaatagagttttattattatgtgttttctaagctttagtcttcacatttaacaaaaggagagtagtcctgattttacaactttgttgtgagcataaaagtgtaggtaaggcccaagcatcatttcttatatatcgttaatgcctcctttgcatcttctgtggaaagaaatatttgattaaaaggctggaagaagcagctatggaaaatagaaaacaaatagaactggacaatgtaggattgtattaatgagttgacatttgtggtgaagaaattttattttaattaattaattaatttttttgagacagagtctcgctctgtcacccaggctgaagtgcagtgacgcaatcttggctcactgcaacttctgcctcccgggttcaagcgattctcctgcctcagcctcccaagtagctgggactctaggcgcctgccagcatgcctggctaatttttatatttttggtagagacggggtttcaccatgttggccagtctggtcttgaattcctgacctcaagtgatctgcctgcctcagcttcctagaatgctgggattacaggcatgagccactgtgcccacccagaaatttaattttagtatagaagcaatttagtatggtatagaaatttaatttagtatagaagcaatgccagttttactttgggaaattatttatagtgaattagaattctggatcaggagttggaagatcttagtttgaatcttctctccactgctaatttacagtgcaaacttgggtgagtcatttataaaatgactgcttctaacttgccagtgtactcttcagaagcaaatataccatatgaaagctcatgatgatggtggtgataaagacagtgaaaatagtatcttctgtttatttagtaccagggctagtgttacatattttatattaattatcttgtttaaccctttaactctctgaggaagaaactattattttcccttttattagtttttttttaaataattttttttaattgaagcataacatgcaagaaagaaagagcattaagcaaaaacacatagctggccgggtgtggtggctcacgcctgtaatcccagcattttgggaggctgaggcgggcggatcccctgaggtcaggagtttgagaccagcctggccaacatggtgaaacaccatctctactaaaaatacaaaaaaaattagctgggcacggtggcaggtgcctgtaatcctagctacttgggaggctgaggcaggagaatcacttgaacccaggaggcggaggctgcagtgagtcgaaattgtgccactgcactctagccttggcgatagagtgagactccacctcaaaaaaaaaaaaaaaaaaaacccaaaacaaacaaacaaacaaaaaacccatatagctaaacgacataccacaaaatgaacatactcttgtaaccaccaccaagctcaagaaattgaacaatatcagcacccagaagtgcttgttgtacatatactcacttactactgccccttctttccccaaagcaaccactttactgacatctgacaccatagtagggtttggactctttttaaatttttgtatgaatggaaccatatgtattttgggcctagattattttgctcaatattatgtaaatgaaatttattcaggttttcgtctgtaacaatagttcagttctgcgtgtatatatctattccctctccctgcacaatcaggtgagcaagggttggggttctgcctgcactggtctttcctggatatatgtgggatggcgagtttgcaggtctggtctgtgttgtgaataaaacatttttttgctcagtgtaccattgatatagatttaattatgtccagttttggctataatgaataatgctatagcgaacattttcatacatgtcctttggtggacatatacatacatttctgttgggtatatgcctaggagtgaaattactgggtcatagtgtaggcctatgttaagcttcagagatactgacaaatagttttttcataatagtaatgccatttttttactaacaagtaatgcacgaggctgtattaaaatattgcagttaaaataagaattgtaatatctttgtgagggtaaaaaggcaagccacagatggaagtgtatattcttgatacttaaaatttgcaacatacttatatccacaatatataacttctataaatcaataagaaaagaatagacaactcagtagaaaaatggacaagagacttgaacaaacacgtaaaaaagagtataccccaaagaccaataaacataagatgttcaattaacaccaaatcagattgcactaaatacttgccataatggattaaaaaataaaataattgggccatctatctattccttctcctttaactcattccttccccttacgtattttttttttataatttccaagacttttatttcagtataaaggtcttcagaatatctaatcttttctactattagaggcagaatcctatcatctcccatgtggttgacattcaagttgttctaaaatattgacattgcccatagtgctggaatgtacatccttttttatgtttccttgttacgtgtttgaattctgtaaattatgatcaggaaaagaataactgcatatgtaaacattcagttatgttttatattgctgaattgttctctaaaatgattaaatcaatttattaccatccatactatctgtgagaattaatatttctttttattcctttccaagttgtattttaggttgagagggtacatgtgcaggtctgttacttgggtaaattgcatgttgcatgcatttggtgtacagattattctgtcactcaagtaatgagcatagtacctaatggttagtcttttgattcttaccttgctcccaccctccaccctcaagtaggccttggtatttattgttgccttctttgtgtccatgtatactcagtgcttagctcccacttataattgagaacatgcagtgtttggttttctgttcctgcataatttgcctaggataatgccctccagctctatccatattgctgcaaaggacatgatttcatccttttttatggctatgtagtattcgatggtggatacgtcttgtattttctttatctacttcactgttgttgggcatctaggttgattccatgtctttgctattgtgtatagtgctgcaatgaacatacacatgtgcgtgtctttatggtagaaagatttatattcataagcgtgttgcctatgcttttgaggtcttagtcataaattctttgcctagaccaatgtcaggtcttacatttaagtctttaatctatctcgagttgatttttttaaatagtgagagataagggtctaggtttgttcttctgcatatagatatccagttttcccagcaccatttattgaagagactgttcttttcctcagtgtgttttcttggcccctatatagaaaatcagttggctgtaaatgcatggattcatttctgggtttttgattttattccattgggctatgtgtctttttttatgccagtaccgtactgttttggttattattgcttttagtatattttaaagtcagggagtatgatgcctctagctgtgttctttttgcttggggttgctttgagtatttagggtctttgtggttccataaaaattttaggattgttttttcttatgtctgtgaaaaaatgtcattggtattttgatagggattgcattgatttcgtagattgctttggatagtatggaaatgattttggaagaattccctccacttcaattttttggaacagtttgtgaatattggtattagttctttaaatgtttggtagaatatgacagtgaatccaaaggtcttaggcttttctttgattgctttttccaggttttggaagttttctctatttctttgaataagcttcctaacctctttttaaaaatagtattcttatatgttgtattttgggtttgttgttttcaatcaatactatgcttttaatatttctatatattggtgtatatagttgtagagccctaatttcagtgatgaataatattttactgattaaattgtagcacatttctaaagtaagtaccagaaactagaattcattttctaagtttttgaaatatagttgctgttatattttgtgtttaagaaaaaatacctttaaaacagtaatgtcctctttcactgaataataattgtctagggtctagggtatccttgaaatttgaatacttcactttttctttctttcttttttttttttaagagagagtcttaactctgttgttcaggctggagtgcagtggtgtgatcttggctcactgcaagctccacccctgggttcaagccattcttgtgcctcagtcacctgagtagctgtgattttctgcatttgccaccacacccagctaattgttgtatttgtagtagagatggtgtttcaccactttgcccaggctggttttgaactcctggcctcaagcaatccgcctaggcctcccaaagtgctgggattataggcatgaaccaccatgcctggcctgaatagcttacattcttatagcaaagtagataagaacatgcactctgcagtaaggttgccagagtttgaattacagctctgatctttataaactgtataacaatagacagactattaccactgtgcctcagttttcacattttttaacaggaccgtgtaaatattgtcagataagagatgtaaaagacttagtgtagtatctgagtaatagcaaatactcagaaaatgataattgttatcataaagagagggaaggaaacatctacaggatatctttttttttctcatttctggtcctactattgtaatttcttaatttgtgtacatatataatattagtaactaaatcattattcatataatatgtaaatttgaaatatggtagtcatatgtctttttcaactaacagacaactttgaaatttatctgcaaataatactgtttagacacatcttctttaatttctactttttaaaaacttataaaataaaatgttgaattaattagaagttgccaggatatactcagaaatagtgttataacctgaactaaaacacattttattgttttttaaattcccatggctaacttaaaatcactgggcaagtagatttgggcctgatatttacctaggaattgcttatcagttaagaaataagaaatattgatttgctaaaggcttcatttcatacttttatactttaccatcaattgttttatttttattcctttgaaaatatactctagagtgttattggtgatttctttattaattaatgtggtggtgtccactagacctttctgtgataatacaagtgttttatatcttctctctccaatatggtagccactagccacatgtggctgttgagcacttgaaatatagctagtgcaaccaaggaccttaatttttatttttatataattttaattaatttaaatagccacatatggctggtggctaccatattggatagtgcaagtttagagtagcagtgagttttttttaatataaaatgaatgttaaatgaatgacttcttcaaaaaattatctttaatgtggattcttaagaattttattgttatctcattgtgtaagagaactgtagtgaaatttttcataattaaaaaaaatttgtagttaatgtgccatgcagattggggcaaactaattaggtctctgattcttcatatataaaatggggagaattgtgcctatttcataaagttgttggaagatttaaattgtataataaaatgaaaagttcattgcatatggtctggcattatgtattaaatgctccatgaatcttattttctgttattattaattttattactatttatactaataaataatagttgcctttcccctgctaattttcctttttacttaaaatgtttttttttctttttagcaactgatttggtgctgagaaaggttatcaatttttctgactgtacagtttgtcttgataaacggaatgccagtggtaaaatagaattttaccaggatcctttattatacaaatgttccttcagaactcgtcttcattttacatatgaaaacctaaattccaagatgccatctgttattaaagtaggtatctcttttttttgcagttaagttgcatgtctttattttgtttattgactcttgtggatgctaatcattattaacaaatgaagaaattaaccttgtaaatatgtatgccatttgtttttataaaaattttatttatgtttatgatttttatgttgtatttatacatttctgtataacgtattctactagagtttagagacaacttttttctgtaattgtttttttttagtttttccagctgtttattagtgtttctctcttcaagtagatagaggaaataatattaaaaggtatatttatacccacagtggactgcatatcagtattctgtatttcagttcttataatctgttcagcatgatctgctatctatactttttcttctctttactaggtgacttcgtaaagcttgatatactaacctaatagtttattggttcaagaagttttagcttttgatttatgatttttaaaatgtaattaaaatcttagggagttattcaggacatgtctttttattttttatctgcattttcatttaagattaagggatttgttacaagggtatattgtgtgatgcttaggtttgggctcccactgataccatcatccagatagtgaacatagtacccaaaaggaagtttttcagcccttttttcctctccctccttccctccttttagaatccacactgtctgttgttcccatctttatgtccatgtgtacccaagatttagcttccacttctaagtgagaacaggacatgtcttttgatacatgtgaaaattttctgtccaatgtagtgtatgttttcaatgtatgtgattagtatctaagcataaatattgttgtcttatttaacagttttctgaacattgtttgtctgcctatcattgtatcttggaaaaagaattcagtgacttctgatcccattaagtaggttttaatgtggagtaaatgtttattgttgaactacttgcctctgactgtcaaagttctgtagatggaagggctggacttaggtgtctgaacactggtattaactactgttcctgtttgagtatggctgtataaaaattagttttgtttttgttaccttatattttattaaaaatatagtattttctattttacgtagccttactgtacttaatatgtaaaatctacatgtttttttcttggtagtgcttagtcacctgtgttttacttttttccacacggtgtataatgcatattggtttgtttatattctgttactttttccttctatatttgaattagcttctttggcaaagataaacatggaaaagaattaactcagtaatagtgatggctctgtctcagggaaatacgcttattttctatagccttgggttttctagtaaatttggggaatgtgaaggtaaattgaagatacattgaaagcaagtaatggatatatggaagcttactatataaaatactctttttgatcattagtgcaaatgtaatggtctattctaggatgtggttatattagaggaaggtaaaaatagatgaggaaaaacttagtgttggcatataagtaagtttgtgttctcaaaactgattagtcattacatttcactgaaaaagtcccttatcataaataaacttgtataatagttgccaaatatgtgatatcaatgtgttatactcaactgaaatcaattttggaggttttatttctttcttcttttcttttctctctttcttttttctcccctcctctccctctccccacccttcccctcccctctgtttccctcccctctcctccgctttctctccttttttctttctccttttttctttaccttcgaggctccctgtcacccaggctggagtgcagtggcacaatcatacttcactgtaaccttgaactcctggggtcaagcgatccttctgtctcaggctcttaagtagctaggactacaggcgcatgtctccatccctggctcattttaaattgtttttttgtagagacggagtctcactgtgcagcccaggctgatactgaacctcctagcttcaagtaattctcttgtctaggcctcccaaagtgctgggattcctggcatgagccaccatgcctgcctgagttttttgttaatactattgtaatgttaagatttgccattttgggttagacccatcattcttccaagtcctaatcctagggaatatgtattaaacagatatggtcgacctcattaattacttcacagaggtttctcaaaatgttccagatactatatttcttttcttctttttttttgagacggagtcttgctcttgttgaccaggctggagtgcaatggcatgatctcggctcactgcaacctctgcctcccgggttcaagtgattctcctgcctcagcttcccgagtagctgggattacaggcgccggccaccaggcctggctaatttttgtatttttagtagagacagggttttgcccttttggccaggctggtctcaaactcctgacctcatgatccgcctggctcagcctcccaaagtgctgggattacaggcatgagtcactgcgcctggcccctctatttcttttcaaatctttcatgtatgtttattttgaatgtatttatatgttgggttggctttttataattttccattttttttgtgtgagatacatacgttctggtgattatgatgtttatgagatacagatcctatgggtacgtaatttatttaacatttctcctgtttttagaaatttactttgcagtttctcagagcagtgaaattctgtgcatagaactttgaccacatttcctgagtaattccttaggaaagatttgtataattgcaaatatcttttttttttttttaagacctgtgatctgtattgccagattgtttccagaaagatttaaccaggttatactcacatgaacattaaggggagtgcctatgtcatactcttattatccttaaatatgatcatattttaaaaattgccaacttgttgaacaacaaatgatatgtaatttaattgccgtttattagtgaagttagatttttgaaaacacattcactggtcatttgttctttgtattatcagttcaggttctttatccatttttctactgagtattaatcttactcattttaaggagcttttaaaaagatacttatgacagattctttgttattggttttgctgactgcttattaccagtgctattggtgcaatacaagatttaaaagaatgtgacagaggaatttcaaattaaggaaaccttagcagacatgcatactcctttcctgctcacctcccacactcattccccgctttcttacctcttcattgtttattcagtgtatgattattaggtcagtttttaaaagcttgtgctcatatttgaaatatggtatttcacagtccccccatatagttttctcccccttcacatacatttttttatgtgctttgcaccctaaaaatacgatgattaccattactattacttcatctttcatagacactgaaatacattagtcaaaataaaccttctaagagacttgactttatggcataattggttttactccgtgtttagataacagcaggaaaccattacactgaagttgtgtttatattccactgatgtctctttctttaaggagagctttgattgctgtatatcctatttgctagtagttaatcttatttctttgttataatggtttcattttatcagttgaataagttttatgtcatttaaatcttatctacaatttggaaaacttttgttatttaaatcttacttaaaatttgtctgaaaaacttttttcaacatatatttcacttgtttttccatatttgacaaaaatttttattatttacatactttcatagttgtaatactagtcttttccccagttaacatatggttttaggatgtatatgtattctttatggttaataaacctggaaagaatgattagagtttcactaaaatgacataaaatttttattattcttggttttgacagattgttctgttttttgaggataatactgttattctcttaatgttatagagtagctatttggttatataactaactttgtttctggaatagtaatctggaaatctagtgtgattataccttctcactattaattccatttgtatgtacatcatttggtttaatatcgtttctatctaacgtgtattgatcatcatagcaaaatttacttaattcctaagatcttagagtaagtattgttttgatttaagtattaaaatgtttggagcatttcttttatgttatgccatttaaagactttaaaacatttctttatgtaaaaaatactctttttaaacatgcgtttgttggtgttatgtctttttcaaaatgcagattcatactttagtggaaagtttgaaactttctatcacagatcaacaactgcctatgtttattcgtataatgcaacttggaattgctctttactatggagaaataggcaattttaaagaaggcgaaatagaggaccttacttgtcataataaagatatgctaggaaacattacaggtaatgtaaaactttattaaacaaaaactttattttaagactattcttacgttttaccattgggaaactttaaaaaatgtattagcttgagttttacagtattctaatgagatgggctgattgttttttggttgttttacactattttaatttttttgtttgttttgttttgagatggagactagctctgttgcctgggctggagtgctgtggtgcaatcatggctcactgcaacctctgcctctcaggttcaggcagttctcttgcctcagcctcccaagtagctgggattacagacatgcatcaccacgcctgtgtaattttgtattttttttttttagtagagatgggttttcaccatgttggccaggctggtctcaaactcctgaccttgtgatctgcccgcctcagcctcccaaagtgctgggattacaggcatgagccactgtgcccagcctacactactttaattttatctacatgctggataacattctgattttctcctatatgctaaaaataacttctatatttataatagatataagtgttcagaatgtactacttatttatttatgaatgagggttttgctctgtcacccaggctggagtgcagtggcatgatcatgggtcactgcagccgcgacctcccaggctcaggtgatccttctaccccagccttccaaatagttagggctacaggtacatgccaccatgcctgggtaatttttgcattttttgtagagacagggttttgctatgttgcccaggctggtctcaaactcctaggcataagctatctgcccgcctcagcatcacaaagtgctgggattacaggcatgagccaccatgcctgacccaggatatacatttgataaaagttgaagtagtatacctcaagatttcctagtaaataatagtattggtaatttttctgcaaaagttcacttaagttgaattgagttattttagtgctgttaattaatgaaatgtatacttcattgaaggatatgtaatgtgggaaaatacagaaatcattttgatgtatttctttcccttagaattttaagataaaatgggacagatagacatgtcagtagttagttaagtatgatgaatggtagaatggcagaaagtttgataaatatcatgaatgatctgatgtagaaagatgaaaggatgactgatttcaacttggtattgggcctgagactcagaaagttttcaggtgattaatttccatagataaagccctaagagaagggcatttaaaacttaggggcaaataacccaattaaaaatgggcaaagagacatttctccaaagaaggtaaacaaatagcaaacaagcaaatcaaaacctcagtgagataccacttcacaggtactagatgactataataaaaaaaaatacaaaataacaggtattggtgaggatgtggagaaactggaactcatataagttgttgggagtgtaaaatggtatagttgctttggaaaacaatatggcagttcttcaaaacgtgaaacatagagttaccatgttgacccagcaattccattcctacgtgtatatcaagagaactgataacatatgtccatgtaaaaacttatatatgaaatgttcatggtaacatattcatagtagccaaaaactggacacaattgaaatgtctgtcaactgatgaatggattatcaaattatggcatattcatacattggagtattatttagctgtacaaaaaaatgaaatactgatataggctacagcatggatgaaccttgaaagcattatcttaagtgaaagcagccagtcaaaagataatacatatgatatgattccattagaaatgttcataataggcagttctgtagaggcaggaagtagattagtaaccaggagttgcggggaggagagaatgactgcaaataaataggtttctttttggaatgatgaaaatgttctaaaattagatagtggtgataggagcaaaacttgtgactattaaaaaaatcccactgaattgtacacctttaaatgttgaattttatgctatttaaactttatctcattaaaaaaatcttactaccttaaaataaagcatagagaacaacattaatcagagtatgtagatataaaacatacctttatttcacactagagggtaaatttttgttagacaatgcattgctgagacagaaacagtgtcttatacctggaacaaacataacatgtagaagatacttgatttatttttttccaacttgacaaatttcaaatatatggaaaagctgtaagagttattataaggtgaacactcacagacttatcatctggagtcttctattgatattctgttacaattgcttcatcacatattggttcatctaacatccctttccctatttatcaatacaattgtttttgatgcctttcaaattaagttacatacattgctacacttcacccctaaccctcagctgcctgttgttatctagagtttctactaagtggtgggtctttttattttttttggaggttaaatctccaaagtaaaattcaatgagtttgagaaatacatacacctgtgtgatgcaaaacactcatcaagatataggtcattaacatctgagatagtttcttatgcccctttctagtcattcccctttcacctgcctgcctccccgcgagaaaacactgttctgaagttccttaaaactgtagatttagttttgctgattctagaatttcatataaatggaaacactcaatatgtataaaaggcttctttcattaagcatagtgtgtttggtatttatctatgttgttgcatgtagcagtcgttctttccttttcattgctacatacactgtatgaatataccatgtgaatatactatagtttattttaccattcactgtttgatggacacttgggctgtttttcgtttttggctattataaataaagctttcatagatatttttgtacaaatttcacgtagacatgtgctattctttctcttgggtaaatacttaagagtggaattatatgtttagttttcaaagaaacttccataacttttttcaatgtggttgtaccattttatattcctatcaacaatgtgtgagagttgcagttggcctacatccttgctaacattcaatggtgtattttttcacttttttgccattgggatgagtgtgttgtggtatctcatggttttttaatttgcattttttgatggctaattattttgaatttttaatgtgattatcggcctttatctgcctttgtgaagtatgtgttaaatatttgtccatttaaagcttttttgtgtcttttaaaaattttattttactttatgtatttattatttatttattgacatagtctcactctgttgcctaggctggagtatgatggcatgatcatagctcactgcagccttgaactcctgggctcaagcaatcctccagcctcagcctcccgagtggctgggtgggactacaggtgcacgacactgagtgtggctgataaattttgttttgttttgtttttggttgaggtgggggtctcactttgttgcagtaggctgttcttgaactcctggcttcatgtgattctcccatctcgggctcccaaagtgctgggattataggaatgagccagtgggcccaacagggtttgcaccttatataaaacttattctgaactacaatggcttaagtgtcttggtactgttattttagttactctagttaattcttattaagccttttccttctcaggtgaaagaaggtaaacattcataacctataaatgtagaatgttccaagagtctcctgtcataagagtttaaaaagttataaagctttttgagtaagaaaacctgtaaggatgttatttaaagatttaaaggagtatgtgtatttatagatttatcaatggagagtagatatgagtgaatatgctggagactaatttttccatggtgttttttttttgtttgttttttgtttttagacagggtccagggtcttgctctgtcacccaggctgcagtgcagtggtatgaaacatggctcactgcaacgcctgcctcctggattcaagtgattctcccacctcagcctgccaagttgctgggaccataatgggtgcacaccaccacacccagacaatttttttgtatttttagtagggacagggtttcaccatgttgcccaggctggtctcgaactcctgagcttaggtaatctgcccaccttggcctcccaaagtgctgggattacaggtttaagtcaccgatcctggcccctatgaattttacacccggacagtttttttgtatttttagtagggacagggtttcatcatgttgctcaggctggtctcgaactcctgagctcaggtgatctgcccaccttggcctcccaaagtgctgggattacaggtgtgagtcactgctcctggcccctatgaaatttttaaaaagtaatttttttttctaaatttcatgatgcctcttttgtttatattgctataattatattaaaggactttgatggagtttgtctttacaaaggtggcataaattaaagagtagttggaatctaaatctttggtctgccagtttgtaaccaaataaaatttcttggctataattttttcagctgtacaacaggaaaggtataacatatcttacttgctagtaagaaagaggccccaacattattatttttcttaactacatataaaagttgttttattctaatatttgctttcatttttgggataattcttgtttgggcaggggagcattttgcctagaagcacttgccattttttttttcctccatgggtgctgatcaggaaatgaagaatgtttcttgggtctttgtggtattatgtttctgagaaaagtcagtttttcaatatatcagccttatttttgagaggtaggttttttgttgttggtttaaaacattcatgagcgatgttaaagaattaatttattatttgtctttatcaaatacagttaaaagttatgtgcagttgataaactactttccacatcacattaaccataacctactaaaggagaaagatacggtacaacatacagaaagttgagagtcataatgctaaattattggtttcaaatagtaataatcactgtatcatttgtttataccttatattagaaggatatgggaggaaaaattttaaaggatgtctatttctattctcttagttaaatccttttgacttatttaaaatgacttaattttaattgataggttctgaagatgaaacaagaatagatatgcaatatcctgctcagcataaaggtcaagagttatattcacagcaagatgaggagcagccacagggatgggtgtcatgggcctggtcctttgtgcctgcaattgtgagttatgacgatggcgaggaagactttgttgggaacgatcctgcatcaaccatgcatcaacaaaaagcacagactttgaaggatcctattgtttctataggattttattgcacaaaggcaacggtgactttcaaagtaggtcttttctcttgctgtttatatctctatcaactttaatgcttaaatttggattgttagtacaattctagctttattcaagtttgctttgcattcagtagatgtgagatagagtctaacagttcttacttcataaaattacatggctcctccacttgaaatctttgaattctgatcccttcctgtcttcttagggcattctccacatttcttttttattagcttcatggatagttttttgccctattgaatcattcagttggtgtacaaacatgccttaatattgtcattaaaaaagaaaggaacagcaa

SEQ ID NO: 2155 - DNA, 196522 bp, Homo sapiens
  source 1..196522: mol_type = genomic DNA
ggcgcggtacaggagcagcactgccggcgggggcgggtgccagggacttggaggtggaggggacgcggcggtactctggcgtgtgagccgagggtggagtgcagagggagcgggagcgggacgggaggtcttctagctttggttctatggtggcagatccggctgggttccgggaagcgagggcctcgcggggtggctgggttggtgaagggctactgcggccgaaggggagcccgcctcacttcattcttccactctgagggacccgctctcttctggtcactacgtcttcctccctcacttcgcttggcgaagggtgttgtacttgtgaggaagtcgcagctggagctgggagtccgctggagtttttctctgtttctaagaggaggcgaacggccgctttggtggggacttactgctttcggcctgagataacgaacgctctttccttcactctaccgccgacttctaacgtttctgtctactcctttcagcttccgacttcgactccttaccttaaaagatgctggagtcatatgtaactccaattttaatgagctatgtgaatcgctacatcaagaacttaaagccgtcggatctacagctttcactatggggtggagacgtggtactcagcaagctcgagttaaagttggatgtgctggaacaggtaagctatttagctgtcattaactggaaacagttttcagcttgtttagacggtaatctattgtttcctaagctttgactttatgctgtaaaaacgtaacttttctactgatgtattttgagctaccctgaaacaagggggctttattttacactattttctttttctttctttctttttttttttttttttttttttttgagatggagtctcgctttgtcgcccaagctggagtgcagctgcgtgatctcggctcactgcaacctccgcctccgggactcaggcagttctcctgccgtagcctccctaatagctgggattacaggcgcgcaccaccacgcctggctaatttttgtatttttagtagagacggggtttcaccatgttggccaggctggtctcgaactcctgagcttaggtgatccgcccgcctcagtcttccgaagtgctgggattataggcgtgagccaccgcgcccggcctgcataatttttaaaaatagtttgttcccagttttggtatattagaatgggattacttaaagttgctttgacagaaagacgatttcattgttcatgtcagaattgttcggtctacttactcaattttcaagcattatgaatgtgctaatttatgttgtcaaaattctgtatgagcctggaaaacatcacattctcattctcctttttgggcaatggaagggtttgaaagccagcaggaagggtggctggcttgtgggggtcgaggaaaaaaagacaaaaaaaaaaaaaaaaaagagcagattcagatcatgaggaaagatgacatttcccacggcatcctcagagtgttgagtagatacattgagaatggcagtaaaattggaaacttctttattaatcgttttagtttcttttaacatgagatttgtctgatgcaaaagaaccgtaacttcaaagatcacatattcattaattcatttattacatttattagtaacatgccaagaaattctgttaggcttgaggatctgtgcaagctcagaagagtcagagaccaactgctttttaggagataagggaagacttaatctgacagtgatggttatttataatttttagttatagtccacagcctcttttattactcttttattaagtcaatctagacttagcactaagaaataatactcctggctgcttctttttcctcttcccaaggttagttgagtggcttaatatttaatattttcattttattttattttttaatgagcacaaatcccaagtgtaacagctcaatttttttttttttttttttgagacggagtcttgctctgttgcccaggctggagtgcagtggcacgatctcggctcactgcaagctccatctcccgggttcatgccattctcctgactcagcctcctgagtagttgggattacaggcgcccgccaccacgcctggctaattttttgtatttttagtagagatggggtttcaccgtgttagccaggatggtctcgatctcctgacctcatgatccgcccgcctcagcctcccaaagtgctgggattacaggcatgagccaccgcgcctggccaacagctcaattttaaaatgttttacacctgtgcaactactgtccaataaaaaaatggaatgtttccagcaccccaaaaggctcacctgtttttgtaagtactccaggccgggcacggtggttcacgcctgtaaccccagcactttgggaggccaaagcaggcagatcatgaggtcaggagttcgagaccagcctagccaacatggtgaaaccctgtctctactaaaaatacaaaaaattagctgggcttggtggcatgtgcctgtaatcccagttatttgggagactgaggcaggagaattgcttgaacccgggaggtggaggttgcagtgagccgagatcatgccactgcactccagcctgggtgacagagtgagactccatctggggcaggggaacgtactccccactcctaaaagaggcgactggtaatctgacttctgtcaacatagataagttttacctggttttgaacctcaaaaaaattggaatcatttatgtttggcttttttctttcaacctttctaagattaacccatgttgttagaagagtttgtttttcgtattgtcagtactattccattgcataaagattccacaatttacttactcattctcctgttgatggacacttgggtttttaatatttttggctggtgaagaaagcttccataaacattccagtacatctatcttggtaacgtaagtattaatttctcttaggtgtatacctagaaggtaggcctgtgtttagcctgtgttttcattttatattgccaaatagtcttccaaagtggttatatcaattccagtcttaccaacaacttataagcattccaggtatttcacatttttgctactacttgttatgtttgttattttaatgttagcctttctagtgggtgtgtagtgataacctcattgtaattttaacttgtattttcctaatgactaattatgtttttatattcttattggccatttagctatctttttttttttttgtgaagtctaagtcttttttccttttttaaaaattgagttttctgtcttattgatatataggaattctttttttttttttttttttttttgagacggagtctcgctctgttgcccaggctggagtgcagtggtgcgatctcggctcactgcaagcttcacctcccaggttcacaccattctcctgcctcagcctcccgagtaactggactgcaggcgcccgccaccatgcccggctaattttttgtatttttaatggagacagggtttcaccatgttagccaggatggtctcgattccctgaccttgtgatcctcctgtctcggcctcccaaagtgatgggttacaggcatgagccactgcgcccggccaggaattctttatatattttggaaatgagtcctttgccagatagatgttttgcagtatttactctcagtttgtggcttgtctctttactcataaaggtgtcttgatgaataaaagttaataatcttactgaggtccaatttatcaatcttttcccttgtggttagggtttttctagtcttgtttaagaaatcttagcttacaccaacatcgtgaaaatattcttttatatttcttttaggagctttattgaattccatgattcatctcaaattttttttctgcatatgagtaatagaggttaaggttaatttttttccattgatagtcagttgatctataccatttgttgaactcttctttccctactcaattacagtaagcctttgctgtaaatcaggttgccatatgtgtgtggatttgtttctgaactctttattctattgagtggtctatttgtctattcttgtgtcactccatatggttactgtagcttttataataagacttggttggtatctcagtgtaattagtacaactttgttcttttctccttcaagattgtcataactattttaggtcctttgtatttccatatacattttatttttttatttttattttttgagacagagtcttgctctgtagcccaggctggagtgcagtagtgtgatctcggctcactgcaacctccacctccctgtggagcaattctcctgctgcagcctccgtagtagctgggattacaggtgtgcaccaccacgcctggctaacttttgtatttttagtagagacggggtttcaccatgttggccaggctggtctcgaactcctgagctcaggtgatccacccgccttggcctcccaaagtgctggattacaggcatgagccaccacgcccagcctatcatatacattttaatttcaacttataacttttagaattaatttctaaaaaggaaagctgttagtgttttttgctgagattacattgaatctatcgatcaattttggatgaattaacatattaacattgagctgacatagttttgagtttttcaattcatgtacagagcattgcttttcatatttttaggcctttaatttctctcagcaatgttttgaactttttagagaaattttgcatgtatttcattaaattttacctctttttatggatgtttaagtagcattttaaaaacctctattttctggttaggtgtggtggctcttgcctgtaatcagtcacagcactttgggaggccaaggtgggtggatcacttgaggtcaggagttcgagatcagcctagccaatatggcaaaacctcgtctctactaaaaatacaaaaattagccaggtgtggtggctcacgcctgtaatcccagctacttgggacgctggggcacaagaatcacttgaactgggaaggtggaggttgcagtaagctgagattgtgccactggactccagcctgggcgacagagtgagactctgtctcaaaaagcaaacacaaaaaaacctctatttttaaataatttgttaccagtacaggaaataaaatcaattttagtatgtcgacctatccagtggcccaacttgtctaacagtttttggtaggttcttttggattgtccatgttcaatcatgtcacctgcaaataatgacagttttacatctttctatccaatacttgtatcttttatttcatttcatttcattattgcagtgggctaggaccttttatataatgtggagtagaggtcatgagaatagacatccttttttgtttctaatttcagtgggaaagtattcaatgttttactattaagtatgttgttagctataaataacctttactgagttgagattcttttctattaatgattttccaatgagttttaaaaaatcataaatgaatgctgaatttgatcaaatattacacttaatgagttgatatatgatttttctcttttattttgttaatgtggtaaattacattgttttcaaatctaaaccttgcattcctggaataaacctgattatatattatcttttttacatattgttggattcaatttgttaaattttgattgattttgttgtgtctttgcttataagtgatactagcctatgattttcctttctcgtaatgtgattacctggttttgaatgtcatatatatatattggccttattgatttatttgtgaggtattccctctttttataatctctaacagtttatgtaagatcaatgttagtggtttttttaaaattgtgatagaatatgtataatacaacatttatcatcttaaacatttttttttttttttttttgagatagagtttcactcttgttgcccaggctggagtgcagtggtgcgatcttggctcactgcaacctctacttcctgggttcaaatgattttcctgcctcagcctctcaagcagctggcattacaggtgcccacgacaacacccggctaatttttctgtatttttagtagcgattgggtttcaccatgttggccaggctgatctcaaactcctgacctcacccaccttggcctcccaaagtgctgggcttacaagcatgagccatcgtgcctggcccattttaatcatttttaaatgtacgattctgtggtattacgtatgtttacattgttgtgcaaccatcactactactcatctctagaatattttcgtcttcccaaactgaaattctgtatccattagacaccaactccctattttcccctgttcccagccccttggcaaccaccattctactttatgactgtatgaatttgactattttaagtacttcatataagtggaatcattcagtgtttgttctttcgttattggcatatttcacttagcacaatgtctcaaaaagcttatctatgttgtagcatatgccactatgtcctttgtttttatgtctaaataatctattatatgtacatgccacattttgttcattcatttattcgttgatggatagttgggttgctttcatcttttggctataatgctgatatgaaggtaggtgtacaaatatacctgagactgtgcttttaatttatttgggtatatacccagaagtggaattgctagatcacgtgataattctgtgtttaattttttgaggaatcaccatactgttttccacaatgattgcattgttttacattcctaccagcaatgtgcaaaggttcgaagtgctccgtatcgtcactaacacttgttgttttacgtgttttttttttttaaatatagctatcctaatgggtatgaaatgatatctcaatgtggttttaatttgcatttctcaaatgattagtgatgttgagcctcttctcatgtacttattagctatgtttgtcttctttggagaaatgcctatttgagtcctttgcccaattttgaatcgggttctttgttttttgttgttgttgagttataggagttctttatgtattgtggatatcaatcccttagcagatacatgatttgcagatattttctcacatgctgtcagtggcatcttactctataatagtgtcctttgatgcaccaaagtttttaattttgatgaagtccaacttagctatttctctcattcattgtctggatttttgctgtcatatccaagaaatcattgtcaaatctaatgtcatgaaggttttctcctatgttttcttctaatttttttgttcttacatagtataaggtagtgttgcaacctttctctctttttttaaaatgtggatattcagttttcctaacaccatttgttgacatctgtactttcacattgaatggtcttggttcctttgtcaaaaatcatttgaccatagatgtgagagtttatttctgggctctcaatcctattccattgagtaatatgtctgcctttatgatactatcacactgtttggattattgtagcatcgtagtgagtttcagaatcaggaagtgtgagatcaccaacttctcagttttttaagtgttaggaagaattaaacatgaagtcatctgggtaatgatgtaaagttataaactgctgatttaatttaagacatataggatcatttagacttttatttctggtgttgtcagttttggtgagttgtatctttcaaggaatttccctatttcttgaaaattagggatcagcaaactgtgtcctgggcctgcttttgtaaatacagttttattgaaacatagctattcattttgtttattgtctatggctgctttcgccctaaaacagaaggattaagtagctaggacagagattgagtggcttgcaaaagcctaaagtatttactgtctccctctgtactgaaaaagtttgctgtcctgctctaaatcgttatatgtaaggaataaagttggtttttttgttgtttactttttaattttttgagccaaagtctcactgtggctgggcacggtggctcatgcctgtaatcccggcactttgggaggccgaggcgggtggatcacgatgtcaggagttcgagaccagcctgaccaaactggtgaaaccctgtctctactaaaaatacaaaaattagctgggtgtggtggcgggcgcctgtaatcccagctactcaggaggctgaggcaggagaattgcttgaacccaggaggcggaggttgcagtgtgccgagatcatgccactgcactccagcctgggcaacaaagcaagactccatctcaaaaaaaaaacaaaaacacaaaaaaacaaagtctcactctgttgcacaggctggagtgcagtggcatgatcatagctcactgcagtcttgacctcccaggctcaagctatcttcccacctctgccccctctgagtgccagtgccaccatgcccgaataatttttatactttttgtagagacgaggtctcacgatgtttcccaggccagtctcaaactcctgggctcaaatgatcttccaacctcagcctcccaaagtgttgggattacaggcgtgagccccttatgcccaggctggtgtttattataaagctgcctgatttacaaaaatgtatctataggatctgctgtgatatcttcttttcatgtctgatgctcgtaatttgtatttttttcatcgatattgctagggtcttattaattttattaatattttcaaagaactaatttttctttttgttgattcttttttgaattgtacttgtgctttctttgtcatttatttttgttcttatttttataatttctttcactttttttggatttggtttacttttcttttttctagtttcctgagttggaaacttaagtcattgctttttttcagtctttttctactcaaatatatatatataatgctataatttttttctctaaccatatatttagcactgtcatgtgggatttcatgttgtcttttcattaagttaaaaaaattttataatttccattttgatttctttaattattgggttattatttggcttacttagaagtatattgcttaatttccaaacatttaggaatttattaattatctttctgttactgatttctaatttaattccactgtggtcagcagcacattgtctgtatgattttaatttattaaaatgtataaatatatagtctgtttttgtaagtgtttcatgtgcaattgataaaaagtgtgtattctgcacttgttgctgtagcattctgtaaatatcacttaccagaaattggtcattagagttcttcaaatcttgtaaatccatatggattttcattgtttgcttattctgtcagttactagatgatgaggtatgtctggagatatggagattgtgaatttgtgtatttctcatttttagttttgttagttttcactttatatatcttaaagttatgttattaagtgtatacaaatttagtatcatgaatctcattgtttaatatacttgaaaaaaatcattctgaaaagtgtccctcttttttttctttttggtattgtggtccctctttttccttgttttgggttgggtttgattttgtttttctactctcaaggtggacattttaggttattgatttgagatctctctcttttcttttctttttttttttcttttggacaaggcgttgccctgttgcccaggctagagtgcagtgttgatcattgctcactgcagcttcgaccacatgggctcaggtgattctcttgcctcagcctcccaagtagctaggaccacatacatatgccaccattaaccatctctcctgcttgcccctcccaccccttctacccttcccagcctgtggtccagctgtaattttgtatctgttaataaacatcttcctagtccccattttttctttaccttcctagtatctagtaaccactgttatactctctacttctatgatatcaactttttcagccctatgtatgagaatatgcaatatttgtctttctgtgcttgacttatttcacataacataatgaccttcatttccattcatgttgctgcaaaagacaagattttttttctggcataatagtattccgttgtgtgtacacaccacattttcttttctttctttcttttcttttttttttttgagatggagtcttctctgttgctcaggctggagtgcagtggcgcaatcttggctcactgcaacctctgcctcctgggttcaagcgattcttctgcctcagcctcccaagtagctgggactacaggtgcacgccaccacacctggctaatttttgtatttttagtagagacagggtttcaccatattggccaggctggtctcgaatgcctgacctcgtgatccgcctgccttggcctcccaaagtgctgggattacaggtgtgagccactgcacccagcttataccacattttctttatccatcattcctttgtagatggatagttaggttgattccatatccttgtattgtatatagagctgcaataaacatggaggtacaagatatctctgtcatactaattttatttgtatgtacacccagtagtgggattgctggattatatctagttctattttcagctttttaaggaacttttgtggtgttttttataatggctgtactaatatatgttcccaccaaaagtgtgtaagtgttctcttttctttatatcctcagcagtattttgtttgtttgtttgtttgtttgggtaatagctattctaactgatatgataccttattgtggtttttatttccattttccctgtgattagtgatgttgaacatttttcatatacctgttggccatttatgtgtcgccttttgagaaatgtctactcagagcaattgcctattttaaaattggagtctctttgtgcgtgtgtgtgagagcgtgtttgtgtgtgcatgcgcacatgtgtgctattgagttgtttgagttccttgtgtattatggatattaacctcttataaaatacaataaaatatttgtctagaccaaagtcccaaagcattttctcttatgttttcttctagtagttccatagttccaggaattacatttaagtctttagtccatcttgagttgatttttgtatatggtgagagatcgggatctagtgtcactcttttgcttatggatatccagttttcatggcaccattgattggagagactgtcctttccctaatgtgtgttcttcatgcctttgttaaaaatccattggccataaatatgtgggtttgtttttggttttgttgttctgttctcctggtctgtatgtctgttcttatgcaagtaccatgctgttttgattactatagctttgtagtttattttgaagtcagaaattgtgatgcttgcagatttgttcttttgctcagaattgctttggttattcagagtctagtagccaaatacaaattttatctttgcttgttatgtatctgtaaagaatagcattgataatttaataggaattgcattgaatctgtagatctttttgggtcattttaacaacagtttttccaattcatgaacatgagatgtctttctaatttctttgtgtcttcctcaatttctttcaccagtgtcctgtcatttttttttgtagagatcttttacctccttgattaaatttattctaaggtattttattttttgtagctattcgaaatgggatcactttcttgatttctttttcagctagtttgttatcgttgtatggaaacactactgatttttgtagattttgtatcctgcaactttactgaatttatcagttctaagagtttttttgatagagtctttaggtatttctgcatatgagatcttgtcttctgcaaatagggacagtttgactttttcttttccaattttgatccctgtttcaaaaaatttttttcccttgcttaattactctggctgggacttcagtactatgttgaataagggtggtgaaaatgggcattttgtctttttccagttcttagaggaaaagctttttggcccattcttgcattcctgggataaatcccatttaattatggtgtataatcattttgctgtgctattagatttggtttgctagtattttgttgaggattttgcatctatgttcatcaggcatattgtcttgttttctttttctgttgtttccttgtttggttttgttattagggtaatactggccttgtagaatgagttaggaaggattttctatccttcagttttttggaatagtttgagaagaattggtattctttttcaaaagtttagtggaattcagtagtgaagccattcagtcccaggcttttctttgttgagtgattttattactgattcaatctcattactcggtattggactgttcaggttttctgtttcttcttggttcaattttggtagattatatgtgtccgggaatttatttgtgttctctaggtatactaatttattggtgaatacttgttcataatggtcactaacgatcctttgtatttctgtggtttggtctctttttttcttagtctgtgtaatagtttgctgattttgtttatcttttcaaaaaaccagcttttcattttgttgatcctttgtattgtttggtctctatttcatttattttgttctgatcctcataatatctttccttctactaattttgtgtttgttttgttcttgcttttctaggtccttgacatgcattgttaggttgtttatttgaaatctttcaacttcttgatacaactgtttaatgctaaaaactgtttgtactgtttttgctatattccgtaggatttgctatgttgtatttctattttcatttgtttcaagaaattttaaaatttcttgtttaattttttattgatccattggttgttcaagaacatgctgtttaattttcgtgtatttgtacagtttccaaagtgtacttgttactgatttttagttttattctattgtggttagaaaagaaacttgatatgacttggacttttaaaatttttggagaatttttttgtgtgctaatggcaagaatgtatcccgcagctgttgttctgtaaatatctgttaggtctatttggtctaaagtgcaattgaaatttgatatttttggctgattttctgccagcgatctgttcaatgctatgagtggggtgttcaagtccccaactattattgtaatggagtctatctctctctttagatctaataatatttgctttatctatctgagtgttctagtagtgagtgtgtatatatttatagttgttatagatgcttgccaaattgacttcattattattatatgatgaccttctttgtctccttatatagtttgtgacttaaagtgtattttttctgatataaggataactactcctattcatttttggtggaacttttttcattttttcattttaagtttatgtgtatgtttacagaagtgagtttcttataggcagcatatagttgggtcttgttttatttattttttttttcccccgctccgagacggagtctcactctgtcacccaggctggagtgcagcggtgcaatcttggctcactgcaaactctgcctcccaggttcaagtgattctcccgcctcagcctcctaaattgctgggattacaggcacccaacatcatgcccagctaatttttgtatttttatggagatggggtttcaccacgttggccaggctggtcttaaaactcctgatctcaggtgatctacctgcctcggcctcccaaaatgctgggagtacatgtgtgagccactgtggccagccaggtcttggttttggtaatccattcatccagtttatagcttttaattgaggattatagtttttaatttggggtttttatttgtttacattcaaggttattattgataggtgaggaatttctgttgtcattttgctaattgcctttttttttttaaatatatatccattcttccttccttactttcctattgtttatctttgcagtttggtggtttctgtggtgataagttttacttctctttctcatttgtgaatctgcttcatcagtgagattgacacttcttcatgttttcatgatggtagttatagtctgttcgctttcagttctaggattcccttaatcatttcttctacatctagtctagtggtgataaattacctcattttttgcttctctgggagattttagttttccttcatttctgaagggtagttttactagatatggtaatcttggctcacagtttgttttctttcatcattttgaatatggcatcccattgtctcttggcctatgtttctgctgagaaatctgctgttagttttttttatttttttatttttttattttttatttttatttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttaagattagggagtggtgatgactcttaacaaagcacatcttgcaccgcccttaatccatttaaccctgagtggacacagcacatgtttcagagagcacagggttgggggtaagatcacagatcaacaggatcccaaggcagaagaatttttcttagtacagaacaaaatgaaaagtctcccatgtctacttctctccacacagacccggcaaccatccgatttctcaatcttttccccacccttcccgcctttctattccacaaaaccgccattgtcatcatgacccatccccaatgagccgctgggcacacctcccagacggggtcgtggccgggcagaggggctcctcacttcccagtaggggcagccgggcagaggtgcccctcacctcccggacggggcggctggccgggcagggggctgacccccccacctccctcccggatggggcggctggccgggcggggggctgaccccccccacctccctcccggacggggcggctggcggggcagaggggctcctcacttcccagtaggggcggctgggcagaggagcccctcacctcctggatggggcggctggccgggcggggggctgacccccccccccacctccctcccggacggggcggctggccgggcagggggctgacccccctcccccctcccggacggggcagctggccgggcggggggctgaccccccccacctccctcccggacggggtggctggccaggtggggggctgacccccccacctccctcccggacggggcggctggccgggtggggggctgacccccccacctccctcctggacggggcaactggccgggcagaggggctcctcacttcccagtaggggcggccgggcagaggagcccctcacctcccagatggggcggctggccgggcggggggctgaccccttaagttagcgcttatgggggctgaccccccccacctccctcccggacggggtggctgccgggcggagacgctcctcacttcccagacggggtggctgccggacggaggggctcctcacttctcagacggggcggctgccgggcggaggggctcctcacttctcagacggggtggttgccaggcagagggtttcctcacttctcagacggggcggccgggcagagacgctcctcacctcccagacagggttgcggccgggcagaggcgctcctcacatcccagacagggcggcggggcagaggtgctccccacatctcagacgatgggcggccgggcagaaacgctcctcacttcctagatgggatggcggcggggaagaggcgctcctcgcttcctagatgggatggcggccgggcagagacgctcctcactttccagactgggcagccaggcagagggctcctcacatcccagacgatgggcggccaggcagagacgctcctcacttcccagacggggtggcggccgggcagaggctgcaatctcggctctttgggaggccaaggcaggcggctgggaggtggttgtagcgagccgagatcacgccactgcactccagcctgggcaccattgagcactgagtgaacgagactccgtctgcaatcccggcaccttgggaggccgaggctggtggatcactcgcggttaggagctggagaccagcccggccaacacagcaaaaccctgtctccaccaaaaaaaaaaacgaaaaccagtcaggtgtggcggcgcgcgcctgcaatcgcaggcactcggcaggctgaggcaggagaatcaggcagggattttgcagtgagccgagatggcagcagtacagtccagctttggctcggcatcagagggagaccgtggaaggagaccgtggaaagagggagagggagagggagagggagacggagagggagagggagagggagagggagagggctgttagttttatggagagtccctggtatgttacttcacacttttcctatttttaaaattctctttgtgtttgaattttgacagtttcactataatgttcatcttttctcagtttgactataatgtatcctgagaggacctttttgggttgagtctatttgggaaactttgagcttcctggacctggatgtttatatttcttccgtgacttgagatgttttcagcaattatttatttaaataggttttatatgctttgtctgttctcttcttctggatctccaaaaatacatgcttttttttttttttttttttacttaatagtatcccataggccctgtaggcgttcttctcattctttttaattatctgttttttttgtttttttttttcggctaacctgggtacagcaggacctcaaaataatgttcagcgttgtttagttataatgttgctgagacaaaaatgatttctggttaggacctctgtctttatggagtttgcttgttctccccatgtctgcatgggttttctccggatactctggtttccttctgcttcccaaagatgtgaatgtttggttaactggtatgtctaaattgtcccagtatgagtgagtgagtgtgtgtgtgtgtgtgtgtgtgtgtgtgtaccatgatgtaatggtgtcctgtccagaactggtttccactttttaccctgagtgtctggataggcttcagccacctgtgacactgaactggaataagcaggttggaaaatgaatgatcacgttactataaaataaaaatgcgtaaagtatatgataatcatacaaatgcacaatatattatgcgttcagaaagcactcagtgatctcaccatattcattgtttttttaactgtgtggcattagaggatgctcgttttcactttgcaaacatttatttcatgatttcattcataaccattgtgacttctgtcattcgccaattcataaatttggtaaatatttattaatcttaattttattaatttagtagtgtactaatttgatactaatttaataatttcattaatctttcttaaatgtacatataacctacatctatttcagtatttgatattagaagtggtttgactctttacaatattggtgatgtttttgtgactagacgtaggctgtaggaacttttgtttatatcagttagcctaggtaaaattagttttgttacatgttgtttcatttaaatcacagtttccaagaacccactgatgatgtcaggtgaagatttcctgtatttcaaaagacttatgttcaagttcacaaattcttctgcttgatctagtgtattgccgaagctttcaattgtattttttaattttattcactgacttcttcaatgccaagatttctgtttggttcttttttatggcatatatctgttcgttgaatttctcattcagatcatgaattgtttttctgattttgttgaattaactatctgtattcttttgtatttcactgagtttccttaagaaattactgtgaattcttttcaggtattttataggtttgtcttccttggggtatgttattagagaattactgtattcctttgaggtgtcatgtttccatgccttttcgtgtttcttgtgtccctagcttgatatctgtttatctagaggaacaaccacctcttccaattttatgaagtagttttcgtaggaaaaaactttttcctgtagatttgacttacagtactggttgagtagggtgtttaggcttttttcctcattgggtgcagtagtgtaatttctatgtgatttcttcacccgtcatcaatatcagcattttctgtgagtgcctcagtgggctagattgtgggtgtttgtggaggcagtggtgtggctttgcttggggtgaggaatgctaggcaggctggtccttagtccctgagaaatggctgctatttctcagctgccattttctgattacagtgtccaagggatgtagagatgccagggctattgagccccaaggcagaatgcactccagcagttgcttcattctccaaatgatatagtactgcagcaacttggatcctgaggaattcagtggatcaaatgcgaattctctctttggagcaatccagccttatggacctcaggtagctccctatactggactcagggcttgtgaggactgtggaactgccctgtagcttggattgcaagtatccacagtggtcatggggactgctgaggatgtcttgcttaacttttctcgtcaatagggagtcccttctggctccaggctgatcttggccaggtgctctcctttcccctttatgctgacatgtggagtttctgtacctcagaagatcttcattacttcctgatgagttccattgttctcccatagacactaaactcaaactgctctatttgttgttttggtttttctttgtggaggagatgaacattgggtaccattttgattgaagtttttaatctgttcacttctaatttttattcatatgattggatttacatttatcattttgctattattttctgtgtgcctcatgtcttttttgttcctctgatatttattaatttcttttgtaataaattgatatttttgatgttctattttaattcctttattgattttcaaattgcttttgaattactttctttctttcttttctttttttttttttttgagacagagtctcgctctgttacccaggctggagtgcagtggcgcgatctcaactcactgtaagctccgcctcccgggttcacgccattctcctgcctcagcctcccgagtagctggaactataggtgctcaccaccatgtcgggctatttttgttttttttttttgtatttttagtggagacagggttttacgatgttagccaggatggtctcgatctcctgacctcgtgatccacctgcctcagcctcccaaagtgctgagattacaggtgtgagccactgcgcctggcccgaattattttctttgtgattgcttgggggattataatatgcatctgatttactgcaaactagttgagattattgataactttattccattaaaatagagaacatttctctactatagctccattttcttctgctgcttgtgctgttattgtcacatatattgcatcttgttaaaagttcaactatacaattttatcattattgttttatgcaatttccttttaaaccagaagaacaaaggagaaaaaagcatttatactgtcctttactagtcaccaacataattacctgtatcgttttgttgtgtgaatttgttgtgtgaagtagctgttgctacttcctttcagcctaatgaacttcctttaatattctgctaggaatcaattatcttattctttatttgagtatattttaatttgcttgcattattgaaggataattttgctggatatagaattcttggagaaattaggtgttaatctactaaaagtttccttgtacctgaaaaattatttttgtctttctgctctcaatatctatatattttttgtccctggctttctgcagtttgactatgatatatttggatttgaattcactgattcttttgccaattcaaatctgctgctgagcccttctagtgaattttttattttgttgattgtactttcaactccaaaattttcattttttttgtaatttgtttttattgacattttctaattgatgaatcactgttgtcatatgtttctttaattatttgaatatgaggctgggtgcggtggctcacacctgtctgtaatcccagcactttgggaggctgaggtgggtggatcacttgaggtcaggagttcaagaccagcctgaccatcatggtgaaaccgcatctctactaaaaatacaaaaattagctgggtgtggtggtgggtgcctgtaatctcagctattcgggaggctgaggcaggaaaatcatttgaacccgggaggcagaggttgcagtgagccaagatcatgccattgcactccagcctgggtgacagggtgagactccatctcaaaaaaaaaaattatttgtatatggtttcccttatttctttgaacatatttggaattgatgttttgaagtctttgtgtaccaagtcctgtatttgatctccttcacagatagtttgtttctattgactatttttatttctgtacactttgcatgtgtcatagttgtttgttgtaaattggacattttgtgtaatatattgcagcagctttggattttgatttcttctcccccaggagatggttgttgtttcaggattatttgtttattgacttgcctcgactaattttgtgatgtctgtttcgtgtgccttctgatttctctgctcattaaaacaaattctcttttctatttttaagcctggcattctaggaatttcgctgggttactataacttagtcatcagccagtgattgtttggaggttgtttaaacctttgagctagttaggtatttactctttggcatgggatatatacatttattgggtaatactttcaaagtcaggagattataagtctgttttttttttttttaaattctctatgttcatgaggcctcatggttaactcgaaatgagtagcttgctagttactgccctctctttgtggttgcttaggggattatatctgtgtatctggtggaacaacagatatacagtcttctgagtaagtactatcttgcacatgcatacaactttctagactaccagtaatatatatgtgagaccctggcaagaccctgttgggctatatcattttccagatttctctgttaatttttgggctggtttgctgttttgttgcctgacccaaattgtattgtgaccctatgctagccttactcttattgctgctgagctgtctgttgtttttgacaactttgtcctgttttgtcattgctttttggggagaggatttgccgagctcctcattcagcactcttgaagtcttgtcgcatgcgcgcgcgtgtgtgtgtgttcctgtagtaacaaacatgtgacataaaatttgtcattgagactgggcatggtagctcgtgcctgcaatcccagcactttgagaggctgagatgggaggctagcttgaagcccaggagttgaagacaagactgggcaacatagtgagactcatctgtgccaaaaattaaaaaaattggttgggcgtggtgacgtgcatataatcctagctacttggcatgctgaggtgggagagcccaggagtttgaggtttcagtgagctgattgtgccactgcactccagcctgggtgacagagttagaccttgtttcttaaagagaaatgaccatcttaagcacttttaagtgtatactatattactattaattatatgcacatccttgtgtagcagatcttcagaacttttttgtcttgtaaaactgaaactctctatctattgaaccaatgactccctttttacctttcccctgccccagcccttgacaaccaccagtctactttctaagagtctgacaatgttagataccttatatatgtggaatcatacagtatttatcttttcgtaactggcttattttatttaccataatgtcctcatgtttcatccatgttgtggtatattatgggattggcttatttttttaaggctgaataatatcccattgtatgtgtgtattacattttgcttatccattcatcctaaaatgagtattagagttgcttttactttacagctattgtgattaatgctgctttgaacatgggtgtgtgaatatctccttaagattttcttttaaattattttgggtatatacccagaattggggtttctggatcattgtaattctgtttttgatttgttgaggaacctccatattatgttctgtagcagttgtaccattttatgtttccactaagagtgtataagtattccattttctcaacacttactatgtttttgataatggccattgttatggctgagagatatctcattgtggtttttttatttgtatttccctaatgagtagttatgctgagcttcttttcatatacttattggccatttgtatatcttttttgtggacatggcttcaattcctttgtccattttaaaatagaattattgttattttgttgttgattagtcataggacttgtttatatattctagatattagtaccttatcagatagatggtttgcaaatatttttgtccatttcataggttgtcttttttactctttttcctttgttgtgcagaagttttaaaatttgatgtctcatttttctatttttgcttttgttgcctgttatgttcattttaaaagtatcccttttctctgttattttataataccttacctagaattagatttttgagatatattcaactctgttctgaaattctttgctactaatatcctttgcattatcatagatgttctgattttagggatgcattttacatgatgtattaactaaaagttatacataaataaagtatttttaagttgtagacatatatttcaagaagggaaaagaatgaaaagaaaattccttttttggttatcttaaggaagatccatttgttataacaatcatcatttgtgtttcaccttttactatatatgtatgttgtttatttttccttcctctgtgattttgaaattgaaactatcttgcttatagtcagatcatatggctcaaaattccatgttctaatccagaaagccacctcttgtgttactgtttggttagtagcattctgatgatactaagttcttgagtttgattcaggtgtctttaaacatttgtactctgagaactctgagacaatctgatttatgcccttagactgcaactttggtagccattttgcaaatatatcattgttacacaaggcgtagggtggtagaggtggaattgtaatgtgctcattgtccagttagatagataaatagccagtggaaacattttcagtgctgataatggaagtatagaggcagtattatagtggttaattgccatggctgtggaataatatttcttaattttgagtccaggctctcctagatgactcgttttgggaagattcctgacccttcatgtctcagattcttcattgtaaaatggggataatgctatttacattttgtgattcttaggaggagtaaatgattgtatacgagtaaggtgcttagaatagcgcctggtacatactcagtgcttattgcttttgttacaggcactgatcaatatataatcttgtgctagctgaacaatgcttgaagaaattaatgcattttaaaaatactgtgataatgacaaatatctaaaaattgtaacattccattagcatagagtactaacaatagacttaatagctgacctttaaaaaaaaaccctctggttgaagaaacaaattaggcccacacttttgtaataataataataataataagcacctttataatgatttctctgtgaggaaggtagtattctaagctttatatagattaatataatattcaaaatgtagtctttttatacaaattttacagataatgaaactgaggcacagatacaataaactgtctgctggctgcagagttattggtcttaatcactttgctatactgtctgtatttaggcatattgttactgtgttgctgaaccaactaggtagactaaaatgtgaatgaataagcttaatatttttattaactttcacaaatagagttacaataactaaaaatgtgatagaaatacatttttttcttcctcctttgttgatttgtaaacaaattatatctagaagtgagacaaatgagcataaagcaattttggtgacatttttcatgcctaaccttttatctaatgataatgaaaagcagtcagaaaacatttaaaatttatgaccaagtagtatccagttcaattttacattaggtgaagtggaatactttttttttttttttttaagttgatcagttttcattttgtcaggttattttcaaatctccaattgagctcccctttcaacttgacttagaatactgttctattagtttaaaatatattttgaagacatatttttagatggagacttaaaaaattacatcatttcagttatttgaagtactgctgctatatactgttgcactatcatatatcagccttcatcatgtactgagtattatatattatttccattcagcaaagtaggagacaggcctagagtgcttaaggaacttattaaatgtaacttgtaccataaattattgttatttatcattaactatggcctaacaaggtatttgatgctactttttgataaacagtaattctgaaaatatttttgtgttggacattttatttctcttttaagaaaggaatttgtatattagaatgaaaaatattaagcactaaacaataagtctctgaatattcttgtgttggaaattttattttttaaaaaagaaatttgcatattataataaaaaatattaagcacttactaatttttatgtaatgttttgtgttttaaggaactgaaattaccattcacttttttaagtggacatattcatgaattgaggattcatgtaccatggacaaaactgggttcagaaccagtggtaattaccatcaatactatggaatgcattttgaaacttaaggatgggatacaggtaagaaattattgaaccaagttgtttatgttaactaattttagtagtatttgacatttctttaccttttcaaatatgccaactgttacataaacatatcttagcttatatacttttttttttttttttttttttttttgagatagagtcttgctctgttgccaggctggagtgcagtggtgcgatctcggctcactgcaacctcctcctcctgggttcaagtgattttcctgcctcagcctcctgagtagctgggactacaggtgtgcgccaccacgcccagctaatttttatatttttagtagagaaggggtttcactatgttggccaggatggtcttgatctcttgacctcgtgatctgcccaccttggcctcccaaagtactgggattataggcatgagccactgtgcctggcctttaatttgtatatgcctgtttaagtgacatgactatttgcaaagtcatttttaaatttgaataaagtatgtaaaggttgttttcatacagattttactttgtcatagctctactagggaccatgcagattgcttattacttacatctacaatgaaagtgcagcctaattgtgtccgatttttacattaacatttttagatttttgcaaaggacctgtatgtattttttctttacataatttttctaaatctgaagggaatttctcaggttattttttgggaagatgaaaatatatttacaccaaattttataattgtttttgaagttttggtataagaaactgattttttcttttttcagatttatttatttcttctctgacccatcttacatttcttgctagtgtttttttgcagatgtaatattggttttaaagagtttctaccaaaaattttccaatctaggaaagcaaaataggtcaggaccatagcttattgtggagaatgtttccactttcaccttgcagaagagtagtgtgtctgtcattcatttttattaggtttttttttttttttagcacccacttaatatttaacttttagttttaaggaagattggctataatcaagtaaattgataagtattattaaaatgacttcatatgaatctgtaagtttaacgtattctaaatgtaactttaatctttgtgaagttagggttatgtatgaactgttaaaattatttcctattttaagtggatgctttgagtgccatatcaacccagtggactcagatcttttttccatttatgaaatctttgattccaaacacgtattatccaatttaacttaatatagtttctagaagttaatagaccaatgttatattctcatgaaaatgaaaagttactttgtgaacttctaatatttgagagattaatttagaaatctgtggatagttacattacaacaaagttttactttccatttatagttggtaatacttaaatgttaagtggttcttaattattatcttttcttggaatttattttttttcaaagtctggacttggttataccacccatgcagtgttccatattaaaagagaaaaaaaaaatccagacacttaagtacttttttcattgagaaggtagaagtttcaaggccagatgtcccttaagaaacatgttttaacagaggcaaattacaactaattatagaggctgcagaaaaagacttgtaacacatgacttagtgcaacctagaactaatacttgatattggactatgcagatggctactgcaggaatgatcagatttcctgcttgcatggtatttgggacttgaattttgtggtttgtacagcaaaaggttaaatgtcatgaatgtaaaccactctcaaaacaagtattttttacagatgtttaaaattttgggttagaaaggatttttgaaaattgcagttgacatttggacaaattatttagcagtgtacacctctggagagtaatgcttgggtttatgctagtgattggaattaaattttgcgtaaaaacattgtagatgaaacagattttaaaatagtttattttcctgttttaagctttgattagtatagtatgtaattaagcaggtactagtaaaactgaattagtttatattcaaagtatttcaagttattacattgtagaatcaccacgaagaaaagacgtattttctaaataaaattgtggttggaatggtaggttcagtgaaggggccttttagagttacaggtactcaaagatatgaatctgttaaaaaaaactattatgcataggaatgtattgaagtatgattaaaaggtaggaatatgaggcttaaatcagataagatcattccaaaaataagattttgttaaatgccttgataagaaggcatgtcttgtttgtgaaggtcaatttaattctaccaacatttgttggttgtctactctgtactgcactgaaaagcattgctaaaatatttatataatctcagcaaaagacacttagaaaaagagattcataatgattgtgattctagtggtcatggttttaatatactgccttaacatatccttacaatcagttttacttatagagatttttaggatgacagggtgaccgaattgttgtgttaggtaaaataaagtccatcttgatgtttactctgaattttaaaaaatatattgaaacttcactcatgaaatagttgttaatgatttcctattcactctgagagatgtatctatgtcagtcattgccctcacttttaaatcttgcagagttactacttgtaaactgtttatcctgtttttgatttcagatacacagtttttgattcatgacacatcatgtccatgctaatctaataaatacttgttaacataactcaagagctaaaacattatcagtaacttccatttaactatgtgctcctctcctttttcatattcttttttgttcagcctctaggggcctcatctgtaaaacaggacaagacttgctatacaatttaaaaaattatatgattgatgtgctttctttgatcattgaattaagtcttggctgggcatggtggctcacgcctgtaatcccagcactttgggaggccgaggcgggtggatcacgaggtcaggagatagagaccaccctggctaacagggtgaaaacccgtccttactaaaaatacaaaaaattagctgggcgtggtggccggcgcctgtagtcccagctactcgggaggctgaggcaggagaatggcatgaacccgcgaggtggagtttgcagtgatccgagattgtgccactgcactccagcctgggcgacagagcgagactctgtctccaaaaaaaaaaaaaaaacttcttcaacctaaagagagtaataaatctgtttctaaaccacctattctggtttttgtaccacctggaacataaatgttaaatcttttcatctaataaatgtaactatttgtaaggctgtttatagaagtaatacttatttttcttaaaaaatttgaaaagtgggaggctgaggcaggagaattgcttgaacccaggaggcggaggttgtggtgtgcagaggccgcgccattgcactccagcctgggcaacaagagtgaaactccatctcaaaaaaaaaaaaaatttgaaaatcatcttttgaacctaaaaatctgagattatcttctaataggagaaatacttgtagtttcactccagattaaacttatttttatgtatatattcttaccatctttctcctttttagcttaacttcttttaaaatcatttttgcaagtttcattttatttctttactgtcattaaccttttaccacctttctcctttttagcttaattttctttaaaatcatttttgcaagtttaattttatttctttactgtcataaccttctaattgttgatatggctctttaagattacaaaaatattctgtttgaaaacctaaggtgattttatccttttatctcatgtacctacaggtttagctagattttaaacaagaaagtgaaaatatttgtatatgtagtattttaaattcagagatagttttctgtttcccataagcacggattcctttcttaaacattttaagtcagataccagtaagccactttttgtttgttttgtttctgtttttgatactgcgtcttgctgtgttgcccaggctggtctcgaactcctggcctcaagtgaccctcctgccttggcctcccaaattgctggaattacaatcaagagccactgatttccagtattaataagaaaaaaattttggtcctgacagcccatagatttaggtgacctgatcaaaaagtgatatgttattactcttgactgtggcattttatgtcaactctttttatagtttcatcttgtactttatttttgtttttctacaaagtctgtgtcagtgtaattagacttaaagatctgaggcagctgttttgatttgaatgtctaattctgatgaagggcttcagaattattttttccactgtagagcagggaaataaagctttctttgattggacaccagcacctatctgctctatctagcagaacttttctgggatctagagaatttccatactttcacaggacgaagtttttttttgttttttgttttttttaattttgtttacatttagataggattttttatttactggatggtcatttgatctggccatcaatgtgctctgtttaccatcagggatttgatggatttacttgtagaaattttacatgtgatcattggaattttaagtgtggattattatgaattagtacagttgttttggtagactattaataatcagtctctattaattgattttaaaaatcaattagttagaatttgagattaggaggcctacaagagaggtatcacctctctcttagcttggctgaagtctgtgtttatcgtcactgttattggtgaggtcattgcttgaatgttataataaatggccttctaattggactgactctagaccattactcttctacacacactcacaaatatctcttatttttttgaagctcatgtgacctgactatataatcatttgtggtcctctgatagctatcatccattgattttgtggtccctcccccactgtgactgaaaattttgttacctggttcacagacttttttttttccaattgaagttcatccatcttgggtcatttcagtgtccatatggattcttacataactctctagcaacacaattccttgatttttaactctgtcatccttatttctgttccatttcagccaatccctttatggttatgttgtggagtttgctgttccttgaagcattctctttattgtggatcctgtctctgtatcttaagtatctcactttaacagtattccttcacttcaatctctcatttgatttattggcactttgctatcatttaaagtgcttatttctctgctacattttggggaaatactttcctgcaaccatgtttccctctctagcttcttttcttttctttataaccacatcatttctttttttttttctttctttcttttttttttttttttttgagacggagtctgctctgttgcccaggctggagtgcaggggcgcgatctcggctcactgcaagctctgcctcccgggttcacgccattctcctgcctcagcctctggggtagctggggctacaggcgcccaccacctcaaccagctaattttttgtatttttagtagagacggggtttcaccatgttagccaggatggtctctatctcctgaccttgtgatccgcccacctcagcctccgaaagtgctgagattacaggcttgagccaccgcgcccggcctctttttttcttttttaaaataagtcaatgtttgtgtgtgtgtgtgtgtttttttaattgaaacgaaattcacataacatacaatcaaccattttatttttgtttatttatcttttaaatttttttatttctataggttattggggaacaggtggtgtttggttacatgagtaaattctctagtggtaattcgttagattttggtgctcccatcacacaagcagtatacgctgtaccgaatttgtgtcttttatcccttacctctttcccccaagtccccaaagtccattgtgtcattcttattcctttgcatcctcatagcttagcttccacatatcagtgaggacatatgatatttggttttctattcctgagttacttcacttagaatgatagtctccaatctcctccaggtcactacaaatgccattaattcattcttttttattgctgagtagtattccattttatacacacacacacacacacacacacacacacacacacacacacacaccaccccccgcccccacggtttctttatccgctcgtcgattgacaggcatttaggttggttccacatttttgcaattgtgaattgttttgctataaacatgtgtgtgctttaaacccatgtgtgcaagtatcttttttgtataatgacttcttttccactgcgtagatacccagtagtgggattgctggatcaaacggtagttctgtttagttctttaaggaatctccacaccattttctatagtggttgtactagtttacattcccaccagcagtgtagaagtgttcctggtttactggagccatgccaatatctattattttttgatgttttgattatggctattcttgcaggagtaagttggtatcacattgtagttttgatttgcgtttccctgattattagtgatgtgaacattttttcatatgtttgttggccatttgtgtatcttcttctgagaattgtctgttcatgtccttagcccactttctgatgggattgttttttttttcttgctaatttgcttgtgttcgttgtagattctggatattagtccgttgtcagatgtatagattgtgaagattttctccgactctgtggattgtctgtttactctgctgactgttccttttgccgtgcaaaagctctttagtttaattaagtcccagctatttgtttttattgcatttgcttttggggtcttggtcataaaatcctcgcctaagccaatgtctagagggcttttctggtgttatcttctagaatttttatagtttcaggtcttagatttaagtccttgatccatcttgagttgatttttgtataaggtgagagataaggatccagtttcattctcctacatgtggcttgccaattatcccagcaccatttgttggatagggtgtcctttccccactttatgtgtttgtttgctttgtcaaagatcagttggctgtaagtatttgggcttatttctgggttctctattctgtttcattggtctatgtgcctatttttataccagtaccatgctgttttggtgactatggccttatcatattgcttgaaatcaggtaatgtgatacctccagattttttctttttgcttagtcttgctttggctaggcagactcattttttggtttcctacgaattttaggatttttttctagttctgtgaaggatgatggtggcatttttatgggaattgtattgaatttgtagattgcttttggcagtatggtcattttcacaatattgattctacccatccatgagcatgagatgtgtttccatttgtgtcatctatgatttcttccagcagtgtttgtagttttccttgtagaggtctttcacctccttggttaggtatattcctaagtattttattttatttttgcagctaatgtaaaaggggttgagttcttgatttgattctcagcttggttgctgttggtatatagaagagctactgatttgtgtacattaattttgtatccataaactttgttgaatttttttttttatcagttctaggaggtttttggaggagtcttgatagggttttctaggtaaacaatgatatcatcaacaaacagtgacagtttgacttcctcttggccgatttggatgccctttatttctttctcttatctgattgctctgggtaggacttccagtactgtttaagaggagtggtaagagtgggcctccttgtcttgtcttccctaaaagaatgctttcaacttttccccatttagtattacgttggctgtgggtttgtcatagatggcatttattacattgaggtatgttacttgtatgccaattttcctgagagttttaatcataaaaggatgccatattttttttgaatgctttttctgtgtctaatttttgtttaaattctgtttatgtggtttagcacatttattgactcgtgtgtgttaaaccatccctgcatctctggtatgaaacccacttgatcatgggtggattatctttttgatatattgttggattcagttagctagtattttgttaaggattttagcatctatgttcatcagggatattggcatgtagttttcttttttgttatgtcctttcctggttttggtattagggtgatatcggtttcatagaatgatttagggaggattccctctttctctatcatgtggaatactgtcaataggattggtaccaatccccctttgaatgtctggtagaatttagctgtgaatgcatatggtcctggacttttttttgttggtaattttttttattactatttcagtcttgctgcttgttactggtctgtccagggtatcaaattcttcctgatttaagctaggaaggttttatcttttcagggatttatccatctcctctaggttttctagtttgtgcatgtaaaggtgttcacagtagctttcaatgatcctttgtatttctgtcttgtccgttgtaatatttcccgtttcgtttctaattgagcttatttggattttctctcttcttttttggttaatgttgctaatggtctatctgttttacctacctttttaaagaaccagctttttgtttcatttatcttttgtattgttttttgtttcagtttaatttatttctgcactgatcttggttatttcctttcttctgctggctttgggtttggtttgttctcgttctctagctccttgaggtgtgactttagatcatctggttgtgttctttcagactttttgaggtaggcatttagggctatgaactttctttctttccttttcttttttttatttttgagatgaagtcttgctttgtcacccaggttggagtgcagtggtgcgatcttggctcactgcaacctgctcctgtggggttcaagcagtttttgtgcctcaccctcccaagtagctgggactacaggcacctgccaccatgcatgactaatttttgtatttttagtagagacgtggtttcatcatttttgccaggctggtcttgaactcctgacctcagtgtatccacccaccttggcatcccaaagtgctgggattacaggtgtgagccactgtgctctgctctatgaactttcctcttagcaccacctgagctgtatcccagaggttttgataggtcgtgtcacaattgtcattcagttcgaagaaatttttaatttccatattgatattattgttgacccaatgatcactcagaaacagtttacttaatttgcatgtatttgcatggttttgaaggttccttttggagttgatttccagttttattccactgtggtctgagagagtgcttgatataatttcaattttcttaaatttattgaggcttgttctgtggcctctcatatggactatcttggagaaagtttcatgcactgaggaatagaatgaatattctgcagttgttggatagaatgttctgtaaatatctgttaagtccatttgctccagggtatagtttaaatccattgtttctttgttgactttctgtcgtgataacctgtctagtgctgtcagtggagtattgaagtcccccactgttattgtgttgctgtctatcttgtttcttagatctggtagtaattgttttataaatttgggagctctaggctgggtgaggttgctcatgcctgtaatcccagcactttgggaggccgagacgggcggattaccagtggtcgggagtttgagaccagcctggccaacatggtgaaaccccttctctgctaaaaatacaaaaattagctgggtgtggtagcgagcgcctgtaatcccagccactcagggggctgaggcaggagaatcagttgaacctgggaggcggaggttgctgtgagccaagatcaagccactgcactccaggttgggtgacagagcaaaactctgtctcaaaaaaaaaaaagaaaatttgggagctccagtgttaagtgcatatgtatttaggattctgatattttactgttggacatagccttttatcattatataatgtccctctttgtcttttttaactgctgttgcttcaaagtttattttgtctgatataaggatagatactgccttttgcttttggtgtacatttgcatagaatgtctttccacccctttaccttaagtttatgtgagtccttatgtggtaggtgagtctcttgaaggcagctgatggttggtgaattctatccattctgcaattctttatcttttaagtggtgcttttaggccatttacattcaacattagtattgagatgtgagataccattccatttatagtgctatttgttgcctgtatacctttttttttttcaaattgtatttttgttttataggtcctgtgagatttatgctttaaagaggctctgttttgatatgtttccaggatttgtttcaagagtcagctccccttttagcagttcttgtagtgctggcttggtagtggcaaattatctcagtatttatttgtctgaaaaagactctatctttccttcatttatgaagcttagttttgctggatacaaaattcttggcagataattgctttgtttaaggaggctgaagatagggccccaatcccttctagcttgtagggtttctgctgagaaatcagctgttaattcaataggttttttttttttctttaataggttaccttgtgcttttgcctcacagctcttaagattcttttctttgtcttaactgtagataacctgatgacagtgtgcctaggcgatgatctttttgtgatgaatttcacaggtgttctttgagcttcttgtctttggatgtctaggtttctagccaggctgggcaagttttccttgattattccccctaacatgttttccaacttttagatttctcttcttcctcaggaatgccaattattcttaggtttggtcatttaacataatcccagacttcttggaggctttgttcatattttcttattctttttcctttgtctttgttggattgggttaatttgaacaccttgtctttgagctctgaagttctttcttctgcttgtttgattctgttgctgagactttctggagcattttgcctttccttcttttatttttttttaacttttgtatttttatttttttatttatcttttttaaattatactttgagttttagggtacacgtgcacaacgtgcaggttagttacgtatgtatacacgggccatgttggtgtgctgcacccattaactcgtaatttaacattaggtatatctcctaatgctatcgctcccccctccccccaccacacaacaggccctgctgtgtgatgttccccttcctgtgtctatgtgtgctcattgttcaattcccacctataagtgagaacatgcagtgtttggttttttgtccttgagatagtttgctgagaatgatggtttccagcttcatccatgtccctacaaaggacatgaactcatccttttttatgggagcatagtattcaatcgtgtatatgtgccacattttcttaatccagtctatcattgttggacatgtgggttggttccaagtctttgatattgtgaatagtgcctcaataaacatacgtgtgcatgtgtctttatagcagcatgatttataatactttgggcatataccaagtaatggatggctgggtcaaatggtatttctagttctagatccctgaggaatcgccacactgacttctacagtggttgaactagtttacagtcccaccaacagtgtaaaagtgttcctgtttctccacatcctctccagcacctgttgtttcctgactttttaatgagtgccattctaactggtgtgagatggtatctcactgtggttttgatttgcatttctctgatggccagtgatgatgagcaagttttcatgtgtcttttggctgcattaatgtcttcttttgagaagtgtctgttcatatgctttgcccactttttgatggggttgtttttttcttgtatatttgtttgagttcattgtagattctggatattagccctttgtcagatgagtagattgcaaaatttttttcccattctgtaggttgtctgttcactctgatggtagtttcttttgctgtgcagaagctctttagtttaattagatcccatttgtccattttggcttttgttgccattgcttttggtgttttagacatgaagtccgtgcccatgcctatgtcctgaatggtattgcctaggttttcttctagggtttttatggttttaggtctaacatttaagtctttaatcatcttgaattaatttttgtataaggtgtaaggaagggatccagtttcagctttctacatatggctagccagttttcccagcaccatttattaaatagggaatcgtttccccatttctggtttttgtcaggtctgtcaaaggtcagatgattgtagatatgcggcattatttctgagggctctgttctgttccattggtctgtatctctgttttggtaccagtaccatgctgttttggttactgtagccttgtagtatagtttgaagtcaggtagcatgatgcctccagctttgttcttttggcttaggattgacttggcagtgcaggctcttttttggttccatatgaactttaaagtagttttttccaattctgtgaagaaagtcatcagtagcttgatgggaatggcattgaatctataaattaccttgggcaatatggccattttcacgatattggttcttcctacccatgagcatgcaatgttcttccatttgtttgtatcctcttttatttcattgagcagtggtttatagttctccttgaagaggtccttcacatcccttgtaagttggattcctaggtatttcattctctttgaagcaattgtgaatgggagttcactcattatttgtctttctgtttgtctgttactggtgtataagaatgcttgtgatttttgcacattgattttgtatcctgagactttgctgaagtcgcctatcagcttaaggagattttgggatgagatgatggggttttctcgatatacaatcatgtcatccacaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcaatatgatgttggctgtgggtttgtcatagatagctcttattattttgagatatgtcccatcgatacataatttattgagagtttttagcatgaagcgttgttgaattttgtcaaaggccttttctgcatctattgagataatcatatggtttttgtcgttggttctgtttacgtgatggattacgtttattgatttgcgtatgttgaaccagccttgcatcccagggatgaagccaacttcatcttggtggataagctttttgatgtgctgctggattcggtttgccagtattttattgaggatttttgcatagatgttcatcagggatattggtctaaaattgtctttttgtattgtgtctctgccagactttggtatcaggatgatgctggcctcataaaatgagttagggagggttccctctttttctattgattgaaataattttggaaggaatggtaccaactcctccttgtacctctggtagaattcggccgtgaatccatctggtcctggactttttttggttggtaagctattaattattgcctcaatttcagagcctgttattggtctattcagagattcaacttcttcctggattagtcttgggagggtgtatgtgtcgaagaatttatccatttcttctagattttctagtttatttgcatagagatgtttgtagtattctctgatggtagtttgtatttctgtgggattggtggtgatatcccctttatcatattttattgcgtctatttgattcttctctcttttcttctttattactcttgctagcggtctatcaattttgttgatcttttcaaaacaccagctgctggattcattgattttttgaagggttttttgtgtctcttatttccttcagttgtgctctgatcttagttatttcttgccttctgctagcttttgaatgtgtttgctcttgcttctctagttctttaattttttaattatttaattatttatttattttttatttttagtatactttaagttttagggtacatgtgcacaacatgcaggtttgttacatatgtatacatgtgccatgtttgtgtgctgcacccattaactcgtcattaagcattaggtatatctcctaatgctatccctccccgctccccgcaccccacaacagtccccattgtgtgatgttccccttcctgtgtccatgtgttctcattgttcaattcccacctatgagtgagaacatgcggtttttttggttttttgtccttgcgatagtttgctgagaatgatggtttcctggttcatccaggcccctacaaaggacatgaactcatcattttttatggctgcatggaatactatgcagccatcattctattatactttctgtttctatgattttgagtattctaagtacctcaagtaagtggaatcatacagtttttgtcattttgtgtctggcttatttcacttagcacagtgtcctcaaggttcatccatgttgtggcatatgacaaggttcctttttttttcctttttttttttttttcttgcttacaactcttttttttttggttttgatacagaatctcacttggccacccaggctggagtgcagcggtacagttccagttcacttcaacctctccctcctgggttcaagtgattctcctgcctcagcctcctgagtagctgggattacaggcgactaccaccacccccggctaatttttatattttttagtagagactgggtttcaccctgttggccaggctgatctcaaactcctggcctcaggtgatcctcctgcctcggcctcccaaagtgctgggattacgggcgtgagccaccacgcccagcccagggtttccttttttctagggctgaataatatttttttgtgtgtatttaccccatttggtttattcattcaccgatggacacttgggttgctttcatcttttggttattgagtataatgctacaatgaacatgggtgtgcaaatctctctttgagaccctgctttcagttcttttgcatatatactgagaagtagaattgctggatcatatagtaattctgtgttcacttttttcaggaatttccatactgttttctacagtggctgtaccattgtattctcaccaccagtgtacaaaggtttcagttttgccacatcttcaccgacacttattttctgttctttggatagtgtctatcttaatgggtttgcaatctttgaccattttaaaattcaattgtttgtctttttgtttgagttttaagagttccttttgtattcaaggtagtagagtaggtccttagcagattatgattttcaaatattttcatccattctgtaggttgtgttgtcacattcttgagaatgtattttgatgcacaacgtatttaatttggataaagtccaatttgcctatttttaacttttattgctagtgctttcggtgttatatctaagagttcattgctttatctaaggtcttgaagatttccccctatgttttcttctaagagttttaaagttttagctcttatatttaggttgttgatccatattgaattaaattttgtatatggaatgattaattttatatatgatatgttgtatatgggttcaacttcattctatggttatttggtggtccaagcactatttgttgaagagtcttttctttgcccactgaatggtcttgtcactcttgttgaaaataaaccctataggcctatgctggccatagggtttatttctggactcagcattttattccattggtttgtgtgtgtgttcttaagcctgaacaacactattttgattattgtgctttgtagtaagttttgaaataaataagcttcctattttgtatttctgttttttttttgtttttttttttgttacagggtctcactctgttccacaggctggcatgcagtggcatgatctcagctcgctatataacctctgctttcgtgcttaagtgattctccagccttaacttcctgagtagctgggactataaacatgagccagcatgtttgtctaacttttgtatttttggtagagacaaggttgtgccatgtcgcctaggctgatctcgaattcctgagcttaaagcaatctgcctgcctcagcctcccaaagtgctgtgattacaggcgtgagccaccatgcctggccctattttatatttctttttcaaaattgttttggctctttgcagttgtatatgaatttgaagattagctttttcagtttggttcaaaaggccattggaattataatagggattgtactgaatctgtcaattgcttggtagtattagcatcttaacgatgttaagtatagtgatccatgaacatgggatgcctttctatttatttaagtaatctttaattgtgtcagcagtgtattataattttcattgtgtctttcaccttcttagttgaatttattcctaggtatattattattttgggtgctattgtatgtagaattgttttcttaatttccattttggatcatttgttgctagtgtacagatacaccaccaattttggtgagttgatcttttatttatttatttttgagatgaggtcttactttgtcacccaagctgcagtgcagtgatgtgatcatggctcactgcagccttgaccacctgggctcaagcaatgctcccacctcatcttccctagtagctgggaccacgggcacatgccacagtgcctggctaattaatttttttttttttttttttttttagagagagggtcttggtatgttgatcaggctgatctcgaacttctgggctcaagtgatcttcccaccttgtcctcccaaggtgctgggattacgggtatgagccaccatgcttagctgtgagttgatcttttttgtttgtttgttttttttgagacaggattttgctctgttgctgagggtggagtgcagtggtgtgatctcagctcactggaacctccatctcccaggcttaagtgatcctcccaccccagcctcccaagtagcagggactacaggtgtgcgccactatgcccggctaattttttttgtgtgtttttgtagacatgggttttcatcatgttgcccaggctcgtcttgaactcctgggctcaagcgatctgcctgcctcagcctccaaaaatgctgggattgcaggcgtgagccatcatgcccagcctgtgggttgatcttttatcctgcacatttgccagattcgtttgttagctgtagtagtttttggtggattctgtgggattttctatatatagagtcatgttatctgaaaatatatagagatagttttacttttctgtctccaatttggatgccttttcttccttgtcaaatttctttgtctaggacttctagtacagtgtttaatagcagtggtgaaaatgggcatccttgtcttgttatttatctttgacggaatgctttcagcctttaactattggatatgatgttaggtgtgtgtttttcatagaagtttccttctattcctcatcctcattcctccatccagtggaggtggcagggggtgaaatggactctgtgagggtcatccttagttttggttgtttaatgctctatctttgtgctggttggccttaaacatgtagatgaatttcacaggaatatttttactgtgttgagtcttacaatccatctacacagtacgcttctctaattatttagattcctttgtatttctttcatcagcattttcttttttcagcatgtaagtcctatatatgttttgttagatttatacctaaatattttatttcctttggggcatttttaatattatcatatgtttaattttttattttgattgttcattgttaagttatagaaatgcaatttatttttctgcattgatcttgtgtcctgtgaccttgcttaactgtttaattttaggagttttttgggtggattcctttagatttcctccataaataataataccacctacatagacaataatatcacccacaaaaagtatttttttttttgtttccagtctgtatgcctttctaccctttttaaacttataagttaatatttatacctcatggattctgcctccatgatgccgttgtaagcactttggcagagctcattagtaacatcaagcttaaaaaatccagtgtattcttttcatttattttttgattctcatttacctttgccatttaatacttgtcatctctttccaaaaacttcactttcttggctcctctgattctttccctacatctttggcaccctgtctctggctcctgttgttacttttctgctacctatcccacatttaaataggagttttgtaggttttcgttattttagtgctcactctccttggataattttattcccaatggatttagttatcattatatattttttactcacaaaatgctattttaggggtcagtcttttttttcctgaactccagcataagagctaaatgggccttcacctatatgtcccatagaatgttccaaactgaaatcatcttaaacctcaaatcctttcctctttatgtattttctgtgtcagtgaacaattccactgtgtgctttcaatccaaaccaggaaccctgaggtcgtccttaactttacccatcccttatatcaattattcatcagtctgttttctactgctttcctatctcttgagtgtatctattagctttcattggtacttcgaatcatttttcacactgtctctagacatgatattcttaaatgtgggtcatttcctcaaaacttcttttctagttcagtgattttctcagatcataaacttatgtgcaactcataagaaagagactgaaattttttgtaatctagttgttttcgaagtgtgatctgaagacctccaggtgttcccaagttttttctttttatatacaaaatcaacattatttttctaatactaagacatgattcatgatttacttttttcaccctcattttctcatgaatgtagtgtggaattttccagaggttatgtatggcactggaacagactgacggcagaagcaaatatgagaatgtagctgtcttctcttaagtcagatttaaaaaaaaatataatgccccctttttttatttttgttttagaaaatatagctatttttcataaaatatgaaaaccctaaaatctatcatttattttaaattatccataatataattataattaacaaataatggatttatttaaaaataagtcataaaatatataaacatatatattagaatttttttcttttgtatttctactatggtaaatatgtgattctcagtaatttttaacacattaagaggtcctgagattaaaatatatcaggattgctggtctcatgcatattaatacatagcaatcaaaattgaattattttaaattggcaagcaacttgactgaatttataattttggaagttgacttttttcacagtggaggggaagggattggaggaaataatttcagagaattagttagattctttttgccatattttagaagaaaagttatggagcccagatggaactaagtcattgtctgtggcattggagaggtggtgataggttgtgaaggaggatatacagaggaagttctgggatgacttatggaattttactttaggatgattggtgtggattttggtgctgttgatttagattcttttcagacttgtctgtctagctcatcatatgctaacattactagtaattagatctcactgaaggataatacagaaagtaggcatagtacattgtgtgtaaaccacatagaaaattaccattttagtacttatttcctttctttgaaggaaaagttgaaaagttctttattcaacacatgcttactgagttttataacactgtactgaatgctatggatatagtagttagtgatacagacaaaaactttctcttcttttggagtttatgtctttttgagagaaggtctcactctgttgcccagcctggagtgcagtggcttgatcttggctcattgcaacttctgcttcctgggttcaagtgattctccagccttagtgtcccaagtagctggtactacaggcggaagccaccaatgcccggctaatttttgtattttttgtagtgatggggttttgccctaatttttgtatttttggtagagacggggtttcgccatgttggccaggctggtctcaaactcctgagctcttagctattttcccaccttggcctcccaaactgctgggattacaggcatgagccaccatacccagcctctttttggagttttaagaagactgtatcaattgatacagtctgccctctgtaccacggatgtgaagcccatggatgcagaaggctgactgtaaggtatttgagcatccacaggggtcctagaaacaatctcctacagatactgaagtatgactatctatcatgagtggtttatgattttaattttaacatgaagtattgtttgtaatcttagaatcattggatactaaacttttgttttaggtttagcttctgcttttttttttttttttttttgagacagggttttgctctgtcacccaggctgcagtgcagtggtgtgatcttggctcaccacaacctccacctcccaggttcaagcaattctcctgcctcagcctcccaagtagctgagattacaggtgtgcgccattatgcccagctaatttttgtattttttttcgtagagacggggtttcagcacattggccaggatggtcttgaactcctgacctcaggtgatccgcccacctcggcctcccaaagtgctgggattataggcgtgagccactctgcaggccaaggtttagcttctttttgaggtgaaataattggggtcatttgagaacattattgaaaaagaagtaaaaaaactacaaaccacacactgatacttgtagatggatgacagtgtaggtaaatttttttcaaattgtattgtgttccctgagagtttgggaacacaagaaatcatggtttcttgaacttcagcttgtgtctagatcctagaagtaatagaggattctttttagttagctatttgggagatatagtgtgttataaatgtttgattctttaaaaatacataaattgggctaggcgtggtggttcacccatgtaattccagcactttgggaggctgaggcaggtggatcacttgaggttaggagttcgagaccagcctggtcaacatggcaaaaccccatctctactaaaaatacaaaaattagccgggtgtggtggcaggcacctgtaatcccagccactcaggaggctgaggtgggggaatcacttgaacctaggaggcggattttgcagtgagccgagatcacactactgcactccagcttgggtgatagagcgcgacttcatctcaaaaacaaaaaaaaaaattgatttaaataatataatcttttattatatgatgtataatcctgaaatttatggcatatgaaaatgaaacttggcataaagtggattttttagttcaataatacttttttttaacttattgaggatgttttagttcttgtttgccataagtgaaactttttggaattctgtatttgtttcacaattgggaagatttttttttctttttgagctgaaaaaggtatattttatttttagtctgtcaactattttaagtaagaagaaaacatttagatcaagacaaggaaggctttagtttcatcagggactttctaagaatgttatgaatgagtgaaaatatggggttgtaacagaagtgcaaatataaccttaattgtagtgttcagtgcttttgacactataatttatgtctaaatgctgcaaactgaaagaaccttagtttgaaactttgaagttgatggtggttgcaggttttctttttcccttcagttttatgccatctcaatgtgttatctggcattaaagacataaggaacacagattgcagcttccatttttttggcatgtttttgatttctatttgattcatatgctctggaggttccttttgaatctataaaatgcaacagttctctgattttgttttgatgattagatgctgctaattttcttttttttttttttttttgaacttgttcattttgccatgactattttttgaaacttgagatgtctggtatttagaaactgtactgagactttagtttttctatctgacctgagttttctatggacagattatagtggggtcttactagtctgacaattcctgactattcattggagtgtttacttttatttagttctaaatgtggttaggtttaagtttaatgtcttcatattttactggtcccatctgatttttgttcctttttttcttttcctgccttctttgggattgagtatattttagcattctattttctcttcattattaattaaccatactttattttttagtaattgctctagggttgacagtatgcatgtttaacttatcaatgtctactttgaaataatattataaaataccactttataagtaacgtaagtattatcccttacctagaatgtttatgacagtatgctcctcttcatgtcctgtcatgatttgtgctaatgttgtcataactcttacttctgtatgttacacactcacaatggtcaataataataactattactgctttgaataatttttaagaaattaaaacaagagtgtttgttgtgtttacccacactggattttaaggagtgaatcttgtttggtgttcgttgttattttgtgcttctgtgtacacaaaggtgcctatgatgtttcaccttagttgttaaatacttccttaagtcgaagctcatgtctcaacagtatactgttcagccctcctgggatatgtttttgcttccttcaacttgtctaaatccacatattcccccgaagttagatcgattctcaacttcagtatcttatttagtaaaaccattatttgcttctgattccctatgcgttttatagggaagataggacatgccatttcctgtaaataagattagtctaacatttataatacaaatgccaatgctacaaaagggaaaactgttcttatttagggttctgtttatgtagcagttcatacagagaattttcatgtgcgtcaaaaccaataagagattagatatgcctttacaaaacacaataaattatcattattcttttcttttattcaaataagacaacctttcaactgttgaagagcatgggccctgaaaaataactttattatatgtttattttttttgaggcagagtttcgcttttgttgcccaggctggagtgcatgggcgtcatctcggctcactgcaacctccgcctcccaggttcaagcgattcttctgcctcagcctcccgagtagctgggattacaggcatgcgccaccacgcctggctaattttgtatttttagtagagatggggtgtctccatgttggtcaggctggtctcgaactttcgacctcagatgatccacccgccttgtggatcccaaagtgctgggattataggtgtaagccaccacgcctggcctatgtgtttaatttttaattccttaatacataagaatacattattctcttataatagtttaaggtattcagatattttcttaaccattactgaaagtatctgtggatatagatgggcactcaagtatagaatagatgttagaggattgcaactacaaaataaagtatttcttaattattttaaaaatgaatatagtaaacattatggccttttttcctttatttacttatttttaaagcaggatgcatttttttaggagccagagtctcttttatagcaatagtgaaatgaattattgtaatctgaacacttaacaatccataaattgactcttccaagatggcccagtaggaacagctccagtctgcagctcccagcgtgattgacacagaagacgggtgatttctgcatttccaactgaggtacctggttcctctcattgggactggttggacagtgggtgcagcccacagagggcaagccgaagcagggcggggcgtcgcctcacccgggaagtgcaaggggtcgggggatttccctttcctagacaagggaagctgtgacagacggtacctggaaaaacaggacactcctgcccaaatactgtacttttccaatagtcttagcaaacggcataccaggagattatatcccatgcctggcttggtgggtcccatgcccacagagccttgctcactgctagtgcagcagtctgagatcgacctgcaaggcagcagcctggcagggggaggggtgtctgccattgctgaggcttgagtaggtaaacaaagcagccagggaagcttgaactgggtggagccaaccacagctcagcaaggcctgctgcctcatagactccacctctggggacagggcatagctgaacaaaaggcagcagaaacttcttcagacttaaacgtctctgtctgacagctctgaagagaggagtggttttcccagcatggtgtttgagctcagagaacagacagactgcctcctcaagtgggtccctgacccctgtgtagcctaactgggagacacctcccagtaggggccaactgacacctcatacaggcaggtgcccctctgggacggagcttccagaggaaggatcaggcagcaatatttactgttgagcaatattttctgttctgcagcccttcgctggtgatacccaggtgaacagggtctggagtgaacctccagcaaactccaacagacttgcagctgagggaccagactgttagaaggaaaaagaaggaaaactaacaaacagaaaggcatagcatcaacatcaacaaaaaggacatccacaccaaaaccccatctgtaggtcaccaacatcaaagaccaaaggtagataaaaccacaaagatggggagaaaccagagcagaaagctgaaaattctaaaaaccagagtgcctcttctcccccaaaggatcgtagctcctcgccagcaacagaacaaagctggatggggaatgactttgaggagctgacagaataaggcttcagaaggtgggtaataacaaaattctctgagctaaaggaggatggtcgaatccattgcaaggaagctaaaaaccttgaaaaaagattagacgaatggctaactagaataaacagtatagagaagaccttaaatgacctgatggagctcaaaaccatggcatgagaactatgtgaaatatgcacaagcttcaatagctgattcgatcaagttgaagaaagggtagcagtgattgaagatcgaattaatgaaataaaatgagaagagaagtttagagaaacaagagtaaaaagaaatgaacaaagccttcatgaaatatgggactatgtgaaaaaaccaaatctgcttttgattagtgtacctgaaagtgatggggagaatggaaccaagttggaaaacactatgcaggttattatacaagagaacttccccaacctagcaaggcaggccaacattcaaattcaggaaatatagagaacaccacaaagatactcttcgagaagagcaactccaagacacataattgtcagattcaccaaggttgaaatgaaggaaaaaatgttaagggcagccagagagaaaggtcgggttacccacaaagtgaagcccatcagactaacagctgatctctcagcagaaactctacaagccagaagagagtgggggccaatattcaacattcttaaagaaaagaattttcaacccagaatttcatatccagccaaactaagcttgataagtgaaggagaaataaaatactttacagacaagcaaatgctgagagattttgtcaccaccaggcctgccctaaaagagctcctgaaggaagcaataaacatggaaaggaacaaccggtaccagccactgcaaaaacatgccaaattgtaaagaccatgaatgctaggaagaaactgtatcaacacaacaaaaaaagagaatttcaggttgatatccctgaatgaacattgatgcgaaaatcctcagtaaaatactggcaaaccaaatccagcagcacatcaaaaagcttatccaccacgatcaagtcggcttcatccctggcatgcaaggctggttcagcatacgtaaatcaataaacataatccatcacataaacagaactaaagacaaaagccacatgatcgtctcaatggatgcagaaaaggccttcgacaaaatttaacagcgcttcatactaaaaactctcaataaactaggtattgatggaacgtatctcaagagctatttatgacaaacccacagccaatatcatactgaatgggcaaaaactggaagcattccctttgaaaaccggcacaacacagggatgccctctctcaccactattgtgcaacatagtgttggaagttctggccagagcaatcaggcaagagaaagaaaggaagttgtattcagttaggaaaagaggaagtcaaattgtccctgtttgcagatgacatgattgtatatttagaaaaccccattgtctcagcccaaaatctccttaagctgataagcaacttcagcaaagtctcaggatacaaaatcaatgtgcaaaaatcacaagcattcctatacactaataacagacagagagccaaatcatgagtgaactcccattcacaattgcttcaaagagaataaatacctaggaatccaacttacaagggatgtgaaggacctcttcaaggagaactacaaaccactgctcaatgaaataaaagaggacacaaacaaatggaagaacattccatgctcatggataggaagaatcaatatcgtgaaaatggccatactgctcaaggtaatttatagattcaatgccatccccatgaagctaccaatgactttcttcacagaattggaaaaaactactttaaagttcatatggaaccaaaaaagagcctgcataggcaatacaatcctaagccaaaagaacaaagctggaggtatcacgctacctgacttccaactatcctacaaggctacagtaaccaaaacagcatggtactggtaccaaaacagatatatagaccaatggaacagaatggaggcctcagaaataacaccacacatctacaaccatctgatctttgacaaacctgagaaaaacaagcaatggggaaaggattccctatttaataaatggtggtgggaaaactggctagccatatgtagaaagctgaaactggatcccttccttacaccttatacaaaaattaattcaagatggattaaagactttaatgttagacctaaaaccacaaaaaccctagaagaaaacctaggcaataccattcaggacataggcatgggcaaggacttcatgtctaaaacaccaaaagtaatggcaacaaaggccaaaatagagaaatgggatctaattaaactaaagagcttctgcacagcaaaagaaactaccatcagagtgaacaggcaacctacagaataggagaaaatttttgcaatctacccatctgacaaaggtctagtatccagaatctgcaaagaacttaaacaaatttacaagaaaaaaacaatcccatcaaaaagtgggcaaaggacagacacttctcaaaagaagacatctatgcagccaacagacacatgacaaaatgctcatcattactggtcatcagagaaattcaaatgaaaaccacagtgagataccatctcacaccagttagaatggcaatcattagaaagtcaggaaacaacagatgctggagaggatgtgtagaaataggaacgcttttacagtgttggtgggagtgtaaattagttcaaccattgtggaagacagtgtggctattcatgaaggatctagaactggaaataccatttgacccagccatcccgttactaggtatatacccaaaagaatataaatcatgctgctataaagacacatgcacaggtatgtttattggggcactattcacaatagtaaagacttggagccaacccaaatgtctgtcaatgatagactggattaagaaaatgtggcacatatacaccatggaatactatgcagccataaaaaaggatgagttcatgtcctttgtagggacatggatgcagctggaaacaatcattctgagcaaaccgtcacaaggatagaaaaccaaacaccgcatgatctcactcataggtgggaactgaacaatgagaacacttggacacagggcggggaacatcacaccctgggtcctatcatgatgtggggggcagggggagggatagcattaggagaaatacctaatgtaaatgatcagttaatgggtgcagcaaaacaacatggcacatgtatacctacgtaacaaaactgcacgttgtgcacatgtaccctagaacttaaagtataacttaagaaatccataaattttggaatgccttggacacaacagcaacaagaatctataaatattatgcttgctaatagtataatgtataatttaacccttttaacctttacttcaattccttaaagtctttaaaatctcagttggcatcaaaagtattactgagaaaattcttttgtgctttaccgcaaatttatctgaaatgcattcttttcttcttatacattgaatactctcggagttcgttgttttggaattatatgtgattataagatatttcctgttttttcctcccatgctcccattgttttcccatgacacttttagatatttatcatgttggctagatttcgccttttacttttgcatatgtttggaatatgctattttatattatgtagctcttacgtgtattatttattttccgaaatatttgtatttttcttctcccttgagcctctttatcttcttcagcccattttcttacagatacttcctttcctttcctttcttttcttaaccctttagtctttcattagaactgttaaggaataacagaagaaataccttgtcttctttccagtacttttgccaagcataaattttgtgcttttttcttccctagctgttttatagattttcttataattcagacatatttgtggtctgaactttttgccttttataatgaaatcactaggttacaaagcatttataagttgtgtagtttattctgtaaatttttaataaagacagatgatttagagtaggggtaatcaaactatgccccatgggctcactgcctgtttttgtaaatacaagttttttggaacacatccactcttacttgtataaatattgtgtttggttgctttcatgctccaatggcagaattgagaagttgcacatattaggccgttttcacactgctatagagaactacctcagactgggtaatttataaagaaaaggtttaattgactcacagttctgcattgctggggaggcctcagaaaacttacaattatggcagaaggcgaagggaaagcagggcacatcttaggtggcagcaggggtggggggaatgccacactttaaaggccattaaatctcatgagaactcactcactatcacgagaacagcatgggggaaaccatccctgtgatccagtcacctcccaccaggtccctcatttgatttgtgggaactacaattctagatgaaatttgggttggtacacagagccaaaccatattattttgataaagcctaaatggcttgcaagcctaaaatatttattgtctggccctttacagaaagtttgcctactcttattttaaagtatatgatcatttaaaagtgacatttaattctattaaaagtaaaagcataaaataatttaaaaattatatatatttttctagattgttataggaatttgcatgttggtaattgctaaaatttgataacataatacctacataatttgagcccttaaataaatggagtcaggctgggtatggtggctcactcctgtaatccctgcacattgggagcctgaggtgggcggattgcctgagcccaggagttagaaacctgctggggcaacatggtcaaaccccatctctacaaaacagtacaaaaattagctggacttggtggcacaagcctttagtcctagctactctgaaggctgaggcaggcagatggattgagccaggaaggttgatactgctgtgagctgtgatcacaccactgccagcctgggtgacagaacaagagcatgtctcaaaagaaaaggagtcattttgtgattgagagacaaaagaacaagttaataatgacgtttgtcaattattagagtatgtagttatctaataagttattagggtgtgtgtatatatatgtgcacatacattttctaataatttgtgtatgtatgcatctgtatacacagatatttacatgtctagatttcacagtaggttgatctgagaatgacagcatgatctactattactgagtaaattatcattaccattcagggttatgattcttggaaattatattcagaatggcctaagagaggttgttatattcagtgtgttgaacttgagaaggaaattggaagagtattggcagaaaactttagagcgcatatagtttacttttaaaaattctaaatacatttgaaaaaaattctcttgctcctttttccatgaatttttaattgttttaattaaatttttgaaaaaagttttaaagtttttaaaaacaattttagacaagatcttgctctgtccactcaggcaggagtgtggtggcacagtcacagatctctgcagcctcaaactgctgggctcaagtgattccccccgccacggcatcccaagtagctagggctatagacatgcaccaccatgcccagctgatttttttaatttttaattttttggtagagactaattctcattgggttccctaggcttgtcttgaaatcctgggcttaagcagtcctcctgccttagcctcccaaagtgctgggattacagacgtcagccaaagcacctggccccatgaaattttttttagttcttcgattatcttaaaatatgtgatctgttatatcctgttagtaggttattaacatcctaaagtactaagaaattttctatccagtcagttaaatattttgaagtgttttggaatggatgcatgaaatttttctgtgaaaactttaattctttctttgtattatagtacatactttgggaattatatcctgagttttctagaacagttccaatttcatacttattgaaattaactacaactgcttgagattaagtatttgactgcttatggctgccatgaaagtaatgcttgttgcaaaataattcaaatggtacagaagtaaataagtagtaaaagttaatttttttctctttgttttttgtttttctgatactccccttcagagacatatattatctataggtttcctctccactgtctacattaccttcttttctcgaattttatttcttagttttctcattctgcatactgtatttattgttcaaactgttacgtcattgagtattatttcgagatcttgtggctgtgcttcagtcttccattattcttttttcttttgtctcctgtatgtattttcaaatagcctgttttcagtctcactaattctttcttctgcttgattaattttgccattgagaggttctgatgcattcttcagtatgtcaattgaatttttcagctccagaatttctgcttgatttccaaaaattattttaatctttgttaaatttatctgataggattctgacttccttctctctgttatcttgaagttcgttgagcttaaaaataagtattttaggttctctgtctgaaaggtctcatatctctgtctcttcaggattggtcattggtgcttcatttggtttgtttggtgaggtcatgttttgctgtatggccttgatgcctgtggatgtttgttggtttttgggcattgaagagttaggtgtttattgtagttttcacagtctgggcttgtttgtatccgtccttcttgggaagactttccaagtgtctaaagggaagtgagtgttgtgatctaagtctttggttgctgcagctgtatcgcactgggggcacctgaagcctagtaatgctgtgactcttatagacttgcagaagtattgcctttgtggtcttcagtaaggtccaagagaatttcctggattaccaggcagagaataccctggattactgagctccatgctgaactgcttcaggcggggaaaaaggtgacacaagcatccatgtggccaccaccactatgactcgttgggtcagacctgaagccagcatatcactgggtcttgtctaaggcctacagtgaccactgtgtggctactgttgttgttcatttaaggcacaggctcttttggcagcaagtggaaaatccagccatgcttgtgtctttcccttcagagtggcaagttctcctgtagcccagggtgggtctagaaatgtcatctaggagccagagcctagagtctgggaatcttagaaatctgcttggtgttctgttctactgcagctgagctggcacccaagccacaagacaaagttcttcccactgtttcctctccttttcagaagcaggagactctcattgtggccatcatcaccccaggtctgcagtgaatactgcatggctaccagtgatgttcattcaggggccaaaggtttgtcagtcagcttgtggtgattgcttccaggcctgggtctgtccctttagggcagtgggctcccctctggcccaggacagacccagaaatgccatccagaagccagggtctggaactggggaccctagcagccttcttggtgctctgcgattttgtggttgagctggtgtacccaggcagcaagacaaagtcccctttatccttcctctccttccatcaagcaggaggagcctctccttgtggccaccacagctgggaatacgctgggtcacacctgatgccagcacagcactgggtctcacccctagacccacggtgagtactacctgattactgctggtgtttatccactgcccaagggctccttagtcagcgcgttatgaatcctgccaagactggttccttcccttaaaggtagtgggttttcttctggcccaggatggtctagcaatgttatctggcagctagggcctggaatggaggcctcgaactcttcctgatgccctatgctactgtggttgagggcatccaagttgcatgacaaagagctctttagttttccctctcctctcccactcctcaagcttaaggcaggaatgtctcctgggagcttgtttggcaggtggagccaggggtgcggggccgaggtggtataggcactcccctggctgggtggtttaacataataccattcgtgtatttctgtttttattgtttggggttttgaggtcataaccgtaaaatctttgcctagatgagtgttctgaggtgtttctcctgttttcttttagttttaatagttttatagtttcaggtcttaaggttaagtctttaatccattttgagttgatttttgtatgagttgggagatagggttccagtttcattgttgtgcatgtggatattcagtttcactgcaccatttattttagaagatgtcctttccccagtgtgtgttcttggttcctttgtcaaaaatcaggtggctgtaaatacatggatttatttctgggttctcttttctgtttcattggcctgtatgtctgtttttataccaatattgtgctattttggtaatgatagctttgtagtatatttcaaagacagtgtgatgcctgtaggtttgttctttttgctcagggtacccaggcagcaagacaaagtcctctttacccttcctctccttctgtcaagcaggaggagcctctccctgtggccatcacagctgggaatgctctgggtcacacctgatgctagcacagcactgggtctcacccagtgctttggctattcagagtcttttgtagttccagattaattttagggctgtcttttctatttcaatgaagaatgtcactggtatttcaatagggattgcattgaacctgtagattgctttgggcagtatggccatttttaacaatattaattcctctaatctatgaacataggatgtcttttcatttgtatccttttctgtttctttaatgagtgtttcgtagtttttattgtagagttattttttaccttttctgttaaatttattcttagatatttaatttttttgtagctattgtaaatggcattgctttcttgagttctttttctgaccatttttggtgtgtggagatactgctgatttttctatgttgattttgtatcctgcactgaatttatcagatttaagagctttctggcagtctaggtttttctgtatataagatcatgttgtctgcaaagcagagcagtttaacttcctcctttccatttggattttctttccttttttttttttttttttttggtgtggaaacccaggactttcttttctttcttttattttttgtttctttctttcttctttttttttggtcataaagtttcactctgtttccccatgctggagtgcagtggtgcgatcagggcccactgcagcctcaacctccctgactcaagtgatcctccgttctgaggctcccaagtagctgggaccacaggtgtgtgccaccaggcctggctaatttttttattttttgtagagatagagtctccctatattgcccaggctggcctcaaactactgggctcaagtcctcccaccttggcctcccaaagtactgggattacaggtgtgaaccaccatgcccagctgtctttattttgcctgatagctctggctgggaccttctgtactgtgttgagtaagaatggtgaaaatgggcatccttgaaagcctttcagtttttctcatttcagtatgatagtagctgtgggtttgtcatatatggcctttattatgttgaggtgtgttccttctatccctaatatgttgggaggttttatcatgaaggtatgttggattttatcaaatgcatttttagcaccaattagatgatcatatggtttttgtcttgattctgttaatgtgttgtatcacgtttattgatttgtgtatgttgaatcgtcctttcatcccttaagtaaatcctacctgattaggagaatggcgtgaaaccgggaggcagagcttgcagtgagccgagatcgcaccactgcactccagcctgggtgagacagtgagactccgtctcaaaaaaaaaaaaaaattctacctgattatagtatattatgatgcttatttgttgttgggttcagttggtttgtattttgttgagaattttaaatctatgttcatcatggataatggcttgcaggtattttgttgttattgtttgtttgtttttgagacaatcttgttgctcaggctggagtgcagtggtgcaatctcagctcactgcaacatctgcctcccaggttcacacaattctcctgcctcaatctcctgagtagctgggactacaggtgtgtgccaccacacctggctaatttttgtattttttggtagaaacagggtttcaccatgttggtcaggctggtctcgaactcctgacctcaaatgatcagcctgcctctgcttcccaaagtgctgggattataggtgtgagccaccactcctggcctgcagttttttaattgttgttgtgtccttgtctgtttttggtgttagagtaatcctggccttgtagaacgagttagtaagcttcccttctcatcatttttttggaatagtttaagaattggttcttccttgtaagcttgataaatttagcagtaaagccatttcatcctgggcttttctttttagggagagtttttactactcattgaatcttgttacacattattgatgtgctatactattcttgcgatgttataaaggaatacctgagactaggtaatttataatgaaaagagatttaatttgctcacagttctgcaggctgtatagtcatgtagccggcatctgcctagcttctggggaggtctcagggagcttttactcatagcagaaggtgaagcaggaacaggcatgtcacatggtgagagcaggagcaagagagagtgctggggaggtaccacacacttttaaaaactcagatcttgcaagaactcactattgtaaggataattccaagggtacagttccaaaccattaatgggcagtttttccccatgatccagtcacctctcaccaggcctcacctccaacactgggggttacattgaggggccaaattcccaagctatatcaattggtctgttcaggttttctgtttctttctggttcagtcttaataggttgtatgtgttcaggaatttcatttcctttaggtttttaagtttgttagtatacggttgtttattatagtctctagtgaccctttgtcattttgtagtatcagttgtaatgtcgccattttgtttgtgattttgttcatttgggtctttgctccttttaacatggttagtctagctaaaagtttgttgattttatcttttcaaaaagctaactttttgtttcattgatcatgtatattgtttagtctctagttatttctgctctgatctttattgtttccttgtgctagctttgtgttggtttttcctcttctggtttcttgagagtcatcattaggtggtttttttgaaatctttctacttttttgttgtaggcatttattgctataaactttcctcttagtatcgcttttcttgtatctcatgagttttcgtatgttgtatttctatttttgtttaatgaaattttttaatgttttaaattactttattaatggagtcattgatcattcaggagcatgttgtttgatttgtctctatttgtacagtttccaatgttcctcttgttactgatttccagttttattcttgtggtctgagaacatatttgacatgattttgatttttaaaaatttgctgagacttactttgtggcctaatatatgatttacactggagaatgttttatgtgctgatgagtcgaatgtgtattttacagctgttggatgaaatgttctgtaaatatctgttaagtctgtttggcttatagtgcagtttacatctgatttttttggttgattttccatgtggatgatatgtcccatgctgagagtggggtattcaaatgccccactattattgtattggagctatctctccctttagatctaataatatctgctttgtatatctgagcattctggtattaggtgcatatatatttagaattgttatatcttcttgctgaattgatccttttataattaatgactttgtctttttttttttttttacagtttttcatttaaagtctgttttatctcatctaggtgtagctacttctgtttgcttttgttttttgtttatatgcaatatctttttccattcctgtacttctagtctatgtgtatttacagttaaagtgagttatttataggcagcatacagtttggtctttttctttttaaaaattcattaagccagtctatatcttttatcaggggaatttaatctatttacattcaaggttattatttataggtgaggacttatttctgtcattttattgttttctggttgttttatatatcctttgttcctttttcattgtttatttttgtggtttcgtgtttttctgtatttgtaatgtttggttcctttctctttctcttttgtgtatctgctctaccagtgagttttatactttcatgtgttttcatgatggtggatattattctttcacttctagatgtaggactcccctaagcttttcttttagggtggtttagtggtaatgaattccctcagtttttccttctcttagaaagatgttactgttctttcatttttttttttaaaaggagtttcacgctggttgcccaggttggagtgcaatggcgcgatctcagctcactgcaacctccgcctcccaggttcaagtgattctcttgcctcagcctcccgagtaactgggattacaggaacgtgccaccacacctggctttttgtacttttagtagagacaggttttctccctgttggtcaggctggtctcgaactcccgacttcatgtgatctgcctgcctcggcctcccaaagtgctgagattacaagcttgggtccccgtgcctggcctgctctttcatttttgaatagcactttgctggaaatagttttcttggtgggcagtttttttcttttaatattttgaatatattatctcattctctcctggtcttaaggtttctgcttagaattgtgattttagtctagtggggatttctttatatgtgtgttgacacttttctctcgctatttttagaattctctctgtgtcgttgattttgatagcttgagtataatgtaccttggaggactttttctggtagaatccgtttggggttcttgagcttcctgtattgaaatttgtatggctcttgcaggagttggaagtttttagctattatttcattaattaggttttctatgcctttacccatctcatttccttctggattttctaaaattttctgaattttctaaaatctagttagatatttaaaaaagaaaaaagttatcttaaaagacttgtcttcaagtttagaaattctttctgttgcttgatctattgttgaagtgctcagttgtattttttattttattcattgagtttttcagttatgggattttgtttggttgtttttttaatgacatctatctcttttgaatttctgattcatgaatttttttttataaccttgtattatttatgtgttttctcctgtttctcactgaggctcttcgttatcatttcaaattctttttcctttttctttggatctgttactagagaattagtgtgttgctttggaggtgtcatgtttccttgcttttttatgtttcttgtgtctttatgttgatatttgtgcatctagtgtaccgttcacttcttctagttttgcggattgtcttttgttgggaaagactttttttcttatagatgcatctattatgttgcttttgtagggtgctttgtctttgattcttggtgggtgaagtagtatagtctgcatgatttctttggctggaatcaggattagtcttgtctgtgatttccccagtggcttaggctgtggttcttaggtaaaggctttggtgtggctttttcttgggaggaggaagacaggcagactagttctcaggcaccactggtggcagtgatgggctgcgcatgacagtccttggtgccctgtgtggcatatgcaggtgattgtggtgatgggtctagatgggccaaactttggttgtccaggcagcttttctgggtgccagaggtagaagtggtatggtgagtctggtgggtcctcagagtcttgggtagtgtgatggcattggtggtagcaatagcggtggcaggccaaccattgggtctccagtggcaggccagcagtggtgttgggctgggtgtgccggtccccagtcccctaggtggtatgcataggtgagtgctggtgatagtggcaaactgagcaagttggtatataggcccctgggagatgcatgctggtgccagcagtggccatggtgggtgtctgtctaggcccgcagatagtgcacatggtaaaggtggctgtctgggcagattcatcctcaggctgctggaaggtgtgtatgggttctggcagtggcaggccggtaggatcaatctccaggctcccagatatcaggtgccagatgtggtgagtcagtctccagggctctggagaatgggcgtaggcaatgttggtgggcacggctggtctgtccccacaggttggatgggttgatccccaggccccagatggtgtgttttgatggcagtagcggtgggttgggtgtgcctgtcctttgattcctggatggtgtgtgcaagtggtggtggcaggtggggtggtcttgttgtcaggcccccatcatggtgtgtctgattatcaatgacagcaggttggggcagatcaattcccaggcctccagatgacacctgtggctgtggtggcagtttgggtgggctagtcctgtccttactcccacctccccaaaattgaatgtggttgtggtggatgtggacagagcaggttgatacctaggccctggttggcatgctatccatgttgatattttactctagtttataaatgttaactgctgtatagtatagtgtttaatgaatattaaataatgatcctactatgaattttttttatttctccttgtgtatagattttagagttctaaagtggattgttgagttgaagtttatgtacattgattttccccttaatataaaattgtttttttaggttacactgtaagagaatttctgtttgtctatagtgaaatcaatacttgatagtttcatacttgaattttgccagttgagtggttttgaaatgttagctcatcatcatttttacttacatttttatcataaaaagtggttttccgggaggctgaggcaggagaatcgcttgaacccgggaggtggaggttgtggtgagccgagatggcgcccctgtgctccatcctgggcaacaagagcgaaactccatctcaaaaaaaaaaaaaagtagttttcattttaaaaaaattgcctgttcaagtttttttagttttcttaataatgtatcatattataattaataatgtgtaaatatatacttgtgtattatattgtatattatctatatcatataaattatatataacattaatgtttcttttattttgtctttttcttactgcaggggtcattattcagaatacttaattttgttgcatgttaggtgtattgcaaatatattctgtcactctttggattttcctttaactttctttagtgtgtcttttgtgtagaatagcttatttttgtcttaatgaagttgggtttttctggtttttgtatttttcttgcttttgtattttttgcttttttgtttcatgtgaaattttcaactgacctgtggtcataataaaatttcctatggtttcttgtagtaattttaaacctttattttttaatttatatcttttaatcagtggggtttgttttcctgtatagtgtaaggtatggcactttatatgtctaactggttcttcctgtaccatttgaattgtttctcttcccctctgatttataatgctacctgtgtcatattccatgtatccatatatatcacgatctgtttctgggctctcctctgttccattggcttgtttaaattattatggttctaaaataaatcataatgtggggtggaggtaatttccccacttactttatattttgtgtttgtttgcatagatattattcaagtatctctgagaatcctaaacacaattgttgtaagattgtttaaggctgttctagaagattaattttattgtgacttaattttgttgatttccttagctgtcttagcattagatttcttcgtgtgctttagaatggtggtttgtaaggttatttttaacagaaaggtcattatctctctatttcaccatcttcttcttgtcttactcaagcccttcctctgctcattgttagtgttatagttacttcctctggtctatggtctagaatccagttttaccttgacagttcaaggctcttgcattgctgtattgggtgatagcaaagcattgcttatttcgtttttcatgaggtttgtttacttctgacaccctttatacataacttcatgttaaattctaggcagtggttggcagtaagttttttctgcctccttcaaaattggggattcactctgttactggttttaagcgttgagcttggtaacagtctcccatccttacatgacaattttcagttctctttattcttcatctgcctctgccaggttttacatcttttgcatggccacctgtctttctcaatctgactaaatgctttgagtctggttaaaatttttctcttttttatgttattgctagtatttcttgtcctcccccatcctcaatgtttttatctagtcagcctttatcagaagtataaatccttttttctttttattggaaatctaaaagcttcaaagattactttttttattatactttaagttttagggtacacgtgcacaacgtgcaggtttgttacatatgtatacatgtgccatgttggtgtgctgcacccattaactcgtcatttaacattaggtatatctccaaatgctatccctcccccctcccccaaccccacaacaggcccccaccccacaacaggcccccaccccacaacaggccccggtgtgtgatgttccgcgtcgtatgtccatgtgttctcattgttcaattcccacctatgagtgagaacatgcagtgtttggttttttgtccttgcgatagtttgctgagtatgatggtttccaacttcatccatgtccctacaaaggacattaactcatcattttttatggctgcatagtattccatcgtgtatatgtgccacattttcttaatccagtctataattgttggacatttgggttggttccaagtctttgctgttgtgaatagtgcctcaataaacatacatgggcatgtgtctttatagcagcatgatttataatcctttgagtatatacccagtaatgggatggctgggtcaaatggtatttctagttctagatccctgaggaatcgccacactgacttctacagtggttgaactagtttatagtcccaccaacagtgtaaaagtgttcctgtttctccacatcctctccagcacctgttgtttcctgactttttaatgagtgccattctaactggtatgagatggtatctcattgtggttttgatttgcatttctctgatggccagtgatgatgagtatgttttcatgtgtcttttggctgcataaatgtcttcttttgataagtgtctgttcatatcctttgcccactttttgatggagttgtttgttattttcttgtaaatttgtctgagttcattgtagattctggatattagccctttgtccgatgagtaaattgcaaaaattttctcccattctgtaggatgcctgttcactctgatggtggtttcttttgctgtgcagaagctctttagtttaattacatcccatttgtccattttggcttttgttgccattgcttttggtgttttagacgtgaagtccttgcccatgcctgtgtcctgaatggtattgcctaggttttcttctagggtttttatggttttaggtctaacatttaagtctttaatcatcttgaattaatttttgtataaggtgtaaggaagggatccagtttcagctttctacatatggctagccagttttctcagcaccatttattaaatagggaatcgtttccccatttcttgtttttgtcaggtttgtcaaagatcagatgattgtagatatgtggcattatttctgagggctctgttctgttccattgatctacatctctgttttggtaccagtaccatgctgttttgcttactgtagccttgtagtatactttgaagtcaggtagcctgatgcctccagctttgttctttttgcttaggattgacttggcaatgcgggctcttttttggttccatatgaactttaaagtagttttttccaattctgtgaagaaagtcatcagtagcttgatgggaatggcattgaatctataaattaccttgggcagtatggccattttcatgatattgattcttcctacccatgagcatggaatgttcttccatttgtttgtatcctcttttatttcactgagcagtggtttgtagttctccttgaagagctccttcacatcccttgtaagttggattcctaggtattttattcctttgaagcaattgtgaatgggagttcactcatgatttggctctctgtttgttattggtgtataggaatgcttgtgatttttgcacattgattttgtatcctgagactttgctgaagttgcctatcagcttaaggagattttgggtgagacgatggggttttctagatatacaatcatgtcatctgcaaacagggacaatttgacttccccttttcctaattgaataccctttatttccttctcctgcctgattgccctggccagaacttccaacactatgttgaataggagtggtgagagagggcatccctgtcttgtgccagttttcaaagggaatgcttccagtttttgcccattcaatatgatgttggctgtgggtttgtcatagatagctcttattattttgagatatgtcccatcgatacataatttattgagagtttttagcatgaagcgttgttgaattttgtcaaaggccttttctgcatctattgagataatcatatggtttttgtcgttggttctgtttacgtgatggattacgtttattgatttgcgtatgttgaaccagccttgcatcccagggatgaagccaacttcatcttggtggataagctttttgatgtgctgctggattcggtttgccagtattttattgaggatttttgcatagatgttcatcagggatattggtctaaaattgtctttttgtattgtgtctctgccagactttggtatcaggatgatgctggcctcataaaatgagttagggagggttccctctttttctattgattggaatagtttcagaaggaatggtaccaactcctccttgtacctctggtagaattcggccgtgaatccatctggtcctggactttttttggttggtaagctattaattattgcctcaatttcagagcctgttattggtctattcagagattcaacttcttcctgggttagtcttgggagggtgtgtcgaggaatttatccatttcttctagattttctagtttatttgcgcagaggtgtttgtagtattctctgatgatagtttgtatttctgtgggattggtggtgatatcccctttatcatattttattgcgtctatttgattcttctctcttttcttctttattactcttgctagcagtctatcaattttgttgatcttttcaaaacaccagctcctggattctttaattttttgaagggttttttgtgtctctgtttccttcagttctgctctgattttagttatttcttgccttctgctagcttttgaatgtgtttgctcttgcttctctagttcttttaattgtgatgttagggtgtcaattttagatctttcctgctttctcttgtgggcatttagcgctataattttccctctacacactgctttgaatgtgtcccagagattctggtatgttgtgtctttgttctcattggtttcaaagaacatctttatttctgccttcattttgttatgtagccagtagtcattcaggagcaggttgttcagtttccatgtagttgagtggctttgagtgagtttctgaatcctgagttctagtttgactgcactgtggtctgagagacagtttgttataattactgttcttttacatttgctgaggagtgctttacttccgactatgtgatcaattttggaataagtgcggcgtggtgctgagaagaatgtatattctgttgatttggggtggagagttctgtagatgtctattaggtctgcttggtgcagagttgagttcaattcctggatatccttgttaatttctgtctcgttgatctgtgtgatgttgacagtggggtgttaacatctcccattattattgtatgggagtctaagtctctttgtaggtctctaaggacttgctttatgaatctgggtgctcctttattgggtgcatatatatttaggatagttagctcttgtcgttgaattgatccctttaccattatgtaatggccttctttgtctcttttgatctttgttggtttaaggtctgttttatcagagactaggattgcaacccctgcctttttttgttttccatttgcttggtagatcttcctccatccctttattttgagcctatgtgtgtctctgcacatgagatgggtttcctgaatacagcacacttaatggttcttgactctttatccgatttgccagtctgtgtcttttaagtggagcatttagcccatttacatttaaggttaatattgttatgtgtgaatttgatcctgtcagtatgatgttagctgattattttgttagttgatggattttcttcctagcatcgatggtgtttacagtctggcatgtttttgcagtgtgtagtactggtttttcctttccatgtttagtgcttccttcaggagctcttttagggcaggcctggtggtgacaaaatctctcagcatttgcttgtctgtaaaggattttattctccttcacttgtcaagcttaatttggctggatatgaaattctgggttgaaaattattttctttaagaacgttgaatattggccccactttcttctggcttgttgatttctgccgagagatcagctgttagtctgatgggcttcactttgtgggtaacccgacctttctttctggctgcccttaacattttttccttcatttcaactttggtgaatgtgacaattatgtgtcttggagcaacaattatgttgctcttctcgaggagtatctttgttgcgttttctgtatttcctgaatttgaatgttggcctgccttgctagattggggaagttctcctgtataatatcctgcagagtgttttccaacttgtttccattctccctgtcactttcagatacaccagtgagacatagatttggttttttcacatagtcccatatttcttggaggctttgttcatttctttttattcttttttctctaaacttctcttctggcttcatttcattcatttgatctcccatcactgataccctttcttccaattgattgaatcggctactgaggcttgtgcattcatgatgtagttcttgtgccttggttttcagctccatcagatcctttaaggacttctttgcattgattattctagttagtcattcgtctaattttttttcaaggtttgtaacttctgtgccattggttcgaacttcctcctttagctcagagtagtttgatcgtctgaagccttcttctctcaaatcgtcaaagtcattgtccgtccagctttgttccattgctggtgaggagctgcgttcctttggaggaggagaggtgctctgatttttagagtttccagtttttctgttgtgttttatccccatctttgtggttttatctacctttggtctttgatgatggtgatgtacagatggggttttggtgtggatgttctttctgtttgttagttttccttctaacagtcaggaccctcagctgcaggtctgttggtttgctggaggtccactccagaccctgtttgcctgggtatcagcagcggaggctgcagaacagtggatattggtgaacagcaaatgttgctgcctgattgttcctctggaagctttgtctcagaggagtaccgggctgtgtgaggtgtcagtctgcccctgctggggggtgcctcccagttaggctactcgggggtcagggatccacttgaggaggcagtctgtcggttctcagatctgcagctgtgtgctgggagaaccactactctcttcaaagctgtcagacagggacatttaagtctgcagaggattctgctacctttgtttggctatgccctgcccgcagaggtggagtctacagaggcaggcaggcctccttgagctgtggtgggctccacccagtttgagcttccaggccgctttgtttacctactcatgcctcagcaatggcgggcgccccctcccccagcctcgctgcccccttgcagtttgatctcagactgctgtgctagcaatcagcgaggctctgtgggcgtaggacccacccagccatgtgcgggatttaatctcctggtgtgccgtttgctaagaccgttggaaaagcacagtattagggtgggagtgacctgattttccaggtgccgtctgtcacccctttctttgactaggaaagggaattccctgaccccttgcacttccagggtgaggcagtgcctcaccctgcttcggcccacgcttggtacgctgcacccactgtcctgcatctactttctgacactccccagtgagatgaacccggtacctcagttggaaatgcagaaatcacctgtcttctgcatcgctcatgttgggagctgtagactggcgttgttcctattcagccatcttggctccacccactgtttttttgtttttttttttttttatagactgggtctgtttatgtagcccagcctggctgccaattctttggttcaagcagttctccaccctcagcctcctgagtagctgggattataggaatatgctacaaagccctgtttcaagtataacttgtattttaaatgagtcctaagtctttatataactgatctctttcagtctcttctagtacacattcagctttcctgtgcacatatataattgtatgtcatgcctttactagaaataccacctatcaaaaattgaatttattaggctgggcgcagtggctcatgtcggtaaacccagcactttgggaggccgaagcaggtagatcagttaaggtcaggagttcgagaccagcctggccaatatggtgaaaccccatctctactgaaaatacaaaaattagctgggcgtggtggcatgcacgtgtaatcccagctactcgggaggttgaggcaggagaattgcttgaacccccgaggcagaggttgcagtgagccgagattgcgccactgtactccagactgagtgacagagtgagaccctgtctcaaaaaaaaaaaaaaaaaaaattgaatttaccatttaaccttaaatatcagatcttaaaaaaaaaatcaattggtaatttcctgggtagtgtagagcttagagattagtgttgtcttatatgactcatggtcaggcatctgtttttctgttctgaaatttgcagatctcattagcatcattttgcaatgttagagcagacataaaagttagattatattcttctttcttaggagactgagaagataatagtgtcattaactgaattagggaataaaggacagaggattttgggggaaacaatgggagaaggggaaaaaggagctgaatcagttgcagagttatgagttttgttttagacgtgttcaatttgaggtgctcacataaaaaaattttttctcagtgctacttccctcattatttaatttctaaacttttataataatctattgctaatgtttctgcttttgctcttggccaaatactcagaagagtcttcttcctaaatgaaatacttcatctttttattctcccattcataagtttaattggcttgtttaatatatagaataaagtttaaatttcttggactaataggccctctgccatttgccctagtttctttttacagcttgatatttcactgctctctatttaacctaaattgggctatccattatcatttcagtaaggcatgttaccttgccttgttcaacttttcctttttcattcctgcaggtacagtcttttcaaatctcttgttctttgtgatgttttcctgactactcaatctcactctgatttttcttttctcaggataaggaaaggttaggttggataggttaggaaaggataggttgttaatttagtattatatttttcagttccctttttctcatagggaggcagtagggcaaagtggttagtattgggcatttaatagctgtgtgattttgaagcatttaatctctttatgccttcgtttcttcatctataaaatgaggatattcttgcattcatagagtcgattaggaggattgagatatgaacataatgtctttagcagtatgtgacatattgaaagtgttacaatgttttttctgtttgtctctttttcatccatccctgccttccttccttctgtttgtaaaccaaaaagcatttgagacaagtctcaatttagaagtttattttgccaaggttaaggacaagcctcaggacgtcctgatgacgtgtgcccaaggtggtcaggctacaccttggttttgtgcattttatggagacataagacatcaatcaatatatatcaaatgtacattggtttggtctggaaaagcaggacaacgttaggaggaaggggcttccaagtaataggtggaatcaaagatttgcagttggttgaaagaatttatctaaagacctggaatccatagaagggagtgtctgagttcagataagggattgtggagaacaaagttcttattatgcagatgaagtttccaggtagcaggcttcagaaagaatagattgtaaatgtttcttaatcacacttaaaaaggtgccagactcttagttaattctctcctgtatcagagaaaagaccaccaggaaagggaaagggattctctacagaatatagattttccccacaagagacagctttatagggccatttcaaaatatgtataagggttatactttgatttctttcagggcctgtgatctgtcatgtgatgcaatactagagtcagggtagaatttggtgtcttattgctacaaaaagtcttaagatttctgttttaatgttaatactggtcagttgtgcctgaatttcaaggagaggcgggtataatgaggcatgtctgacctcccactcccatcatagcctgaagtagtttttcaggttaagtttggaatgcctatggcttgagcggaggggtccattcagatagttttgggggctaaggattttatttttagtttatgcctactctccacttttcttaagagaagctctacttttcttatccttgaaatacttgctgcctagtaactgctatttctttgtgacatgtataatcataaacttttttttttttttttttcacacagagtctctctctgtcacccaggcaggagtgcagtggtgcgatcttggctcactgcaacctctacttccctggttcaagtgattcccctgcctcagcctcctgagtagctgggattacaggtgcaaagcaccacgcccagctaatttttttgaagttttagaagggacagggttacaccatgttggccacactggtctcgaactcctaacctcaggcaatccacctgcttcccaaagtgctgggattataggtgtgagccaccatgcctggcctgattaactcttaaattactaactttttagtgtttacataggttttgttatttgagtaaataggtaaaatacttagataaaggtatcaattttactactttttttaaatttttttttcctgaaggtgcctaacacatacttttctttgctcagacatcttttgctgagggaagttatatacaagaaaacaaagtgcagttaaattaatctgttcaataacccagttccccccagtgaatttggtaaaaattagatggtagaatgtggtttagaccagagtagttctgtatttactttttttttcttcctccctgaatttctgcctatttcaccttctaaatcttagagtggatctcacagtttcaattctgtggtttaaaaaaagtgggagagggaggtggcaatcggatacacacccacatacccaccaatatgaaggaaaggaatgtcataggtagcaataaagaacaaatttttcataacatgttttgcaatttctctgatatatgttctggcatagtttaatagtttgattattctgtggctggggcagtatcatgggtcgggggctatgtgggtgaaaagaaggcagaggagagatggctaatggttgagtcatctgggaaaatgactctggtccttttactgagtagcatgggtctcagagattagaagagcagagattagaaaagcacatagaagtgttcacagtgaatatggtgatctcttttattgttaaaatgtggcccaatgaatgttcagcttttggtcattaaggttagttatatcttcctttgagatgatcaaatgaaaagaatacaagggagggtcatttctttttcctttttccagcctgtcataaccccttttttccacccttgatagaagatggaaacagcctcccttgtggactaaagttgatgtgtgaagagattggtgctatatattcctctttatttaagcatgcttgatatatatattttttatgactaaagttaaggttttaaatattgctgttaaggtagagttgagtcagatttctatttttaccatgaaagttagtgaatgtgttttccctggctctctcttgtgctctccaagtgtacctctgagtaaatgactttatttagctttctgtctttgaagtgtgcagtattactctcagagattctttattgcatctggctgttgtcattgtacttgctactggagaggatagaggtgaatgttcctaaaagccttgtagcagttcatttctaagcccctttggtgaccagagctgacaggtgagtcttagttcttttctgcttgcgaagtttggtgccacagggttgaagagcataaagtacatcacctcttagtttcactgtccactttctccttcttcagctctttcctgcatcttaacctcttgctctgtagttttagacaaggacttcaatgatgtagtcacttgttttcagttttattctaaatgttattcacactattgtgaatctgggagttgatggttttctagttttagttgacaaaccctgtgagggacagggagaaaagtgagtaacatgaactcatgatctgtcagtatgaaagtaatggatctgtttacgtgcagtgtttgccacacatttttcctctgttaggaacttttgtaaggaaatgacattcttgcttgtttcatgaggagcaaatggcagtattttcagaaatagctatgtggtccccaagagaaaacattctttggccatgaaatatacttaccagacattttggaaaattgcaacctaaataagatatgactgtaatgcttttggtgttaaagattatcttaaaatattttagctggtatttttgagaacagagtttcttttattagtaattaagggctttcaatgaacgaaaactgtgtaatggtccacagtgatgcctactggttaaaagcagatgatgaattcaaaactaatggaagtaatttcagtcttaatagtaaatattataattattcttattttgctttatttttatttatttaatttgattggggcatgatttgaatggaaactcacttttatttgatacaactaaaatgtaattgaaatgaaagcaagttcaaatcattgaaaggattaatttctaattatagtatatacattgtcaaagtttcctaaccataattaagaaagaagtgtttacatgtttggtaatgtttggtttatagtatatattcctatgagtaccatgattaatgctcattttttaagcacaccaaaatttcaagtttttaaaataaattttgtttaggcaaataaagttatttagtttgtttttcttttgaataataaatacatgtagtttgcagggaagctttactcactttttttttttcagtgctatcattatttaattgctatgtattatatacattttgtatactttggtatattttatattggtaaaatcaatggcaccacaaattaaatatgtcaagcacttatttttaaaattacactgaatgactcctaaagatgtctatacaaataatattataaattttatgatgtagagagataattaaatcaatcaaatacagtatctttaattaagacaacaggaaaaccccaaagaggatttggttactggaaagaacagcacttgaaaaagaacagcctcattaagaaatgtgaaagttatgaagagttaaatacaaaagtggacaaacatatctcacttagagttctttacactgcatactctgggagtctatgctattcaaagcacctcaaatttggaaatttttttttttaaattttttttatttatttattattattatactttaagttttagggtacatgtgcacaatgtgcagtttagttacatatgtatacatgtgccatgctggtgcgctgcacccactaacttgtcatctagcattaggtatatttcccagtgctatacctcccccctccccccacctcacaacagtccccagagtgcgatgttccccttcctgtgtccatgtgttctcattgttcaattcccacctatgagtgagaatatgcggtgtttggttttctggtcttgtgatagtttactgagaatgatgatttccaatttcatccatgtccctacaaaggacatgaactcatcgttttttatggctgcatagtattccatggtgtatatgtgccacattttcttaatccagtctatcattgttggacatttgggttgagagaatactacaaacacctctacacaaataaactagaaaatctagaagaaatggataaattcctcgacacagacactctcccaagactaaaccaggaagaagtcgaatctctgaatagacctttactcacttttttttaacaaaaatttgaaaactcatcgttttcatttaatcccattttgctgctaataatttttaaaaaatagagtaaaaataacttgttctttcttttgctttaaaatgtttgtcatctcacatatgccagatttattggactgcagtagttttagtgcattttggctggaatgtttattatgacatcaccataatctatatacagtatgtgatttcagatggtttcagtgttaaatattttcataattatgctagttttggcagttcacttggaactttttcacatctttttaatgaacatgttttacttctgggcttctgagacaaccatatgtttcaaaaattaataatgtgcttttaatgttaatgttgtgcagaagtgtatgactatggacatttttaaggatttaagttgaactaaaagtaattacagtgaggctttattcacagtagtagtcttttagtatttaagactgtaacatcccccaaataacagaagatgtctttatgaatattgaatagtgaagttattttgtggaatgaaacctgtgatgtttgtttttcattaacttaaaatgaacataagttcatgagaaaattttcagtgttgtttatggttgcaagtctttttgcttgtatgaagtttcaaacaaatttttttctaacgtatcactaccatctgaagccatgctgttttgtaaaacaccttttattgtatatttctcttagtgtgatagtgaataaaagttttcttaaagaggtcttattgtcgttcttatttgcctctagtaccctgttagtttggtaaactagtgatgattattcttttatatgctcttgaaattttcccttcaaatatataaagtagaaaaactaaatttaataccattcttgtaagtattataaaatagtgttattattgattaatgaattcatggtgcgcaatgcactctcagctaccctttgtgttggtatctttgatctctcactccacatgtgcatctttacttcaagcaaaaatgtattcttttatccttaaaaaaggaacaagaagttagttgccagctgatcttccctcatgttactactctacctattttctcttcgtaatgcctatcttcgtgaaagagcaatttattttaattgactccatggtaacttctcattcactctgagctactcatttactgctcccacttctctccctctgtgggaactgctaaatcacctttctaataggttagtggcagcctcctcctaattaccaaatcctgaaacaggtcaactagaatgaggactaagaatatctctatagttgttaacattaccccatttttattgaaaggtctgtgcctttaacttcttccatcttagacactgtatactctggccttatttgactaatcatcattctttgtacgtgctacatacgttgatactgttttgcttttgcttatggttcctcccaccacccctcatttagccccagtctaaacctaaaacatttctacatttgattttgaatggcctgatctttctagttcttccaaacagaatgactctttttatactccttattacttaaaaacaaacaaacaaacaaaaagtattgcttttgtagaattagttatacatgtgttcgatagattctgaagtccctaaggacaggatacaaagataaatatatctaatttatccttgtaaatccagcaatttggcatgtaagagtattatatacatgttgaatcaggacaggaaaaaagtactcatttgcagttataaatacagggataaatttcaaaaatatgtataatttatttgtttctgttactcatattgaaacccagttaaaacttatacctaacatgaatgataatttagtatacattgtttagtatacattgtttaggagaggattataaggattattaagattaatcattaaagatgaccaagatagcttggattgaaaatagtgttttaacatataaacaacaaatggggaaaaattaagaacctttttatttattttgcacttacatagagatggatgttgtttaaaggctttcattaagtcattttttcttttgctagagccataaataagaattctttggagattgtcaagtagtttgttttgatatcagctaaagaaagaagaatttatagttttaaactatgagttattaatattttttaaatgctgtttgagaatgcaaattatgaaaattggttatgtagtttttagagctaaaaaataaaattatgttgatcttatctcctgtagctaccataaactgcatatattaaaaaattttttttcttaattcttgagtatgatcgatggttttctttttctttctttaaaataaaaataggatgaccatgaaagctgtggttctaattctaccaaccgtagtactgctgagagcacaaaatcatcaatcaaaccgcggagaatgcagcaggctgctcctacagatcctgacttaccaccaggtaacttctaatgggatcaataaaaccaaatttcaatttttggccgggcatggtggctcatgcctgtaatcccagtgctttggggggctgaggcgggtggattacttgaggtcaggagtttgagaccagcctggccaacatggtgaagccatgtctctgctaaaaatacaaaaattagccgggtgtggtggtgtgcacctgtaatctcagctactcgggaggctgaggcaggagaatcacttgaacctgggaggtgggggttacagtgagccaagatcatgctactgcattccagcctgggtgacagagtgatactctgtctcaaaaaaaaaaaaaaaaaattgatcattgttttagtactttgtagaatatatatttttagtatcataaaacttttaagctatatgtgcatatgtacttgctacatgacttcagaacaaattgggtcctgggattacaggtgtaaaccactgtaccaagcccaaggtacttttatcttgagactctggtatcttttaggccagactttggattctgctgctttcagccttttcaagaggaaagagtctggagaagacctatctgcttcttaatatccccaggctggaagtgatacatattcctctgatcaaatttcattgaggagaactatttgcagggatattacttatgacttagaagttaaatctcagtagcaattccacattcctgaagtgggagcacaaattattgatggatagctagcttctctgccatacaggtgttctttcttattaatgtatcaatccattcttaaatggattatgcttcaaagtattattttgttaataaccttcaagatagctgatgtttatattttattacagaaaacgtgatcattagagagcctttatttcattttaatttgactgaatttcaaattattgtttagtggagacaggctgtttatttccctaaatgtgtatcactatttgaataatatgctagagcagctcattgagggctatttttgccctcaaagagttaactgtttaggataggagccttttaaactatcaatcacagtacaaagccaaaggaagatgagctctaatgaaccacaagtaatatcttttgggcactaaaaggagggagttgtcatgtccaggtgtgtgtggcttctgaacacacacatgaaacagaggcaagacagatcaaaaatgaaagtatgggagataatataagagacaaatagtagccaaaaataaatctgtatctttcatataaaaatgaggcaaaaataagaaaactaaagacaaaaaacattaatggagataggtaataaagatactaaattataataaaatatatagttctccagaagatacacattgactttgtatggacctaacaatgtgactttgaaatgtcataaatcaagcagggaaaaaaaatctccagattagttcactggatatcaaaattttgttttagtagatacatgtaaactctgcactaggcacataagacagtatacatttcttttgatgcacacattgagtatctacagatattaacaaagacttggttgaaaaggaagtcttgagaaatttcaaagcatcactatcatgtatctttctctctgaccacaatgtgattaaattagattataattattgatgtggttgtatttacttctgccatttcatttgttgtttttctttgttcactctgttttttgttcctgtttcccatctcatgcctactatttactttttaagagccctgaagtagctgctccatacattctctccaggttttatggcttcagtcactgggaaagacagggtggagtgtttactttatcttatccagaactgaaaccggttaacattgtggtgtacaaccttttagagagtcttttcttcctttacacacacacactcacacatatgcacacaaaaacaatttgttataacctaaatttttcatttaatgttatgccaaaaacatgtttccaggccattcacattttttacgttgttatttcaatcagtggcatacaatcctgttgtataactcttctacagtttatttaaccagtcctttttttggtttgatatttaggttatttgttatttttagttttgtaaaatgctttagcaaacatatgtaggtaagtctttgcatacacctctgcttatatctttaggaaaactcctttccaatttatagagtcaaaatttgtgagcacttttaaggtttttggcataaaatggctaaattactctgtggaaagtttgtaacaatactttattccaatcacatttttagtgtaatgctgttttttattattaaaaaaatctcttaaaacttttataggtggaaaatgctatcatacattttattgctaattgggatttccatctttaccattttctttttatacttttttgttaggaaagctaatttttatattttgttagctgaccagtattcagtattttttagtcgcttcttttggagtttctatataaaaagtactgtcatctttgtgaaatgacttttttccctcctttgcaatacttatacactaatttctcttttttccctttatttcattgtctagaacttctgtgaccatcttaaataatatagtatcaccaactcacatcggtttttttagctcctacagtaattgcccaaaattattatctagttattaaatctgatgtttttaattcatattttattgggcctgtctataacattgacagtaaagattttttattcttgcccttttaacaaagtttttattttgaaacaatttcagcatttcataaaagacaagaacattctaaagaacttattttccctttaaccatttgagcataaatttcctatctgatgctacataatgctcaaataaattttacaccaaaaacttgactacgatgtttttatgtactgtaaccaagtcatcaaccgtggcatttctgattatgagcagcttggcttcccagtgaccacatcaagatgaatcaattgcagatggtgtctctttgtaaccaaaattttttgatacatgccatttaagactatcagagaaataaataagatacagtcttttttctctaggacttcacagtttatcagagaagataagcatacatatacataaaaaatgactaatagtaacataagcccaagaaaagtggtagagacatttctctttaatgttgaggtgtaggatggaggacattggagaagacaatataaggcagaggaaaattatactgcacctgaacaagaagtgcgaatggacaaaaagtattgtaaaaaggaggaagaacacgagtaaagttagtgaaaattagtgttttcatctgggcctgtggatatagatgtatgtttggaagaaggggttatatgaggtatggggagaggtagataataagaatttctggagaaaggttgactagtagcaggctgttttagagccatctaatattacatcttgtaggttctcatccttagtgtgactttctattttcagatgcgtgtggagtagacccggatgatgaacaaatatactcccagggagtctctaagtatggagtgatgagagctattagatctacttgacactatcttgtaccttgcttagaactaagttactgtgagggattatagagacggtttgtcatttattccactgataagtttctgttacttattttgacattgcatttttagtaaggaaacagtgatagtcttctacagaagtagttctttcgatatttgattcttttactttggtgaagtggcttattcatctcaatttgtatgtcagttttataatacaaaatggaaagaaaaaaaaatatatatattttgagacacggtttcactcctgtcacccaggctggagtgtgatggtgcaactttggctcactgcaacctccgcctctggtgctcaagcgattctcttgccttagcctcctgagtagctgggactaaaggcacatgccacgacacccagttaatttttgtatttttgtagagacggggttttaccatgttgcccaggctgatctcgaacccctgagctcaaatgatctgtctgcttcggcctcccaaagtgctgggattataggtgtaagccaccatgcccagccagaaaatatttttaaaaagatgaacaatccatcagtagtgttctatcagttaaaatacatattgtgttttgtttctattactttgcattatacttctatgctatttttgatactgttttaaagataataaaaactcatgaatgcttacgtggtttttaagagtactgtattggccaggcatggtggctcatgcctgtaatcccagtactttgggaggccaaggagggcggatcacgaggtcaggagttcgagaccagcctgaccaacatggtgaaaccccatctctactaaaaaaaatacaaaaattagcctgacgtggtggcacgtgcctgtaatcctagctactcaggaggttgaggcaggagaatcacttgaacccgggaggcggaggttgtcgtgagttgagatcatgccattgcactctagcctggacgatagagagagactagtctcaaaaaaaaaaaaagttccctgttcatgacaggtttttgagaaatagggaaaccaatattagtcatgctcacttgacttcttggaaacatttttatttatttattttttagatggagtcttgctctgtcgcccaggctggagtgcagtggcacgatcccggctcactgcaagctccgcctcctgggttcacaccatcctcctgcttcagcctcctgagtagctgggactacaggtgcctgccaccacgcccggctaatttttttgtatttttagtagagacagggtttcaccgtgtcagccaggatggtctccatcttttgaccttgtgatctgcctgccttggcctcccaaagtgctgggattacaggcgtgagccaccgtgcttggccccatttttgtttttaaaatctgcattgagtagtaataatatggggttatgtacattctaaggttaaaatgttgatacttacaatttcttttggaggtctcatttattaagaattattttagcatctactcatggaagagtaattgttactttaaatctattaatattttgaatgttaattttatagcatgtgataattggcactctaaaagctgctaatagtttctatataggagaaaacctcgaatctaagttgtattacatttctttcctatttgcatcattgggaatgaatgaaggagttgggttttgcacacgttatggttgaatagatttaagtaagtcttctctcagcaggctttagtgtaggtgttaacaatgtcagatgctgacagaagttgattatgttttgtccagtaaaattctgggttaaagaatacaaccatatggttatttcatgaaatagctaaaattttaattaccttttaaatagttttctttaatagtggaaatgcattaccttttagttagctttttacagtggaaaagattaatttttttttctcctggcttttaaaatgctttttataaagtgttatttatatttttaactaaattactcaataatgtatccatgtacacacttacatgagaaacataagtgagattatggagtattcctcagtagcatgaaattaaaagaaaaattttggagattctaagcaagccatggagaaatagaatgttcattaattacttttagtgtttggagttaacctgtatttctgtttctttttcctatttccctgtgttcttattctacttttatacattctccttccttccatacttttgttttttcatttttctgtcttcttcatggtagtattttaaaaatatttctttaactcttcctgtctacattttcttcttcattcatattttcccctctactctattttaacattaaatattagtaagtgagtagagttgaatccattatgatggtcatgtttcttctatccgaggcataacttttaaatatttttatggctaaactaggaagagatgaaggtagctggtttaaaaagaggcttaagcttaaagaagaccatcttctaatatactgtataatcagcatatagtaacattgcttcattttggaaaatgtttatataatacaataagcaaaaatcaaacaaagtacttgtagaataggataatcattgtatgggatctaatattatgttatcaaaaatatatatggtctttgtggtttctcttagtatatgaatacttcactatagaacttcttgataatgacgtttgttggggtcgatctgctacttattacctgtgtcactttggcaagccttttaacctatctgaacttcagtttctctttgggaaatatgctaaataataaccacctttctcatacattaagttcaataacactttaagaaataattatttactgagagatttgtggctaattaaattctttttttctattttataggttatgtgcagagtctgattagacgagttgtaaataatgtaaacattgtgataaataatctcatactaaaatatgttgaagatgatatcgtcctttccgtcaatatcacttctgcagaatgttatacagtaggtgaattatgggatcgtgcattcatggatatttctggtgagtaaatatggagaataccgtatatttttccataattgaaacaattaccttaactcttaacccttctttgggccaactgagttgctggtaaatgttatcaaatcttcatgcctccagtgtgggaaaaaaatgcacatatacaaaatgttgcatataattacaggaggttagtagacactccaaattcagaaatctatacttgtggtttttgtttgtttgtttttgagacagggtctggctctgttgcccaggctggagtgcagtggtgtgatctcagctcactgcaacctctgcctcccgggctcaaacaatcctctcacctcagactcttgagtagctgagactacaggcacatgctgctatgcccggctttttttttttttttttttttttgagatggagtcttgctctgtcgcccaggctggagtgcagtggctcaatctcggctcactgcaagttccacctccccgggttcacaccattcttctgcctcagcctcccgagtagctgggactacaggcacctgccaccatgcccggctaattttttgtatttttagtagagatggggtttcaccatgttagccaggatggtctccatcttttgaccttgtgatccacccgcctccgccttccaaagtgctgggattacagatgtgagccactgcgcctggccaaatttttgtgtttttttgtagagacaaggttttgccacattgcccaggttggtcttgaactcctgagctctagcgatttgcctgccttggcccctcaaagtgctgagattacaggaatgagccaccatacctggcctatacttgttttttaatacttttaattttcattctttcttacttgccacatgcttgtttcaaatgtgatgtataatacagtcatgcattgcttaacaacagggacatattctgagaaatgcatcttaggcgattttgttgttatgcaaacatcatagagtgtacttacacaaacctagatggtatagccagtacacaacctcaggtatatggtattggctattattgctcctaggctgcaaacctgtacagcatgttactgtgctgagtattgtagatagttgtaacacagtggtatttgtgtatctaaaaacagaaaaggtatagtaaaaatatagtattataatcttatgggacagccatcatagatatatagtctgttgttgacttaggtattgttatgcagtgcatgactatattttatagtgccatgggttgtagcaataaaagttaaatgatatttagtttgaattgtttatgtttttgaaaggtgaaaggcatcatgtttcatttacaaagcttggtgaaggcaaggcaatatatctgattgatttatgttttaggcttgtgtgttccaaagcacatttggaatttcttccttcttttcctcccctctccccaccgtcccccctcccctctccctttcatcctcccttccctttccttgcttctcccctgcccctttccctcttccccctttcctttttgagaaagggtctcattctgttgcccaggctggagtgcagtggtgctaccttggctcactgcagcctcgacttcctgggctcaggtgatcctcccatcttagcctcccaagtagctgggaccacaggcgtgcactaccatgcctggctaatttttgtatttttttgtagagatggggttttgccctgttgcccaggctggtctcaaactccttggcttaagtgatccacccaccttggcctcccaaagtgttgggattacaggtgtgagccaccatgatagccctggaatttcttgattatcctgaagcctgtttttatctctttttaatgtttagtcatatattcctttattcatcataaatcccagttaaagggttaaagcaaagtgaaattgagtctcaagagtatttaacttgcctgattaaggcatacaactaggaagtagcagaactggaatagagttttattattatgtgttttctaagctttagtcttcacatttaacaaaaggagagtagtcctgattttacaactttgttgtgagcataaaagtgtaggtaaggcccaagcatcatttcttatatatcgttaatgcctcctttgcatcttctgtggaaagaaatatttgattaaaaggctggaagaagcagctatggaaaatagaaaacaaatagaactggacaatgtaggattgtattaatgagttgacatttgtggtgaagaaattttattttaattaattaattaatttttttgagacagagtctcgctctgtcacccaggctgaagtgcagtgacgcaatcttggctcactgcaacttctgcctcccgggttcaagcgattctcctgcctcagcctcccaagtagctgggactctaggcgcctgccagcatgcctggctaatttttatatttttggtagagacggggtttcaccatgttggccagtctggtcttgaattcctgacctcaagtgatctgcctgcctcagcttcctagaatgctgggattacaggcatgagccactgtgcccacccagaaatttaattttagtatagaagcaatttagtatggtatagaaatttaatttagtatagaagcaatgccagttttactttgggaaattatttatagtgaattagaattctggatcaggagttggaagatcttagtttgaatcttctctccactgctaatttacagtgcaaacttgggtgagtcatttataaaatgactgcttctaacttgccagtgtactcttcagaagcaaatataccatatgaaagctcatgatgatggtggtgataaagacagtgaaaatagtatcttctgtttatttagtaccagggctagtgttacatattttatattaattatcttgtttaaccctttaactctctgaggaagaaactattattttcccttttattagtttttttttaaataattttttttaattgaagcataacatgcaagaaagaaagagcattaagcaaaaacacatagctggccgggtgtggtggctcacgcctgtaatcccagcattttgggaggctgaggcgggcggatcccctgaggtcaggagtttgagaccagcctggccaacatggtgaaacaccatctctactaaaaatacaaaaaaaattagctgggcacggtggcaggtgcctgtaatcctagctacttgggaggctgaggcaggagaatcacttgaacccaggaggcggaggctgcagtgagtcgaaattgtgccactgcactctagccttggcgatagagtgagactccacctcaaaaaaaaaaaaaaaaaaaacccaaaacaaacaaacaaacaaaaaacccatatagctaaacgacataccacaaaatgaacatactcttgtaaccaccaccaagctcaagaaattgaacaatatcagcacccagaagtgcttgttgtacatatactcacttactactgccccttctttccccaaagcaaccactttactgacatctgacaccatagtagggtttggactctttttaaatttttgtatgaatggaaccatatgtattttgggcctagattattttgctcaatattatgtaaatgaaatttattcaggttttcgtctgtaacaatagttcagttctgcgtgtatatatctattccctctccctgcacaatcaggtgagcaagggttggggttctgcctgcactggtctttcctggatatatgtgggatggcgagtttgcaggtctggtctgtgttgtgaataaaacatttttttgctcagtgtaccattgatatagatttaattatgtccagttttggctataatgaataatgctatagcgaacattttcatacatgtcctttggtggacatatacatacatttctgttgggtatatgcctaggagtgaaattactgggtcatagtgtaggcctatgttaagcttcagagatactgacaaatagttttttcataatagtaatgccatttttttactaacaagtaatgcacgaggctgtattaaaatattgcagttaaaataagaattgtaatatctttgtgagggtaaaaaggcaagccacagatggaagtgtatattcttgatacttaaaatttgcaacatacttatatccacaatatataacttctataaatcaataagaaaagaatagacaactcagtagaaaaatggacaagagacttgaacaaacacgtaaaaaagagtataccccaaagaccaataaacataagatgttcaattaacaccaaatcagattgcactaaatacttgccataatggattaaaaaataaaataattgggccatctatctattccttctcctttaactcattccttccccttacgtattttttttttataatttccaagacttttatttcagtataaaggtcttcagaatatctaatcttttctactattagaggcagaatcctatcatctcccatgtggttgacattcaagttgttctaaaatattgacattgcccatagtgctggaatgtacatccttttttatgtttccttgttacgtgtttgaattctgtaaattatgatcaggaaaagaataactgcatatgtaaacattcagttatgttttatattgctgaattgttctctaaaatgattaaatcaatttattaccatccatactatctgtgagaattaatatttctttttattcctttccaagttgtattttaggttgagagggtacatgtgcaggtctgttacttgggtaaattgcatgttgcatgcatttggtgtacagattattctgtcactcaagtaatgagcatagtacctaatggttagtcttttgattcttaccttgctcccaccctccaccctcaagtaggccttggtatttattgttgccttctttgtgtccatgtatactcagtgcttagctcccacttataattgagaacatgcagtgtttggttttctgttcctgcataatttgcctaggataatgccctccagctctatccatattgctgcaaaggacatgatttcatccttttttatggctatgtagtattcgatggtggatacgtcttgtattttctttatctacttcactgttgttgggcatctaggttgattccatgtctttgctattgtgtatagtgctgcaatgaacatacacatgtgcgtgtctttatggtagaaagatttatattcataagcgtgttgcctatgcttttgaggtcttagtcataaattctttgcctagaccaatgtcaggtcttacatttaagtctttaatctatctcgagttgatttttttaaatagtgagagataagggtctaggtttgttcttctgcatatagatatccagttttcccagcaccatttattgaagagactgttcttttcctcagtgtgttttcttggcccctatatagaaaatcagttggctgtaaatgcatggattcatttctgggtttttgattttattccattgggctatgtgtctttttttatgccagtaccgtactgttttggttattattgcttttagtatattttaaagtcagggagtatgatgcctctagctgtgttctttttgcttggggttgctttgagtatttagggtctttgtggttccataaaaattttaggattgttttttcttatgtctgtgaaaaaatgtcattggtattttgatagggattgcattgatttcgtagattgctttggatagtatggaaatgattttggaagaattccctccacttcaattttttggaacagtttgtgaatattggtattagttctttaaatgtttggtagaatatgacagtgaatccaaaggtcttaggcttttctttgattgctttttccaggttttggaagttttctctatttctttgaataagcttcctaacctctttttaaaaatagtattcttatatgttgtattttgggtttgttgttttcaatcaatactatgcttttaatatttctatatattggtgtatatagttgtagagccctaatttcagtgatgaataatattttactgattaaattgtagcacatttctaaagtaagtaccagaaactagaattcattttctaagtttttgaaatatagttgctgttatattttgtgtttaagaaaaaatacctttaaaacagtaatgtcctctttcactgaataataattgtctagggtctagggtatccttgaaatttgaatacttcactttttctttctttcttttttttttttaagagagagtcttaactctgttgttcaggctggagtgcagtggtgtgatcttggctcactgcaagctccacccctgggttcaagccattcttgtgcctcagtcacctgagtagctgtgattttctgcatttgccaccacacccagctaattgttgtatttgtagtagagatggtgtttcaccactttgcccaggctggttttgaactcctggcctcaagcaatccgcctaggcctcccaaagtgctgggattataggcatgaaccaccatgcctggcctgaatagcttacattcttatagcaaagtagataagaacatgcactctgcagtaaggttgccagagtttgaattacagctctgatctttataaactgtataacaatagacagactattaccactgtgcctcagttttcacattttttaacaggaccgtgtaaatattgtcagataagagatgtaaaagacttagtgtagtatctgagtaatagcaaatactcagaaaatgataattgttatcataaagagagggaaggaaacatctacaggatatctttttttttctcatttctggtcctactattgtaatttcttaatttgtgtacatatataatattagtaactaaatcattattcatataatatgtaaatttgaaatatggtagtcatatgtctttttcaactaacagacaactttgaaatttatctgcaaataatactgtttagacacatcttctttaatttctactttttaaaaacttataaaataaaatgttgaattaattagaagttgccaggatatactcagaaatagtgttataacctgaactaaaacacattttattgttttttaaattcccatggctaacttaaaatcactgggcaagtagatttgggcctgatatttacctaggaattgcttatcagttaagaaataagaaatattgatttgctaaaggcttcatttcatacttttatactttaccatcaattgttttatttttattcctttgaaaatatactctagagtgttattggtgatttctttattaattaatgtggtggtgtccactagacctttctgtgataatacaagtgttttatatcttctctctccaatatggtagccactagccacatgtggctgttgagcacttgaaatatagctagtgcaaccaaggaccttaatttttatttttatataattttaattaatttaaatagccacatatggctggtggctaccatattggatagtgcaagtttagagtagcagtgagttttttttaatataaaatgaatgttaaatgaatgacttcttcaaaaaattatctttaatgtggattcttaagaattttattgttatctcattgtgtaagagaactgtagtgaaatttttcataattaaaaaaaatttgtagttaatgtgccatgcagattggggcaaactaattaggtctctgattcttcatatataaaatggggagaattgtgcctatttcataaagttgttggaagatttaaattgtataataaaatgaaaagttcattgcatatggtctggcattatgtattaaatgctccatgaatcttattttctgttattattaattttattactatttatactaataaataatagttgcctttcccctgctaattttcctttttacttaaaatgtttttttttctttttagcaactgatttggtgctgagaaaggttatcaatttttctgactgtacagtttgtcttgataaacggaatgccagtggtaaaatagaattttaccaggatcctttattatacaaatgttccttcagaactcgtcttcattttacatatgaaaacctaaattccaagatgccatctgttattaaagtaggtatctcttttttttgcagttaagttgcatgtctttattttgtttattgactcttgtggatgctaatcattattaacaaatgaagaaattaaccttgtaaatatgtatgccatttgtttttataaaaattttatttatgtttatgatttttatgttgtatttatacatttctgtataacgtattctactagagtttagagacaacttttttctgtaattgtttttttttagtttttccagctgtttattagtgtttctctcttcaagtagatagaggaaataatattaaaaggtatatttatacccacagtggactgcatatcagtattctgtatttcagttcttataatctgttcagcatgatctgctatctatactttttcttctctttactaggtgacttcgtaaagcttgatatactaacctaatagtttattggttcaagaagttttagcttttgatttatgatttttaaaatgtaattaaaatcttagggagttattcaggacatgtctttttattttttatctgcattttcatttaagattaagggatttgttacaagggtatattgtgtgatgcttaggtttgggctcccactgataccatcatccagatagtgaacatagtacccaaaaggaagtttttcagcccttttttcctctccctccttccctccttttagaatccacactgtctgttgttcccatctttatgtccatgtgtacccaagatttagcttccacttctaagtgagaacaggacatgtcttttgatacatgtgaaaattttctgtccaatgtagtgtatgttttcaatgtatgtgattagtatctaagcataaatattgttgtcttatttaacagttttctgaacattgtttgtctgcctatcattgtatcttggaaaaagaattcagtgacttctgatcccattaagtaggttttaatgtggagtaaatgtttattgttgaactacttgcctctgactgtcaaagttctgtagatggaagggctggacttaggtgtctgaacactggtattaactactgttcctgtttgagtatggctgtataaaaattagttttgtttttgttaccttatattttattaaaaatatagtattttctattttacgtagccttactgtacttaatatgtaaaatctacatgtttttttcttggtagtgcttagtcacctgtgttttacttttttccacacggtgtataatgcatattggtttgtttatattctgttactttttccttctatatttgaattagcttctttggcaaagataaacatggaaaagaattaactcagtaatagtgatggctctgtctcagggaaatacgcttattttctatagccttgggttttctagtaaatttggggaatgtgaaggtaaattgaagatacattgaaagcaagtaatggatatatggaagcttactatataaaatactctttttgatcattagtgcaaatgtaatggtctattctaggatgtggttatattagaggaaggtaaaaatagatgaggaaaaacttagtgttggcatataagtaagtttgtgttctcaaaactgattagtcattacatttcactgaaaaagtcccttatcataaataaacttgtataatagttgccaaatatgtgatatcaatgtgttatactcaactgaaatcaattttggaggttttatttctttcttcttttcttttctctctttcttttttctcccctcctctccctctccccacccttcccctcccctctgtttccctcccctctcctccgctttctctccttttttctttctccttttttctttaccttcgaggctccctgtcacccaggctggagtgcagtggcacaatcatacttcactgtaaccttgaactcctggggtcaagcgatccttctgtctcaggctcttaagtagctaggactacaggcgcatgtctccatccctggctcattttaaattgtttttttgtagagacggagtctcactgtgcagcccaggctgatactgaacctcctagcttcaagtaattctcttgtctaggcctcccaaagtgctgggattcctggcatgagccaccatgcctgcctgagttttttgttaatactattgtaatgttaagatttgccattttgggttagacccatcattcttccaagtcctaatcctagggaatatgtattaaacagatatggtcgacctcattaattacttcacagaggtttctcaaaatgttccagatactatatttcttttcttctttttttttgagacggagtcttgctcttgttgaccaggctggagtgcaatggcatgatctcggctcactgcaacctctgcctcccgggttcaagtgattctcctgcctcagcttcccgagtagctgggattacaggcgccggccaccaggcctggctaatttttgtatttttagtagagacagggttttgcccttttggccaggctggtctcaaactcctgacctcatgatccgcctggctcagcctcccaaagtgctgggattacaggcatgagtcactgcgcctggcccctctatttcttttcaaatctttcatgtatgtttattttgaatgtatttatatgttgggttggctttttataattttccattttttttgtgtgagatacatacgttctggtgattatgatgtttatgagatacagatcctatgggtacgtaatttatttaacatttctcctgtttttagaaatttactttgcagtttctcagagcagtgaaattctgtgcatagaactttgaccacatttcctgagtaattccttaggaaagatttgtataattgcaaatatcttttttttttttttaagacctgtgatctgtattgccagattgtttccagaaagatttaaccaggttatactcacatgaacattaaggggagtgcctatgtcatactcttattatccttaaatatgatcatattttaaaaattgccaacttgttgaacaacaaatgatatgtaatttaattgccgtttattagtgaagttagatttttgaaaacacattcactggtcatttgttctttgtattatcagttcaggttctttatccatttttctactgagtattaatcttactcattttaaggagcttttaaaaagatacttatgacagattctttgttattggttttgctgactgcttattaccagtgctattggtgcaatacaagatttaaaagaatgtgacagaggaatttcaaattaaggaaaccttagcagacatgcatactcctttcctgctcacctcccacactcattccccgctttcttacctcttcattgtttattcagtgtatgattattaggtcagtttttaaaagcttgtgctcatatttgaaatatggtatttcacagtccccccatatagttttctcccccttcacatacatttttttatgtgctttgcaccctaaaaatacgatgattaccattactattacttcatctttcatagacactgaaatacattagtcaaaataaaccttctaagagacttgactttatggcataattggttttactccgtgtttagataacagcaggaaaccattacactgaagttgtgtttatattccactgatgtctctttctttaaggagagctttgattgctgtatatcctatttgctagtagttaatcttatttctttgttataatggtttcattttatcagttgaataagttttatgtcatttaaatcttatctacaatttggaaaacttttgttatttaaatcttacttaaaatttgtctgaaaaacttttttcaacatatatttcacttgtttttccatatttgacaaaaatttttattatttacatactttcatagttgtaatactagtcttttccccagttaacatatggttttaggatgtatatgtattctttatggttaataaacctggaaagaatgattagagtttcactaaaatgacataaaatttttattattcttggttttgacagattgttctgttttttgaggataatactgttattctcttaatgttatagagtagctatttggttatataactaactttgtttctggaatagtaatctggaaatctagtgtgattataccttctcactattaattccatttgtatgtacatcatttggtttaatatcgtttctatctaacgtgtattgatcatcatagcaaaatttacttaattcctaagatcttagagtaagtattgttttgatttaagtattaaaatgtttggagcatttcttttatgttatgccatttaaagactttaaaacatttctttatgtaaaaaatactctttttaaacatgcgtttgttggtgttatgtctttttcaaaatgcagattcatactttagtggaaagtttgaaactttctatcacagatcaacaactgcctatgtttattcgtataatgcaacttggaattgctctttactatggagaaataggcaattttaaagaaggcgaaatagaggaccttacttgtcataataaagatatgctaggaaacattacaggtaatgtaaaactttattaaacaaaaactttattttaagactattcttacgttttaccattgggaaactttaaaaaatgtattagcttgagttttacagtattctaatgagatgggctgattgttttttggttgttttacactattttaatttttttgtttgttttgttttgagatggagactagctctgttgcctgggctggagtgctgtggtgcaatcatggctcactgcaacctctgcctctcaggttcaggcagttctcttgcctcagcctcccaagtagctgggattacagacatgcatcaccacgcctgtgtaattttgtattttttttttttagtagagatgggttttcaccatgttggccaggctggtctcaaactcctgaccttgtgatctgcccgcctcagcctcccaaagtgctgggattacaggcatgagccactgtgcccagcctacactactttaattttatctacatgctggataacattctgattttctcctatatgctaaaaataacttctatatttataatagatataagtgttcagaatgtactacttatttatttatgaatgagggttttgctctgtcacccaggctggagtgcagtggcatgatcatgggtcactgcagccgcgacctcccaggctcaggtgatccttctaccccagccttccaaatagttagggctacaggtacatgccaccatgcctgggtaatttttgcattttttgtagagacagggttttgctatgttgcccaggctggtctcaaactcctaggcataagctatctgcccgcctcagcatcacaaagtgctgggattacaggcatgagccaccatgcctgacccaggatatacatttgataaaagttgaagtagtatacctcaagatttcctagtaaataatagtattggtaatttttctgcaaaagttcacttaagttgaattgagttattttagtgctgttaattaatgaaatgtatacttcattgaaggatatgtaatgtgggaaaatacagaaatcattttgatgtatttctttcccttagaattttaagataaaatgggacagatagacatgtcagtagttagttaagtatgatgaatggtagaatggcagaaagtttgataaatatcatgaatgatctgatgtagaaagatgaaaggatgactgatttcaacttggtattgggcctgagactcagaaagttttcaggtgattaatttccatagataaagccctaagagaagggcatttaaaacttaggggcaaataacccaattaaaaatgggcaaagagacatttctccaaagaaggtaaacaaatagcaaacaagcaaatcaaaacctcagtgagataccacttcacaggtactagatgactataataaaaaaaaatacaaaataacaggtattggtgaggatgtggagaaactggaactcatataagttgttgggagtgtaaaatggtatagttgctttggaaaacaatatggcagttcttcaaaacgtgaaacatagagttaccatgttgacccagcaattccattcctacgtgtatatcaagagaactgataacatatgtccatgtaaaaacttatatatgaaatgttcatggtaacatattcatagtagccaaaaactggacacaattgaaatgtctgtcaactgatgaatggattatcaaattatggcatattcatacattggagtattatttagctgtacaaaaaaatgaaatactgatataggctacagcatggatgaaccttgaaagcattatcttaagtgaaagcagccagtcaaaagataatacatatgatatgattccattagaaatgttcataataggcagttctgtagaggcaggaagtagattagtaaccaggagttgcggggaggagagaatgactgcaaataaataggtttctttttggaatgatgaaaatgttctaaaattagatagtggtgataggagcaaaacttgtgactattaaaaaaatcccactgaattgtacacctttaaatgttgaattttatgctatttaaactttatctcattaaaaaaatcttactaccttaaaataaagcatagagaacaacattaatcagagtatgtagatataaaacatacctttatttcacactagagggtaaatttttgttagacaatgcattgctgagacagaaacagtgtcttatacctggaacaaacataacatgtagaagatacttgatttatttttttccaacttgacaaatttcaaatatatggaaaagctgtaagagttattataaggtgaacactcacagacttatcatctggagtcttctattgatattctgttacaattgcttcatcacatattggttcatctaacatccctttccctatttatcaatacaattgtttttgatgcctttcaaattaagttacatacattgctacacttcacccctaaccctcagctgcctgttgttatctagagtttctactaagtggtgggtctttttattttttttggaggttaaatctccaaagtaaaattcaatgagtttgagaaatacatacacctgtgtgatgcaaaacactcatcaagatataggtcattaacatctgagatagtttcttatgcccctttctagtcattcccctttcacctgcctgcctccccgcgagaaaacactgttctgaagttccttaaaactgtagatttagttttgctgattctagaatttcatataaatggaaacactcaatatgtataaaaggcttctttcattaagcatagtgtgtttggtatttatctatgttgttgcatgtagcagtcgttctttccttttcattgctacatacactgtatgaatataccatgtgaatatactatagtttattttaccattcactgtttgatggacacttgggctgtttttcgtttttggctattataaataaagctttcatagatatttttgtacaaatttcacgtagacatgtgctattctttctcttgggtaaatacttaagagtggaattatatgtttagttttcaaagaaacttccataacttttttcaatgtggttgtaccattttatattcctatcaacaatgtgtgagagttgcagttggcctacatccttgctaacattcaatggtgtattttttcacttttttgccattgggatgagtgtgttgtggtatctcatggttttttaatttgcattttttgatggctaattattttgaatttttaatgtgattatcggcctttatctgcctttgtgaagtatgtgttaaatatttgtccatttaaagcttttttgtgtcttttaaaaattttattttactttatgtatttattatttatttattgacatagtctcactctgttgcctaggctggagtatgatggcatgatcatagctcactgcagccttgaactcctgggctcaagcaatcctccagcctcagcctcccgagtggctgggtgggactacaggtgcacgacactgagtgtggctgataaattttgttttgttttgtttttggttgaggtgggggtctcactttgttgcagtaggctgttcttgaactcctggcttcatgtgattctcccatctcgggctcccaaagtgctgggattataggaatgagccagtgggcccaacagggtttgcaccttatataaaacttattctgaactacaatggcttaagtgtcttggtactgttattttagttactctagttaattcttattaagccttttccttctcaggtgaaagaaggtaaacattcataacctataaatgtagaatgttccaagagtctcctgtcataagagtttaaaaagttataaagctttttgagtaagaaaacctgtaaggatgttatttaaagatttaaaggagtatgtgtatttatagatttatcaatggagagtagatatgagtgaatatgctggagactaatttttccatggtgttttttttttgtttgttttttgtttttagacagggtccagggtcttgctctgtcacccaggctgcagtgcagtggtatgaaacatggctcactgcaacgcctgcctcctggattcaagtgattctcccacctcagcctgccaagttgctgggaccataatgggtgcacaccaccacacccagacaatttttttgtatttttagtagggacagggtttcaccatgttgcccaggctggtctcgaactcctgagcttaggtaatctgcccaccttggcctcccaaagtgctgggattacaggtttaagtcaccgatcctggcccctatgaattttacacccggacagtttttttgtatttttagtagggacagggtttcatcatgttgctcaggctggtctcgaactcctgagctcaggtgatctgcccaccttggcctcccaaagtgctgggattacaggtgtgagtcactgctcctggcccctatgaaatttttaaaaagtaatttttttttctaaatttcatgatgcctcttttgtttatattgctataattatattaaaggactttgatggagtttgtctttacaaaggtggcataaattaaagagtagttggaatctaaatctttggtctgccagtttgtaaccaaataaaatttcttggctataattttttcagctgtacaacaggaaaggtataacatatcttacttgctagtaagaaagaggccccaacattattatttttcttaactacatataaaagttgttttattctaatatttgctttcatttttgggataattcttgtttgggcaggggagcattttgcctagaagcacttgccattttttttttcctccatgggtgctgatcaggaaatgaagaatgtttcttgggtctttgtggtattatgtttctgagaaaagtcagtttttcaatatatcagccttatttttgagaggtaggttttttgttgttggtttaaaacattcatgagcgatgttaaagaattaatttattatttgtctttatcaaatacagttaaaagttatgtgcagttgataaactactttccacatcacattaaccataacctactaaaggagaaagatacggtacaacatacagaaagttgagagtcataatgctaaattattggtttcaaatagtaataatcactgtatcatttgtttataccttatattagaaggatatgggaggaaaaattttaaaggatgtctatttctattctcttagttaaatccttttgacttatttaaaatgacttaattttaattgataggttctgaagatgaaacaagaatagatatgcaatatcctgctcagcataaaggtcaagagttatattcacagcaagatgaggagcagccacagggatgggtgtcatgggcctggtcctttgtgcctgcaattgtgagttatgacgatggcgaggaagactttgttgggaacgatcctgcatcaaccatgcatcaacaaaaagcacagactttgaaggatcctattgtttctataggattttattgcacaaaggcaacggtgactttcaaagtaggtcttttctcttgctgtttatatctctatcaactttaatgcttaaatttggattgttagtacaattctagctttattcaagtttgctttgcattcagtagatgtgagatagagtctaacagttcttacttcataaaattacatggctcctccacttgaaatctttgaattctgatcccttcctgtcttcttagggcattctccacatttcttttttattagcttcatggatagttttttgccctattgaatcattcagttggtgtacaaacatgccttaatattgtcattaaaaaagaaaggaacagcaaaaattttcccgtgaattcttttacctgtcaggtacggtttcctttctgtgctctccttcgtaacaatcataacaatctctctctctctttttttttttttttttttttttgagacagggtctgactctgttgcctaggctggagtgcagtggtgcaatcacagctcagtgcaacctctgcctcccgggctcaagacatcctctcacttcagcctcccgagcagctgggactacaggcacgtgccactgtgcccagctaatttttttttttttttaatattttgtagagttggggttttgccatgttgcccaggctggtctcgctcctaggctcaagcgtttttccccctttggcctcccaatgtgctaggattacaggtgttagctatcacgcccagcctcataacaaatttttttttaaaggattgtttacatataattatctctttcctcatctctttcgcttttcaagacaaaattgttaactaggtcctcttctagctatttttccagcagtatttaacataacttgacgacttcctccattaacataatgcatgtaaaatacctgttcttatctatacaaaaatatatatgatatatacaaatatgtgtatgtctaggttaaagaataataaagtaaatacccctttacttgaagaaatataaaattatgccaggcatggtggctcacatctgtaatcccagtacccctgcacttcagccaaaataaatataaaattcctagtagctttgatcccccatgtgttcttctttgatcatattttaccttctcttcctctcacatataacccaaacttaatttttgagttatttgtttcctggacttttataatgctattaccatacatgtaatattcctgaataatatcttaattcattcaacaaatattttcaatgccagctgtgtctaagcattgttttgtctccagagataccagagtgaacagatataaattcctgctttttcaagcttaaattgatattataaacaaataacatatatattgtgttcattgaatataaaggttaggtagaaaaatcaagtgggggccagacgtggtggctcacgcctgtaatcccagcattttgggaggccgaggcggccagatcacctgagatctggaattcgagaccagcctgaccaatatggagaaaccccatctctactaaaaaaaaaaaaattacccaattagctgggcgtggtgacgcatgcctgtaatcccagctactcgggaggctaaggcaggagaattgcttgaacccgggaggtggaggttgtggtgagctgagattgtgccattgcactccagcctgggcaacaagagcgaaactctgtctccaaaaaaaaaaaaaaaaaaaaaaagaaagaaagaaaaatcaagtgggaagaggaatagtgagtgctttcaccagaggggatattatgcagtttaaaatgggatgatcagggaaggccttattatgaagggaatattaaagcaaagacctgtgaaagaggaagccttattgatatttgagaatgaacattccagtaataacaaatgtaaaggcaccagagttcaagaaacagcaaggaagccagtggggcagtagtgtcatgagatatcatgaatgaatgtggtatgaaagataagaggggtgatgaggtttggagtggttcacaagttgtaaactgtgtagatcatttttaggactttgtcttttattctgagtgagataaacaatatttggccagtttttagaagaattatatgatctgggttatattttaatctggatcactgtggctgctgtgttgaaagcaaaagtaaggaaaagaaatagataggaatgcaattttcaagcaagagatggtaatgacttggactagggtgatagcaagtggaggtgatgaaaagtgattgtgttttggatgtgttttgaaggtcaaataggcagaatttcctgatagattttattatgagacatgaatgaaaaaaaaaagatgatccaaggatggctcttaaacaactagaagagttgagctgtgacattttgagatgactgggattgggagaagactagatttgagatgaagatgaggaatttagttttggataggtttaagatgcctgctgtatatttaagtagagtaacttagtggagagttggatatatggatctagaattcagattagaagtttgcctaggtgcatatatttgatagtcatgatcatattaagactgaaattagtgtagaatagaaaaaagaggttctagagccaagctctgaggcactgtgatgataagaaattggaaagatgaggaagaaatagcaagggaagctgagaataagtgatcaatattgtaggcagaaaaccaagagactggaaggtaagtaccataaaggttttaaagaggagggaatagattatttgtaagaatggatccttggatttgacaatgtggaaattactggtgattttgagcagagcagtgatatgacactgttagaatctttgctggagttgattaaaagcaaatgggaagactggtagaaatgtaaaatagtgcgtctgctgtggaatatagtttggtggttccacaaaaaattaaacgtagaattaccatataatctagctattttatttctaggtatgtactcaaaagaataaaaaactggtattcaaacaaattggtgaacataaatgttcacagtagcactattcagtgatctcccaaaatggaaacaatccatatgttcatcagtggatgaatgaataaacaaattgtggtatatacatacagtggaataatattcagccataaaaaaatgaaattttggccaggtgtggtggctcatgcgtataatcccagcactttgggaggctgaggtgggtggatcacaaggtcaggagtttgagaccagcctggccaacatgttgaaaccctgtctctactaaaaatacaaaaagctgggtgtggtggtgggtacctgtaatcccagctactcgggaggctgaggcaggagactcgcttgaacctgggaggcggaggttgcagtgagctgagatcacgccattgcactccagcctgggcaacaagagcaagactccgtctcaaaaaaaaaaaaaaaaaaaaggaatgaagttctgatgcatgctaaacatgaatgaacctggaaatctctatgctgaatgaaataagccagacacaaaaggacaaatattttatgattccacttagatgatgttctctagagggacagaactaataggctatatgtatgtatgaaagggagtttattaaggagagttgactcacacgatcacaaggtaaagtcccatgataggccgtctgcaagttgaggagcaagtaagccagtgatggatcagtcggagtcccaaaacctcaaaagcagggaagctgacggtgcagctttcagtgtgggccaaaggcctgagagcccctggcaaaccacaggtgtaagtcccaaagtctaaaagctgaagaacttggagtctgatgttcaagggcaggaagcatccagcacaggcgaaagatgaaggccggaagactcagcaagtctagtccttccacattcttctgcctgctttatcctagctgtgctagcagctgattagatggtgcccacccagattgaggatgggtctgcatctcccagttcactgactcaattgttaaactccttcggcagcaccctcatagacacacccaagaacaatactttgcagccttcagtccaatcaagttgacagtcagtattaaccatcacagatgaggtatttagaatatgcaaaatcacagaaacaggagtagaatagacatgctagaggctgtaggatacaggggagttgagttagtgcttaataggttcagagtttctgcctagtatgatgtaaaagctctgcaaaaatatagtggggataattatgtaatattttgtactaaatgccactgaattgtatattgacaagtggttaaaactataaattatattatgtatattttatgcaaaaggacagataaaaatgcaaatggtagttgagtaattgttgaagagtacagaaaactctttcaagacagttttgttataaagagcacagaaatggggaaatagctggttggggttgtggagctaaagacttttttttttttaaagatgcaggtaattacagcatgtttgtttggtgatatgagtgatctaatagagaggaaaaaatcgatataggcaagagggggagaattggctggagtaatattcttgagtggataagagggcttggcacctcttgtagagatggaaagtctgatgatctctaatgggacaataggtcattaattcatgatagcaggaaagaaagcaatgtgatcttgcacccacataagtggtttggtagaaaaggtgatagcggtttttgaaagttctctttggattatttttttctttaaatagttctcttaactcagagtaagcatggggaaggaggagaagctttgaggaaagggaagaaggtataaaattgtcatcttggggaggatgaggagtaatggcctttgaatatgtatgttcactagggacactaaggacctactacacaaaagtgatcatgaatttgaagatataccagtcattgtggttgtatgtatttttctggtcatattctgctgctttagttagggtgatggtgaaaataatctggaggacaagatcaatgcagaagaggtggtcaaaaaactgagaaatcagacttttggaatgatcatctctctggatattgaaatcaccaaggattatgacagtggtagtgtgggactgaatccaaaattaaatcttcagacaactagtagaatgatgtgggattgatttatgagtctaagaaagagggataatgggtcttacagtctgttccatatattttgctatattttgaacaatgctgatgtaaatgttctggtacagatcttctgacatatatatgtggaagagtttctttgggatatgcttctttttctttaaaaatgttatcgctgggcacagtggctcatgcctataatcccagcactttaggaggccaaagcaggcggatcacttgagcccaggaattccagaccagccatgcaaatatggtgaaactctgtctctacagaaaaatacaaaaattagctaagcaggatggcgtgtgcctgtagtaccagatacttagcaggttgaggtgggaggattgcttgagctggaggggtggaggttgaattgagctgagatcatgccactgccactgcagcctgggtgacagagcgagaccttgtctcaaaaaaaagaaaaaaaaaaaagaaagaaaagaaaattatatctgggttaccagggacttttttgtagtcgtttttggtgcttctcctcttctgtatgacctttaaatgttggcatatagggcttggtctttgaccctctcttcttttctatctacaaactcccaaggtgatataactccatcatgatatagatgctgatagactaccaaatttgtgtctccacttttcacttttccctgagctctagaattcaactgccaattttatatttccactttcatatctgattgatacttaacacatacaaacagaactcttgatttttctttgcagttgtgcacccccacccccactattttacctttcattaaattgcaacattatctactaatttgctcaggcttaacatttatcagtatcttttcttctcccaccacatctaatcagtcagcatgttctgtcagctgtacctctaggatgcagtcatttctcatcagctttattgcaacttatagaccagtagttttcaaactttttgatctcaaggctccaggaaacctttgcattcttaaaaattattgagaactctgaggagttttgtttattcagattacatctactcatatttattgtattagaagttaaaacaaatcttaagaatatgtatatattaatttattttaaaatgaatttattatatgttgatgtgaatatcattttataataaaagtaaaattactgtattttaaaaggtaagaagggacatgcattggttttatttttgtaagtatcttgaatgtctggcttagtagaagatagctgaatttttgtgtctgcttcagtattcagtctgttaggacatgttttaattaatgtatatgaagaacatctagcctcacatagatatttatttggaaaggaaggggtattttaatagccttttgaaaaattatggatattccttttgatattacactaaagctcattaagtggtaattttaaaaggtttgttgggctgggcatgatggctcacacctgtaatcccagcactttgggaggctgaggtgggcggatcatgaggtcaggagttcgagaccagcctggccaacatggaaaccccgtctttactaaaaatagagaaattagcctggtgtggtggcaggcgcctgtaatcccagctacttgggaggctgaagcaggagaattgcttgaacctgggaggtggaggttgcagtgagccaatatcgtgccattgcactccagcctgggtgacagagcaagatactgtcccaaaaaaaaaaaaaaaaaaaaaaaaaaaaaaaaaaaaaaaaatttgttgtttcttcagcacttagaaattgcctggtatgttttctacaaatatttattttttgaataagtatgtgcatccatccattatccatacatctgcccaccttttcatctgcttttcagtttacaaaaatttatggactcatttttcaggttttgtttcctctccaatttcattttttgtgggtttattatttcatgtctgcatttttgtaaaggagataaacccatgtgaaatgagctaaacttttgaaatagtggtataggtattattccaggcaacttgttacattgtggggttgcagcagtggaaaaaaaaaaagtttctgttcccatggttttaaatttagcatagattttctttgtattagtactaaagctacacaatttataactacaacagatggcaagttataaaatactttaagatagctggactcagtggctcacgcctgtaatcccagcactttgggaggctgaggcgggcggatcatgaggtcaggagttcaagaccagcctggccaatatggtgaaaccctgtctttactaaaaaaaaaaatttacaaataaatattaaagacttttctacttaagataattcaatgttttctaatatgacaaaagttgaaaaatatagagaataaatttcaactaaagtttgtgtcatagcttgattgatttaattttttaaagtttgggcaaaaattataatgcatatattagctgtactattttaacatcattattctcagttctactgaaaaaaattatttttgtgattgaaattcactgatttagcattgattaaagggataaggattcatcttcaaaattaaaatataataaaataagatattaaaaaatataataaaaaggcaactgttgataaatattgttggatatgttgtcagtttttttaatatcaaaagtcctgacatatagcctgggcaacatagtgagaccctgtctgtacaaaaaataaataaataaattagcagggcatggtggcgcttgcctgtaatcctagcaatttaggaggctgaagtgggagtattgcttgagtcctggagtttgagctgcaatgagccatgttttcaccactgtactctagcctgggtgaccaagcaagactgtgtctccttaaaaaaaaaaaaaaaaaaaaagtctgacattttgtaaaaagaaaaaaaagatatattgtcagttttagattggaataaagcacttatttttgtggaagattgtgagggaagtcaaggattacaagttaagtaccgtcctttctggtgattttttcctgtttagttttaaatttgaaattattctgatatatttctgttaacttgattgttgagaggaattatattcaacggaatcagtcaaaataggcatttatccaacctgggcaacatggtgagaccccatctttataaaaaaaaatagccaggtgtggtagtgtgcacctgtagtcctaactactccggaagctgaagtgggaggattgcttgagccctggaggttttaggctgcagtgacccatgatcgtgctactgcactgcagcctgggtgacagaggaagaccctgtgtcaaaaacacaaacaaaggcaaacaacaacaaaacaaaatagtcatttgtgtataaaatttttatagacttcttgggcagtatttgtcaatagttaatatatctttttataattttagaacatttatgtttcttaaagtttgctcttagggaaataccttgatattaaggaggaaagcattagaattcattgctcagcttagatttgaagaatgtttggaattaatttctggttcatatttttgttaagaaaacaagatcatgtttctacattagcattttgagcagttgatatcagtccagcaaaaatcatgccaaattaaatctagcatttttctaagaatgtttaaaattattcttgtaatgttcgggtcctttttttttttttttttgaggcagagtctcacactgttgcccaggctggagtgcagtggcgcagtctcggctcactgcaagctctgcctcccgggttcacgccattctcctgcctcagcctccccagtagctgggactacaggtgcccgccaccatgcccggctaattttttgtattttttttagtagagacagggtttcaccgtgttagccaggatggtctcgatctcctgacctcgtgatccgcccacctcggcctcccaaagtgctgggattacaggcgtgagccaccgcatgagtccttttaatcaattaattgctttttctctataataattgtagacagctgaagagggatcaatttaaaaaaattcaagtttacttcagtaatcattctagattacagaattgtgctttaaaatagctacattgtatatatcagtactagaaacatccaagaaataggagtctacattacataaaaatataaaatataaaaagctttattataaagaatgagaataattagttgatactcaatatagagaagtcactgtgcttaaaattgtaactttctagttcaagaactttcattaggcctaagttaaatattggtttttttaaaaatgtgagctttgactttgcatttaaaagtgatgaatatatctatgtcgtaagaatgaggggaagtaaataattggcaaacacatgctgaataccttttttaaaaaagtaaccttttctttttggaataattttagagttacagacaggttgcaaagatagtacagagagttcctttatgttctttacccagtttcccttattgttatgttatcacagtatatttgtcaaaactaagaaggcttcattgatgcattactgttacattttgaacattaattgaatttcatgatatgttttttctgtaccgtgattcaaaccaggataccatgttgcatttagaatagtacttttgtaaaataatttatgtaatttttgaaacatataaataatatgttataagcatctggggagttaagaattttttgttttgttaatatctagattagtacaggtgtacctcagagatattgtggacttggttccataccaccacaataaagcgaatatagcaataaagcgagtcacagaaattttttgttttgcctaatgcataaaaaattatgtttgcacaatattgtagtttgttaagtgtccaacagtatgtctaaaaccactatatataccttaattaaaaatactttattgttaaaaaatgctaacaatcatctacactttcagcaagtcataactttttgctggtggagggtcttgactcagtattgatgattgctgtctgatcagggtggtggttgctaaaggttggagtggcagaggcaatttctcaaaataagacagcaatgaagtgtgccacgttaattgactcttcctttcatggaagatttctctgtagcatgggatgctgtttgactgaattttactcagagtaggactattttttttgagacagagcctctctctgtcacccaggctggagtgtagtggtatgattttggctcactgcaacctccgcctcccaggttcaagcaattcttgcacctctgcctcctgagtagctgggactgcaggcatgcaccaccacgcttggctaatttttgtatttttggtagagatggggtttcaccactttggccaggctggtctcaaactcctggcctcaagtgatccacctgacttggcctcccaaagtgctggcattacaggcgtgagccactgtgtccggcttcagagtagaacctctgtcgaaattgaagtcagtccttttcaaacactactgctgctttatcgactaaatatacagaacattctaaattcatcgtcatttcaacaatgttcccagcatcttcaccaggagtagattccatcttcagaaatcactttctttctttatccataagaagccagtcctcttcaggttccacttctaaatctaattctttagtagttacttcctccacctaagtcttgaatacctcaaagtcatccaggagggttaaaatcaacttctttcaagctcttgttaatgtggatagtttgacctctttctatgaatcacaaatgttcttaatggaatctggaatagtaaaccctttcaggaaagtttttgatttactttgcctagatccatcagaggaatcactatctatggtggctatagccttacgaaatgtattccttaaataataagacttgaacatcaacattactcctaatccatgggctgcagaatggatgtcattttagcaggcatgaaaaacaatattcatctccttgtatgtctccatcagaggtgtagggtgaccagatgcattgtcagtgagcagtaatattttaagaggagtccttttttttgagaagtaggtttccataggcttaaagtatttagtaaaccatgccataaacagatgtactgtcattcagtcattttttttccattcatagagcacaagcaaagtagatttagcatgattcttaagggccctaggattttcagaatggtaaatgaacactatcttcaacttaaagttaccagatatgttagcccctaacaagagcatccgcctgtattttgaagctttgaagccaagcactgacttttcctctctagctcagatgacatcttcttccaggagaaggctgtttggtctgtgttgaaaatctgttgattagtgtagccactttcgttaattatcttagctaggtcttctgggtaactgcgtgcagcttctacgtcaacccttgcgcttttatggtatggagacgtcttcgttccataaggctcatgaacagacctctgctactgtcggacttttctcctgcagctttcttacgtctattagcctacatagaatttaagggttagggctttactctggattcagccttggcttaagggagtgttgtggctagttcgattgtctatccagaccactcaaaattcctccatatcaacaggctgttttacttccttatcacttgtgtgtacaattttaatttccttcaagactttttcttttgcattaatgactgggccaactgtttggctcaagatgcctatgttttggcctgtcttggcttttacatcccttcttcactaagcttaatcatttctagcttttgatttaaagtgagagacagggactcttcctttcacttaaatacttagaccattgtaatattactaattagcctaatttcaatattgttctgtctcaggaaataggcccaaggagaagggagagaggggagtggctagacagtggaacagtcagaacacacacatgtatcaattaagttctcagtcttaaatgggcatgttcatggtgccccaaaatagttccaatagtactatcaaagataactgattacagatcaccataacagataataataatgaaaaattttgaactattgggagaattaccaaaatgtgacacagaaacacaaagtaagcatgtgctattgggaaaatggtgctgatagacttgattcatgtggggttgctacagacttccaatttgtaaaaagtgcaatatctgcgaagtgaaataaagcagagtgcaatacaatgaggttcgcccctacttcttatctagctggctttcaataagtatttgttgcatgattgaatgagtctatgagatttagtaggaaacatcttttgaaaagaaatatgcttgattctatttccttcataggaactagaaagagcctgttttatctttttgcatttcatcaccactttcttttttatttcaaatagtgagaagtcttggaaatgactgaaactacacgttgttgaatgttttgttgaatataaaatgaactgaggttatactatatgtaaatttttggcagaatacataaatgattttgtgagtatgggactgttattgcacacagctttcactttttaaaacaatattaagaaggagtttaaaaagtatttaaattctctatatacgttgagactagcatattcaacctttataccatggataatctgttacagctgtttttgttgcacctgctttcctgcttaatatttaaatttcctgaatcttaaaattggccttgttttaatcaattaatcatcataatgacaatttattgctctttaatactaaatttgatttacttaatattcttatatttcttagctcacagaaatgcaagttgagagtagttattacagtccacagaaagtaaaatctaaagaagtattgtgttgggaacaagaaggaactacagttgaggtaatctttcaatattgaacctgtatttttaaatattttgttctttaatattttataaatacctgtttttatcagatgtagtgtatttaaaaatacaagtaagatgtttgtttcttattttaatagagtttactatctcatggatagtataaataaatagtatagaataaatttaaaaatgacataattctaaagatgtttaactaatttagagattctacaaggaaagcctctaacatttttattaaattcaattcttagttctaatgtttcctttcgtcttataggcccttatgatgggagaacctttctttgattgccagattgggtttgttggttgcagagccatgtgccttaaaggaattatgggtgttaaagattttgaagagaatatgaatagaagtgaaactgtaagtccgtttcctccatccttttttggataggatataggaataattaagtgcttactgaagtgtttaaccatataatatctgttagactatatatatctcaggcttgagagaggagctttactatttctccctgtgtttcacctgccagaaattatagatctcagggaagtttagaaagttggtagcgcctaacacctggacagtagttccaactactttcttattcatgaatctttcttcttttttgttcatggcagttatttggagtttccttttggtttgtaaaaatgatctttggcaaaatagtcaatgaaggtggagcagcagcattccttatctttctgttttagtgatttcttttgactagtaaatgggcatcataaaatcaaggttttattttgtttaacaggctaatggtttttcttcccatttataaattttgcatttgttttcaggaagcctgtttcttcatttgtggtgacaatttgagtacgaaaggtttcacataccttacaaattcattgtttgattaccgaagcccagaaaataatggtactcgcgcagaatttatcttggattcaactcatcataaggttagagaatatatatttgaaccaaattctaggctgtgtttgggtggacacattgtatgaatacttgtgatttctagctttcttttcaaataatgccttctgaatgctaattgtttattaaaacatttagaatgcatttatacagtatacatgtagaaatgtttgaggagtgcacagagatcttttattgaatatgtaaacatattttgcttatttatgccctgcttcaaaaataatcgtggaggaaacatgttgaattacctctgttaatttttgttacttttaatgtgtgggattgatgtaaagaaatgaggaatttacctttttactatctatacttcttagtgttttttaaatgtaagaatatattaatatgtttatggaatattaatacatttatgaaatcagttaaaaattcagataattacctgaagattaatgcaataggataatttacattttactctttttttatcaagatttacttccattgttaaaatatttaatgttgacttgcataattaacatacatttagaatatttcagtatatctttagtgtttgaattgtttcatgatatgaagtatttaaggattaattctatttgagagtatacattattagacagttttgtgatagtgataaaggtcaggagtgtactatctcctccattgtaggtatttattaactagacatgattaataaagtggtcaaaatgtctcataaaagtatggatgtcttttttgtgtggtctgtaatagatggaatattacctttcttagaagtaaattcttggaataacctctgttcttttggtcatcctttgtgttgttatacattctatataaagatatgtgtctaacctatcaagctttaaactcaaaagtttcttttatacaatgtttattctgtttgcattgctttgttggcaggagacatacactgagatagctggaatgcaacggtttggggctttttatatggattacctgtatacaatggagaacactagtggcaaaggtattggcttctttcctttatgtgtgccatttcttgaacaactgaaacaaagccttcctcagaatcaattggtccttgactggttgtactctgctacataagatttatcttctagtactttggggagtggtttaattttaacatcatgttagaattgtcttagattcttgtcatttcaaatccattctttatacagctgactgaagacattttgtataacctgttagaattagttctcatgtgtaccatatattatgattctgatatatcaaattttatattacattaaatttttaaaaagaataaaccttttctattctaaatacactttgaaggtgatactaatttttaattaaaaagaatgtgttgtatcaatcagaaaaatagaaaatcttccagagactttagatgtatatattgtattattttattatgtaccttattattgtattattttctattttttggaaataaatgacgtttaaaacatttcaacacttttttttttacttctatatcaatatatgatgtacttactatttcagtcttttttatgttgaaaagttagcgaaaataggttcacagttttttttggtgaatttttcatgttttataaaaatgatttcagtgtattaggtgatatgttaggtacagatgaatgcaatgaaaaccaaagcatttcccaaagagccaataggtggtgttgaactaggcatttaagtaaatgattataacgtagcatgttaagaagagtagtatagagaactagaagtgtgggtaaaaaaaaaaaaaaatgacaacttttgcttgtgagattgaaacttcgcagagttgatcttgaagtaaatttgtttttgatgaagaaagaaggaaagagcagtaaatttctggcttctgcttttggaatggtttctaaatgttgatgttttcattggtcaatccttaatttctttccctaaactttctcccaagttaatttcattcttttccatggatttaagtactttccatatgttgttgatactcaaatttgcattttatagtccaaagttctctaagattcagaattaaatatccaatgcatacttgacgtttttgcctctgtgtctttcagatatctcaaaactgattttgtccaaaattgagttattaataaatattcctatgaccacttactacctctgcttctttatttttaggcttctcttctttgaaaatcgtactatcctcttcttgttgctcaagccagaagcctgggagtcatcatgacacaccttttccctcgctcctagccatctggtccacagatgataacagtggtatcactgttaccatatggactagcatttagttcatatgtaccatcatctctagattctaatatatatatattttttgagacagagttttgctctgttgctcagagtgcagcgtcatgatctcggctcactgcaacttctgcctccctggttcaagcgattctcatgcctcagcctcctaagtggctgggactacaggcatgcgctgccatgcctggctaatttttgtatttttagtagagatggggtttggccatgttggccaggctggacttgaactcctaatctcaagtgatccatccaccttggcttcccaaagtgctgggattataggcgtgagccaccgcactcagccaggttctaaagctttcttactggtcttcctgctttcattgtagtcctatagtttctactgcaatcacagggatttaattctctgctgttaattttcatgggcctgacattggtttgtttaaaaacaaaatttaaatagtttactagattctggtcttgagttacttggtggatagtgataactattaagaaagctaaataagaggaaaatttttggaggaaaagatgagttttgagataactgtggacattgaagtgtaaatattccttagccagttatatatatgaaagtgcaactcagaagtcttgtgttctaatagcattgcaaattattgtagtgttgtagttgccacttgtaaactggtaggtttcctcttgttcaatataatgtcttatgcatgtgctgtggattccatgtcttgtgaggaggtgaagtatgtagtagttaccttttaagcaaaggaaacctagcacagaacatctttatttgtatatatgcctctcctgcagtttttaaaagatagaaacatgatttatgtttgttagattgtttatatattacttctgagaagccagtagtttgttaacttttgggtttttcatatttttcacttccatgaatactatacagtgttacagatattatagtccttaacttttaaaacaaaatattgaatattgcacatgtacagaacagcaaataatttaaaactgaacacctgtgtattctccacgcacaccaagaaataggacattgttagcatccagtaagcctcctatgtgtttcttttctaccacactctgcctcctttactggaggagattgctgttttgagattcatgagaaccactgtcttgcttttggtttatccccattttacagatgaggaaacagcaaacccaatacaggtaaagtaacaagaaccaagatcacacacagtatgtgggatttgaacccaacctatccagctctagagcctacatttataactattctgttgatatttcctttttttttttttttttgtttgagaccgagtcttcctctgtcgcccaggctggagtacagtgttgcaatctcgactcactgcaagctccgcctcccgggttcatgccattctcctgcctcagcctccccagtagctgggactacaggcgcccgccaccacgcctggctaactttttgtatttttaatagagacagggtttcaccatgttagccaggatggtctcgatctcctgacctcgtgatccacccgcttcagcctcccaaagtgctgggattacaggtgtgagccactgcgcccggccctctgttgatatttctttctttcttggtttacctgaaacaagaaatttgtagaattttaagtattaatgagctaggaaaagtaatgagttcctataagaggatacttgtaaatacttaaaaaaaaaaagctttatctaaaactcttgtttttttgtgacaactttttttttgtttctatagtctacattatcaaaaagtgccctaaattttattaagtaaatatctaaacacgtattgagccaatatttttacagagtttgtagtgaatcctgatagtttgaaggcggatttgattttgtgtgttttaagtaagttcatggcagtattctaattaatgtaagaaactaggctgagcgtggtggctcatgcctgtaatcccagcactttggaaggctgaggtgggcagaccatgaggtcaggagttcgagaccagcctggccaacatggtgaaaccccttctctactaaaaatacaaaaattagccgggggtggtggcaggcgcctgtaatcccagctacttgggaggctgaggcaggagaatcacttgaaaccggaaggtggaggttgcagtgagctgagatcataccactgcactccagcagcctgggcaataagagtgaagctctgtctcaaaaaaaaaaaaaaaaaaaaaaggaagtaaatacagtaataaaggaagcttctattatttatttttcttgtaataaatgataaaatagtatcttgtccacattatactatggcatataaataaaaattaagtttcctctgctactatttggtattgatgataagctgctgcttctcttcttctcctccttctcctcctttcttcttgctgctgctgctgcttcctccctctcctccccttctcttctcctcctctccttcctcctcctccccctccttgccttcctccccctcctccccgtccttctccccttcctcaccctcctcctcctcctccttctccttctttgtgagtatactttagtcatttttgtttacaactgaaactctggaaaaattaacatcttttgcccaggagcttcttacagacaccagtaaaagtttgaaccttgtgttccacaagataagcatcttctgacaattattttacttttttttatggtacttgaaagcaagtgatgttttaaaaactaaatggaaatatttattattaatataattgtgtaaatatttgttaatgttgtaatgactacctttctagtcttttctgtttaagggggttattacaaatgttatggaccctaaagtagatagctgaaattgtaatgtacaacaggaagattttagagataaccaattttagagatacaataggagataaatctgaaacaattaagttattgaattgaagggcaagaattgagaaagagtcttgactcttaataagggcagccaaacattcagggagctggagtggccagatgcatgaaaggtgggcacaagtaaatagctgaaaatatatagctaaaagccagttgtgtttttacatttcagacaagccatggtatctaaatttaaactgcattatattcagttttcattatggggggcattggcctgtattattttagagacaattttgtgtctaaaagaagagtcttgttatacagtgacatcatttagggagtctattatcccctaaaggacgcatagcagggcatttttattgctttttgagtattttgatttgtaaccgaagttctatctttaagttacctcattctgtcttacatgtaattctagaaatgtaatggttttagctatgaaaagtaatggttttgatgtgaatggtatgttatttatacctaattcctaatgtgagtcagtattaatcatacatcttacaaaatatgtataagattaattttgtatgttttatttgatgtgacattgggcttatagatttttacttgtattatatagttaactttaaaataatctttgcactaagtcgtctggttaaaaatatgtgagtaataaatctaattaatttttggccaggcgtggtggctcactcctgtaatctcagcactttgggaggccgaggtgggcggatcatgagggcaggagattgagaccatcctggctaacatggtgaaaccctgtctctactaaaaaaaaaaaaaaaaaacaaaattagccgggcgtggtggtgggcgcctgtagtaccagctactcgggaggctgaggcaggagaatggcatgaacccaggaggcggagctttcagtgagccgagatcacgccactgcacttgagcctgggtgactgagactctgtctcaaaaataaataaataaaaatcaatcaatcaattaatctaattcatttttgttcatatgatgaagactaaagattgagctgtactcctttgcatgaaataatggaaatatatttttgtataaaagtattagaaggtatagatataaaagttttgtgtaagtaggcttttctagtttctaaggttattaaatcctggaaaattctttcttctttttgtctgaataaacaaaatgcattataaattaaaaatcatttttatcacaataatggattcatgtatacaaaaaacctctcatttaagagatgtacatattagataatgacacatgcctatacctggggccaatatcttatttagaaaacagtgtatgaggagatgaggagtctaggaagtaggattctgtaccatggaacatcgctataatgaatctattctagaaaaagttcaaagcaggtaatacctactgttcatttccatggtcattataaaactctcaaggcaccctgtgatcatgttacttaaataacccaattttcaatagactaagataatttactaagataaattagtaaaatggagtttcctccaaagtaccccctctcagtcaatgcatattgtgtatagaattactagatataagccaattaggttttgcagaataattttctaagaatgacaattttgattttatattgcttgttataatattaaataacaggaataaattttaatgaattgctttttatcagtaatttattatatgcacagagaaatacaaatcagcagggctctctgtatgcagctgattgggaatttgttttaaggcattaagctacaagctataaaaatgagagaagagcgattttaaaatatttacttggtatatccaattgatgcttaaaatataaaatttgacttcttttaggttccacaaatcaacaagacttttcttcagggaaaagtgaagatttgggaacagttcaggagaagtccaccaaaagccttgttataggtcctcttgattttcgtttggatagcagtgcggtgcataggattttgaaaatgattgtgtgtgccttggaacatgaatatgaaccatatagcaggctaaaatcaggtttgtttctggattaattttgaatcttttgccatttgttttgagaataattatataatccaatttgtgttgtcttgctaactttacgtttttagtgtaatttgcctgtttgcaaggactttgatatatgtagctgtttatttaaagaataaacttgtgtgtagaagttggagagatcaagatttgaaaattattgcacaagtactttatttgccagtatttgtcagtattttattgttatacctttttgatactttttctagtggatacttgtgaatatgatttttttttttcacattaatggattctaaggagccagatacaaaattgggctctaaacacacaaatttaacattgaagaaaacttaggcactgctggtttagaaaaagttgctgtacaactaattttttctacatggtagatagctatagttgtcatagtttcataaaatacgaattcctttttaaagcagtaaagcaactctagagtagagcataatagtgtaatgaggaagtataagataatgaagaactcaccctgtggagtcagactgtggtttaaaatttgaccctcacttcttagtatccttaagaaatttaattaacatctttgatgtttcatttctctgtctctacaatacgtttagttactgtgacagagatggctaattgtctcctcaatatccatcctttttcatagtaatagaaatttctataacagaagtaaagactatacatttaagggatagtcatatgactaggttctgtctactgggatgggagcagaactttatgtgatgttttgggccatgactttaaaaggaaaagagcatgccttccttcttttcttctcttctttcttctggctggaaaataaatacaatggtatgggctggacctgccatttcagatcctgagattaaagctgcatgctgaggatgacagagtagcaagataaaaagcacctaggtcctcagtactgtgatggcaccatgtccgccctggatcctttagactcagattgtttcatgaaaaagaaataaggactgagcatggtcactcatacctgtaatcccagtagttagggaggccaaggcaggaggattgcttgagcccaggagtttgagaccaacttgggcaacatggcaagacccagtctctacaaaagattaaaaaaaaaaaaattagttgggtgtggtggtacatggctgtggtctccgggctgagcagggagaattgcttgagcctgaatggttgaggttgcagtgagctgtgattgtgccactgtgctccagcctggccaacacaacaagaccctgtttcaaaaaaaaaaaaaaaaaagctgctgtttttgttgaaatttctattactttacttttgtcccagcaactttactgttaccttaaatgatacactgataggacctacttccaatgattgttctgagcactaaatgagatagtgcacataaaagcacttaacccagtgtacagtaagtgcttgacacattcatgcattcatttattataccttacttgaatgcctaccctgtgccagacattctttatgtgctaggatagtatagcaaacaagacatacaaagcctttggtctcatggagcttatatcctcatggggtagacaaatagtaaacaagttaaaatatttcagtcattgataaatactagagaagaaaaataaaaggaagtgtgagcaagagtgccagaaacagaaggaggggagagctgttttagtagggactttaggaaagttttctctgaagtttatatgtgagctaacttgtgaatgatgtaacggagtgaatcatgcatgtatttgtgaaaagagggttttatgtagacaagtgcaagagccttgaggtaggaacagtttggcaatatacagggatacaaacaggctagaatagctgaagcacaataaatgtttgtaagtcatagaggtagacatcaatcaccttgttgggttttagggaccatgtagtctggattttattctaaatgtgatgggaaatcatcagtaagttttgaataggaagttattaacttattattttaatagtaaatagtatggttggcatatgttttcattttaaaaaatttagattttcctagttttacttgcactcatttgtgtgcatgtgtattaagttctatacaatttcatcacctttgtaggtttgtgtgttcactaccatggtcaagaaaatgaacagttccaataccacaaggatctggcatgttgctctcttacaaccacacccacttccctaccatgttcctttctcctccctcttttccaggggctagggataacccctggaaacttttgtcttccatttctaaaattttgtcatttcaacagtgttaaataagtgaaatcatacagtatgtaagcttttgaggttgacttattttgctgagcataattctctggagactcattcaagttgttgcatgtatcagtagtttgtttcttttcctgctgagtagtattccattgtatacatatactatagtttgttaattccctcacttatggaagaatatttgggattattctagttttgggctattacaaataatgctgctctgaacagttgtgtactggtttttgtgtaaacatttcttcaggataaattgctgggtcatatggtagttgcatgtttattattttttttaaagaaactaccaagctgttttcaggagtggccataccattttacattaccatccaacgatgactgtgtgatccagcttctttacatcttcccagcattttgttttgtcactgctttttattttagccattctgatagatgtgtagttttaatgagcaatctgccatctcattgtggttttaaagttgtgtttccttattggctaatgatgttgaacatctttttatgtgcttatttgccatttttatttcttcagtgaactgcatatgtcttttgctcagattaattgggttaatctgaaagttttaatgtttttcattttatactcaagtatgtcatcattttgaattaattttttacataaggagtgaggtttagataggggtttatttatgtgtctttgaattttcaattgcactagcaccatcctttctttattgaactggttttttacctttgtaaaaaatcaattgagcatatttgtgtgggtctgtttctgagtcctctagtttgttttcagttagtagacctgtggtatttcccactgtcagtaccatgctgacttaattactgtaactctatggtaaacctttatattggagggagaagttattcattttggttttgagggaacatttgcttaggttagaaataacctcattataactttcatttacatatatctctaatggaatattgggttggctgtttcgttttgtttttgtttggagatggggtctcactttgtcacctaggctgaaatacagtggtgtgatcatggttcactgtagccttgatatcctaaaatcaagtgagtctcctgcctgagcctcctgagttgccaggaccataggtgtgcaccaccaagcccagctaatctttgttttttttgtagagatgaagtcttactatgttgcccaggcttatcttgaactcctgggctcaaacaatcctgccttggcctcccaaagtcctgggattataggcatgaaccactgtgctggcacttgactcttttaatatagatctattggtgttatttatttttctcatggaaaagtccaagttggtcagtattccagggaaactgttttatgaggttgtcttagacccagattccttctattttattgttctgccaaccccagagatatgccatatatacatggtcagaattgggtcaccattatagtgtgtaattttaatcaggaggaagggggaacaagactataaaggaaggtatgtagtcttatttatttatttatttaagatgtagtctcgctttgttgcccaggctggagtacagtggcgtgatctcggctcactgcaacctctgtctcccgggttcaagagattctcctgcttcagcctcccgagtagctgggattacaggcacctgccaccatgcccagctaatttttgcatttttagtacagatggggttttaccatgttggccaggctggtttcgaactcctgacctcagatgatctacctgcctcagcctcccaaagtgctgggattacaggtgtgagactatttcttaacaatttttaggagtttttaaaatttttgtttttaatatgctgtggatacaagtccctcatggagctggatcttccccctccccatctatctgtagcaaatattttctgtcagtctgtgtcttgcctttacattatctcaatggtattttactgaccaaaagctgttactcttttaaagaaagaaattggggatttcttaaagatatattaaaatgaaaaactggtaaatttttatataacaaagatacatttacattcgagaatagtgcaacttatatttgttaaaggtaacttattattttatacctgcttcattgttgaaaagaaaaacaggatttgaccttatagtttggagaactaattcatttttcagttgtttaagaatattatttaaaaatattctttattaattttttatcattttaattttagatattaaggatgaaaatgaaacaatactgaatcctgaagaggtggctcttctggaggaatatattcctactcgacatacaagtgttactctcctcaaatgtacctgcacaatttccatggctgaattcaacttgctggaccatttactacctgtcattatgggagaaaaggtatattttgtgatttgctatattttttttccctcatatatggatttttttttttttttttgtcatttactgaaagaatatctgcagccgggcacagtggcttgagtgtgtaatcctggcaattcaggaggctggggcaggatgcacacttgaggccaagagtttgagaccagcctaggcaacagcaataccttgtctctaaaaaaaatttggcacggtggcacatgcctgtattcccagctcttcaggaggctgaggtgggaggattgcttgagcccagaagtttgaggctgcagtgaactatgatcacgccactacacttcagcctgggtgtcacagtgtgaccctgtctcaaaaaaaaaaaaaagaaaaagataaaagtatctgcttatatagttatccatgatgaagtaaaagcaatgtaactatgaactaaaaattaactgttaatttttaaaatgtaattttaaatttatatttttaataaaataaacttaatcttgagagtgtataaagaaatgttgaagaatatgggcctagaagtcagaccatatgccagctataatgccatagacaattactttatatctctaagccctgattttctcttctcaaaaagaaaacaattgtattttttcaagcagcctgactattttagttttagccagtaaaactgtcagcctgcctagattcagacagtttattacttacatagacagcagaagcaaagtcagtaatggtgccagctcccctgtcccttgttctataggacaacctgtaaacaaagggccaaatgacttctattggtacatggtggggcaccctgttggcaacaattcagtttcacactgcagctaagcagtggtgtagcttagcgcatatgtggaaagcccataactcagctgaatgaggaatgctgatgagaaaatgtttcatggccgcctctctcaagatgggaaggtgaatgagaaatgctcttttagcagctcctcacaagaccacatatgatcctttgtttttagaggatcacaggatattctaccaaggtctgctgtggttgagtattgccttcatggcatggatttgtgtaacattatcaggatgctggtacagactagacccaccatagtacttagctcctaggattattttaaattttcattgaaataatgcatgtaaactattttgcatgtattaggaactgagtgatgtctgctgtaattgttgagaatgcttaatatttgtttatggtccatatacaatgtattgctttctgagtttgacttatacatacaaggccttatttgttcgtttgtttgctttttgagacagagtctcgctctgttgcctaggctagagagcagtggtgaaatctcagttcactgcaacctatgcctcctgggttcatgcaactttcctgtctcaggcttctgagtagctgggactatgggcgcatgccaccacgcccgactaatttttgtatttttagtagagacaggatttcaccatattggtcaggcaggtcttgaactcctgacctcaggtgatccacctgcctcagccttccaaagtgctgggattacaggtgtgagccaccacacctggcctatgtgtttttttttttttttgatatatttcttttgatgttcatataatgatcaggggtccccaactcctgggatgcggaccagtactggtcagttgccttttaggaactgggttgcagagaaagaggtgaatggcaggtgagtgagcgttaccacctgagctccgcctcctgtgagatcagcgatggcattagattctcataggagcacaaactctattgtgaactgtgcatgcaagggatctaggttggcactccttatgagaatctaatacctaatgacctgaagtggaacaatttcattctgaaaccataccccttctcctgtctgtggaaagattgtcttcaatgaaattaatctccgatgccagaaaggttggtgtccgctgacagtgataatcatagaaataaaaagtgtcctaactttaaagaagttatgtaagggaattaactatatgcattaactttatttttgctccctactggccactcatcattaagtatggtagtgtattacgattaagagatcatgtagagaaaatttcactggagacaattaaaatatgtctgcattttgtcatctctgtttttgctatcatctaatttttaaaatagatactattttttagagcagttttagattcacaaagcagagtgaaaggtacagagatttttcataaactgactccccccacgtacatagcttccctctttgtcaacatccctcaacagagtagtatgtttgttacaattgatgaacctgtattgacacatcagtatcacccaaagtccacagtttacattagggttcactcttggtgttttatgttctatgagtgttgaaaaatatataattatctgctataacaatatcacatagagtagtttcaattcccaaaaaatcctttgtgctctgcctattcatcccttcctctccctaaccactggcaaccactgatctttttactgtcctcacagttttgccttttctagactgtcatatagttggaatcatatagtatgtagccttttcacattggcttcttttacttagtgatatggatttaagtttcctctttggcttttcatggcttgatagctgatttcttctttgcacttactaatattccattacagatgtaccacaatttacttatccattcacctactgaaggacatcttggttgctttcaagttttgagagttgtgagtaaaacaggcatatacatccacgtgcacgttttggtgtgggcatgttttcaactcctttgggtaaataccaaggagtgtgattgatggattgtatgctaaaagtatgtttagttttgtaagaagctgccaaattgtcttccaaagtggctgtatgattttgcatccctgccagcagtgaataagagttcctgtttctccacatccctaccaacatttgatgttgtcagtgcttcggttctttgccattctaagacatgtgtaatggtgtcttattgttttgattttttatttccttgatgacatatggaaacatcatttcatatgcttatttgccatctgtatatcttctttggtgaggtatctcttcagatctattgcccattttttaagagttgtttgttttcttaatattgaattttaaggattccttgtatattttgggtaacagtcctttatcagataggtcttttgcaaatattttcccccaatctgtggcttgtcttttaattttcctgtattttgcagagcagaaattttgaatttttagtgaagtcctgcttatcaattctttgttttatagattgtgccttttgtgttatatctgaaggtcatcattatacccaaggtcatcagcttgtatcctttacgaattggtccatttcatctaggttatcaaatttgtaggtatagagttgtttatagtacttctttgttttttttttgagatggagtttcacttttgttgcccaggctggagtgcaatggcatgatcttggctcacagcaacctccacctcccgggttcaagcgattctccttcctcagcctcctgagtatctgggattacaagcatgtgccaccatgcctggctaattttgtatttttagtagagaaggggtttctccatgtcagtcaggctggtcttggacttctgacctcaggtgatctgcccaccttggcctcccgaagtactgggtttataggcgtgagctaccaccgcacctggccttttttagtattttaaaaattatcattttagtgtccttgggatttgtaacaatgttcctctttcatttctgacattaggaatttgtattctcttacactttttcttagcctggctagagaggcttactgatttttattgagctagcttttggttttgtttattttctctattgattttctgttttcaatttcattgatttctgttttgattttaattcttttcttcttattttggatttatttaatttcctgaagtgtaagcttaggtgattgattttagattttccttttttgtaatatatgaactcaatactataaacttacctctaagcattgctttcactgcatgctacaaatttcgataagttggatttttgttttcatttaattcaaagtattttgtatttctcttgagatttatttctttgacttgtgttctttagaagtattttatttaatgtccaagtattttgacattttttagttatgttactgatttttagtttaattccattatggtctcatagcagacattgtatgatttcttttaaatttgtttaggtgtgttttgtggcttagaatgtgtctgtgttggtgaatgttctatgtaagctttagaagaatgtgtactctgttgttgctgtatgaagcagtccattgatgtctattatatctggttgattataagttcaattatgtccttattgattttctgtctgctggaactgattatatctgatagagggatattgaagtctccaaccaaaacagtgggtttgttggattttttccttgaaattttatcacattttgctttatttttttggcactgtgtctttaggcacatccatgttagggactgttatgtctttttacggaattgacacctttatcattatgtaatcccttctttatatctgatagctttccctggtctgatttttcttctgtctgaaattaatatagccactcctactttcttttgattagttttagtaaggtatgtatttctctattttcttttaatctacaagtgtctacatatttaaagtgagttttggctgggtgtggtggctcatgcttgtaatcccagtgctttgggaggtagaagtggactgatcacttgagcccaggagtttgagaccagcttgggtaaaaccctgtctctacaaaaaaatacaaaagttagccaggcatgctggtgtgtgcctgtagttccagctacttgggaggctgaggtgagcggatcacctgagccctggaggttgaggctgcagtgagcaatgatcacaccacttgcactccagcctgggtgacagagtgagaccttgtctcaaataaatacataagaaaaatttttttaaaaagtaggtttttttgtagacaatatatagttgggtcttgtatcttcagctgccttgacaatctgtcttttaattgatgcatttagaccattgatatgaagttattattgatataattggactaacatcaaccatacttcttgctattttctattttttgcccttgttatttgttcctgattttttttcccgctcttttttggccttttgtggttttagttgagcattttatattattcgattttctctcctctattaacctacctgttatacttctttttagtgtttgtcctagaatttgcattatatttttacaactaattcaagtccactttcaaataacaccataccactttacaggtagtcagagtttcttataataaaagaaatactaattctgccatcctgcttcttgtatcattgctgtaattcattttatttttatataagcattcataagcctgccacacacaatcatacgtaattacttattactattattattttgacaaaatttatgtattagatcaattaagaataacaaaaattaaaagtctttttttaccttatgccttttctgatgctgtttttttttatgtagatgtgaaattctgacctttatcatttttcttctctctgaagaatttaacacatctagtaaggcagatatactggaaacaaattctctgaatttttttttttgtctgagaaagtctttttttctccttttgaaggataatttcgtggggtatggaattctaggtttgtgggttttttcctcttaaaatactttgttttactctcttcttgcttacattgtttttgagtggaggtcaggtataattcatatcattgctcctctataagtaacatgtatttttttctgtggatttttttgggcgactttatctttgatttctatgatttgaaaatgatgtgtctgtatgtaggttttttttgtttttttttttggcatttatcctgcttggtgttctctgagtttcctgggtttctaatttggtgtctgacattaatttgaggaaactcacagtcattattgtttcagatgtttcttctgtttctttctgtcttttcttctcttgtggaattcgtattacatgtatgttacatcttttatagttgttccacagttctgaaatattccgggtttttttttggtttgcttttcagttttggcagtttctactgagataacttcaagcttagagattcttttgttagccatgtctggtcttccagtatgcctgtcaaagggaaaaatgctaacaaggaggtcttactcagaaggcagcccaaaaatttgtataaaatttcctttagattgttggctaattcctaagctgcccatgtgtaatgcaagacttcaggaaacccagcagaaagcaaagtataaatttgactatttgcatggtgctgtgtatctacaattagagttcaggccctgccacattagcacctggggccttcctttgagaccttataagggccacaccctaggaataagtacagattgaaatagattagtctgagcaatcctaattccagtcctggataggaccatgatgatgtacttgtattctgtctgcttgccaaagaatggttaacttactttaggggaagatagcattatcaaagcctctataattttttacccatgatgtcatctgcttgatacaaaattatgaggtatactaaaaatagaagcaattgaattaaatataataaaaaatcaataatataaatagacttagagatgattaaggtattagagttgttagacatggagtttatgattaattgcttaaggaaaaagacaaaaaggtggaagatttccaaagagacctcaatccattaaaaaaaagcaccaaattaaattgtgaaactggaaaatgtaaggatacaggtttgaaggaaaaggatggaaaaaatataccatttgaacactaaccaaaagaaagatagcatggctattttactaagagataaagtagattttaagctaagaaatattactgaaataaagaaagccacttcataatgataaaagtgtgaactgaaagaaagaacaacacagataattctcacaggtgtaatattgagtaaaaaattatatactatatgatttcatttatatgaagttccagaagagagaaaactaatctatggcaattgaagtgattggctacgtctgttgaggatttagtattgccttgaaagggacatgggacagtctcatagggtgcttcagatgggtggtggttacagatgtaaaaattcattcagctctacccttcagatttgtgtgctttattctgtgttattttttagtaatcccaaagaaagtcacttaaaaaagcaacataattcctaaataaatggtggttttaaaattattagtaatgagtaaaaaatcagcattgtattttcgacttagttttaagcacagtgattctcagtaatggcacttttggttttttggattggagaattattatgtagcatttaccatctttggccaatacccgctaaaggccaatattattgtgacaatgaaagacagacaaagcaatgaaactgctcttcttgcattttgtcatattcttctggatgggaagtcatggcattcctcattgagaaccacaggtagagcattttaagggagtgagtgagtgagttctaggacagggatcatttgccactcagggtacatacgctggacatcttgaaacttacctgtatttatttgaaagctcagaaagattctgtaaaactgagaatactgtgccgtcctcaagattcttaggactttatgagcccttaacatgtgtattgttagtagatacgatacagataaggaatttttcttacctgcaaacattgcttattgtgaatgtttttgacattgtgtggtgtagtccatttagttctttagtcagctaaatgtgaataaaagagattaaaataaaagatgctgactcttggatatctaggaaacattttggaataattaagcttaataaaatatcttcatcatactgaggcatgtcgtgatactattccagttgattgaaaaagaaaaaaagcttgagctgaaagggcaatgataattttgcaaaaaatatgcattctttgaagtctgggacatatttaaaatacatggaaagacatttgttatttggttatggcaagagagttctgtagaaaggcatcatttctagattgatttgatatcactgcaaatgtgcagatctgaagcttgcatagagggaactgcaactcagtcactgctccacttttaaaatataaagcgaacactattattttctagaactcaagtaacttcatgaatactacaaacttccagtctcttcggcctttgccatccattcgaatattggtggataaaattaatctggaacattcagtgccaatgtatgctgaacagttggtgcatgtggtcagcagccttactcaaccttctgataacctgcttcattattgttatgtacactgctatcttaaggtatgaaaagtgaattttcttgtttgttagcatgggtttggctttgggatcatcagataagtttcttttttcttgatgttgtaatttcagagaaatagtactctaaaaggtaagatttaaataagaaataagatgtatttattccaataaattaaagtaagtaataaaaatatacttattttaaagatttttcaattatgtgagattagtagcttgatatttataaatgaatggttaatcataacttttgaataattttatttatcattgatggtaatttttataagcaatgtgaaagagcacttagtttaatatggatgctttgaagactcatgtttttttgaagggagcatttgtgtgaggcataatgaggcataaagagggcctaaaacttttttatgtcacctttatttaattcatgtcaatttattgatgcaagggaaatttattttaaatacaggcatatgccattttatcatgcattactttattgtacttcatagtaattgtgtgtgtgtatgtgtgtgtgtgttttttttttttaacaaattgaaggtttgtggcaatcttgcattaagcaaggctttggtgccattttttcaatagtatttgctcacttcgtgtctctgtgtcatattttggtaattatccaaatatttcacaagttttcattattattttagcattgtgatctgtcatcactgttctttgatgttgctattgtaactgtttttcgggcaccaagaagtgcacctatttaagatggtgaacttggtaaatgttgtgtgtgttctgggtcctccactgaccagttcccccttctctctcccttatcctaatccttgagacacaacaatattgaagttaggccaattaatagccctacaatggcctgtaaatcttcaagtgaaaggaagagtcccataactctactttaaatcaaaagctagaagtaattaaccttaatgaagaaggcatgtcaaaagccaagatgaggccagaaagctaggcctcttttgcaaaacagccaagttgtgaattcaaaggaaaagtctccaggaaattaaaagtgctactccagtgaacacaggaatgacaagaaagtgaaacagccatattgttgatataaagtttgagtggtccagatagcagatcaaaccagctacaatattcccttaaatgaaaagcaaggccctaactctcttcaattctgtaaatgctgagagacttgagaaagctgcagaagaaaaattagaagctggcagaggttggttcatgaagtgtaagagaagccatctccataacataaaagtgcaaggtgaaacagcaagtgctgacatagaaactagagcaggttatccatatctagctcagttaattgatgaaggtggctacactaaacagattttcaatgtagacgaaatagccttctcttggaagaagataccatctaggacttacatagctagggaggagaagtcaatgccttgcttcaaaacttcaaaaggcggccgggcacggtggctcatgcctgtaatcccagctcttttggaggctgaggcgggtggatcacaaggtcaggagatcgaccagcctggccaacatggtgaaaccccatctctactaaagatacaaaaaaattagccgggtgtggtggtgtgtgcctgtaatctcagctactcaggaggctgaggcaggagaatcgcctgaacccgggaggcagaggttgcaatgagccaagatcaggctgttgcactccagcctgggcgacagggcaagacgctgactctcttgttaggggctaatgtacctggtgacttcttaagttgaagataatgctcatctaccattctgaaaatccaaagtgctttaagaattaggctaaatcttcactgctcatgctctataaatggaacaacaaagcctcaatgacagtacatctgtttatggcatggtttactaaacattttaagcctgtggagacctactgcccagaaaagactcctctcaaaatattagcgctcacggacaatgctcctggtcaccctacacctgtgatgaagatgtacagggagatgcacattgttttcatgcctgttaacatgacattcattctgcagcctgtggatcaagagtaattttgactctggggtcttattatttaagaaatatattttgtaaggcttatagctaccatagatagccattcttctgatagacctgggcaaagcaaattgaaaaccttttggaaaagattcatcaatctagatgctattaagaatatttatgattcacagaaggaggtcaatctatttacattaacaagagtttggaagaagttgatttcagtcctcatggattactttgaggggttcaaggcttccatggaggaagtaactgcagatgtgatggaaatagcaagagaactagaattggtgtctgaagatatgactgaattgctacaatctcatgataaaacttgaatggaggaggagttgcttcttatggatgagcaaagaaagtgatttctggagatggcaattactcctggggaagatgctgggaacattgttaaatgattacagagaatttaaaaagttctataaacttggttgataaagcaatggcatggtttgagaggattgactccaattttgatagaagttttactactgttaaaatgccatcaaacctcaaatcaatcatcaatgcctgctgtggagaaatctttcatgaaaggaagagttaatcaatatggcaaacttcattgttgtcttatttttagaaattgctgcagctagccccaccacttttagcaaccaccatcctgattagtaaggagccatgaacatcaaggcaaaaaggttattacttgctgaaggttgagatggtcattagcattttttagcaataaagtactttttgtaaggggtgagggcagagtcttactctgtcacccaggccgtagtgcagtggcatgatcttggctcactgcaacctccacctcctgggctcaagtgattctcccatctcagtctcccaagtactgggaccacaggtacacatgcccatgctcagctaattttttgtatttttggtaagatggggttttgccatgttgcccaggctggtctcgaattcctgagctcaagctatctgcctaccttgcttcccaaagtgctgtgattacaggtgtgaaccactgtgcccagccaataaagtgctttttatttaaggtatataagtttttttttttgacataatgttattgcacacttaatagactacagtataagtgtatacataacttttattatatgtactgggaaaccaaaaattattgtgatatttgttgtattgtggtgatgtggaacttgcagtatctcctgggtatgtccatctggttatgtaaagtgaattattggtagctttccccagctctttcaatttttaaaaaataagtaatacatccaatgcaggtatatacaaacaataacctcaaatgttgaacaatacatgttttagctaagcaagcagagatgtatagtttaaatagaaatagtgtgtacacaatcaacttctgttttatgaacaaaagaaaactataaaaagttgaatttaagaatcagtactggctgggtatcgtggctaacgcctgtaatctcagcactttgagagtctgaggtgggtggatcacttgagcccaggaggtcgagacccccctgagcaaagtggtgaaacctcatctctacaaaaaatacaaaaattagccaggcattgtggttgcgtgccagctacctgggaggctgaggtgagagatttgcttgagcccaggaggtcaaggttgcagtgagctgtgatggcgccactgcactccagcttaggcaacagagtgagaccctgtctcaaaaaaaaaaaaaaaaaaaaaaggtactaaaaaagcactaattttcatgtaatgtatcaaaagattagaggactccacaaataggctcttggcctaattagtttatttgaagttataaagtttttaagtatttgtatatctgtaacgcaaaaataaaccaatttcaagataccagttttagatcacctgcaggtgtatataaatgtaagatgttaacatttgactgttttcagaccattgcagactagaagaacatgttttcttggttgtttttgcaaagccttttttctcaaggatggctcctttggtggaagaacaacagatcacattgcaaaagggtgtggacacagggaagtgtgactcattggggccattattttagtgatctaccataatgttttatgttatatggagagtagcagaaatattttcaaaacctagatataaagattataaatgtactttatactttacaatgctttatactctataattttcagattcaatgctttatacttaagctttatttattgtcacaattaatacatagaagtgtacaattttaaaaaatattggtacaaatttaatatcagattacagtgttaagaatatttgctttgttttttcatgtcaataatatattttatttaacccaatatatgcaaatattggttaacatgcagtcaacataaaacattgacattcagcttatagataaatgaagtgagtctctatactcaagaaggatgttcaccaaaaccattggtcatcaatatagtcaccatccatactgacataaaatttattggaatacttcttcacgatttctacttgtcaatatgttaaaactcacatttccagtgtaatgtaaaagttatttacagtgtactaccgatatagttatattttggaaaaagggcctttgctacacatgctgtctagttttcttttatattttggcttgtttgaatacagtcataatggatacgtttaatgtctcaggaagtaaggtgttaggcagagtgggaatagcattaatatgcgtgggaaaaccattccctggtgttaagtgtactaaatccttttttttttttttttttgagacagagtctcattctgtcacccaggctggagtgcagtggcacaatctaggctcattgcaatctccacttcccaggttcaagcgattctcctgcctcagcctcccgagtagctaggattacaggtgtgcaccaccacacccagctaatttttgtatttttagtagagacagggtctcaccatgttgaccaggctggtctcgaactcttggcctcaaattgatcctcccacctcgacctcccaaagtgctgggattacaggtgtgagccactgcgtccggccaagaatactaaatacttttgaaaataaagccttgaatcttgtcttgaatatttcatttcattttcatacttctactgtgacataggacttttgaatactttcaggatgtggtagagagtttttttttatacggctattgtgatgtgactccatttaccagtttgctataaagtttatagcagttcatattacttgggttgattttagtagcctttgaggaagtttttaaagttttagttttatcatattacagtagtacagtagaggattcgtgtgtttggcattttagtccatatataattttcaattaagtacttaaacaaatccttgagttttaattttgtatactgaaccttggctgtattggctatatgatgaaattgtgtccggagttggtgggttcttggtctcactgacttcaagaatgaagccgcggaccctcgcggtgagtgttacagctcttaaggtggcgcgtctggagtctgtcccttctgatgttcagatgtatttggagtttcttccttctggtgggttcgtggtctcgctggctcaggaatgaagctgcagacgtttgcagtgagtgttacagctcttaaggcagcgcgtctggagttgttcgttcctcccggtgggctcatggtctcgctgggctcaggagcgaagctgcagatcttcgcggtgagtgttacagctcataaaagcagcgtggacccaaagagtgagcaatagcaagatttattgcaaagagcgaaagaacaaagcttccacagtgtggaagggaacccgagcgggttgccaatgctggctcgggcagcctgcttttattcttttatctggccccacccacatcttgctgattggtagagctgagtggcctgttttgtcagggcgctgattggtgcgtttacaatccctgagctagatacaaaggttctccacgtccccatcagattagttagatacagagtttggacacacaggttctccaaggccccaccagagcggctagatacagagtgtcaattggtgcattcacaaaccttgagctaaacacagggtgctgactggtgtgtttacaaaccttgagctagatacagagtgccgattggtgtatttacaatccctgagctagacataaaggttctccaaggccccaccagagcagctagatacagagtgacgattggtgcattcacaaaccttgagctaaacacagggtgctgattggtgtatttacaatccctgagctagatataaagactctccacatccccaccagactcaggagcccagctggcttcacctagtggatcccgcaccggggctgcaggtggagctgcctgccagtcctgcaccgtgcactcgcattcctcagcccttgggtggtcgatgggactgggcgccgtggaatagggggtggtgctcgttggggaggctcgggctgcacaggagcccatggagtgggtgggaggctcaggcatggcaggctgcaggtcccgagccctgccccgtgggaaggcagctaaggcccggcgagaaatcgagcacagcgccggtgggccagcactgttgggggacccagtacaccctcggcagccactggccggggtgctaagtccctcattgcccggggccagcagggctggctggctgctctgagtgcggagcccaccaagcccatgtccacacagaactccagctggcctgcaagcgccgcacacagccccggttcccgctcgcgcctctccctccacacctccctgcaagctgagggagtgggctccagccttggccagcccagaaaggggctcccacagtgcagtgggggctgaagggctcctcaaatgcaaccaaagtgggagcccaggcaggggaggtgctgagagcaagcgagggctctgaggactgccagcatgctgtcacctctcaatcccccctctaaacaggacaccccaattgctgttgggaatttggccgttgactgctctagctacttcctgctggataggggcgaagaaggggccctgcagttgtggtgtccttcagaggggaactctccaggccaggggaagtgccagtgggtcggtccaggggtcccgggtagaagttgttagttgaactcatttggggttccatttgtaagaccatctgttgcttgatggtctcgattctagaggaaacaaaattgacaagaaggttagaaatacagggcccaaaggtgagtaacagcaagatggctgccacaggacctagaaaggggagaagccatgttgcccaactccagaggttggtataagtatttgaaaggcattgtctgatttcagaagccttttcctgtaaacgccgggcagcatctcgtactatccctgactggttagtgtaaaaacaacactcttcccctaaaaaggtgcagagtcctcctttctcagcagtgaggaggtctaggcctcagcagttttggagagtcactgctgccaaagagtctatttgggattgtaaagtaaggatagatttcgttatttcttgcaaactgtctgagaagcaaatatgggttgaagacccacataagtagaatatgccttggctgggtagatagaaatttaccctggcttttaaaggaataggatacactgttttttctttactacttccatctctctctttctctcttcgacttcttctttgtctcttcttctctttttaactctctctttaactttctgtgtctgtccctctttctctctgactccttttctttgtctctgtttctgactccctctttgattttctgtctctctgtctcttcctctctctgtctttttgactttctctttctctcttcgactttttctttcctttctgctgcctctgccagctgcttatgctgctgttctcccctctccttcccgttttgatggctttgtcagtgtaagaaaatgattcataattcccacttcatgtaataaaatttaccaattgggagagttggcatggatctgtatggaaaatatgcagatgaaagattccttttatttgtaattgacaaaattgtatatattattgtttataacatgttttgaaatatgtatacattttgaaatagctcaatttagctaacatatattatgtcacatactatcatttttgtggtgagaactgtttaaatctgctgtcattgattttttaatagaatacattgttatttactatagtcttcatgttgtacaatagatcttttaaatttatttctcctatctaattgaaattttgtatgctttgcctaacatctcttcaacctcctctccccgagagatgacacttgcttatggcttaccaattcctctttatgtatctggcaaacccatcgtttgaatatgtatggtattgagtagctaagagtttcaaggcatctgatatttgaaacatatgtagaaaatttggtaatgtgactgcgttgtgtaatttgtagaatagtatataactttaaggccttattcatatggatcagctgcaatacatacttcagacagaacaaggagttagagtaggatggaaaccctttggattctttggatctgttaattttttacctcaagaaaatcccaggggatttggaggaaataatgttttcatacacattttacggttacataaattggcatatttattttggaagtagcagcatgtaatacatttgaaagcacatctaccttaccacccatttgttccaattttcagtgtataccctccagcaggggtcagcaaaattttgcctacaggctcagtatatattttaggctttgtggaccaagtggcaaaattgaggatattatgtaggaacttaaataacaagagagagaacaaattttacaaatgttgagtttataatattcaaaatgtaataattgagtacagtttttgggtaatacacagttttatttttcttttatttatttatttttttgagatctagttttgcactgttgccctggctggagtgcaatggcacgatcttggctcactgcaacgtccgcctcccgggttcaagtgattctcctgcctcagcctcctgagtagctgggattacaggcacgtgccaccactcctggctaattttttgtatttttagtggagacgggacttcactatgttggccaggctgttcttgaactcctgagctcgtgatccacccacctctgcctctgtctcccaaagtgctgggattataggcatgagccaccgtgcctggccaggtaatacagttttattaatgagaagaatggaactctttttggagggacaacatttcacctaattgggatttcaacttattgttcccaccatgttgattataaatgtttatgtgtaaaaattattctttgcttgtaggctatcccggaacaagcagtgtgtgggatttggcctgtaggctgtagttggtttttgttctgttttcttagaggtttattgtttaggaattaacttaaccaaggaagtgaaagacttttgcaataagaaccacaaaacagagctgaaagaaacgaagatatacataaatggaaacgcatctcatcttcttgaattggaagacttaatattgtccatgctatcctttctacacattttcagtgcagactctattacaattccaatgtcttttttcagaagtagaaaaactcatcctaaaattcatatggactctcaagggaccccaaataaccaaaaagatcttgaaaaagaacaaagctgaaggacttactcttactgattccagaagctactacagagctatagtaatcaaaacagtgtggtactgttgtaaacacagacatatagacccgtagaaaagaatgcagtgcccagcaataaaccattgtgagaaagattgtttatttttctttaagaataaacagagaatcagccattcctttttaggtgaagagaaggaggaaatagaggaaggaaggaagatcgggtgaaattttgagttaatagatgagctacatcaaatgaagtatcatatccttgttacatcaatatataatttcaaagatgtccctaatccttttggacttcatttttcctgcatgtgaaatgagatgattgagttaaataatctctaagcagtttgagctctaaaattctttggttgattttgatttcattcttttcccctgaagagtttttcttcacaaggtgttcattattatgctgtacaaccctagttattattattctttcttcagtttttatgtgtttcagtgtattattgcatacataccaacttttaaaatgaaagaaatgcttatttgttcctttagtgaagggacaaatctttatgatgctgattatactattatgtgttttatactattatgtgttttatttaatggtataaaactaccatgtgttttataatggcagtaacaaaaattatttattgtatatcataattataatgtttttattgtcatttacaattagcatgtgctttttatacttttgtctttttaaaatagcaaattctaatttatgataatttttggcaaaatcttacagaagtaagttgccatataatgtttctaaatccattacaatttcttctatttgagatattaattcaagaacatttgttgtaaaatgttaaaatcttgatgatgtattcatttttgttatttactaattgggatttttaaaaacaggtggcaatacatgtttaactttttatttaatgagatgtgtaagttctcttattcaactttacagtttcctttagctaaaatttctactggtagttatacttactgtttcatacatttttattgctccagattattagtttgcaacatttaccaaaccagtttttgaatatgtgagctatccttcatgaaagcaacttcagtttacactgctggttctgctttttccagattaagtatttatagtcttggtcaagggatgttgacaaattattagcttatataggttttgtaaatctatgtatctgattgctgtaatttaaaagagagagtttaaaaatttatttttaaatagttctttttgatttggtggataatagaggaagcaaaaatatgactcataataatttggcaatatttagaaggtaacttctttgtccagtaggtcctgttttattgtaattttcacctggttgaatgttttcttagaagcatctctaggcaacacaaaagtataataaagacttttaaaaaaatgacagaatagtatgtagtttccccaaagccctttgcaattctgcagacaaccagcaggggatctcgtctacacccaatttccttctgagtacagttggtagatagtgtctgtgattatactgttggggcatttaatggaaaatttgacagtggctttgagagagttcttagttgagcataggtaatatgatgtgataaaatattatctttattcataactcgaaatatttggcagttggatattgttttaaaaatgttttgtattgttataataataactgtaaattccagaatcctttgaatatttggcctttatgaggaaataagaaatcctgaaattgtacagaaaccaacgcagtactttgcatacattattgctcagaacaggtcttcaaaaagaatgaatgtgaaatatcttaattttaagttatgattttaagtaatcatttcagtattagaaagatatctttttctcaattctgtacttcttatctattggttaatagcaggttataggtgctgatgggtgcatcacttttgttttccttgatagtaattacataagtaggttctttgaaatgcagttttccttgaaaatgtaattttaaaaaatgttttatttctaaaacattgttttgttcactcaaaactgagtgtataagaaataatttgacattgtcgatttgatgaatgttaggagtataatagctttttgaaactatttggaagtagcttaatacttttaaagaaattgataattattttatgctcattaaatagtattttgaaatcagttatgaagaaattctaaacatattttattatagaacttcacagttgatattaattctagagatatggaagtcagtgctttataaacccaagggataaaaaacagtaactaaagataaatgttgagattaagctacttttacatttactggaaaacagtaactctttgttttgtatccatgtgtgtatttccactctgaggtgtttatcttttgttgttttacaaataattgaagcagaaatatcatcagttctctacagtatttcatgtaacgtgatgttatgttgtttctttctattatgacaaatatagtatccaggaatttcagggattgcttataaaattttgtagtatggtctgcttgctttaagcatagacatgcttgtacatatgaagagtaatttatgccatgtaccaagttttctggggtttaaaacctcaatcccacaattattttcacaaaagaaaatagaaataacattttaggatatttttcgatatcctttttgtatgtacattatacaaggtgaagacaaaatacatttttaaacagtttttcttgtagttaatgttattttagtcataaaatattaacattaatttataaaatttgtagtttactgtgtagaaaatgcagtcagcggtttatatttatggaaaaatgtatattttagcagataataaaacactacctgaggagtatgtatagaaataaaatgtgaaacttaaaaaaatttgtcaaaagagcagtgatctttcagggatgtgaaataaatactgtatatttaagtttcttaattttgacctactgtcaaattgtatagaagaaaatgttgatcgtttgggaagtggaaaaagactttggaacatatttagtgtgcagctgttgtaaagcaagttgaaactgacgtatttcatcctgtgcttattaaaactttgtctgtgtgaacacttgcatcttttctttttgttttagatatttggtttccaggcaggactgacgtctttggattgcagtggatcttactgcttacctgtaccagttattccctctttcagcactgctctttatgggaaacttctgaaactccccacatgctggtaagtcttacatgttaaaatgtgatttatgttaatttccatttattaggagggaaaaaacccccaaatgtatctgtcttatgcccatgctagttttatacaaaactttagaaaaaaaatctaaacttgtacttttactgagacactaaaagtcttttttaagtttctgaaatctgttagttcatcatgtcttttgtgatagcaataactgttattagggtaataactgttaattcatgttggatgtgtgtaaaatactacttgagattataataggaactgtaagaggaagtgcctttttttcaagagtgggtataaagattttaaaaagttataaattaatattcaagaccaaagtatttatctattaaataataatttcgtatatattcatacccactgacaaaagtatacacattatgtagagttagaatgtatttacatgtctagtagctatattttataagaaattgattgtagccctcaccattttcattccgaattgaatgctatatttggaggtcacatttccttaaattcggagagatttacagaaagaaagccagtagttaccagttataaatttttagtttaaaggaatgcttttaatatattgtttaaatatataaaataatgtttaaatatatgaaattaatttttagtgaaccatttttccaatttaaaatgtgatttagaatatgtcttttgtattctcattctaattagtaagcttatttttgcaggatagtttttctattagttttttactaaaaatgacataacctttagaaaattagcattaatttcttatctaaaatacttcagttgctaaaaatttgtttctttaataatatataacttttaaaatgaaattataaaataatcgctcatattttcaagaaactttgcctgctgatacagaaaatttttttaaaagtcgtagttaagtcttagtaccaattcctctataaagtgaaaccattattaaatgataattcttaatttctagtgataaatttcattttgtccttactcctccatacctctcacatgtcatttattatgttatatagagatagatttaactttttattagcatacatggtatgttgcatttgagtcaagttttatattctgatctattaagaaataaactgggatatgtcacagttgatatggtgatatcaattttaataggtatttgtgaaaactattttctccgttatgtgctgattaatttatcatttctaggaccaaaatagttttattgcaaacagtgcaatttactatagaaaattcttaatttctttaaaaaagtccatatttttcaaaatgattatagcctttatataaaatcaatattgaaataagtaagacttatttgaaggatacaaagagggtattatgaatactgtcaaatgttacttaaaatatgcctacagacatctagaaataatattccaattaaatactgaaagcatgagatcacagaatgccaatattttttggatgtgttttgcttttttgtagttaagactacttctgtgttatttcagtgatatttttgctatgctttatagaagtatattgatttgaaatatttcttgaaattttcttaataaatgtaaaaaaaaactttagtaactgtaacttgaaaataaagagaaaacttaataaattgagatattggttggttttagtgcagtttgaattcaataaaatactgcttaagcagtatgtcctataagtttaaagaaagcagacagtttccctgggacgtcagagatagctgatgagatgaggtcctgttagaattggacattagtggatgagacagatatccatgtatctatcactgcatacagtgggcgaagaatttggacagttactctaccttagacttgtccatgagcaatgatatctaaatgttttaatatgaacacttaaagatagttaaaccagttaatcaaatattcattagtcccatttcttcatgttcatgtttgttaaagcctaactaaaatatagtctcaaattcactttgtcctataattgagggttcaaatgtgtgattctatttgtagagaaatatatgcaacatattttggaagtttggagtatagaaatagtatattggcttagaaagtcatggaaaacatggaggggtaatttttaagcaggatattgaggaatggatataatctgaaagagcatactatattgttttatacagtcttaggtacctagttaaagttcatgacggtcctgtgagataagatgatattgtctcttataaactctttctaattttcagagaggttaaataagttgtccaaagtcacacactggcctcacaagattttcgtagaggattgtctgatttgaacatctttgattgttttattacttgaaggagcgaaggggacatatataatcttctgttaatcagttttgaaggccctgttaatcagttttgaaggcccagtatgctttttgcctatagttaaagtaaatttccatggagtgaaaggctagctaataaatctgaactctgctagtattagttaatagtatgtagatattattgtaattctgatcttaaaatgatggatattaacattaggtggaatcttagacattatcccagttactgagtctttatgacgtacttttggtttatagccatctgtgtactgcttgaacattttattcaaggatgttagctactttctgggccaaccattattgggcagctctaaatttctttcttttatttaatcaaagtttgcttttatgagaagtttatacttggatttctgcctaagaataatgtttcttctctgatataattattacttatatatatcatgaggcattttcattctcagagaaatgtgtgaaaacacatatttctttttaaggttgagggacttctaagttcccattttttacttagcacagtgccaattgttgattttaactagcaaagttattgaacagatcatttgcaggggaaaaatgcttctgtgaaatctttgagttcagtgttaattagaagttacacgacttggtgctggtaggctggtggtattgatgtggtgtgtgaagggcaggtgaggcagatactgatccttttgcctccctggaagtgaaactgaaggcatcatttgccccagctcagagtgacaccagggtaaattcttttagttttaatggatactgggaccttcaagtctaaaaaaaattgccagtaatacttattatcaacacaataagtaaccttccagggcttaaaatgatgtttatacaactgccctgttcttcgtaataccacagttcgaggcctcaagaagctatacttgagtgtttttaatgaacctggagatagatcttccttccaaaactgtgttcatcagtctggttttgtgattaacattccctttaactaaatgccttaaaactactaagccttaaatgggatgttaattctcttatctccacctgataggtgttagactgatttttcagctttggttctgccatctaagatgtgcttttatggaatgttttgaacaaaaaagaaacattaacatctgttacaatcttctcatttcaaagatgggaaaactgagttccagagaggtcaaatttcttgcctaagaccacacagttaattaatatcagtgcctcaatttgatcctctccttcttgattcaaggctcgatcaactgtaccattttgcttaaaacaattgctattactatttcaaaaaataactatttttaaatgtaaaattcagtagcattaagtacattcacattgttgtgcagtagtgccaccattcaactttctgtctctataaatttgactattctaggtacctcactgaaatggaatcattccatatttgtcatttgtgtctggcttatttcacttagcataatgttttcaagattaatccgtgttgcagcatgtagcagaatttccttccttattcattcgtttgtaagactgaattttatgtattcattttatgtatatgccacattttgtttatccatttatccattgacaaatacctctcaccttttagctattgtgaatgatgctgctgtgaacatgcatgtacaaatatctgtttgagtctctgctttcagttattttgagtatatacctagaagtggaattgctgtatcatatggtaattctgtttttgagagctgccatactgattttcacaccacttgacacctgcaacagtgatggaaaaaggttccaatttctccatattttcatcaacacttattattttctgttttttgataatagctatcgtaacaaatatgaggtgatatctcattgtggttttaatttgcattttcctaatgattaggaatgttgaccatcttttcatgtcctatctattcaagtcctttgctcatttttaattagtttttttccttgagttgtagaagttctttatgtgttgtgtaaattaatcccttatcagatatatgatttgcaagtattttcttccactgtgtggaaccatattgcagggtcctggctggagatgcatcaataaacaaaataggcaagttatttcccctcatggcaatagagaataaacattctcttaattaagggaattttaaggagagaaaaattgctccatgtagattgtcttttaaaattgaatcataaaatcatcctttttgctgtactgagccttgaaaggaggtgtttaaatagttcttgatagcataacacttttggattacttaacatttttctatttattattttttatgtttcagtgaatgcagcatttttactttttcttaatgattcatgtttgaactgaaaaccatcgaattaggagtagagcaaacagtgataggaattgaaatatagattcttgcagataaatgaaaaaacccattggataaattaaatatattttttatttgccagctctgaaaacattcttcagttattgttgaatgatgttgtaggagggtgcatttgatgattcaggacttaatgcaagcttttctaaaaacttgatttctcatcaagtattttaacatgtacagcttgaacaacatgggcttgaactgtgtgagttcagtttctttcaataactatattggaaaatttttttgagatttgtaacaatttgaaaatttgcagatgaaccatttagcctagaaatatcaaaataatgaagaaaaagttaggtatgttatgaatgcatacaatttatgtggattttgtctattttatcatttactaccatgcaatatacaaaaatttattataaaaagttaaaatttggccaggaatggtggctcacgcctctaattccagcgctttgggaggccaaggtgtgaggattccttgagcccaagagttccagaccccatttctagaaaaataaaaaggtaaccaggcatggtggcatgtgcctatagtctcagctgtttaggaggctgaggtgggaggatcacttgcgctcgggagattgaggctgcagtgagccatgatcatgccactgctctccagcctgagtgacagcgagaccctgtctgtttcaaaccccaaaaccaaaaaggtaaaatttgttaaaacttatgcacacaaatgcttagggaccacacatggcaccattcagagctgatagaaatgtaaacaaacataaagatgcagtattaaatcataactgcataaagttaattgtagtactacatggtgtactactataataatttcgtagccaccttttgttgctactgcggtgagcttttgtgttgtatctgcttaaaatgctgtgtgatggtaagcatctccatgtgagcagtccctgagcagttcctctctacagtatgactgtgtattgcaatagaaagtgatctgtcacagttctcacatatttgtcattgggcttagtgcaatactgtaaaatactataaacttttgttttttttttttgagacgaagtcttggtctgttgcccaggctggaatacagtggcatgatcttggctcactagcctctgcctcctgggctgaagtgattctcgttcctcaacctcctgagtagctgggattacaggtgcttgtgccaccacacccagctaatttttgtatttttagtagggacgaggtttcatcttgttggctaggctggtcttgaactcctggcctcaagtgatctgcccaccttggcctcccaaagtgctgggattacaggcatgagccaccgcgcccagccctgtaaaccttgaataacaccacagggtccacacagagtgattctggaagtggttccaagaagcagaaaaaagccatgatgctataagacaaagttgagttgcttgatatgtaccacagattgaattctgcagcttcagttgcctgccctttcaagaaagataaattcagcataaggactattgtaaaaaaataaaaaataaaaggaaatctgtgaaaccattgcttcagttttgccagctagcacaaacacttttcactttttgtgaaatacctttttattttgtattgaaaatgcagcttttatgtgggtgcaggattgctataagaaaggaatactagagactctaataagatttgagaaaaagtgaagtcattatgtgacaacttaaagcaaagagaagatgaaggatctgaaggtgaagaatttaatgccagcagatgatggtttgacaattttagaaagaggtttggcttaaaaaatttcaagagaacaggagaagtactttctgctaccaagaaactcatattagtcagcagatgagtttcctaggtgccattaagaaaattattgaggagaaaggatatctacctgaacagattttaagtgcagatgaaagtgccctattctggaaaaaaatgccaccaaggacatttattagcaaggaagtgatgagtgctcacagacctgtgccagatgataagaagtaggagaagcagtgccagaaaacaaatggacattgtacagtctggcagaagggttccagttattcaagattgcctttgacttttttttatgacatggaccatcctatgataggggcactgcattatttgaaataaatttcttggaaagactgaccagtctttgtatatgttaatggtcttgccaatttctgtttttccttatatttttggttgtgatttgataatgtgtttagataaataacttgtcaaaaaatacatacatttatagtttttaaaacatggcctatgtgtatgaaattaaaaggatataaaaagcacaattataggtaaatagtatgtatctttatattagattttttccctttaatttttttagaaagggcacaaagagcatttgacttgacatatgttaacaagcaagagagtgttggtccaatgagaacagaaagtttcctttgattgtgattttggaaaatttgatattttccacatggaattttatggtcagttggggtgaagttgtataggcaaatatgatgcatttccaattccctagtttaatgttttaaacttagtaaaatagtttgtttagtggtgtccaaatgagcatttacaactcattcttagcttattgcctttaaatttgatttttggttattggagaatatttctacatgacctatatctatgtcagaataattatattgacttttcctcagtatttggctttgcctgtgcacagcagtgggaaaatattatcctgtgacaacattctattctagtgacagcattttaaaaaatgtatctttctttcattatttttgtgagggagagtgaaagtcagtagtattctttgagttcaaaagaactctacgttgttaatgtatttttttttaaagcgaaatggcttggttagtaattattaaatttagcctaggttttctttttatgactacctttaaatttttttcttaactgtgttttgatgatttaatttctttttattttttattttattttttttttattatactctaagttttagggtacatgtgcacattgtgcaggttagttacatatgtatacatgtgccatgctggtgcgctgcacccactaatgtgtcatctagcattaggtatatctcccaatgctatccctcccccctccccttgaaatgtaagaacaaataatcattggcggttcccatattcaaaagatcagatagtgcttaggttagtgacagaagaaaatttctaataatagcatcataatccccttgtatagcattttgtacttaactaagtttcactgcatacaggaagttttttgatactcacaaccaacctttgaaataaacaggttaggtatccttatttctattttatagatctggaaatggaggattagggaaggtgatatggtagacctagagagataaaatcgcttgcattggacatcttttatttattttattttattttatttttctatattttgagacagagtcttgttctgtcacccaggctggagtgtagtggcacgatctcgactcactgcaacctctatctcctgggttcaagcgattctcctgcctcagcctcccaagtagctgtaattacagatgtgtgccatgacacctggctaatttttgtatttttagtagagatggggtttccgcatgttggccaggctggtcttgaactcctgacctcaagtgagccacccgcctcggcctcccaaagtgcagggattacaggtgtgagccactgcgcccgccctagacatcttttgattaattgatgttggaactattaatagcatgttgattaatagctattaatagcaggttctagataagaactttgtattcttcattatgccttataacttaaaaaatactgccagcttcttagaagaatctgttaatacttaacattgttcagatttcaactgactaatgagtcatttattcattaaaaaaaaattttggtgcctatcatgttaaaactgttgtgttgtaggccttggagtgtgaataccacttggtctttgtgtttcctttcttgatactttaagaatttagacaggtgttcttaaatactgtctaactcatacatctgcagccaagtttgtttgtttgtttggcttgtttttggaagatctaattatgacctctttactagaatactttgcttcttacaatttatatggtaaagtttaaaagctttaaaatattctttgatgccctctatggtctggcccctgcttggctttctacactcatctgaaacgtcctcctctctgtcccctccttcttgcttttaaaaattttctctccttttaccaaattgttcactattattgttttactattctgtatcctaaataactgtaactgactccagatgctactccagttgatactttttctgacctggtcacttcccctctaaaatatgctttaaaatatgagataatgttcttgtttttcattgtacttttcatagaagtgattttacactgctttgtgtgattatttaatagcctttcccactcgttttattttaagctccataagaaacatctctttttctgtggggcacgtttatcgtgaaaacctcgcatctgttgtagacatgagtaaatatttattggcatgcgtctggctgtttctttaacaatttcaattttttttttggttttctgatttatgaggttttagattgtatacttttttgacaatcaagttctatctcctattagctcacattatacatgcaaaacttactcttggccaaagtgaaaatcagtgatgttaattacttaaattaaactaaaattttagtgacttttcctattcagagttctcaaggtaatatttgaaagttattaattacatatataaaatatattgtataaacacacttcatctcctttttttcctgagcagttacattcttattttaagtagatgaattgtctgttttaaattaacttgtctagaagatgagataatgtaaaggcatcttacttcttttgtattttgtttgtttgctaccacacatcagttaaccattatttaagctgttccatattccgtaatactagcaccactttttggctcatatcgagcaagtatagtatataggccattccctccagagacttacaactcatgctgcaactcatttataaatatttattgggtccatggtataattccagtcatcattctacatgctgggaatgcagtggtaaacaaaatagaccttgtctctgtttcatggagccaatattctgaagaggtagagccaacactgcattaagacaaatacatgcatttcagataatggtgagtaataagaaaaattatggccaatgggatagaaaatgaatgttttggggagtttatttgtctaaaatggtcagggaagttctcttacatggatgtgacttttgactccaacctaaatgaccagtcaatggcagccatacaaagattttgggaaattgtgttgcaagtgttgggaatagctggtgcaggtctcaaggtagaaatagatatagttcatatgaaggacagatagaagtcaagtgtgactgcaacatagtaaagggagatagataagagattaaattggagaggtggtctattcacaaataaaagcaacgtaagtaggtataacctgaacaatttttagccttaatagtagagaagtaaagatttaaacaatgtagaattaaccatcttttttgtgtactgttaaatgaatataatattcagaatgttaaggattgtgacaccagtggtggaaatttaatatgacagatccttacaacttttctgctgtacagcttgactatatccatcaaaatctgtaagcatgaatatcttttactcagcatgtccatttttaggagtttgtccttagatataattaagcgaatgaccaataattagttatgataaaatggaaaaatgtaaatagcaaataatgaaaaacaggttgtataaattatgttacactcataccagttagcaatatgtaggatagccattaaaattttgttgtagtatatgtttattggtatagaaatgttctcatgataaatatcgagtgaaaaaaggtcacagaacagagggatacagagttagtctattaatctgaacaaaaaatatgcttgcacaggtaaaaaggctgggctattgctaaactgtttgtgatggtgttatgtgagtggtaggtaatgtgtggtttatgtattatagtggttaggagcatggacctcagaactggattccttgcatttaaatataggctctgccacttcctagccttgtggctgagaaagtctttgtgtctgagtttcctcatttgtaaaaggggcaattcttaattcttaccttcgagttattttgaggcttaaatgagttaacaaatatgagctgctttgaatagtgcctgacacataacaagttctttatgcaagttagctgtgattattactattgcatatttacttttttctgacttttttcagtgaacatacatttataaaattgatgggtcacctttctctcaaagattgtataaagttttatttgacatgccaaaaaggaaaagtttgtttttaatcacatgtattaatataataggtataatctattaataaatttataaacttctataaagcagttaagaaaataaactgaggaacagactgagtaaaaagatgcacaaaacatctgaaaaaattattgtatacagaatatatgaaaatatcctacagttgaataagaaaaaatacaaccaattaaaaaatgggcaaaagacttgaacagacatttcacaaaggaagggtcaccaaacacataaaaaagaacccaacaactatacataagggaattgcagattaaaaccacgttgagaatgatcataacagctttattcaaaataatcccaaactgaaataaccctggagattaaataaattgtggtatatttaaacaacaaataccactcatcaataaaaaataatgaactactgatatatacagttgtgtttcctgagtgaaaagaactgggcacaacagaaacatggtatgattctatttatatgaatttctggaacaggcaaaattaatctgtagtggaaaaaagtctaaattgcctttgggaggatgaaggaggaaggattgattgggaagaacacagggaattttctggggagatggtgatttcagtatctttttggggtgagggttataacacagttatgagtatttgtcaagattcatgaaattctacagtttttagaatatataaaaagaatataaaattctttttatattttactgtttgtaaattttacctaaagaaaaaaggactgaaaacaaaattgaaatctgtttgcttttttgcagtggaatgagttagcaactaatgatatgagttaagcaattcttaaagcactttctgtgtattctaggcttgactaaataagtaggcttattcagagtaatggtatccaggtttttcacctgtggagaaggagttacaaatatgttaaagagaaagtctatatttatttatcgttttatttcttctttgagacggagtcttgctctgtcacacaggctgtagtgcagtggtgcagtctcagctcactgcaacctctttctcccaggttcaagagattcccgggcctcagccttctgagtagctgggattacaggaacccacccccatgtctggctaatttttgtatttttagtagagactgggtttcgggtttcattatgttggccagacttgaactcctgacctcaggtgatccgcctacctcggcctcccaaagtgctgggattgcaggcgtgagccaccgcacctggctgtggaagactatatttaatggtaggccgtcatggaaaaaaaagaggaggaagactataattcaccttggtattgtatttgaattggaggtatcagaatgaactcatggtttttaatacaaagatatgtcacatttacacctttttgttcatattgttgccgttttcttcttatttaacatcagtacttttgttgaatttagacactaggttgagacattatgccccgctgctgctctattgacggtatattgaagtttatataggttaatggggtttttgtttgtttttcttttttttgaagaattttttctttgcatgaaattttactctggagattaatatgtaaaaagttcaacatacatattgaaatgctcagatggaattggggagatatgcagcctagtagtttgcatttggtctctgcatggcagatgtttggataaacaatgaatatcttttggtatgttagatattaagttctcagtaagcacagagtggctttttaactgtattattgtgtagcatcgaatagtatctaatacttagtacttgcctaataaatgtggacttaaattgggtattttttcttttgaattgtagtgtttcagagtgttggaaaatcttagtaactaatatataaatatattttttcataaatgtagtattgaagtaataaaggtaatccttaagtaaactataagtattcatttttaaaaaatgactatattgaggtataatttacataccataaaattaatctgtttttaagcatacaattcaatgatttttagtaaatttaccaagttgagcattcatcaacataatcatgtcaccctaattagatcctctttgttacagttaatcctaattcttaccccaacttcaaggaactgtagatttactttctgtatctctagaaatagaaaatatctctagacatgttctgtccctggaatctataatatgttgtggtcttttgtttcagggttcatctaccttgtaacatgtattagtacttcacttctttttattgctaaatagtagtcaattggttggatagaccactttttatttatccattcaccagctgatagacatttgtgttgcttacacttttaaggctattatgaataatgctgccatgaacatgtagtctttgtgtggacttaatggtttcatttctcttgggtagatacctacaggggtatggttggattatatagtaaatttatgtttaactttttaagaaactgcaatctgttttgcaatatgatatcattttatattccttccaacaatgtatgaggttcttgttttttcacagccctgctgacatttgttattgtctgtctttttgattatgtccattccagtggggttgaaatagtatctcatggtagttttataagaattcatttttgtttgcttagttcattttaagattttggattttatgtatggtaataagacatttattacacttttattttagtggtaggcagcttttcttatattttcctatttttcatctaatattttaattcaaataaaactattccagaaatttgaaaaatgttaacatatttttatatctcgacaaacaggatataatttgtattttatttgcaaatgctaaaatcattgtaattaaaaatatatgacaaaagctggccaggcatggtggctcacacctgtaatcctagcactttgggaggcagatgctggtggatcacttcaggtcaggagtttgagaccagcctggccaacatggcgaaaccccgtctctaccaaaaatacaaaaattagccaggtgcagtggcacgctcctgtaatcccagctactctggaggctgaggcacgagagtctcttgaacctggaggcggaggctgcagtgagctgagatcgtgccactgcacttcagcctcagggacagagcgagactctgctttgaaaaaaagaaaaaaaatggcaaaagctaatggatgttgaaaaagatactccgatacactgctgacgaatgtgaaaattcagcgtgatatcatgtatgcattaaaaagaccactgtagaaggatttgtattcatgtaaagatcttagtgatctctaagatatgttgtttactcatatcaagtaggctgtagacatacacctatgtgtatattctcattaaaattataaatgtatatttgagtgcatgaaatgaatatacagaggtctgcagggatatatgataaactcataaaaagttgttacctgtagagtgtggagttgggagtaaatagtattagcttttcattttatctatttaattttttaaaactttaaaaactttttttcttttcattgagtattgatgtgtaagttaagtagtcactgtgtaaagaaatatacatcttagctttttaaactgttttcatttctaagttgagttagcaaagaactgtactcattttattttggaaaaagtgaactaatcttattttactgtacaggatatgagtaataacaaaaatacatttttggaaccagtttgtaggttcaaactttgcattttgggactctatataaatctttagatccagctgttgctgagaatattctttcaattgctatgaggtgtgttgattttaaaagaatggatggctgttcctcaagtgtacatatggcaaaaatttaatggtatcgctatgaacttgaatggattgtttaatttctttgcatcgagtagtaagaaccacacttccatcatttttatttaaaatttagaagaaggaatttttttttatagaaatgcccatttggtcctgaaatttcatcagctctctgttatagtttgtcaacaaatggtacaagcaaagtctttcaaagtatttgttaattaggccatattcatttttagtcttcgctactatacagtcaagacctacttgtttctatttcctttaatttatcctggagtttgtccaagttgagttttaatgagttgtttatcccactagttacactaggatttatttttccctagagagtaatgtttgaattgatagtttttaaacctattctgtaaaatgaacatatgttcagactaagacttctggatatgaggaataggcatgtgttaaagaaattattttatattcaacagcttaactgttaaaatggaaatttagtgatatttcaaaatattaggtaagtccagaagttagaaatttttggtatgaatttatattgaactattttgttttaagtaaagtttaataaatatgtagtagtctaaatcacaaggaaaaatacactttttattgtgcatttttattgacactttaatgactcccccaaatagtttaaataaagttgtaaaagctgttgatctttaaaaaattttttgaggtgaatatggtataatgttatgtcttgatgaattggtaatagatacattgagtatttgttattttctacatttgttaaccagttacaaatatttcaaaattgacaaaaacaaaagagaaaaacccctcttcattggtattgttacattaacagataattgtgtaagataccatctatacccaaatcattttaaatttatttatgtcagtttaaatactactggagtatctaacagaagtataaatagaatgtatttttatttgttgtgggttacagctgaaaaataaaccacaaagacatatcctgtgtgtataattggcgtgtttattattgaattctaacttttgtacaaagtaagcttctcctttgatattaaaataattaaggagagaatttttccctacccttgggcattactaaaatgtacaatatattaatctttctgaatttgcatgtgtttaagtttttattcaagtctatgttatccatttgggaacattttaggtgatataagctggcttgaaagggtaccatatacggtagctgaatttattatgaaatagtaaagacctgcttgtaaaaaaaatgaatcccatctataatattgccatacaaatacttactgctgtagttatatgaacatggctcttgctacacgataggacctcctaattgccacagagtgcctgaagatagattaattgtacattttcgtattataggagatattccaaatatctgtgttctttactacttatcactaataaaatgttgtgggttttttggtgcaggggcggggggcggttcaggaatttgaacagaaatttgagaacatagtggagagacctagttaactattttaaaatgcttatagaataaaaaggaaaatgagaaagaaaagaaaatgtctttaaaaatattctaaatgttggaaaagcgaaaggaaataataaggataattacattcagatttatgaattgagtcatatttgtttatccttctatttcttttgatctctactactttacctgtttggcataagggatcttttatttactgcatatttattttctggtccattcattccaatcctttggcttttatagccaaatatgatcagaattgtggattgagggacacaggtagtgtcacatgttgctattaaggatttgaaagttgttggatgggatagtggctttcttattgggcaactgtgtatttgattgatcttacatactaattaagagagatgggtaggccgggtgcagtgactcatgcctgtaatcccaacactttgggagggtgaggcaggatgattgcttgagcccaggagtttgagaccagcctgggcaactaagtgagatcctgtctctataaaaaaataaaaattagccgggcatgctggtatgcacccattgtcccagttactcgggtgactgaggtgggaggattgcttaagcctgggagatggaggctgcagtgaaccgtgatcatgctactgcattccaaccagggctagagtgagaccctgtcttaaaaagagagagagagagtgacggagacagagacagagacagacagaggcaggggtgaccctaggcttttgtttttgttgtttggacattttttttttttttttttttgtgagggaaggcattggtatttgaatcagttttgctaagaacagagttctaatactttagggacctagtttgttttcattgagctaaaatttacaacataaatttcatcattttaaagtgtacaattaagtggtttttactatattcacagttttgtgcagtcatcaccactatctaattccagaacattttcaaaacctcaaaaaagaaattctgtctctatgagtctagacattttataataacagaataatataatatgtgactttttggtctgacttctttcagttaatgtaatattttaaaggttcatccatgttatatagcatgtatcagtatttaattttttatcactgaataatattcctttgtatggatcgaatacattttgtttattcatcagttggggtacatttgtgttgttctcattttttggctaagaatagtgccgcaatgaacattcttgtgcaattttttggtatgaacatgttttcagtcctcttgggtatgtatatacctatgaatataattgctgggtcatatgataactcaatgttcatcttttttacaaattgccaaattgtgttttacatagtaactatacctctgtgcgtgatgttccaatttctacctattcaggccatacttgttattttctgcttatttttattttttaaaattacatcccttctgatgggtatgaagtggtatcttgtggttttgattttcatttccctgatgtctaataatgttgagcattttttcatgcgcttattggccatttgtatatcttctttgtcaagtgtcttttcaggtcctatgttcactttaaaaattgggctgtgtatcttgttcttgttgaattatgagagttatgaattatgagagcgatctcggctcactgcaagctccgcctcccgggttcacaccattctcctgcctcagcctccccagtaactgggaccacaggcacctgccaccacgcccggctaattttttgtatttttagtagagagggggtttcatcatgttagcccggctaattttttgcatttttagtagagagggggtttcaccgtgttagccaggatggtctcgatctcctgacctcgtgatccacctgcctcggcctcccagagtgctgggattacaggcgtgagccaccgcgcccggccaaagttcccttatattcttttaaggatgaattgtgcacataaattgactatgtatactaggctgttgtaaacagggtaggaaggataatagaaagtctgggaaattctggagaatttcattttacttcttcgtagctgcacattcctttatctatttgaatgcccatagaattttttccttatcatttttggagttcagtggctttactaggataatgatcattcagaatcagtattgtttgtgacacattgtgcacgttgtagtttaggtgtttattttagacaagatttttttttgataaatatttctgtatactatttcttttctatttgttttcctcttttctttaggaacactgattatgtatattttatattgccctttcctgttactgatatcagtgtccttttctaatattgttttataatttttcaaaattgttatttttgtatttctagattttatctaccacgttcctaatttgagttatattttatttgttgaacttctggctatttggagatttatacataactttatgatattagtttatagtttaaatccattgtgatcagcacatatattgtatatgatttcagcctttttcattctacttagacttgcttttatgttcttgtagtatgccttggtgaatgtgtactctgctgttgttgggtggggtgtcctacaaatgtcagttaggccaagttgattgatagtactgtttttgtttttaattctttacttacggtctatttgttttatcaattcctgagagaggagtgttgaaatgttcaggttttggatttgtctattcctgttttcagttctgtattttaaaaaatgtatgtatttcggagatgtgtagtgcctacaaacttaattaaccatgttatcattatgaaaaaaatctctctatatccatggtaatagtctttgttccagagtttactttgtctaatgttaatgtgtaactcttttttgattagaattatgtggtgtttgttttgctcgttcgtttactccttcatgcccctatccccttaatttttaacctatctactttattatttaaagtggatatatatgggtctttttttttttaatataatcgaagaatctcttccttgaattggtatgcttagacgtttgagacttaatactatattttggggtttagttctagtatcttgctgtttgttttctagttgtcccatctattgtttgttttcttttttcttttcataactttatttagattcattccgtttcatcctctctattccattcttattccactctgtctacactattgcctttattagttttaccttttagttttatggctttagttgttctagggtttacagtttacatcttttacttatcacagctaccttcaaataatgttatactgtgtcatacattgtgtaagaacctccatttccctcttcctgtccttggctattgacattgtgcattctacttttacatatgtcataaactctgaactatgttgttatgatttttgctttaaacagttaattcttaatcttattagaagataatgtttctttcttcttcttttttttttaaaaaattcacccatatatttaccattcccattctcttcacatttctttgtgtagagccacaaatatttccatctggtatcacattcatttagcccgaagaattttctttaacattttttgtagtacagatatgctggtgaggaattcttcccagcgtttagtcataaaaaagctcttttgctaacatttttgaaagttttttttttcctgaattttggattctaggctgacagttttcctttttctttcagcatttcagtcatggtattctgttgtcttctgttctgcatgatttctgatgaggagtctgctttcattttgtagctttgtttctttacatgtgatgtgtttttctccttaacactagttttcagcaatttgattataatatgccttggtatgtttttaattctcttctgcttggggtttgctgaatttcttggatatttgggtttatagttttcttcaaattgcttgatagtgtcccacgtcccattaaagctttgttcagttattttagtctctctctctctttttttttttttttttttttttttgagacggagtctgtctctgtcgcccaggctggaatgcagtagcgcgatctcggctcactgcaatttctgcctcctgagtttaagcaattctcctgcctcaggctcctgagtagctaggattacaggcacatgccaccacgcccagctaatttttgtatttttgctagagacggggtttcaccatgttggtcaggctggtctcgaactcctgaccttgtgatccgcccgcctcggcctcccagagtgctgggattacaggtgtgagccaccgcgctgggcctattttagtgttttatctttcctggtcctcgatttcctgggaactcctcagagactagtcagctagtgggagaagagagggaagcatttgttcctacatttccatcttctgcatatatgattgcaaagtagtttgctggtgtctcatgctgcatggtggctttaggcaatgcaaatgaaagtgtacattgaattggtctccatagcagcggccagaatatgaggtagggtgatatacaagagaagttctgtactctccatgtgtggttacagttgggaaaatgacaaatggtggagggtttgtggggttaaggaaagagcaggttacatacagtatactatagtagcatcctgattttttttaatctatttttgttttattgttcttctattttatcttgcatgtttattaaccttcagtataaacttgttgctcacagacatattgaaatgttttcttactttgaggctttgttatttagaaaatttaattacataattcactttattcatagacaaaaccaaatgaataagggatcaacaaattagatattccagggcagaaattttaaaaataattttccatgttactatcaagtagagtcctgcatgtaatgtaaatacttcataaatacttctgagagaaagtattaggatagagggctgtggatcaggttgcctggatttaaattctaatttttcctctttttagtagtatgacatttcataccttaatatatcggtgtgtgtcttggttttcccatttgaaaaactagtataatgatagtacctccctcatagagttattatggaaggattcaacgtgttaacagataaaagaaatctagaacaatgcaggtttgctagtaaatcctttctaagtgttaagaagcactatttttatttttactcaggatgattgccttgattatgtagtaattgcttgagcagtatatgtgtaggtgaatatgtgtgtatggacatcattctagtttgtatttttatattattcagagtttctgaaatagtggaacttaaagttagcagaattgcatatctattttgtttaagtagtatgtttgcatacatactttggatgtataccctttcttcccttgcaacctaagtcatttagtattttgttgtctgtaaatgctatttactgtattgcgattctttctgttttcttgtgcaggaccaaaagatctcagattgctataactgaaggtatatttgaacttccaaatctcacaattcaagctacaagagcacagacacttctcttgcaagcaatatatcaaagttggtctcatcttggaaatgtcagctcttccgcagtgattgaagctttgataaatgaaatcttcctaagtataggtaagagcacagtctttttgataactatatggaaaatttgtgttagaggcaactaatattttattatgaaaatccatatgtctagcatggtcaacttaaattgtaatatgtttctttgaatgtagatatttatagcttatgtttaaaatccagattatgagttaagccatccagttttatttcctcgtacctatttctgcatatgtttcataattgcaaaagattatttttcaccagcttcttgtataatttaccctttggataacttttgagggtatcaatgtatgtgtttgaaatgataaccaaattaagtataagtacagtatgtttgattatactggtaaaatgaaataaattcttactcataatatttggttagtttggtaaacaatttttgtgtgtgtgtgtgaaaagcattaatctggcacccttaaggagttaattaactactaaaaatacaaatttctgctttcatatcactataagagatatcttcatcttatcactcagtttgcatgtaaacaaaaaattatagaagctttttaaagttgtttcagttcaaaataataatgttatgtttgtcagtaacacaaaagtagtttttaaaggttataatttaagtgtaattatgcttaaagtaacattatttttaatttatctgttaaaataaagcgacttttgttcttatatgatgcttttgaaggttttaatttcagacctgacatcataattagagttttcttatttggcctagccattaactaatgtaaaatacaggttgattatcccttatccaaagtgcttggtaccagagtgattcaaatttcagatttttttcagatttggaatgtttgcacatacataatgagatatactggagatgtgactcaagtctaaatatgaaattcatttacatttcatatacaccttatacacatagtctgaaggtaattttatacgatatttttaataattttgtgtgacttaatcacatgaggtcaggcgtggaattttctacttgtatcatgtcagtgcccaaagagttttgaattttgaagcatttcagattttgggttttcagattagggatgttcaagttgtagtagttttggtgctggcttttagcattatataaagaataacaagataaatgttgcagtaggctagaggttcttcactcggagcttatgaaaagacttagagttttctgaaccccctgaagtagtatgcaaattttagtgtgtatataaacacacacagacatacatatttgtatcctctttttgaattgaacttactgctcctgtctaactgaaactttgtaccctctgaacaggatcttcctgttacatacccacccccactccattccgcctacgtttggtaaccaccgttctactctaactaccattctactctctacttctatgagtttgacttttttagataccacatttaagtgagatcctgcagtacctggcttatttcacttagtataatgtcctccaggttcaactgtgttgtcttaaacgacagaatttccttctttatttaaggcagaatagtaatctattgcggatatatgccatattttctttatccattcatcccttgatggatacttatactgatttcatatcttggctattgtacagtgaacatggctgtgcagatatctctctaacatgatttcattttctttggacatatacccagaagtgggattgcttatatttttagatttttgaggagcttcaataccgttttccataatggttgtattaattttcttttttcttttttttgtgagatggagccttgctctgttgccaggctggagtgcagtggcgcgatctcggctcactgcaacctccgcctcccaggtacaagcaattctcctgcctcagcctcccgagtagctgggactacaggtgtgcaccaccacacccagctaattttttgtatttttagtagagacggagtttcaccatgttgactaggatggtctctatctcttgacctcatgatctgcctgcctcaacctcccaaagtgctgggattataggcgtgaaggttgtattaattttcattcccaccaatggtattctctttttctccacatccttgctaacacttatctttcatcattttgagaatggccattctaacaggtatgtggttatatctcattgtgaatttaatttacatttctctagtaattaatgatgttgagtatgttttcatatacttgttggccatttgtatgaaccatttatatgttggccgtttgcattgttcaggaacccgttggccatttgtcatcttttgagaaatgtctgttcaggtcctgtgcccattttaaaattgagttatttgttttcttattattgagttgagttccttagatattttggataacaactctttatcagagggatggtttgtaaatttttctcccagtttctgtgttcttccttcattctgttaattgtttcttttgccgtgcagaagtttttgtttgatgcagtcccatttttctgttattgctttcatttcctgtgcttttagggttatagtcaatgcccagaccaatgaagctttgtccataagtttcttctagtagatttacgtttcagatcttatatttaagtctttaatcccttctgaattggtttttcctcatggtgttagataaagattcaatctcattgttctgcatgtagatatccagtgttcccagcagcatttattgaagaatctgttctttccccattgtatattcttggcatcttcatcaaagatcaattgtccataaatgtgtgggtttattttggattctgtcttgttttgtaggttgatgtgtctgtcttcatgccagtaccatgctgttttgattgctatagcctgttagtataaagtcagatagtgtgatttcttcagctttattcttttttgtttaatattgcttttgttctttgaggtcttttattccatatgaatttaaggatttttttactgtttttgtgaaaaatgacattggaattttgataggggtcgcattgaatttgtatattgctttgggtaatatggacattttaacattaattctccaagttcattagcacagaacatctttccatttatttgtgtttttttttagtttcttttatcagtgttttatactttttagtatacagacctttcatatccttggttaactttatatccacatatttttgtttttgctgttataaatgggattgttttcctaaattttttttggatagttttagttttggacatgttaatgcataaaaatggtactgatttttacatgttgattttgtatcccacacctttactgaattcacttatcagttctaaaagtttttggatggagtctttaggggttttttttttttttttttgagttggagtctccatttgtcacccaagctggagtgcagtggtgtgatcttggctcactgcaacctccacctcctgggtttgtaactgagattataggcacgtcaccacacctgggtaagttttttgtattttagtagagacggggtttcaccatgttggtcaggctggtcttgaactccttacctcaagtaattcacccacctcgtcctcctaaaatactgggattacacgtgtgagccactatgcctggctgggatttttacgtataagatcatattgtcaacaagtagaggcaatttaacttcttttttttctattacaatgccttttctttcttcctcttgcttagtttttctgaataggacttccagtactgtgtggaaaagaagtagtgagaatgaacattcttgtcaggtccctcatctttaaagatttcagcatttcactcttccatatgatgttagccatgggcttgttctgcatgtcctttattgtgtttaggtacattccttctatacctaatctattagtagttttgatcacgagaggctgttgaattttgtcaaatgccttttctgcatctattgagatgatgatatgacttttgtcctttattttgttaatgtggtgtatcatatttattgacttgtatttgttgaaccatccttgcatcccaaggataaataccactgtatcatggcaaaagattattttaatgtgttgttgaatttcatttaatattttgttgagaatttttacatctatgttcaccagagatattggtctgtaagtttgttttcttgtagtgcccttgtctggctttggtatgaggataatgctagccttctaaaatgagtttgaaagtattctctcttcagatttttggaagagtttgagaagtgatcaatattagttgttctggtagaattcatccagtccagaacttttctttgatggggactttttgttactgattcactcttcttactcattattggtctactcgtattttccattctttcatgattgagtcttgataggttaaatgtgtctgggaatttattaatttcttttagcttatccaatccattggtgtagcattgttcacagtagtcgattctgatgagtctctatatttctgttgtttctatcagctgtaatctctccacttttatttttaattttatttatttgagcatgctcctttttcttagtctattgaagggtttatcttgtcaaaaaaccaaatcttatacttcagctgcatttgataggttgtgtattttgtgtttccattttcatttgtctcaagatacattttgatttcatcttttacctgttggtaatttaggaacatgttgtttaattttcacatatttgtggttttccccaagatttctttttggggtggtgaaaatattctgtaattatatagttgtgatggattcacaaccttgcgttaggtaatcaccattaatttgaatggcaaaaaacacgattacatttgcaccaacctaatatatatggtaaaatccacttaattacacactttgaaaaaatgagggttatgttatatgaattttatcttcaaaaaacgttttaatttgatgattatttaagtagactgtgttattgccaatcttgtggccgttattttatatggatttactattcaaaatcttacctttttgatgccagcccatctataagttaactctacagtaacatcttccttggcattagcacttatcactgtgtgaaactgtctaattcatttatttgtttatttgctaaatttctatttcctgtgatattttcttcagagtattttttggtttattgtctcacaatattaatgttttttttaaattttaaacttttatttttattaattggcttagatagcctgaacatttgtgttagtaagctcatgaaattattatttgcttttataatttttctttttcctagccaaacctattccatttttacttttctgaatttataaaatggactgtgctatgaaaaagcattttatttgaaatttcctattctaaaaatattctgtgtttaaaagaatggtggcatatgtattgaaaaattgattaggtaagtgacaacagattgttatttgtaacctcaagttctgtcatttagaaacctaaaattagtggaactaatttttgcatattgaggagttgaagaaattagaatgatgttaagacatttctttgccaaataattttatttttatcaaatggaatgcctataaaatttataacagattaaagagaaaccatcagctaagacagttttaaaaagccagatttccaggtggtcagttttcttgtcttttttccccccgagaacaaaacctcattctgtgctttgtattcttatggagtgcttaaaggattgtgccttcaaatagttctatctaaagatccacgaaatgtgtatgtatttagggtgtaaagttttagcattttattattttgcgtctgaggactctcattacatagtactcagcactgttaagctttgtttaatatgttttgtgtaagtatgtgatcctttgctttacaactagttttcatttcccacattaataaagagattatacaagctgtgtacatttttggatctctcagacttaggttctgataatgtgtgaaagaagaaccattattattatcattatatatatttttttgagatggagtctcgctctgtcacccaggctagagtgcagtggcatgatctcggctcactgcaagctccgcctcctgggttcatgccattttcctcccgagtagctgggactacaggtgcctgccaccacacccggctaagattttgtatttttagtggagatggggtttcaccgtgttagccaggatggtctcgatctcctgacctcgtgatccgtctgcctcggcctcccaaagtgctgggattacaggcatgagccaccacacccggcccagaaccataatttttaaagtctacgtttgactgtacaccacctttcatcataatctcatgcctctagcctaccctcctacttgctgtcttaattcatattattgatagttacctaccaacaatatccagttttttcctgtgtatggctttttcttctatctggaacctaattctgtttgattacattctcctacagtttcctctcttctttgagcactagctttattttaacattagtctttttcctttaatttaacactatgctaattacagtctacttgtacttcagaaaaattacgttctcttacacattcctacctttttttcaggtattctcccctcttccatgtcagaaatattttattctttcttttcctttcccttccttctgttaagtttttaaaaacagttttatttatataaaatttttgtaccacactatttattccttttcaggtatgcagtttagtggcttttaatatattcacagagttgtatatccattaccataatcaattttagaacgtttccagcatccctgaatgaatccttgcattccctagctatcactcctggagcctcccattttcccagcaataggcaaatactaatctactttttgtctgtatggatgtgcctattgtggatgcttcatataaatgaattacataaaatgcagttctttgtgactgcatattagtgcatttttccacttagcatactatttcaaagtttgcccatattatagcatatgtcggtgctcattcctttttattgccaaatagtattccattttatccatataccatattttgttaattcattcatcagttgatggacctttgcattgtttctacttctgaatattgtgaataatgttgctttgaatattcaagtacaggtttttttttgtgaatgtatgcttttatttcttttgtgtatatatacctataaatataattgctgggtcatatggtaattttatttgtaaccttttgaggagctgccagactgttttccaaaccagctgtaccattgtactttccattggcaatgtgtgatggttctaatctctccacatcctcctcatattgttatctgtcttttgtgttccagccatcattgtaggtgtgaagtggcatcattatgattttcattttcatttccctcatggctaatgatattgagtatctttttgtgtatttattagctatttctatctcttctatggagaaattattcaaatcctttgcttattttaagatctgcctctttttcttttaaattgtgagatttctttatatattttagataaaagtttcttatcagatatgatttgcaaatgtttcctgtaattttgtgggttgtctttttacttttctgatggtgaccttttgtctaatttttttcattaccctcaagtacatcttctttacattggaccttgttatcatttagaaatggtttatccctttgatactgatattgattcttggtcatcatcattacttttagtccttttatttttttcattttttttaatatcacagaatccttcttggtcttattctttagcttcattcccattggccaacattttctatgacactataattttagactatttttctttcctttctctgtttatctttgttttctccatgcctgttctgtcattcctgtttgcaaataagaaatgtgtatatgtttcacttttactaccaccaaaataactgtatctgacctgaattaaactgttactgatttctgatattcttataaaatgcatgtatataattgagttccagttttaccatttctttcattataaattgtgatttattagcgagttttgaaatcaacttcattgattactactaagaatttgaaaagactagaatagaaactttgtgcctcagtcttctcattctaaatgttggactaatgtgccaccaaaagcaataacaaatttaacttcaagcatcaaaactgcaaagtgcttttagtaagaaaagtttttctttgataaatgctatatccaaaagtaagagataaattttgagtgttgaatcagtcactaatttctattttgtgaatgagtttaagaggctttaagagaatatctgtggatgttgaattatgttttatgatgctacaataatgaatccttcctcagctcttgcaaaaatcaaattaaaagtatattaaaataaaaaagaaaatgttatatgctagtgcttgctagggatttgattttgtgcattgaattatagtaatctttatgttacatataaatactggtttagtgaatgtcttactatttctgttgcgcattattttcacttttcaactattgacacttaggaaagatcactgaattggagtgtgaagattttctcaataactatatatgactaaataaaggtcagtttgtttcattaagttttagttaattttctcatctataaaataatgaaaatatgtttatagctgctcatagagttcttgcaaatgccaaatatattattgtttgtgggcttaatctgttgttcttgtcctagacatagaccttgctggaatcatccatctaaagatattacctatggaagttgttctaggatataaagttcttggagactgagataacaacagtcagaattgtagtctaggtgatccgttattttggttgcaaggatgatagagtgaaggtaaattcaaagagtaagccaagaaagaaaataggataatgaatagatattgatgagaaaagaataaaattcaagacattggttaggtctggttgtttgaacttagtgaagaaagtgtacatttgtgccctgttaatgtagctatttacaagaggcctcactaggctcacagaaatgtatgatgaataaatattttcagttctacagattcccaaggggagggagtcaatagacctgtgaatggatgtgacaatgcaatgggatatctagaagaaatgggtaaattcctggacacagcctcacaaaactaagccagaaagaagtcaaatccatgaatagacccaataacaatttctgaaattaaggcagtaattaacagcctaccaatcaaaaaaagcccaggaccagatggattcacagctgaattctaccagaggtacaaagaggagctggtaccattccttctgaaactattccaaacaacagaaaaagagggactcctccctatctcattttatgaggccagcatcatcctgataccaaaacctggcagagacacaacaaaaaaaaatgggcgtggtggctcatgcctgtaatcccagcactttgggaggctgaggcaggtggatcacgaggtcaggagatcgagaccatcctggctaacacggtgaaaccctgtctctactaaaaaaaaaatacaaaaaattaactgggcgtggtggtgggcacctgtagtcccagttactctggacgctgaggcaggagaatggcgcgaacccaggaggtggagcttgcagtggagcttgcagcttggagccgagatcacgccactgcactccagcctgggcgacggagcgagactgtctcaaaaaaaaaaaaaaaaggaaaatttcaggctgatatccctgatgaacatccatgtgaaaatcctcaataaaatactggcaaactgaatccagcagcacatcaaaaagcttatccacgacgatcaagtcggcttcatccctgggatgtaaggctggctcaacataatgcaagtcaataaacataatccatcacataaacagaaccattgacaaaaaccacgtgattatctcaatagatgcagaaaaggccttcaataaaattcaactccccttcatctaaaaactctcaataaactaggtattgatggaacgtatctcaaaataataagagttatttatggcaaactcacagccagtatcatactgaacaggcaaaagctggaagcattccctttgaaaactggcacaagacaagtatgccctctcttagcactcctattcaacatagtattggaagttctggccaggataatcaggcaagaataagaaataaagggtattcaaacaggaagagaggaagtcagattgtctctctttgcagatgacatgattgtatatttagaaaaccccatcgtctcagcccaaaatctccttaagctgataagcaacttcagcaaagtctcaggatacaaaatcaatgtggaaaaatcacaagcattcctatacaccaataatagacaaacagccaaatcatgagcaaactcccattcacaatttttacaaagagaataaaatacctaggaatccaacttacaagggatgtgaaggacctcttcaaggagaactatgaaccactgctcagggaaataagagagggcacatacaaatggaaaaacattccatgctcatggataggaagaatcaatatcgtgaaaatggccatactgcccaaaataatttatagattcagtatatccccatcaagctaccattgactttctcaacagaattggcaaaaactactttaaatttcatatagaaccaaaaaagggcctgtatagccaagacaatcctaaacaaaaggaccaaaactggaggcatcatggtacctgactttcaaatatgctacaaggttactgtaaccaaaacagcatggtattggtaccaaaacagatatatagaacaatggaacagaacagaggcctcagaaataacaccacacatctacaaccatctgatctttgacaaacccgacaaaaactagcaatggggaaaggattctctgcttaataaatggttttgggaaaactggctagccttatgcagaaaactgaaactggatccattccttacatcttatacaaaaattaactcaagatggattaaagacttaaatgtaagacctaaaaccacaaaaaccctagaagaaaacctaggcaataccattcaggacataggcacaggcaaagactttgtgacttaaacaccaaaaggaatggcaacaaaagccaaaattgacaaatggaatctcatcaaacgaaagagcttctgcacagccaaagaaactctcatcagcgtgaacaggcaatctacagaatgggagaaaatttttgtaatctgtttatttgacaaaggtctaatattcagaatctacaaggaacttaaacacatttacaagaaaaaaaaaccctatgaaaaagtgtgcaaaagatatgaacaaacatttctcaaaagaagacatttatgtggccaagaaacatatgaaaaaaagctcatcatcactagtcattagacaaatgcaaataaaaaccacagtgagataccatcttataccagttagaatggtgatcattaaaaagtcaggaaacaacagatgctggagaggatgtggagaaatagaaatgcttttacactgttggtgggagtctaaattagttcaaccattgtggaagatagtgtggcaattcctcaaggatctagaaccagaaataccatttgacccagccatcccattactgggtatatacccaaaggattataaatcattctacataaagacacatgcatttttatgtttattgcagcactattcggaatagcaaagacttggaaccaacccaaatgtccatcagtgatagactggataaagaaaatgtggcacatatacaccatggaatactatgcagccataaaaattgatgagttcatggtttttgcagggagatagatggagctagaaaccatcattctcagcaaactaacacatgaacagaaaaccaaacaccacgtgttctcactcataagttggagctgaacaatggaaacacatggacacagggaggggaacatcacacactggggcctgttgtggggtagggggataggggagggatagcattagaagaaatatctaatgtagatgacgggttgatgggtggctcgaaccaccatggtacgtgtatacctttgtaacaaacctgcatgttctacacatgtatcccagaacttaaagtataataataataaaaacacgaaacttatactttcatttacttttcacatactttacagctgtctgcttagcatttttcatctagtgagctgtataatgtaaggactggataccattaaagttacttggatagactgagttggctcacctattttagattgatatgtctcatttattaatttcattggcttcttaccaggaatattgttgttggcaggttatatatccttttttacagatgggaacatttatgcttagaacaatttagtgtttttcttaaatatcatcccgcagctattcactgactaagtcattttttgaagccaggcctttggaattttctgctaccattatgtctgcaataccaaactatctctggtaaatgagatcagaaatagagtaaagtgtgttacttcattagaaaatattaatgaaattatagcaaatattggaaatttaattaaaataataaattataaaggataaagcagagattaaaatttgagctaaatatgtattattaatcaggttattgaatatatatttttgttattcgtgtttctgatggctcttaaatcatagaaattctaaccctgtctttttgcgagaagattaaatataaagtcacacatggctttggttttgctctggaaaacaaggacttgctaccacttttccttgttcagaagttcattattttgttgacagtgtagtttcattaatctggtatttgcagggaaataacttacagactttaaaatctgtgctaaaggtgatcaaatggacattcgaatccctcatttaagttatgtcttaatgttaaaataaaaatctactttccagaaagtaactgttaaagtattttatgcaacatttcatgtgggataccttaatggttgaataataaattttacctcataaaaatgaaattcaataatacagtagctttctcagcgcagtagcatctggtctattctcatgagagccaatattttccaactcattaggatcatgtcgttctgtatgtcgtcaacattgacttagccaagcaacctttacttacataactgccaaactattaaataggtctcttgtggagtgaagtcaaatattcctcttactttacttctgccttagaagaggggaagaaaatgtacatactgtaacatttaaacatctggtctaaaaccacatcactgtaactgaataaagttatggaggtattcttcccaggtgtgcatataaaaaggattttggagttgttgaatagttctttaatcacttaggaaaaagattgaggtatattgatatgatttttctattcctctgttttcaaactacttcccccaacaccatcatgtctgctaaatacttctaatgtgttctaagatatatatttttgagatgttataaaattttcttgccagatacaggcattggctatacatttattcttgcgtaaaaaaaaatgaattgagttagatttgtattgagaactaccaattagacctcttgatatttaaattggagtaaaaagacattaatttttgtgaatcttgtgagttttaaggtgtccctatatgcacttttaataatatgaatatttattgaatttaaagtttccattttactacagcttatgtccaggtattgagagctcatttatagaatatgtggtcattattaagaagtgagtaattaatataggtttaacccatttatgctggaggttgcaattttgtgtgtgtgtgtgaaaaatcagatcttggcaatgactttgcacagtaggatataaataactcccacaagcttagcattctaataatgcaacactaggaataaaggggttaaagacacacttagaatgttaagttatgcctgacttaattttgttcctctattctgtctcagacattttgataatgtttgtaaatttttttctgatgatacttcatggcacaggaatgggaattttaggtgtcctttagtgaaagaaaatatataaagtgtaagtgtacagagtagatttgagaaaaatgcaattctttgaattattatttaagtatattttattggatatttgaaaagtaggcaatatgaatttagtgtgatttttcagtcttacagaaagtcttttatgaacatcataaaaatgtgtcaataaattactgttgataataaaatattaatagataaatgagttagatttctgcagaaaagatactttttttgccttatgtatttttttgctgtttatttgcctatgtattctttgctcatgtttatgtcttctatttgttcacaacctaaaatgtatttcttctggttgtattcacttatcagtcattttgaaaatatgtagtttgcaatctgttcagttctgggagcagatagctaacaagaaatagacatgattttagtaatgaatgtagaatcttctgtgtcacctattacaagatcaagtatggctttaaaaatggacaagagttaattacatacagtgaagaaagggactcttatttgtgagggctgtttacaaagtaccacaaactaggtgacttaaaacagcaaatttatttgttgaagccttgggctgcttaaaatcatgttggaaggcaaagcagtagctggcgtgtcacatcgccagagttggagcaaaagagagagttgggaggaggtgtcatgcactttaaaacaacatcttctgagaactcactatcacgcagcaccaagccatgagggatccatcctcatgacccaaacacctcctaccaggccccatctccatcactggggattacatttcagcatgtgatttgaggggatgacaaatatccaacccatatcacatatcattaagacttcttttctttctttttatttcctttttttattgattctacttggaggaaaattgtaatatttcataatttaaaatgaaattttggttgcaaaattccattaatcccaagtttctgattctatctttttatagtcacctttttaaatgaagtgtatatctcatatgataaacatcttcatattatatgtaagattaaatactatgttgattttactagatttttgtttgctctttaccacagagatttatttgaaatataaatattttgcataaagtgaatacttattttaattaatgattcatggaacatataggtcaaatcattgcaacaaatgaaatcatgataaaagtcttattatcatagattgacttcctaattcttaattttaaaacagtcctttactttcacaggaaagccaagtgacaatagtgaagtaattttgtaagttctttgtagtccatattttcattaatctcttgtacattctttgaagtagaaaatctgaacaatattttacaggtttaaaagctgttgaagatatttttacaaggctactgagtagtaaaaaataacagaatgagaagttgggttctagttttcagagaactacttgtgtttattttttaagaaataatgcgactgggcagggtggctcatgcctgtaatcccagcactttgggaggccgaggtgggcagatcacaaggttgagagatcgagaccatcctggccaacatgctaaaaccccatctctactaaaaatacaaaaattagctgagtgtggtgacatgtgcctgtagtcccagctacttgggaggctgaggcaggagaaccactttaacacgggaggcagaggttgcagtgagccaagatagtgccactgcactccatccagcctggtgacagactgaggctccatctcaaaaaaaaaacaaaacaaaaaacaaaaccgaaataatgctgtaatatactacacaattccaaatttttacttattatggcaaatagaatgttagagtataatttatattggactttgttggatttattaatgtgaatccttgaaaaatttcctactgattttaatataggtaagaccaagatctgtaaatattatttttattctgttttagtaggtaagtatatagcttctttacagtagatggacttattttttcactactattatgaattattttaataacaattttttttttttttttactttgtagagattgggtcttgctatgttgcccaggttgatcttgaactcctggcctcaaatgatcctcccacctcaacctcctgaagtgccgggattggaggcccaagccactgtgcctggccctttataaattatgttataatttcatgtaatacataattgtatagtcaaaatggctcacatattaaatattctttatacaa

SEQ ID NO: 2156 - DNA, 108494 bp, Homo sapiens; identical to SEQ ID NO: 2154
  source 1..108494: mol_type = genomic DNA

SEQ ID NO: 2157 - DNA, 864321 bp, Homo sapiens; identical to SEQ ID NO: 2153
  source 1..864321: mol_type = genomic DNA

SEQ ID NO: 2158 - DNA, 78164 bp, Homo sapiens
  source 1..78164: mol_type = genomic DNA
atgaacccgggaagacgaatctcgaccactgtttcgcaaataccgcgtgtgatttattaaatgccgtctctccgagtcccaagcggccgggagcattatgccacctcccttgccctcatctctcactgccatgcaagaaagcgttaatggcaaatagggcacgtagccacactccgtcgttcctgcttccaagcaaaccttgtgccaggttcctcatttcgcgaggctccactctcttgggcttcaggctgccgctgggcctccagcaccaaagggcaataggggtctgagagtccgggcctcaggcatcttcaggccgcaggtgggtggagaatagcgcccgcgcgtggcagcggcccaggccgtctcagccggatttttccatccccggggtaggcttggtcccctgtacactccagcggaactacaactcccagcaccgtggctgcccggactcccggaagccgaatcccggctgggaggaagcagctgagacccggccaacagactgggggttaatttagccagaaaagggggcgggaagggctgtagggtacttgtcaattcgccgccatgaacgtggtttttgctgtgaagcagtacatttccaaaatgatagaggacagcgggcctggtatgaaagtacttctcatggataaagagacggtgagtttgcttttgctcagcatttgtgaaggaaccctctcaaccttacaattgctcgtcccattccactgtaggacttagcatttaattaaacatacgaaaatgagggtcggtttgtgtggaattgaaaagttgtttatataaagcttgcccggtgggttttcagtctacatggctccagccactgcctagagactacttctacccggaacaatttattggaatcagaaatccttttctaaatgtccccgccaagaaatcattaatatgtcagagcacttggaaggctttgggatgggcctactgtttccactcaacattgtgtttttaaagtaaagctgttggagctcaagctgaaatgacagattatttgttggccacagaccagaaaacaaaactctttaaggtgatagaaaaaaatatttttggaaacttatggattgttcctgttcaaagagaccatgttttttgtttttaatcttgaagcttcagctgaaaggatagagcgtatttttcattctcgtatgttacctacctgtttggatgttcagtaaatgttttccgtatattactatttaagttatccagctaagtattaatgaaaaaagagggttagatgtgctacttgtttttattattctagactagcatacttttagttaatcttttgtttttacagactggcatagtgagtatggtatacacacaatcggagattctacagaaggaagtgtacctctttgaacgcattgattctcaaaatcgagagatcatgaaacacctgaaggcaatttgttttcttcgacctacaaaggtactgcataaactgagcttccatctgcccaggcagatgcagaacactctgatctgaaagcattaagaaggcaaaataaatttgtattatcataatttgtggcatcataattatcctggttcatcagtgttataaccttcatttttcttgttttgtttccatatttcagttgaccccttacagccagttcttccttcaagatgttttttaggttcacagccattcccattgccactaatgaactactcttaacggagacccacattactttattcctggattaacctccgtatctgtcacattgaacaccatcaacacttaattttatatacagctatgagtgtcttgaatctttgccactttattcacatttatgctcaggaacctgtggtggcttgatgttacttccatgattaaatctatatttagcccagccattaaagccctactttgttggtttgatctgcccatgtgtatccagccttcctatgtcctaggtctgcttctcctctatagccagctaggctactgttggaatgagcaattctacatgctcattcctgttccttgttttttttttcttccactgattaaaagttctttggccatttgtcactttttatccatcatcttctaaatctagcttgagtctctcctttaaaaagcctttgctattttaatcttatttgttacacttttttttttttttttttttgagatggagtctcgctctgtcgcccaggctggagtgcagtggcgcaatctcggctcactgcaagctccgcctcccgggttcacgccattctcctgcctcagcctcccgagtagctgggactacaggtgcccgccaccacgcccggctaatttttttgtatttttagtagagacagggtttcactgtgttagccaggatggtcttgatctcctgacctcatgatccgcccgccttggcctcccaaagtgctgggattacaggcgggagccaccgtgcccggctgttatactttcttgattcatattcatgttcttcaactctaatgcattttatccggcttgtgcatatgaactttccaaaatgcaaatttgatcatgacactcctgcttgaaatccttgaatgacttctcattgcttttctgataagggcaaaactccttaattgtagccttcaaggtgcagcatggtctggtttctaccatttctccagcctcatttcgaaccatcccccttttgcactctgcatcttaatcaccctgtgtatatcaatccgctatattccccttgtcccgtcatgccacgggacgtttgcatagtcttcttcctctgcctggaacttaacttcttcaagtaacccttcactgtttttgctgaccaggtcaaacctgccccttatatgcatttacaacaccatctttatctccctattgtgtgtaatggtttgaacttttatatggtttatgtgattaccagcagtaagctccatgaaaacagatatgatatctgttttttctcaccctatattcccaattcctgtcacacagtggacactcaataaacagttgctgaattaatgaacacatgctgtgttataatagtttccaattgtttcatgtttgtagctcttagtcatgaaattttggttcaagagatatgttagagatcatctagttcattatttcctaatgttttttattagagaaactctttcactgttatgtactgtctctcgaactcttttaagaatctttccttttggccgggcgcggtggctcacgcctgtaatcctagcactttgggaggccaaggcaggcggatcacgaggtcaggagatcgagaccatcctggccaacatggtgaaaccccgtctctactaaaaatacaaaaaaaaaaaaaacaacaaaaaaattagccaggcatggtggcaggcgcctgtagtcccagctactagggaggctgaggcaggagaatcgcttgaaccagggagtcagaggttgcagtaagctgagatcacgccactgtagtccagcctggcgacagagcaagactccgtctcaaaaaataataataaaataaaaattaaaaataatttttaaaaaagaatctttcctttttctttttcctcttttatatattctcttttgtctttttccacattgtctgaacttttaagaatcttttaattcactttgttatttttgcctagcatattacgaggaagtaattgaggtttaaaagatttattatttaaattttttgccttaagattatattataaagttaatttgaaatctaaattgcatttttaaatctaaattacaatttttaaaaccctttccccattaataagcagtatatattgcttacttttttttaattctgtaaagaaatgtgatttttaaaacaaattaatatgtttagggaacaatttatattgaaatttaaccaggtgttatagtatcaaaaaccaataaaacctgcattataatcttatgtaattggaatcttatattttgaccatataaaaatcaacttttttgttttaaactttcatactttattttaaaacaatgtaattgtagaaaagatcttagcctgctacttgcaaatacttcacaaacattgtagttgtgcagagtcttacatcccaataagttaaaagccaaagtgaatataattaactttattttctcttgcatgttaatttttaaaggaatagacacatttaatgctctatataggaattttgatcaggccaggcgcagtggctcatgcctgtaatcctaacactttgggaggccaagccaggtggatcagttgaggtcaggagttcgagaccagcctggccaacatggtgaaaccccgtctctgctacaattacaaaaaattagctgggtatggtggcacaaacctgtaatctcagctacttgggaggctgagacaggagaattgcttgaacccaggagacggaggttacagtgagccaagattgtgccattgcactccagcctgggcaacagagtgagacttaatctcaaaaaaaaaaaaaaaaagaattttgagcaaatgaatacaatttatagacaagcagcttgatgtgagtttgcagaattataatcaattttatgttgtgtttcaacatctgtgtcctttatattctttatcttaattggccaaaatgcagctggttaatatttaatattatacacatattattaaataatatatgattcccgatcattgtatttaatttatctcttttgtctccagcccttacccaccaacataagcacacttaacctagacttcaatatgcagtagacgcagtaaataaacaaatcaatgggtgaatgcttattacttttttccttaagcaactctcctcatattttgtttgcttgttcttcattttctaggagaatgtggattatattattcaggagctccgaagacccaaatacactatatatttcatttgtaagtatgttagttcactttttcaaacatgtaacaacatcccagttagtgtgtttcattgagcccttcatatcatcaataacttcattgaatctgtcactataaaagtctagtttatttaatgtccttccaaagtattaaaaatcttttgacctgccgggcgcggtggctcacacctgtaatcccagcactttgggaggccaaggcgggcggatcatctgaggagtttgagaccagcctgaccaacatggtgaaaccccatctctactaaaaatacaagattagctgggcatggtggcacatgcctgtaatcccagctacttgggaggctgaggcaggagaatcgcttgaaccggagaggcggagattgcagtgagccgagattgcgccattgcactccagcctgggcaacaaagcgaaactccatctcaaaaaaaaaaaaaaaaaaatcttttgaccaatattctgtttcagagggctaaatgtgatttccattcatctttgattgcttaaattaaaaattttacattttactttgcctttcaagatgctttgtaagtcaaaagttttaagtagacaaatttcacatctcacccctgccaaaaaaaaaaagtatatacttatccctgttttacacttaaaaattgaggcatggaagctgatttattttttgaagtgggaaggtaatacttgagtttgctggaaaagcagaaatttactttacataccagataaaagcctttcacttctctttgttactatatttaatgcactgaaagtataaatcatcaggtagtgatctcttatgtgcacaactttcttggagtgggggttaggtaggggagatctggaaataaactaggtttgtgtttactatacaatttacatggatttttttgatccaatacattcggctgtagaagttacatctattctcctctagatgtcattatttatctttatgttaatagtgttagtgtagtctatttggtaacatttccaaaaccaaggactagatttaacagtaagtagggcatttgagaagttttaaagcttacttaaaggtattagagttttagggtttagactacagtctaagacgtacatactttcttcagcgtatactacttaaatagaataatgatacaaaaaattaacatttgcgaaaagactatatatatataagagctctctcatattttatttcattcagttctgtgtagaattgaaaagttacataaagcttgtccagtgggttttcagtgcacgacgccccaagaggtaaaaataggcaattttattaatctgtggcaacttaatttttgtttgtttttgtctgtttgtttttggctaatagtcacaggttttctttttaaaattaaactttctattttgaagtaattgtagattcatgtgcagttaaaaaaaaaacaacgaataataatacagagatcccagataccctttacccagcttccccctgtgtagtatcttacatgatgatagtacaatatcacaaccaagatgttaacactgatacagtcaggatacacaacattttcatctctataaggatcccttttattagcttatatggacttctgtcccaccccaaccccctcattaaccctggtaaccactaatattttctccattttatattttgtcattcgaagaatgttctataaatgaaatcatacagcatataatcttttgggactggcttttttcactcagcataattctctggagagtcatccaggctgttctgtgtgtgtgtgtgtgtgtttttgtttttttttttttgtccgagaagcagtcttgctttgtcacccaggctggagtgcagtgtcgccatctcaactcactgcaacctccacctcccgggttcaagcgattctcccacctcagcctcccgagtagctaggattacaggtacacaccaccacgcccagctaatttttgtatttttttttagtagagacagggtttcaccgtgttggttgtccagactggtctcaaactcctgaccttgggtgatacgcccgcttcagcctcccgaagtactgggattacaggcatgagccaccacacctcacctgttgtgtgtattaatagttcattcctcctttgagctggaactgcaaaaaaaaaagttttcttaatttaaaaatagttcatttctttttattgctgagtagtattccatggtatgaatgtaccacagtttgtttaactatacaccattgaaggacatatgagttatttccagttttggctattacaaataaagctgctataaatatctgtgtacagatttttatgtgaacattaagtcttcattctctggggtaaataacccccaggagtgcaactgctgagtcatatggtaattccatgtgtgatctgcccaccttggcctcccaaagtgatgggattacaggtgtgagccaccgcaccgaacttttaaagacatacaaaagtagaatagtatcataagttccaatgtacctatcagctggtttcaacaattattgagcctcacccaatcttgttttagctatactgtcacctacttctccagcaatattattttaaagcaaatctaagacattatataattttatccataagtatttcagtaggcatctctaaaagataaggactcattttttttaaaaacacatttccattattacatctagattaaaagtgaaaaataattatttattctttttttttttttttttttttttttgagacacagtctccctctgtcacccagacagagtgcagtggcatgatctcggctcactgtaacctcaacttcccaggttcaagtgatgttgcccaggctggtcttgaactcttagtaccattttcaaataaccattcagcgttcaaatttaaaattgtcttttttttttttttttttttttacagttttttaaaatcaggatcaaagtaaggttcacacattgctgttggttgatatgttaagtttcttaatcttctgtataggtcctcccacccctgcccctgctgccccatgcaatttatttattgaagaaactgttaagttttccacagactggatcttgctgattgcatccccagggggtagtttaacatgttccttgaagtttaaaatattcctctgtcttctagttcctgtaaattcataggtgaatacagagccttaattaggttaagatttgatttcttcttggcaagaatactttataggtggtattgtgtgctttcattggctgcttattcttttgatattagtagctgctgatgctcaatgcctgggtccattcaattgattcattgggggttagaaaaaatgatgatattctaattctgtcattaacatttgttagttattgttgagctggaatgttttcacaaagaaaaattttccctcatctatttggttacctggtagtacagtttatatataaaagacagcatgaaagtttacttctttctccttattttcaataaaatgacttacttccctagtattctcattctccaattcctccgatggagtcttcctctatcgcccaggctggagtgcagtggcctgatctgggctcactgcaagctctgcctcctgggttcatgctattctcctgtctcagcctcccgagtagctgggactacaggcgtccgccaccacgcccagctaattttttttttgtatttttagtagagacggggtttcaccgtgttagccaggatggtctcgatctcctgacctcatgatccacctgcctcagcctcccaaagtgctgggattacaggtgtgagccaccgcgcctggccagtccttttaaaatatatatatatatatatatataaaattatgaatttgtggattaaatatatttttgctacccattccaatttgaaggtcacttattcattaggctttaactatcaggcccttttacatatattgcagcagaaattatctcctttgagtcaaccccaactcatgtgtttcagatttcagtaatgtgatcagcaagagtgacgtgaagtcattggctgaagctgatgaacaggaagttgtggctgaggttcaggtaaacatattggtcctgtaacacatctcgtatgttggccctttttaaatatttgagtctaaaaataaaaaataaggaaaggtctgtctcaaaagaagttttattatgaatacttgaatatgtttatcacataaatgaggaatattgttttcagaggcagcaaataaactagttttgaatttttcagaaggatgtgataggtgataaatgaataaaaagaatacctgttttaaattatattctctctcatgacaacacattggacagcaaagttcttttttatctgagtagaacattgtatctcctattagcagtattttatttttactaattgataagtatgcatagaggtctccagaaatataatgtgtataaccttacaacctttatttgttagatttattattattgctactgttttgtaattattttaattctcccacgttgactgttgttacccaattattaattgaacaatttagtatctctttacacctgtatttcacaaagtttggctatatcatattatatcacttatgaaaatattactgcttgatacaattgaagtttatggaatgactattcttggtgctttatttgcaggaattttatggtgattacattgctgtgaacccacatttgttttccctcaatattttgggttgctgccaggtatggaaggaaaggtttaatttatcagtcgagagttaattcagcaaataattagacttgtaagagaaaattcaaatattttctctgaatatatgtttttaacaaaaagggtcgaaattgggatccagcccagctatctagaacaactcaagggcttacagctctccttttatctctgaagaagtgtcccatgattcgttatcagctctcatcagaggcagcaaagagacttgcagagtgcgttaaggtatggcattacctattcctggttccaaaacataaaggccattcatttctctatcatatttcagaaactaaaggaatagtttatttacaaccaaggagatgattgtatgttaggtttccgcgaaaagaggtaggtatatgtaatttaaaacaaaaagcaacaattagagctaagattcttaggtttaacccaagaaacattcacaagctatttaactttttttggtccagttaaaccacttataaaatagggtttcatatcctaacctcttaaatagtatgctactaaactttgtgagacttttgaatccttcatatggaagatctatgtgggtgcaaagaactattgttaaatgtagtgtttattaatttcctatttatatcatttctatatgtaactagatggttgcacaaaccatctttctctctcacccacagcaagtgataactaaagaatatgaactgtttgaattccgtcggacagaggttcctccattgctccttattttagatcgctgtgatgatgccatcaccccattgctaaaccaggtacaaaaccctttcttggcataatagaaggataattttaagtgatattcatcaaaatacagatagggaagtaaaaacatggtccatttatttgcctccttatttttagctattcttggttttgctttgtatttcctggtgttttggtatcatgattcttccatccactgtcatcataactcttctgcttcatctctcctgtacctttctgccagtacctccacccctaatcaagacagcttcttaattctgtagattctatttccctgtgtttccttctgtctcctcatttccatgcttacagccattgccttggtctagatcctaatctcttgcaagaatattgaaatagtcatctacttcgttccctactttttatttcttctcactccaaatgttccacaagtacaatttcctaaagcacagctctatcttattactcttggcttaaaaaacttcattggttcccatttgcctactaggttaaaaagaaactcctgaacttggcatccaagagccttcacaatgtgggctaaacctcttataaaacctagagttcaccacttacatagataatgccacatggtttcctgccagcatgcttttactgtgactgctttctaaactctagaatgtttggaataccttctcttcccatcttcacctatcaaaatactgctgttaaaaccactcaatctggccgggcacggtcgctcacgcctgtaatcccagcactttgggaggccaaggtggctggatcacctgaggtcaagagttcaagactaacctggccaacatggtgaagccccgtctctactaaaactacaaaaaaattagccgggtgtggttgcacacacctgtagtcccagctacttgggaggctgaggcaggagaatcatttgaacccaggaggcgaaggttgcagtaagctgagatcatgccactgcactccagccagggcgacagagcaagactccgtctccaaaaataaataaataaataaataaaatgatttatatgaataatagcaaagaataaaaaaaagaagagccgggcgcggtgactcacacctataatcccagcactttgggaggtcgaggtgggtagatcacctgaggtcctgagtttgagaccagcctggccaacatgatgaaaccctgtctctactaaaaatacaaaaaattagctggacgtggtggcagatgcctgtaatcccagctactcaggatgctgaggcaggagaatcacttgaacctgggaggcagaggttgcagtgaaccgagatcatgccactgtcctccagcctgggcaacgagagcgaaactcttgtctcaaaaaaaaaaaaaaaaaacactcaaaagccatctccaacatccagccattcttcaacatctcgaagcctgtattctttcagtcagatattgttcttatctcctgaaaatccctgtagacttgtagacctttgtgtctctctcatgtctcatgctgtacttgccatgttgtagctttggttgtttacatcctctcctacgttacatatttcttcaaggcagactgagtctcaccagtgttttttctccttcaagtataagaacagtgcacatagcgggtgctctattaatagtgattttgtatgtgtgtatgtatttattgagacagagtctctctctgtcacccagattggcgtgatctcagctcactgcaacctccgcctcccaggttcaagcaattctcatgccccagcttcctgagtagttgggatcacaggtgcacacccccacacctggctaatttttgtattaaatatttttagtacagacaaggtttctgtctaaatattggccaggctggtctcgaattcctgacctcaagtgatctgcccgactcggcctcccaaagtgctaagatgacaggcgtgagccaccacgcccggctgtgactttgtatttacagagaaaggcacagtctatgtttcagtttcttcccagcttgtactaatgttaatgctaagggaaatctgtggagtgaaacttctctgtagtataaaatagccttgtattcctaaaattcaaagtaatatatgttcaccaaagaaacttttgataatatcaaaaagtagaaagaaaattaattgcctattattctgtctcccaaagaaaagcaactatttatcccacagatttcactggggacttcttttgtgccacgtactaaactaagtactagagataaaaggttaaaagttacaatttctgtcctcaaagagctcatggtccaattatgagaaaaataaacataattttaattgtagagtaagtgctagaagcatgtacaagaagctatccataaaagcataaaacattttgttgtacgttttttttttttttgagatggagttttgctcttattgtccaggctggagtgcaatggtgtgatcttggctcactacaacctccgcctcctgggttcaagtgattccctgcctcagcctcctgagtagcttggattacaggcatgtgccaccatgctcggctagttttgtatttttagtagagatggggtttcaccatgttggtcaggccggtctcgaactcccgaccttaagtgatccacccacctcagcctcccaaagtgctgggattacaggcatgagccaccatgcccagccttgttgtacttattttaagtgcgacttaatggaacttgctttttcaagaattcctttggcaaatcttttaggaaataagcaccttcttttataaccttctaaattatttcttaataaatctagttttcttaagataaaatatgtatataaatatttctagcatttagattctagatgcagaagggaacatgctagaaaatacttcattttgtctaacagacctatgactgaaagtaatctattctccataattggtgaaaagggaaaatttggagatttctcatttccagttttaccaaataaattctcaatttgtgagactggaaaccagtccttcctctcatctccccttaggtaaaaatataaaataaaatgggttcaaaggtaagtttctgaatatcccagtgttttgatcaactcacaaggtttttctgataatattagtgttcccaggacaaatatagtaccactcagatctgcaagaacacacttctcatgctgcagaaaaccatagaagcatacaggaaatggtacagcttgtaactgcagtaccaatatagctctatctgtgaagccaaaaatatactcttaattcacaggcaaaaaattggagctaataatagctctaatttgttttctttctatcaagaatattaatcttgctgccctttttccaaaagtatgaaatctaaaagtattttgacttttcttcagtgtttaatcaattaaaatgacagtcttaatgcttatagcacaaagtatgaataaaatttaactcgagaatcttcatgtaaagaagactagttaaagaatgttatcagtttttatttgttttcctgaacgtttactatttccatattctgtcagttacctttttttttcataattctttatttagtggacatatcaggccatggtccacgaactactaggcataaacaacaatcggattgatctttccagagtgccgggaatcagtaaagacttaagagaagtggtcctatctgctgaaaatgatgaattctatgctaatgtaggtggtttaaatttttttaaattgtctttagttgtttttatgtaagaagatcaatattggcttgttagtataggggcaggcatgggatttcatgtgaaaggatgataggggcatcctgtgcataaactgcctctgaagggaaggcagaagacttggattctgaccctttagcaattttttttcatagagatcacgtagttatttacttctctcccctccagtagctgtttgtgagaatagtaatggtattcatcaacagtgtcccagctaatgtccaaatttggtaattaaaatagaatttccctgcccttcaattctgtgttccaaattctttttcacttctttcaagttgtctgaaagtcagactagttgatgaagtgtgcttccaactttctttttcacagaatatgtacctgaactttgctgagattggtagcaatataaagaatctcatggaagattttcagaagaagaaaccaaaagaacagcaaaaactagaatcaatagcagacatgaaggtaaattgaacatgtacatgaatgacaaacatgtgacagtttggtactattcatgtaagcaacacttttggaatcttctgggtctaatttctaccttgattgattttatttggtttgagacttattttctgtaatgtctttaaacaatatagtgaaaactttatgataagccatgtgcttctttccattcttcagtaatatctggactatttaaagactcaatctattgctgggagcagtggctcacgcctgtaatcccagcactttgggaggccgaggcgggtggatcacctgaggtcgggagttcaagaccagcctgaccaacatggtgaaaccccgtctctactaaaaatacaaaattagccaggtgtggtggcgcatgcctgtaatcccagctactcgggaggctgaggcgggggaatcgcttgaacctgggaggcggaggttgggaggttgcagtgagccaagatcacgccactacactccagcctgggcaacaagagcaaaactctgtctcaaaaaaaaaaaaaaaaactcagtctaccaacatataccagttcttctcttcttaagcataacaaaatgccatgtggctgaaagttgtagatgctttaatctgggctgaaaaacaacccccgctttccccaacccccattcagtacatgcttatcctcagtcaaaaaataacagaacctcccattgatgtttttcccatggcaggcgtttgttgagaattatccacagttcaagaaaatgtctgggactgtttcaaagcatgtgacagtggttggagaactgtctcgattggtcagtgaacggaatctgctggaggtttcagaggttgagcaagaactggcctgtcaaaatgaccattctagtgctctccaggtcagtccaatttgatgagcacctactatgtgtaaggcactgtgccaggcagagcaagagataaaaaggcaagtaatccttcttcatcaacatggaatttagtccaacaaggagctgacatgagaacacaaattaatattatttaagatagatctataaaaagagtcacaagagaagtgtaatgtgcaattcccaagggttcagttaattagtataagggcagcctagtctactagaaagagcaccaaactagaatcagaagatctagattggagtgtttggtataccacttacaggctttgtgacatggagctgttgacttaatctctgagccagtttcattatttgtaaaataggtatattaatactcatctcacagagtggttaggaagactttaaaagataaaacatatattaaaatgtattgtctaagttttttcattattgaagatctgcttttcatcgcaccaacatattaatgcctgctatatgtatatactactgctgtgaggatctgaatacaaagatgaataagataccacattacagtaggggagaaagaaatttaaaccagcaattgtaataccaagcactatgtactatattagaggtatttacaaaggaatatggaaatacagaggaaggacaactgttttccccaaggatgaagcttcttagcacttcttagggaaaataacatcaaacagggaaaaggaagaaacattctcagcagagagaatgcaggcatgaagatgtgaagaaataaatattgatatatatatatatattttctatatatatataaaatatttatatttgaaatatacatatatttaaatatatatatgggaacagagaatagttcagtgtggctagtccagggtacaagatgagtggtcttagactggaaagactgactgaagccaggttatggccattggaaggaagttgggctttaatcttaaaatgatgggggctcccggaggattttagaagaatagcaacataatcagactctggcctcaagaaatgtatagtctagttgaagagacaaaactaaagcacaagaaaaaattagataatgtttcaagatgagaattaagtcataattgtaatactgactgtaacaggttttgaggttattaggaacagttcttagagaaggcaagatttggatggaccacaaaagaatgaatagaatttggggaaggagttcagccaggagcagcaaaagcaaagatgtagaaatatgcaggaagtaataaacagtttgacctgtagagagtgagtatgaaacagaattagataaaattgaattggtaaacaaaaaacagtttacaagctttatgaagaggcttgtaagaatttatacctgctgagataagcaaagagatccagtataggatcttatgtagaaagttgaggtgaggaagacagtattttaggaaatgtaacctagtaaggatgctttagaggtgaaaaaacaggtcagagagacttgtagacttacagtgatagtagtaaaaatgtacagcaaggggctgaactgaaaaacatttcaaagggagaagaattagacgacaggctggatataaagatagaataaatcagaggtaatcccatgtttcctgagaaatgacaaagtatgatgtcactgacaagtaatttaggactacgagtcctttaggaaatagccatttctaagccacttataagaagcacatttccctgttaatagggccctatattctaaagcttagcttctttctttcccagctacagttccactttattctataaaataatgccaacctgttatattggaaacaactcaggttttggacccagactggcttggcttatatcctacctctccttaccaaagtttctttgggaaaattacttgatttgcccaagtcttggggattatgatttcaaactttcagactgttacgatgattcaatgagatatgtaaaatgcttcacatgtaataggtgctttgtaaatgttagttcccttcctctaagcatgattttttttttacacatagtgcaaacaaaagaaagaagtctacctgtgggtgctctagttataccagggtctttactgggacttattgttgttgggttttggatcagaacctaaagtcgcattctttttaatcactaaatagtatcctttgtaaagatgtatcctaatctatttaacttggcctttaaacaacactactaatagtattttatagttgttttgtgggcctaatagaaatgtcctgatatttaccacaaaaaatgagttttctgcctcttattaaataaaaaacaaaattgtgtcccgtaactaaatttaaatttcttatatttctttatcatttgatttttcccttgaaaacagtagaaccagacttaatcactagccagttttactgtctttatttgtatctctctacatgtggaaagcaattagaaaaagttcttgtaataacttgtctgaaactttatttttgtgttcactttaaaagaaaaatagtcactttaaaaatataaattctatttgtgatccactttttatttttagaacttatcttttgaaggttttcttgtctagggtattgggattttacagtgagcagttgatttggagtcccccatcataaacgacttatttggcaacataacttaaatagtctataaagggatcttttgtttgatagtaagtggatgtcaggggcctgacttctagaggggttatagcattccttggcttgaccttagatgataatacgtcatgaagcaatgaaatgaggtttgtgagtagagatggggtttgctttattgaatagtatcatgacaagaaaaaaaagcatgtattgctaaaagttaacttaaaaattgctgccattctaaccattattttgtaggctaatgaaaatttcatttagaaagaatttcactagaaccaaagtgaaatttactaccactgaaacatatacatatcctcagaagagatttattaattagtaatgaagatttgccataccatgaagaaaagcatctttagaaagtgagcaattccacccttaccatcctccctataccctgccccccatgcccagcctgtgttgtcatatcacagtttttcatttggagagaggaaccagtctattttgtattttttcctgacctttcataaagatctcaaatcatcctgttaatgatacataataaggactcaataaatatttattagaaaaatgaggaggaagagctctatttgaagcagtatagagtagtggctaagagcttgggcctttgatggcttgggtttgaaaataattcctaaccactctaaaactcagtccttttgtctataaagggggaaaaataatagtacttacctcagaattgttgtgagagtgcaatgagctaatacatgtaaaacacttatggtacttggtacttacagctttcaagaaatattaactaccaacattaagagtattattatttgatggtacatttaattttcttaatggcatccaagacatgttttttagttcagtgatagccttgtatctctctgatttcagaaaagtgtttggtttttttgtgtgtgtgttttgttttgttttgccactcattaaaattataagaaaagtggttgggacacattgaactgactgacaattttactttgattaattaaatgtaaaaatgatccttttactctaaaacaacatttagccagtattttagaaacagtattgatcagcagaagatctactgcaaagctcaattttatgttgactagtcattaagaaaaggaatactggctccgatgtatttaccagtcagtagaattgggtcttgtctgctttctatcatttttccctgataagctttttatattcccacaacactgttctctcaaactgttaggctcatttttgtcagatcagcatgtggaagtcttctgccaattccatcttactgtcctaatctgttggtttattttgttattctctgactttactacattaatatagtagataacaaagaagggatcctgttctttaggttaaactaaaacaaaaaaaaaaaaacggagactatctttattaccaagaccaactgtaatctgtataatagtttgaaatgtgtgtatgtcataatgatttcttcttgctgtgctgctttatcatagttttgatagaagaaaacagaaaagtaaaaaaagatttagccagaaacaatggaagaatctctaaatatcagaaaagaagaatggttttctcgttgatgtcttataaatgaatgttagttcctttaggaaacttgatctccaaagacactatttttgctttgctttgctttgcttttcctattccttgattacgcccacacaaatgttagagttcagtgcaaggttttcgaatcctgtcttcttaagtagatgacaattttctgttttgctctttactcagtcattgttataatgtgacagtgttcttttctaatagtcacaaggctgatggaaaatttaataagagaaaccaaaaaattatgtaattcagttaatttccaacagataaatactaccgtgtagcatataacttgctttgtaattataagcctctctgattcttttttctcctcttctctggttagtgccctgaaatctcaatgtaatgtatgccactgtcaatcaagttgacaagtcaagtagttatgagggaaatccttcaaaatgaagtcaaaggataaagtgggatcaaggcagacaaaaaggtcctgcgtctccaaggactgatacagctgaaagaaaagaaagaactcagcttgtacctacaggtttcttttcatgagagaatagatgcctctagctagaacatggacctgagccatgagttgggtcctaagggctcaaaagtaggcaaaataattactcgcagtaagcctggtcagatctgggccaagtcctcagtcaagaactaagagtcaagccaggcaatctaaataccactaccaagtctcaaggaatggaagtggattttttttaggattgatgcataatgattgtacagatttatggaatacaatgtgatgtttcaatacatgtatacattgtgtagtgatcaaatcagggtaattagcatatccatcaccttaaacatctgtcatttctttgcgataagaacatttaaaaacctctcttatagctattttgacatatataatacattattgttaactctattcatgctactatgcaatagaacaccagaacatattcctgctatctaactgtagctttgtacctattaaccaatttctaaccacccctatccttcaccatcccatcctctggtaactgctattctgctctctacttctatgagttcaatgagaacaactttttagattccacatatgagtaagatcgtgcactatttgtccttctgtgtctgatttatttcacttaatgtaagtcctccaggttaatctgttttgccagaaatgacaggattttgttctatttcatggctgaataataaatatatatatatatatatatatatatatatgctgcattttcttttccctttttttttttttttttttttgagacagggtttggctctatcgcccaggctagagggtagtggtgcaatcttggctcactacaacttctgcctcccaggctcaagctactctcccacctcagcctccccagtagctgggactacaggtatacactgccatgcccagctaatttttgtatttttgtagagacagaatttcaccatgttgtccaggctggtccccagctcctgagctcaagcagtccacctgcatcggcctcccaaagtgctgggattatagacctgagccaccgtgcccgacctaaatactgcttttcttggtccattcatctgttgatggacatttaggttgattttatatcttggctattttgaatagtgctgcagtaaacataggagtgcagatagctcttcaacatactgatttcatttcctttggatatataccaagtagttagattgctaaatcatatagtagttctatttttaattttttaaggaatcttcatactattttccataatggctgtactaatttacattcccaccagttgtgtgtaagggttcttatttctccacgtcatcatcaacaacacttactatctctaataagaaacagccaagagtcaagatccaagtgaaggtaaatagaaaagggcagagactgattactgcaaatagtctttgactgtcatcataccagttttgtgaatttatagttacttggatttctcagatttgcttaaaagtacagagacagatcagccagaaaaggtggtaagagagtgactgcaagggcaggaaatgagacattgtgcctataagaaaagtaacaacagaaatcccaaatgggatttcttttctttttaaaaaaattttttaaaatttttatttatttatttgagacagtttcactctgtcgcccaggctggagtactgtggcacgtaatctcggctcactgcaacctccgcctcccaggttcaagcaattctcctgcctcagcctcttgagtagctgagactacaggcacccgccactacatcctgctaattttttgtatttttagtagagagggagtttcaccatgttggccaggctggtctcgaactcctgacctcaagtgatccacctacctcgacctcacaaattgttgggattacaggtgtaagccatggcacccggcccccaacaggatttcttaatgttttaaacttacgctgttgattgagatacatacataatttgtacctgaaatttcttcatattatagtagaaaatagtggaacatttgaacagttaccctaaatgggctgtattccgtggctgctctaggggaaatatcccatgaaaggaaaaaaataagaaaaatcttacgaatttgggatcgaaatctacagaagagaagtttctccctttttgatcccttaaggatgatggtagtgaaatagtaacccaaaaaatcaacaatagaaatctctttcagagaactctgtacttgaaagctacatgggaggttccccattatcatcatagtccctagtcagtgtgaacagaagagctcttagacattggacatggttgttgtcaggtacaaaagagataatgtacgtgaaagcattttgtaagttgtaaagtaatcatatagttgatagttatgtcctcagaattcagtgcccttcaaggctcttgccagcctttcaaaccaagccatttcttcctctgatttccatatttattttgatagtgccactgcttttggtctctcacactggttccaatacttactgattcttcaggacctttggcaagtgtcacctctgtgaagtctttcctaatttctcaacaacccaatatactttctcttcccctttctctccccttcctcttttgcactgattttcagcttttgctttttgttttgttttttgcatacatgtttctgttataacaccacatatttgttcctgaaaaacctcatattctataaaaacatgcactaaaaaaagggttatgagaatatagggttataagcagaccacttaaaatctacatgactatagaaagaaagaaaacattcatataatttttaaatcagagccctaataaaaatagtaacaattataataaaaatactagcatggttaaatctccaccggcatttgcacctagaaatagagccagtccatcctctgcagccttattcctggggctcatgttttcttcaaattataaggtcttgaaaatactcacttctcataaagactactttgtcaaaattaaaaataccatatggagacagctttcttcatcaatcagtgtttgattgttattttgttttgttttgcttttttacacagtgcaatatatttgcatcctttttatttgcacttgccctttccccatatagcataacacagtggaaagtgcaacagttcttgaagctacaaaaccagatacttcttgcagaacacacttctgtaggattatcatctttttttcttaaggtattggtaaggcttcccctttaatcataagaaagcctatccattctggaaaaattacatgtgaaccaatatgccttctgtgttaaactgacaccatttccatatttatccatctcacagaactaaagtacattaaagaaacatgtatatagcagaataaattatattactttgatcatccttcaccccattgactgtgaactcactggggacaggaattgtctttaacttatctgtgtgcctgcaacagtgcatgacatactgccttatggggactcaaaagtatttgttgacttgaattaaattatttgttctgctgcataataaatataaatctatactatatggaaggtcctgaatatgaggattaaaaaatgtaaacatggcttctcctgtccccctttcctatcggtacctgcctcttaaaatcattaagtactaaatctagagattacatgctattacatactcatctctgtcaaccatgttgagacatgttctgatgcttcttagagatcaagcccagtctgtgtaaaattctaccaacttgtctccatttcactggtcaatcattaatactaagagaaagcagtaggttttgcaaatcaactagtcagttttgttgtgccgtattgattcaagtcgtggaaatagtaagtgttctttcagcaaggaaattacaacttcagctattggaaaagaaaagtggaactatccattattaaattcatttttgtcctaaagcaattacaatggaaatatatttccttatttaattcttaccttggacaaaaggcatttaattttctatagttgagacagttgctaaatgtatgacttataattgtcatagtagtgatgtatcactaccattcaataattattagatctaaggcattgtacaacagatgactcaagtgaaagggggataaatataagttctatctttcttcagaatataaaaaggcttctgcagaaccccaaagtgacagagtttgatgctgcccgcctggtgatgctttatgctttacattatgagcgacacagcagcaatagcctgccaggactaatgatggacctcaggaataaaggtgtttctgagaagtatcgaaaggtaaccagtttccatattagcccaccaaacaggaaccaactctgttattatattcttagctctaacgaatgataaatcatactatttttatttacagaaatgtataattctgtcttttcatttttgtttccttaataaaattattttcttatgaaatgggcttcctgatgcctaagcaatcaaaatttgcttctctttcttaatagctcgtgtctgcagttgttgaatatggtggtaaacgagtcagaggaagtgacctcttcagccccaaagatgctgtggctatcaccaaacaattcctcaaaggactgaaggtatagacatctcctctatgctctcctgagtgagaacagttgaagtccttgaggctgagagtgaatgaatatgatcttcaaagtatcttgaagattgctgctaatttagtactgtgtcagttaaatgaaattaaaactggcatcctcttgaaagctttttcttttagtgctttctgtcttagagccgtatcaacattggaccaaatagcttagcaggaaataactggaggtatttccaggaaataagaagaaaaagacaaacagttctgttagtcacagatattttacaccatttgtttataattaaagattttttaggtagtttctctttgaaggaaattaaagatgaagcaaacttttgatcttttaaaaatactaacctgttttcttaaaatactcaaaaattaattctaatctgctagcctttctttttttttttttttttttttttgagacggagtctcgctctgtctcccaggctggagtgcagtggcgtgatctcggctcactgcaagctctgcctcccgggttttacgccattctcctgcctcagcctctcgagtagctgggactacaggcatacaccacctacacccggctaattttttttttgtatttttagtagagatggggtttcaccgtgttagccaggatggtctcgaactcctgaccttgtgatctgcccgcctcggcctcccaaagtgctgggattacaggcgtgagccaccgcgcccggcagcctttcttatgtttcctgaagtttttctattttcctgggtattttcagtcttttttatacataatcctttccttttatttgctctacctatcatttaacatttcacaaaagggtgagagacagtgaagacatgataaaggatttaagcaattccatttttaaaaaatcctttacaataactagccctaaattacagagtaatttttatgagattagaacatttctagctgattaaaataatttttaaatttcccacagttacgtaaatctatcccatgaaatctctattgagtgtatgtccttttctgatatgaatattattaattcttgtgttgccaatttcccaaaaatgacataagaaccattttcccctgttttagggagtagaaaatgtatatacacagcatcaacctttcctacatgaaaccctggatcatctcatcaaaggaaggcttaaggaaaacctatatccttatttaggccccagcacactcagagacaggtaagctaacaaagatattaataataaaagccagaaatactgaacaaacagaaaatttagagtaatgttaaggactaaagctgaggttatagcattctgctgctcctttcttctgttaagattcttttggttttacatatgtcagcattagatatgaattcccctgctaagtctgaaacatttatttcttttgtactaaagaaacaagtgttttggagagcctcaaatccttctgtatttcagtatcagaccagtttacttatgccatttaaggttctgttcgatggcatctggcatttggtgtttcaaacattgaggccaaaaataggcttgctgcttgattgccatccagagcaggttgttactatttttggtgaggactggactttgccaaatgttgccagcacacaaactgagagacctaattaataaaggccatttgttacacaggagcaaaggatggctttctttttgagtattaactaaaggaagcaataattgtcatcttaatccagtggttaatttttaataaaaacaaaacttgtccagaacaacttatttaggccaacctgaaattttaaatactgtatacataaattctacctagttaaaaattatatatttttttttgttggaacacatgttatctaaggggctaacatatatacttgaatcctattggatagattaatgtgaaaattttactgttgacataattcttctattatttcagttaataaacatctaagagccttggaagtatagtgttttataaacataatgagattctgaatgagaaaaatgttttgagatacataggtgattcttttatgtgataaagtgtattttttcactttgtcctttaaaaaatttttttctgtaatttggtacagaacagaaaaaaaaaatcatcttttaaaagtccaaggttgagatgcagaacatttggtgttaaattcagagagtacactcattcagataaaatgtttaaagaccttgggatcaagattcagaaatgtcagctaagtgggaagaatgaacgccagcccaaagttatgcacctatctgagaggctttttaaaaaacaactattcttgagcttttgcattaatgtgataaataaaaacatttatttgcttatgaatttttataagaattactgaacaaggaattatttattaccaaagggaaaccacaggccaccggaagaatatactgtatatgatcagtacacagcaggaaacctttctaatttacataattcattcccacacaaagctcaaaattatattccttgaacaaaatgcacatttatcagttgtcaacatctgttaccatttgtcactataacctaagtatgcatatagttaataattcagttgctttgtccttttacacaacagatgttgattgaatgctttcagtatgttaagagctgttgtagatgctggcgatatagaagtgacaggaaagacaaggtacccgccctcaaagaacttacatagagacaatgagtaaacaagtaaacaaatgaagaatataattttaataagtgctatccaggaaataaatagggtgatgagcttcaaagtaattgtaggggtggggaggactactttagatggagagagaacctctctgagaggtgatatttaagatgagctttgagtcataagaaagaaccagaccagacacggtggctcacgcctgtaatcccaacactttgggcggccaaagcgggaggatcacctgaggtcagtagtttgaaccaggctggccaacatggcaaaaccctgtctctactaaaactacaaaaattagcctggcgtgggtagcaggcgcctgtaatcccagctactcaggaggctgaggtagaagaatcgcttgaacctgggaggcggaggttgcagtgagctgaaatttgcaccgttgcactcgagcctgggcaacagagtgagaccccatctcaaaaaaaaaaaaagcaatcacactatgattaggagagaaagcatccaaagcagagggaaacaccagagcaaaggtcttgaagaaagagagaatttggcaagttaatggaacagaagggagccctgcttggctggagcatagtgaataaggaggaaataagaggttgaaagataggtagggttggatcacatcggttctcgaagaccctagtaaagagatttttttttaatgtcataggaagccattgaagagttaagcatatgagtaacatgaacttaattgtgttttaaaagatatttgtggtaagaatggattattgaaggcaaaaatagaagcagagagactactgaggagatgaatgcagtagtccaggtgagaaatggaagtggtttgggtaggaggctgagagagaagccagaatcaatagtcatatttaatggcacagatttatggaacaagggtaagagagaagtcaagaataactctcaggctttgaggagaaacagagttttgttgttcagttggagatgtctattagataacaagtagaaatgtcacatattgagagttgacaaaaacattagtaatattaaaacctctggaaatgttgaactgctccagattaaacatggaaaaggcaactagttggggaaatggaaacaagaggagagtgtattggatcatgacaaaggtattggtgaatgaattggagatttgatgaggccaaagaattattacagaagagtattagtacaggtaaattggaagttgagaggtagttattggataaagatattttgaattcaagatttcatagggggttcagatacttgtaacgaagaagtttagattgtaagcatggatgtgggtggttgtagtgggtaaaagaaaagatcaggattggtaaggagaccaggatgttagatgagtaatccacagtgatgttaaagtcactgacaatcttgaaaagagaaggagaaaaaggaggacaaataagccagagctaaagtcttcatggaataaaagtgaccaggaaaggaggtcaggagaaaacggtgcagctacattatgagcttctaagatagtggaaattttgaaggaagaaggcaaagaaatggttacaaaactacagtgggtgtcacagaacatacctataccacctcctggccatgcctaacagaaggaatactgcaaaggacttgaaaatactcttatttaccaattctacttctaaaagcttactgtatagatattcctgtgcaagtacacaaagatacttaagccaggatgttcactgaagtaatagcaaaaaaactaggaacaagctaaatatctattaatagagggctggttacctaaactacagtacaatattacgtattctttttttttttaaatgacataactcctcacgggtgatatgcaaagctttttaagatatattagatagaaaagcaggatgttgtaacatttcttttcttttttttttttttttgagacagagtcttgctctgtcacccaggctggagtgcagtggtgccatctcggctcactgcaatccccgcctcctgggttcaagattctcctgcctcagcctcctgagtagctgggattacaggtgcatgccaccatgcctggctaatttttgtatttttagtagagatggggtctcaccatgttggtcaggctggtctcgaactcctgacctcgtgatccgcccgcctcacctcgtgatccgcccgcctcggcctcccaaagtgctgggattgcaggcatgagccactgtgcccagccataacatttctttcaggtaaaaaaactgtataatcctgggtgcagtggtttatgcctataatcccagcactttgggaggccgagcgggcagattctttgaggtcaggagtttgagaccagcctggccaacatggtgaaaccctgtctctactaaaaatgcaaaaattagccaggcgtggtggcatgcacctgtagtcccagctactcaggaggctgagtcaggagaatcgcttgaaccagggaggtggaggttgcagtgagccgagattatgccattacacaccagcctgggtgatagagcaaggctccgtctcaaaacaaaacaaaacaaaacaaaaaaagtgtacatgtatataaatatgtgcttgactatacatatgtatgtatattatatatataatatattttcacaagcacatatatgtataaatacagtaactctttttgtttgtttgtttgtttttttgagacagggtctggctctgtagcccagactggagagtggtggcgtgatttcagctcactgcagcctccaccttttgggcttaagccatcccacctcattctcctaagtagctggggctacaggcacatgccacagtacctagctaatttttgcatttttatagagacaaggttttgctatgttgcctaggcttgtctcaaactcctgagctcaagcaatctgcctgcctcagcctcccaaagtgcttggattactggcatgagccaccatgccctgcctacagtaattatttctgaaagaataatcaagaagttgttaatagtcgttacctctggatattgagacagtagttagttacatatctatccttcctattagttattgtattaggtattgtaatcttgaagtaagtattatgttttgttaatctttggggttttcacaatgtttaacacagtgatttacaaataataggtgttcaatagatgtttggtaaattctataggcatctcttctagttgatatgccaatatttatagttggaaaatttaaaccagagaataaacttaattgatgctatacaaaatttagatttttgaagttcataaacaaccctttaaaacattctggctctgtattcacttggccacactatcagctctagccactttcttggccctgtattatcatattgaaaagagtccttgattatagtggtatttattattatttgtctcatcataatagaaattctaggttttattgttgctataataatagaaaatatcaaaggaaatgtggcaagaacacaactttgcaaaaccagaacactggtggaaatttttttagcccttagctgttaaattagtgtttaagctgtttggcagtatagctatatccacaaattggatttgatcattctgcagatgggattcttgcataccctatttttcaagctaatttttttttctcactctagaattgcctcttgtctctgataaaggcaagcaactttttcatttggtgaggaaatggagctatatgatcatgcattccagaatcagtcaattcaaaaaggaagtacttttcatgtttatacaaatgtagtagaatcttgttgctacagcttattttttgtttctgtgaagcagcagtcctttttcattggccttttttcctgcagtaaatgctcataagaactgtaccatttgtaagtatgttcagaaattacaattttagccataagtgtaatgctccacaaaatagataaaatgttgccttttgaaagtttgtgtttccatgtaacttaaccacatatagaaataatgttaaaaattctcaataaggtgggcaatgtgtctcatgcttgtaatcccagcactttgggaggctgaggtggggcagatcagaggtcgggagttcaaaactagcctggccaacatagtgaaaccttgtctctactaaaaaaaaaaatacaaaaattagccgggtgtggtggcaggcacagtggcagatgcctgcagtcccagctacttgggaggctgaggtaggagaattggctgaacccgggaggcaaagttgtagtgagccaagattgcgccactgcactccagtctgggcgacagagtgagactccattaaaaaaaaaaaacacctctcaacaaacttggtattgaaggaacatacctcaaaataataagagccatctattcccagtattctgggaggccaaggcgggcggatcatgaggtcaggagattgagaccatcctggctaacacgataaaaccctgtctctactaaaaatacaaaaaatgagccaggtgtggtgttgggtggctgtagtcccggctacacgggaggctgaggcaggagaatggcgtgaacccaggaggtagagcttgcagtgagccaaaatcaagccactgctctccagcctgggggacagagcgagactccgtctcaaaaaaaaaaaaaaaaaaaagagccatctatgacaaacccacagccaacatcatactgaatgggcaaaagctggaagcattccccttgaaaaccagcacaagacaaggatgccctctctcaccacttctattcaacagagtattggaagtcttagccagagcaatcaggcaagagatagaaataaagtgcatccaaacaggaaaacaggaagttaaactgtttttagacgacatgattctatatctagaaaaccccatagtctcagctcaaaagctccttcagctgataaacaacttcagcaaagttgcaggatacaagtcaatgtacaaaaatcactagcattcctatacagcaacaacaaccaagctgaaagccaaatcagaaagcaatcccattcacaactgccaccaaaaaaataaaatacctaggaatacagctaaccaggaaggtgaaagagctctacagtgagaattacaaaacactgttcaaagaaattagagaagccacaaacaaatggaaaacatcccatgctcatggataggaagaatcaatatcattaaaatggctatactgcccaaagcagtttacagattcagtgctattcctatctaactaccaatgacattcttcacagaactagaaaaaattattttaaaattcatatggaaccaaaaaaacgccaaaatagccaaggcaatcctaagcaaaaagaacaaagctggaagaatcacgttacccaacttcaaactatactacaaggctacagtgaccaaaacagcatggtatgggtacaaaaacaagcacatagaccaatggaacagaatagagagcccagaaataaggcctcacatctatgaccatctgatctttgacaaagctgataaaaacaagcaatggggaaaagactcattcaataaatggtgctgaaataactgactagccatatgcagaagattgaagctggaccccttccttacacggtatacaaaaatttcaactcaagattgattaaagacaaatgtaaaacccaaaattataaaaaccctggaggacaacctaggtaataccattctggacctaggaacaggctaagatttcatgacaaaaaaactatgcatctgagaaaggtctaatatccagcatctataaagaacttaaacaaatttacaagagaaaaacaacctcattaaaatgtggaaggccgaggcaggtggatcacctaaggtcaggaattcgagaccacctagtcaacatggtgaaaccctgtctctactaaaaatacaaaaaattagccacgagtggtggctggcacctgtaattgtgccacgggaggctgaggcaggagaatcacttgaacctggggagatggaggttgctgtgagccgagattgtgccattgcacaccagcctgggcaacaagagcaaaaccctgtcgcaaaaaaaaaaaaaaaagtgggcaaaggacatgaacagctacttctcaaaagaagacatacgtgcagccaacaagcatatgaaaaaaaactcagtatcactgatcattagagaaatgcaaatcaaaactatggtgagataccatctcaacaccagtcagaatggctattactaaaaagtcaaaaaataggctgggcatggtggttcacgcctgtaatcccagcactttgggaggccgaggtgggcggatcacaagatcaggagttcgagaccagcctggccaacatggtgaaaccccttctctactaaaaatacaaaaattagccaggcctggtggcgcgtgcctgtaatctcagctactcgggaggcagaggcaggagaatggcttgaacccgggaggcaaaggttgcagtgagctgagatcgcatcattgcactccagctctgggcgacagagcaagactccaccttgaaaaaaaaaaaaagtcaaaaataacagaacctggcgaggctgcagagaaaagggaacacttgtatgctgttggtgggagtgtaaattagttcaaccattgtggaaagcagtatggcagttcctcaaagatttaaaaacagaactaccatttgacctagcaatcccattactgggtatatacccagaggaatataactcattctaccataaaaacacatgcagctggacacggtggctcacgcctgtaatcccagcactttgggaggctgaggcaggtggatcacctgaggtcagtagttcgagaccagcctggccaacatggtgaaacctcgtctctactaaaaaataaaaaaaaattagccaggcatggtggcaggtgcctgtaatcccagctactcgggaggctaaggcagcagaatcacttgaacccgggaggtggagattgtgatgagccgagattgctccactgcactccagcctgggcgacagagtgagactccgtcaaaaaaaaaaaaaaaaaaaaaaaacacatgcatggccaggttgggtggctcatgcctgtaatcccagcacttcgggaggccgaagtgggtggatcatctgaggtcaggagttcaagaccagcctgaccaacataatgaaacctcatctctactaaaaatacaaaattagcggagcatggtggtgcatgcctgtaatctcagctgcttgggaggctgaggcaggaggactgcttgaacctgggaggcagaggttgtggtgacccaagattgtgcccttgcattccagcctgggcaatgaacgaaactctgtctcaaaaaaaaaaaaaaagacacgtgcacacaaatgttcattgcagcacttttcacaatagttaagacacggaatcaacctaaatgcccaccaatgacagactggataaggaaaatgtacatatacaccatggaatattaggcagccataaaaaaatgagattatgccttttgtgggaacatggatggagctggaggctatcacccttagtaaactaatgcaggaagagaaaaccaaatactgcatgttctcacttacaagttggagctaaatgataagaactcaggaacacagaaggaaacagcagacactggggtctacttgagcaggaagggtcaaaggagggagaggaacagaaaagataactattgggtcctgagcttaataactgggtgatgtaataatatgtatgacaaaccgccgtgacacatgcttatgtaacaaaccttcacatgtacccccaaacttaagttaaaaatttttaaaaagaaataatgatttccagatatcctatatattttttttttattttttaacaaaataagatattatccttgattatccttgtatatctctatacagcatgagctagctgctgttttctaatgtttgctgtctgcattaattaatgctttggttgctatggtgaattacaaagcacaggaagatgcatacaaagaattgaacttgtgtattccacttagcttcaaccatcatatggaaaagatttgctatgtgttttaccattggcctcatcagaacatctacttttaaaatttactgggaaaaggaatgaaaaggaaaaatgtcaggggtatttaaacattgtttttcatagacgttcttccttaagtcagcttgaataagtagtaggaggaggctcaggaaaacatttattaatgttttcataaccaaatgtgacatagtcatctttgcgaggtacacaattgagccaagctctaagagcctatccctgtatctaggttttgtccttacatgtatataacctacacccacagtttaccatccgtgacattttctttcctctccagtagtacaaaaataccctgccaccctgaaatgatcagactgaaggacagtgttctcttactatgctaaaagcccacttgaatttgttccttcccagttcttgcctttcttttccataagagacagatatattgtccaggcaggtgatggtcagaggatagctatggtgaagcaacatcattttccatgatgctctcatttgtctgctcaatcgctttttaaattgacttatcagatcagaagctcaaaacaaaggtgttaactatctgattcttcccattagtcaccaagatggtcactgtacccctgcaaaggaaagattccctcccttcttcttaataaaataatctgcaattcatttatttacttaagtaaataaaatgtgtttatttgagtaatccattatgcagtttatcttgagcaaatatatatattactttcctacatttttcatgttttttggtgaatataatgtcctttcagccttgagtattttattgtttccgaacactttaactgcctcttatcttccagctttttacatagtctgtaactatctgggtaatttttcagtcatctcccttccttcttcccctcttttggagtcccccatagtctcttctcttcatccttatgtccatgtgtacctgccatgtttaactcccatttataagtgagaatatgctatatttgatttttctgcttcagataatggcctcttgctccatccatgttgctgcaaaggacatgatatcattcttttttatgcctgcttagtattccatggtgtatatataccacattttctttattcagtccactattggtggatacttaggttggttccatagctttgctattgtatatagtgctgggataaacatgagtgcaagtgtctctttttatatgatgatttcctttcctttgagtagatacccagtagtgggatttctgggtcaaatggtaagttgtttttgttttttgtttttcctttcttgagacagcatctcattctgttgaatggagtgctggatggagtgtagtggcagtcacagctcactgcagccttcccaggctcaagtgatcctcccatctcagtgccccctccctgcccccagcctcaccaagtagctgagactataggggaaagccaccacgctgggctaatttttaaaaattttttggcagagttggggtctcacaatgttgccaggtggatctcaagctccttggctcaagcgatccacctgccttggcctcccaaagtgctggaattacaggcataagccaccaggcccagccttttttcgttgttgtttttaaggaggaagaggggacatgagcaaggatgtaccctgtgcattcgctcccctccctgtggcttaattgctagttctatttttagttctttgagctagttccataatgttttccacagaggttgaactaatttacattccaaccaacagtatatgagcattcccttttctccgcatccatgccaacatctgttgttttttgactttttaataaaccaaaatagtaagagccatatatgacaaacccacagctaacatcatactgaatggggaaaagttggaagcatttcccctaagaactggaataagacaaagatgtccactctcactggtcctattcaacatactgaaagccctacccagagcaatcaggcaatagaaagaaatataagacatccaaattggaaaagaagtcaaattatctctgttcgcattcaataggattatatacttagaaaaccctaaagatccctctagaagattcctagacttgataagtgatttcattaaagtctcaggatacaaaatcaacatacaaaaatgagtaacatttttaggcaccaataacattcaagctgagaatcaaagtaagagctcagtcccatttacaagagacacacaaaatacttaggaatatatttaaccaaggaggtgaaagatctctacaaggagaactacttaacattgatgaaagaaatcatagatgacacaaacaaatggaaaaacatcccatgcttatggattggaagaatcaatattaaaatgatcatattacccaatgcaatctacagattcaacacaattcctatcaatttaccaacatcattcttcacagaattaggaaaaagaatcctaaagttgatatggaaccagaagaaagcctgaatagccaaggtgctcctaagcaaaaaacaaatccagagtcacattgcctgacttcaaattatattataaggctacagtaactaaaacagcatggtactggtacaaaaacagacacatagatcaatggaacagaatagagaacccagaaataaagccacatacctacaaccaactgatcttcaataaagtcgataaaaataaacaatggggaaagaacaccccactcgataaattatgctgggaaaattggccagccatatgcagaaaaatgaaattggacccctatctcttaaccatatacaaaaattaactcaagatggattaaaggcctagatgtgggacctgaaactgtgaaagtcctagatgaaaacctaggaaaaactcttctggacattggcctaggcaaagaatttatgacaaagatcccaaaagcaaatgcaacaaaaacaaaagtagacaagtaggacttaattaaactaaagggcttctgcacagcaaaagaaataaccaacagaataaacagacaacctacaaataatgcctccaacaaaggactaccatccacatcctacaaggaacgcaataagtaaaaacaaccccattaaaaactgggcaaacgacatgaaaagacatttctcaaaagaattacaagtggccaaaaaacgcttgaaaaaatgctcaacattactgatcatcagagaaatgcaaatgaaaaccacactgagatatcatcttacgctagtcagaaagtcagatgccaccactctggttttaccttcctaccggctcttctgaagcctttgttattttctctctcttgctctcgctcttgctctcactctggctctggctccccccatcaccccattattttcagcttcttctctgccgacttcttttccacaggctataatcatactcaattttcttttgttaaataataaatttaaagcctttggtcctagattttcctgtaagttatgtccttcccttcatagccaagctttttggataaagaagcccacagtcactgtcttctgtttctcaattcttcaatccatgtagcctggctccttactccactacaacacactaaaacatttcttgcaaaatcacagtagtaaatccaggggactctcaattcccaccttattttccccactgctgcatttcacactattaaccattcttttcttcttgagactcagttgggcctcaacctctcccttctgattctcctcctacctttctgaaaatgtccttctcagttgctaatgctggctactctttttacttgttttttagttattagggactcagcaaaaaatctgtcttttggttttcttctcattctacatgatctccctagataaaactcatctattcccatggcttcagctaccacatattcggggaaagcactagacctgaatatacagatgtctagtgggcatctccattagaatattccacaggtatctaaaacacagcatgtttttgtcttatgcacagtaaatgtcctttttctcaaacctaaaccactacacctagttaccaaaaccagaaaacaaagttatggactccccctttacccctatcctccacattcagtcattgaccaaatactgaagaatatgtatttttttgtgactggacatccagtacctcctcttcaccctttctgggatgtctttagttctaggtttcatcatatcttcccagaagtcttacactagccttttattctccaacttttcccaacagttacacccaattcattcttgcacagctgccaaaactatccttcaaaaaagcaaatttggctgggcatggtggctcacacctgtaatcctagcactttgggaggccaaggctggcagatcacctgaggtcaggagttcaagaccccctgcctggccaacatggtgaaacctcgtctctattaaaaatacaaaaagtagtctggcatggtggcgcacgcctgtattcccagctacttaggaggctgaggcaggagaatcgtttgaacccaggaggcagaggttgcagtgagctgacattgcaccactgcactccagcctgggtgacaagagcaagactccgtctcaaaaaaaaagcaaatttgatcatagtaacctgtgagaaccccatgacctgtgagatttgaggtgtgtgagctggcttatgcttttccctctttttctcactatgtccccaacttcacttctgctccaaaggaagagttaggatgagtccaaagtttttggcccaagcaactagaaggctaaagtgaccatcaagtaagatagggaaggctataggtagaacagacttagggaagattggggatttaaaacgtgttgaattgagaaataattaaacatccaaatggaaatgtcaagtaaacaggtatttaagtctggagtttagaagaaaggtctgggctggagatggagatttgggaaccatcagcagatgtatttacaaccaaaaaatggtgtgattatccagggaaggaaatgtgctgtttctctggtaactagtaatgtaaccacttgtcagtgtagctgttgagcacttgaaatgtggctagtgctactggggaattaaatatttaattttattttggttaatttaaatttaaataaccataagtgacaagtggtcactatactgaatggaacagatggagagaatgagtttagattaagaagaaaggaggatcaatgtctgggctctgagtattccacaattaagaggtcacagagatgaagtgggaccataaaaggatactgaaaagtagcaagggaaaaaatcaaatatgaaattttctggaaaccaattgaagaaggtatatccaggaggagcaagtgatcacctcagtcatatgttgctgataagtcaagtaatataaaactgttctacctcacccatcatcaggcaatagtttcataaggaacacacaacctagatccctcccatgcgtagttcacagtaggatttgcactcctatgagaatctaacgcctccacggatctaagaggaggcagaactcaggccctaatactcactgctcacctcctgctgtgcccccgcccagttcctaacagaccacggactggtattggtcctcagcctgggtttggggacccttatcgtaattgacactttaccataacaccctcttcatcattggtagcttgtataactgtttttagggggaaggtttttttggggtgtttttgtttgtttgtttttggagatggagtctctgttgcccaggctggagtatggtggcacgatcttggctcactgcaactttcacctcccagattcaagcaattctcctgcctcagcctcccgagtagctgggattacgggcagctagcactacgcccagctaattttgtatttttagtagagcctgggtttcaccatgttggccaggctggtttcaaactcctgacctcaagtgatccgccttcctcggcctcccaaaatgcatataggcatgagccatcatccccacccttgtataaattttactgggaaatctctgcaatttagagactatctgaacattttaaaatagccacaatagctgattctgtttcagtgaagtcccacaagaacaaatactctctcagttaattctttcaaggtattttagaaagagagagagagagacaagcaggaaggaaatgtagggttggggtttttttcatgatttatacataagcatgtatattccttgattaaagatgtttctggttagttttgtgcaataacattcaaaacggatgcttctgattgatgtagttttagtgtccaatgagtgatttaacaaaattatttgcctagtaatggttttgaaaataatttgatctccttcttggtgatatttaaggaaggagctaataggaacattcacttttgttatgaagccattttgatacggattgaaacaggaaacagagtaaaacaacacagtgctacccaagtgaagctagtgactgagctgtgttcgcatgtccagtatcagctacactcatggtttttttggtttccatggtttctttttcttggtttatcaaaggattcagaaaaaagatttcaagaaaagatagagttcctagaagcaccattaatttttgtgtcccattcttttttttatactcaaaatactaaatgtttctagtttccatgttttggggacatctaaatatgctagttctttcaaaaatgctttgaggtccttgtacagaggccattgtaatagcactgtattaagtatttgacaaaggcttatacatgaaaggagatgtgtagtattaatacaaacataaaattctgccgtattgatatcatgtcatggtaaggcactctgcaccctcttgaatataaaagaatatttctacatttggttccagcaaacactattgtgctattctgaaatccacagcacagaaattataagacatccgctcataaacagaaagcaaatcactattcagcatttcctgctctgtttcctgccaatttcagataattgaaactttttttaaaccttttattctattctgctttaattctgcttcctccaccaaaaaaaaaagatttagaaattaaaactctgtgtatgtaagtcacagtcctttttttttcttatcctgtgataatatctcattcttcattattgcagacctcaggatatcattgtgtttgtaattggaggagccacctatgaagaggctctaacagtttataacctgaaccgcaccactcctggagtgaggattgtcctgggaggcaccacagtgcacaacacgaaaaggtaaaagagaacattcattctacaactgtgtcctctttcccagaggataaagcttaaattccctttatgttggaaaaatttggtcaatactcaccaaactgctgtagactgaaattctctggtgtttgcagctccagaataatttaagaatttgtgagagaaaggatctatagtagttaagttcgttaagttcataaatctctttattaggtcaaagacctagaaagtaagaaccatcttacactgttaacaatttgtatttcctgtgttcaaaaaaggagaaacccttggacctaattcataaggaagggggaaaaattaaaaattgggttttttttaaagagggagaaacctaatagccacagcttagactttgaaaatacttaaacataatggtattgaagtctgtgagtttttctattttgttgattaactttattcacttagcaagtattcagtaagaatacaaagatgaataatctaaagatcctacctcaagttattgtctattaggaaagaacatttaaaaataagaaaacaagtgcccagagaggcagataaaagggccaaggattctcagagtgactaagggaaattagcaaatgtttcacatagaagatagtatattagctgagccttgggtgaaaatggacatatggagggagagcacattctaggtagagttaaccacgtgaacaagttataaaagctgtaggcaacatacatacacaaagaacagcaaatagttgactagctggaatgtgtgtaataaagtgaaaggatgattgaatgccatcattgtggaaggccttgagtgccaggcttgggaatttctacttttttacatagaaaatggggaattattgaaagtagtgattacaagaaactcacggtgttttaggaggattaatttggcagctaaaggtagaagaggaaaagactggagaaccgtgacatgattgttgaatctaaagattggggaccctgagagatccatgctgagccatgtattctagataattgggagtcattaaaagtatttgtatactttttaattttgtatgattatttggtttttaatataacttttctcctttattatggaagtaatatatgcatattctgaatatttttaattcagaaagtacaaggagaaaaaacgtttccataatctaaccactgttacgttttagtgttttcaggcctttttttaagcctgtatagacgtttgtatgagtgtgtgggcagaaagggatctcatcgtacattctgtgttttaactttcattttgcagtctgatgtaaacgtcttctagtgttaaatatataatcattcattcattaaacaaatatttactggataagatttcttgggtttgaatcctgatttccctcttactatttttgtaaacttgggccaattactaacctctttgttagtgtccagaactcactggctatttatatatttcttttgtgaattgctagttcatattctttgcccattccacaattgaagtattcctttttttcttaataatttttttaattctatttatataaataaggttattggccatttgtctagtatttattttgcaaatctttttcctctatatttttgttttatactattcacagtgttttgttgtataaaagttttgttgttattactttaattttatatggtcacagttacctgtgatttctgcctttggtgtcatgcctagaaagttatttcctacacaagattatataaatactaagatgcattttaaaaattatttttaggatacatatttaacatgatatctttacagtctatcagaattttagttttgtgtaaactgtgctgtagggtttccttttataacttctacagaaatattacagtgagaaatattacagtgaggggcttttttcttcttgacaccaaatacaccatgtctttcccaacaccatttttccaattctccagacaccaactggatatttagcaatttgattcaattctgacacgatctacctggagttagcatctcatctcaaagttaaaagggcttaaccccacaagaccacccctacttcagatgccagtcacaagttccagaccacccgtatttcgggagtgactggttgtaaatcaggggttcccatgaccccttcctcaggtttgataatttactagaacagttcacacaactcaggaaaccactttactgcatttgccagttattacaaaggatacaactcaggaacagccaaatgtaagagatgcatagggcaaggtataggggtggggtgtggagtctccatgcctgctctaggaacacccaccccaccccagcaccttgatacgttcaccaacccacaaactcttcgaacactattgggtaggggtttttatggaggtttcgttatgtgggcatgcttgattaaatcattagcccctggtgattgattcaggctccaactgttttccccaccctggaggttcaggggtgggactgaaaattcaaagtttcttattaaggcttggcctttccggcaactagccctcatcctgaagctatctagaggcccaccaagagtcatctcattgaaacaaaagacactcccgtcaccctcagtactcagaaaattcttagggaattaggagctctgtgccaagaatggggacaaagaccaaatatctttctgtgataccacatacatacacttacacacagttatttcattatgtacggaaaagtatataaatgataaacagctcagtaaaacattgcaaagtgaatatatctatgagatgacctctgagtgtaatgatcaagaaatagcacattgccagcacccccagcagcctttcttattcctcatgctccctccttgtcacaaatccgtgcaaagtattcattattatgacttctgtcaccgtagattagttttacctgttcttaaaagatattttttgaataaaagaagaaataagccaggcgtggtggctcccacctgtaatcccagcactttgggaggccaaggtgggtagatcatttgaggtcaggagtttgagaccagcctggccaacatggtgaaaccccgtctctactaaaaatacaaaaattagccaggcgtggtggcaggcgcctgtagtcccagctactcaggaggctgaggcaggagaatgcttgaacctgggaggtagaggttgcagtgagccgaaatcatgccactgcattccagcctgggtgacagagagagactctgtctcaaagaaaaaaagaagaagaagaagaagaaataaaggctacacttaatctatttctgcctttctcacaaataatataagaatattaaaatgttttaactgtaatcactttcctcccaatttgtacactatcattgtccagtgttttggttttacctttttaaattcccaaattaatcattattttcagtagttaatgtttatctatatttactcacatatttgcccccttttccccctccactttgtttctttcctcctggctctttcttcaatccaattttcttctaactaaagaacattcttgcctgaatcccatgcctgtactcccagcgctttgggaggccgaggtgggcagatcacttgaggtcaggaattcaagaccagcctggccaacatggtgaaatcccatctctcctgaaaaatgcaacaattagccaggcgtggtggcacatgcctgtaatcccagctactcaggaggctggagaattgcttgaaccggggaggtggaggttgcagtgagccaagatcgagtcactgcactccagcctgggcaacagagcaaaacaccatctcaaaaaaaaaaaaaaaattattggccagtagtttaggaggccatggcgggaggatcatttgagctcagaagtttaagaccaaacctgagcaatatagagtgactctgtttctaaaaaaaaaaaaaaaaggtaaaaattagctgggcatggactaggcatggtggctcacacctgtaatcccagcactttgggaggccaaggcaggcggattgcttgagcccaggaattcaagaggagttcaaggagttcaggctgggcaacatggtgaaactttgtctctacaaaaaaacacaaaaattagctgggcatggtagcatgtgtctgtggtcccagctacttgggaggctgaggtgggaagatcacaagcctgggagattgaggctgcagtgagccgtgatcatgtcaccaccccccagcctatctgaacaagaccctgtcttaaaaaaaaaaaaaaaactttagtatttttttcagctattgttcattttgatgcctttgtctaaaagtgtcttaattcagccaagtttagaatttcaggttgataattttcacttacttaaaagtaagacaacaatggaatgctgtattacttggtatgaaaaagtcatgtttggcataatttctggaaattttacagtcattatttctttgactgttgcttctctttcatctcctgttgtctatccttctggaattactgtgagatatatgttaaaccttcatctattcttcaggtctcttaatctctcatttatgttatccatctgctatctgtctgtgctgtcttctgtataattttttcagatcagtgttccagtttagtaattctttcttcagctatatctaatctatgtttaatttgtctactaagtccactaatattatatttttatgctcacgagttctattttgcttctttttcaaatttgcctgatgtttttgttagtatcctctttttttctcatgttttcaaatcctttatttttgctaaaccacattaactctataatctgaagtatgtgtaggtctaattctgctgttatatctgctaacattaactcatgatgaagcatttctgcatgtgttctgtgattttgacttatgagttatcttaagaaggattttatctatagcacccgtgaggagctgacattcaagatacatctctcttgcatattcttctttcatttttgctaggtaccccaagagcattgtcagtctggaatcatttttatgttagtttctatacataagggttcctgaaccttgcaaagcatatctccttgtgcagatagatttttttagtccactttttcagtgagggtctctatattacatggaaatctcaattttgatttattttcttaccgaggcctaagccttctttcctgaccctctgtggctactaaaacacagtgcccttgtttaataacactggcacacacctattagatagttgtagcatcagtttatacttatcaagctaagttttggttccctttttgtgctgacccttagcaattcctctcactttccaaagaagttagatattcatttaaaagaatgtttgtcattttttatcctgcatttgtatgtgttttattacaagataattttcaccttatataatctcccttaattctagaaatggaagtgtcagtgtggttatgatcttgggagtggataaaatggtagtgacattatagaaactccattttgaacatcagtagatgatatgatttggaaggatagccatgcatcctaaaatgtcaaactgagggttttgtacctaattcaagggcacctcttgaatatttttgagcacagaagtgacataatattattagagctattttttcaagtgtctccctttgctgctaataaagcaataatagttcatacttattgagtagatactgtatgctaggcactgtactgaaagtactttaaatctattaattcattgaatcctcacataaagtttgtactattattatctttatatatggaaactgaggcacagagagattaacttattcaagtaaacatgactagtaagagatggagctagtattggaagccagaacccatgcttttaaccactatgcatttccttcctcagtattacttgaatgcctaatgctgcattattctctaaataatatttaataatttagggtgcagaaggttttattacttgatggtagccatatgggattttgtcttcttgatccaaatgagttatttcatgaatgtttagttaatcatatgcttttaaataggcttccatatcagaattcaaaaagatgatttgacccttaagtgattcctctgagagttaatatttctcactatttgtagccttatggccagtgactaagaattgtagcatcatccctttaatctgaaatatcagcaggttaaaattaaacatatatatctccatttaaaaaaataggccaggtgcagtggatcacacctgtaatcctagcactttaggaggccgaggcaggcggatcatgaggtcagaagatcgagaccatcctggctatcacagtgaaaccccatctctactaaaaatacaaaaattagctgggcgtggtggcgtgcacctgtagtcccagctactcaggaggctgaggcaggagaatcacttgaacctgggaagcagaggttgcagtgagccgagactgtgccactgcactccagcctgggctacagagggcgactccgtctcaaaaaataataaaataataataataataataagtaggggggccaggcatggtgggtcatgcctgtaatcccagcactttgggaggccaaggtgggcggatcacctgaggtcatgagtttgagaggagcctggccaacatggggaaaccccatctctactaaaaatacaaaaattagccaggcatggtgacaggcacctatagtcccagctactcaggaggctgaggcaggagaatcgtttgaacctgggaggcggaggttgcagtgagccgagatcgcaccactgcactccagcctgggcagcaagagtgagactctgtctcaaaaataaataaataaataaataagtaaaaataaaaaattaaaaataagttgggggccaggcatcgtggctcaggcctgtaatcccagcactttgggagaccgaagtgggcagattgcttgaactcaggagtttgagaccagcctgcgcaatgtggcgaaactccatctctaccaaaaatacaaaaaagtagccaggtgtggtggcgccacctgtggtctcaggtacttgggaggctgaggcaggagaattgcttgagtccgggaggcggaggctgtagtaagctgagatcgtaccactgcactccagcctgggtgacagagcaagaccctgtctcaaaataaataatataagttggatttagatagaaagatagattagtaaagattttttatatgtctttgtaatttagtcatagtacatacaaaaatacatgttttagatgtgtttgactaattaatagtgctatgggctgggcacggtggctcacgcctgtaatctcagcattttgagcactgtggaaggccaaggcaggcatatcacttgaggccaggagttcgagaccagcctgcccaacatggtgaaacctcgtctccactaaaaaatacaaaaattagttgggtgtgatggtgtgtgcctgtaatcccagctactcgggaggctgaggcacgagaatcacttgaacccaggagacagagtttgcagtgagctgagatggcaccattgcactccagcctgggtgacagggcaagaccctgtctcaaaaaaaaaaaaaaaaaggtactatgaataaaacttcattttctgttcaaaaaagtagaaaaaagaaaaaaaaatgaaacatctagggttttccttaaattagtgttcaagttcctgacaaatgaccttttgtttttttggggacggagtcttgctctgtcgcccaggctggagtgcagtggtttgatctcagctcactgcaacctctgcctcccggattcaagcaattctcctgcctcagcctccagagtagctggcactacaggcgtgcaccaccacacctggctaatttttgtatttttggtagagacggggtttcaccatgttggccaggctggtctcgaactctggacctcaagtgatccacctgccttggcctcccaaagtgctgggattacaagagtgagccaccgcacccggcctcaacaaatcatccttatataaaattaagaaggtaaggcagtcctgcgaaggccttatgctagattcttccagctattgtcagcgttggtatctctgtgtgacctaatagcatgctaagcagtacactgtattacatttgagcagatatcttagcaataaagattcaataaaattttggacagaattgttcactggcttcctgaccaaagaaacttttgcaaagagggagttgctatggcaatcaccaaacaggaaaaaatattagttgatttttgcaacacataaatgattcaatatcaagtgtttatagtttacttttgtaaatagatagccctagccaataagtaaatagtgaaatttatcataccagtaagaagattatggaatttatatttcagaggccagttattgtgaaggcttaagtaactgaaagcaatagtttcacctttgaatggaaaggctcaattttcatgatgaatgtaggataccttgggtattactaacatatttagtaagtttacaactcttaatacatattggaatcttagactctcagtaatggaaaggctaatattttttaaaaatcagttttatacctggatatagtagggctgcagtgaactagcaataatatgatatggaggagaaaacattgaataatttgtttctgtgaattattagggtttaattttgtaggagttttagtgtataattttctctgtaatatatgggttatttcttaaggaaacaggccaaaagaattagtgacaaaaatgcagccttgacctcaagagctctgcagcacagaagtagctttttgagagactagggagattagaaaatggtatacgtttagatttgccgcgatattgctctccttttacacttagaatcatgtaagtcatggtatggttggccatgtcttacatgtcttacatccaaatccatggatttggattagtgggtaccccaataaacaggaaagaaatgatatcttgtcactgtgtgatgtattaatacagaagctactatccttccagaataggaaatgtctattgtggaatatttctggaatacaggtcacttggtttccctattacaactcttaaataaaatctgaggccgggcgcggtggctcatgcctgtaatcccagcactttgggaggccgaggcaggcggatcacctgaggtcgggagttcgagaccagcctgaccaacatggagaaaccccgtctctactaaaaatacagaattagccaggtgtggtggcacatgcctataatcccagctactagggaggctgaggcaggagaatcgcttgaacctaggaggcagaggttgcgatgagctgagatcgcgccatcgcactccagcctgggcaacaagagtgaaactccatctaaaaaaaaaataataaaatctgagattactaaacagatttattctgcatgcaaatttcagaactaccacttactagtttttttattacttaatcacttaatgtaatgggtagataggtcaaaattgatctcctgcatcccagaaaataacaagtacccttacccgtcaggtagcaattttagcaaccttaatcatggtttctctatttttatttctgacatatatcaagatcacttttactgtaaattgaaacaaaatcttagttgtaaacaaaacttaaaaataaagaagagaaagcaattattcctttcctccctagtatatttccaaaaatgaacataatttttagtgtaagaacagagcctttgtataagtaagctcgtcatcttaagcaaggagtcacctgaagatataggtcccttagatcctaataggaaatatacattagtttaatctgaaattgaagttgccattcaaagttatcttaaagtggctctttcttgcatactttatttctttaaaacagttcttttgcgataatattttttagtgattcaggcgctggttgtaatgaagcagagttctatatatgcaggccttccgtagttgtatgatttgtttctatagggcctgctctgattagctgtaattgtgattatctttgtttagatttaaacaccatttaaaatagaaggcatgtatttgctgctaagacaccaaggaactttgcagaagcaacttatctccttagcaacattctttttttttttttttttttgagtcagagtcttgctctgtggcccaggctggagtgcagtggcgcgatctcggctcactgcaagcttcgcctcctgggttcacgccattctcctgcctcagcctcctgagtagctgggactacaggtgcccgccaccgcgcccggctaattttttgtatttttagtagagatggggtttcactgtggtctcgatctcctgaccttgtgatccacccttctcagcctcccaaagtgctgggattacaggcatgagccaccatgccctgccctccttagcaacattcttaataaaattgccttctaaataaagagaggcagtcaatatttcttctctttccatagccatatgaagtttaacatgaattttgtattacttccctttttcatttcatatataatgaaatacacagaaataaaatgtagtaaccaattacagagacttctttaaagatataactgttgtgcttttttgaaggcaaagaacctgccctgaaaaagaatctgacctgaacacatgctgtcctaagcagttagtctagtgtgtctctggggtctatgcaggtttgcagtgtacagactgttatctcctgtctcagtatttgcccttcttatggaattactttccttcctcttactaccttatttcctcctcttcatttgtctcattagttgtattagccagatatatatttacttgtaggggagggggaatgtcaaatttcagtttctaggaattatatatggcatgagtcattgctatagcatcacagaaattttcatcaacgtctatctagaacagtcaggagttctagttatgagttctgtaatagatatttattgaacatgtgagaacaatgtaaagccaatagttggttcactcaaatatttactgagcactgggatacctccatgaataaaacaaagatcctaacccttgtgaagcttcattttaatgcagggggagacagaaataaaccataaacttaacaaataggtatattttatagtaaatcagtatgtaatagatgcagtgggggggcagggaatatgaaactgtgtaaagggaaattgatagtgcttggggacagtggctgtaggttacactactcagtatggtatcaggaaaggcctccttaagaagagatgtgtgtaggccaggtgccatggctcacacctataatcccagcactttggggggccaaggcggccggatcacctgaggtcaagagttcaagactagtctggccaacatggcgaaaccccatctctcctaaaaatacaaaaattagccgggcctggtggtgcactcctgtaatcccagctacatgggaggctgaggcaggagaatcacttgaacccaggatgtggaggttgcagtgagctgagattgagccactacactccagcgtgggcgacagaaagaagagtgtgcaaagacttaaaggaggtggggggagtaagccaaacagatagagggaaaaagcattccaggcgcagccacagccatgtcctaagaatcatgcaatgcgttggaggagctgcaaggaggctggtgagtctgggtggagtgagcaagaggagtagaaagaaatgcagtgcgagaggcatcaatacctggggctgttcctggagcaccttatatactgtgaggactgcttttcactaggagttagagagcacttttgggttggggttttttttaatgtttttattgagctaaaatttacataccatacaagtcacccatttgaagtgtaaaattcagtggtttttagtatattcacagatatattcaactattaccacagtcaattttagaacattttcattggctgggcgtggtggctcacacctgtaatcccagcactttgggaggctgaggcgggtggatcacctgaggtcaggagtttgagaccagcctggccaacatggtgaagccccatttgtactacaaatacaaaaattagccaggcatggtggcacgcacctgtaatcccagctactcagggggctgaggcaggagaattgcttgaacccaggaggcggaggttgcatcacgccattacactccagcctgggcaacaagagcgaaactccttctcaaaaaaaaaaaaaaaaagcattttcattgtatccaaaaatccccctctccagccctaataaaccactaatctaacttctgtctctacaaatgtccccattctgagcattgcatgtgaatggaatcatataatatgtattcttttgtgactggcttctttcacttagcataatgttttcaagactcctccatgtgtaacatacatcagtactttattcctttttatgactgagtaatatttcactgtatgcatgtgccatgttttatttatccattcatcaattgatggacatttaggatgtttccatcctttggctattataagtaatgctgctataaacatttatgtacaagtttttgtgtgcgttaatagggttttaagcagagccatgacacctgacttacgttttaggaggatctatcaaagcaatgtgaattaagaaattatccaccaaaatgaacatttgcttattataaaaatgcaaatttctagatgtagttaaataaactatacccattattttattcacctgcaataaactgagccattattgtagttggttttctgaagcacatgatcctaccttgcaaataaacgagcatcttggtttggattttgagctggcctgccttagcacttcacaggtcaatcaatattaaagagttctagtccctgccagcagtaattgacacctttaagttagctgtgtgagctgagaggtcaagaacccaatccatatagatggaattgttatcgtaataggcaaaaatacctgtcttcatgggattcaggatagaagtagagggaaaaagggtggctaggtgaattcattagccaatagcgctgccattgcttgaacactatgtgaactttatttagtctccagttcttcttaaaacttttgacaaatagaaagacatatcctgctagaagatggcatgagagcaacaattctctcgctgccagattccctttcaagccaataataattactgtacatagtatattctttgtcatagtactagatccaactaagccctcattagctataaacctaaagaataattaatgatcccattttcaattattttccccataagtagcaaagacagatagtgctggcaaacaggtaaaggaaagtaggcattccccttgaccaagtaattcatgctcattgttaaaaggaaatgaggctgaacacggtggcttactcctgtaatcccagcactttgggaggccgaggcgggtggatcacgaggtctggagttcaagaccagcctggccaacgtagtgaaaccccatcgctactaaaaatacaaaaatcagtcagacgtggtggcgtgcacatgtagtcccagctactcaggaggctaaggcagaagaattgcttgaatctgggaggcagaggttacagtaagccgagatcgcgccactgcactccagcctgggtgagagaccaagactccgtcttggaaaaaaaaaatgaattataaaagtaaaaatcattcataataccacagctcagagctaatcactgttaatatgttggctttttttctttttttctttttttttttttttgagacagagtctcgccctgtcacccaggctggagtgcagtggcacaatcccgcctcactccaacccccctacctcccggatttaagtaattctcatgcctcagcctcccaagtagctgggactacaagcctgcagcatcacacctggctaattttttttttttttttttgtatttttagtagagatggggtttcaccatgttggccaggctggttttgaactcctgacctcaagtaatccgcctgccttgtcctcccaaagtgctgggattataggcataagccactgtgcccagccccttctaatatttttttaacctaaatgttttagaattttgtttatgttttgtttttaacataagatctatagagtttttttctttaatcatttgagaacattttcccatgttactaaaaagtctttaaaacaatcttaatggctatataattttatttttaaggatgggtctttatttaactattaccattggacatttaggttgtttacatttttttcaccagcatattcagctgcaagtttacttttattttttatttatttatttttttgcttttttaaatttttaattgacatgtaataattttacacatttattaggtacagagtaatattttgatacatgtatacaatgtatactgatcaaatcaggatatttagcataacagcacatcaaacatttatcatttctttgtattgggaacattcaaaatcttttttttctgtattggatatgtattttttattttttttactttttttatttattttttaatatatatatatttttattatactttaagttctagggtacatgtgcacaatgtgcaggtttgttacatatgtatacatgtgccatgttggtgtgctgcacccattaactcatcatttaaaaaatgacgagttcatgtcctttgtagggacatggatgaaactggaaaccatcattctgagcaaactatcgcaaggacaaaaaaccaaacaccgcatgttctcactcataggtgggaattgaacaatgagaacacttggacacaggaaggggaacatcacacactggggggaggggggagggatagcattaggagatatattttttattttttttatatttttaatcatttttgagatggagtctcctctgttgcccaggctagagtgcagtgatgtgatctcagctcactgtaacctccaccacccaggttcaaggaattctctgcctcagcctcccgagtagctgggattataggcgcctgccaccactcccagctaatttttgtatttttagtagagacgggctttcaccatcttggccagactggtcttgaactcctgaccttgtgatccacccgtctcagactcccaaagtggtgggattatagatatgagccactgcccctggccaagcttacatttttaatataaataatgcttcaataaacatcttacgtactgataaaacttggtccccatctcggtggggacaaaggtttaagataaacgtatagtgaggcagtctgaaatattgccagtagaaggataaattagtataactttcctagaaagcaatttagcattatatattctaaggtatgggattaatttcatggcttttgttgttgggtttttgttttgttttgtttttttgagacagagcctcactctgtcgcccatgctggagtgcagtggtgccatctcggctcactgcaagctccgcctcccaggttcacgccattgtcctgcctcagcctcccaagtagctgggactacaggcatctgccaccatgcctggctaatttttttttgtatttttagtagaaatggggtttcaccatgttagccaggatggtctcaatctcctgacctcgtgatccgccctcctcggcctcccaaagtgctgggattacaggcgtgagccaccacaccggcctgttttttgatttttaagaagctcttgctcaagtgatggaaatgttctatatcttgattgaggagttggttatacaactggatatatttggcaaactcatcaaagaatatccttgatatcagtgaattttattgtctatgagttatagctcaataaaaaaaatttatatgtagctgagcagaggtggcccatgcctgtaatcccagcactttgggaggctcaattgggaggatcatttgaggccaggggttcaagaacagcctgggcaacatagtgagactccatctccacaaaaaacgttaaaattagccaggcatcatggtacgcacctgtaatcatagctacaggtaagacaaagcactgtagtaccaaactgacattttctccttcaaatgttcagaaagataaaaaagataatttaaaatggaatagtttctcactgcataattcaatgttatttaatgccatgccccagaaccacctgatgtcaactgatgttatgactcacacactttgaggaaaactgggctattacaattcctaaagcaacgggtatgatgataatttggtaaaacacttaaccaaattttaaagacagtacaacaaaatgtaaaatatctcagtacttttttaagttgattacatgctgaaagataatattttggatatatgggttaaataaaatacactactaaaattaattttacctgtttcattttacttttttaatgtggccacgagaacatttgtgacttgcactgctttatccatttaattttgttaattctcataatgactcagtgaagcagattttttttttttttgaaacagggtctcgctctgttgcccaggctggagtgcagtggcacacacacagctcactgtgacattgatctgggttcaagcagtcctaccacttcagcctcacaagtagcttgtgctaactttttatttttttctagagacagggtcttgctatgttgtccagactggtctcaaactcctgggctcaaacaaacctcccaacttggcctcccaaattgctgggattactggcatgagccaccacacccagccaaggtagatatttttataattgttatcaacttcctttttcagatgaggaaatcaaagtagagagaagttaagtaccttgtccaaagtcataaagctagtaagtggtaaacctggaattgggcacagtctgtttccagtatgagtacctaagcactcagttgaaataatattttggaatatttatctagctatgatatttttaaatcctttgtttataaatgtcacctataagataggcaaaatatgtttttatcaaatggataatatgtgaagctttcagactactaagaaatattgtaaaccaaagctggggaaaaaataatacagaactgagggatcatttacttttattttaagaattttatcattcaatgatgattaaaaatgagatttaagagacagtgttgctctttgagtaaaaatgactaacttggccaggcatggtgactcacacctgtaatcccacactttgggaggccggggcgggcagattgcttgagttcaggagttcaagaccagcctgggcaacatggtgagaccctgtctctaccaaaaatacaaaaaaatagctgggcgtgatggtgcgtgcctgtggtcccagctactcgggaggctaagatgggaggatagcttgagcccagggggcagaggttgcagtgagtcaagttcgcgccactgcactccagcctgggtaacagaatgggacccttgtcttaaaaaaaaaaaaaaaaaagaaaattaacttgattaattagtggaagcttttagtttcataactatctgaaatgatgcctaagtgttataataatttaactttgacatggagtaagtgaaattaatactttttgtagtgaatacagctaagggcctaaaaaatagttggcatcttgaatttctatacataagtttgaggctggtagggggctgattcaatttgtgttatcaacaggtactttatagatttccacctaaacaagtaacactagaaacttggaccttctcctgtaaccaccagtaggttcaatctctgaattatttacagaaaaattaggatactatgacagaatttgcatttcaaagaggcaggaacccagaggggacttctcttcactacggacgtttcaggataagttttgaaactttcccaaagagattttctttcttttttttttttcagtgagacagagtctcgctctgtcgcccaggctggagtgcagtggcacgatctcggctcactgcaacctccgcctcccgggttcaagcgattctcctgccacaaagtcccaagtagctaggactacaagtgcgtgccaccacgcctggctaattatttttgtatttttagtagagatggggtttcaccgtgttagccaggatggtcttgatctcctgatctcgtgatctgcccacctcagactcccaaagtgctgggattacaggcgtgagccactgcatccggcaaagagattttctttgacagcttattttcctccagtgaccaaaggattagacatcattgcaagagttgtgatggagtgtgtcgcctgtcactgacaagcatttattgagtgctgattatgtgtaatgttctgtgcacggtgctagaaagatgaagacatgttctgtatctttaaggatctcaatgtctaataggaaaataaacatataaatgaacaactctaataagatgcctttttaaaagttgaatttaacccaggattcaaatttaggcatgtcccttgattccaatttgtttgtgcactgtaacgtatattttttaattaaaaaaatagcttttcattttacctctgaattgtgtgtaaaaaagaaatttaaaaaagaaaaatatcttttcattacaaaatcaatatataattcctgtaggaaaaaaaatttaatacagctaagcaaaaaaatagccatactgccaccatagggaatgttgtcagccttttagatcttttgctatgaatgtatacacattttttttaattttatttatttatttatttatttgagacggagtcttgctctgtcacccaggctggagtgcagtgacaccacctcggctcactgcaacgcccgcctcccaggttcaagcgattctcctgcctcagcctcccgagtagctgggactacacgctaccacacccaaataatttttgtagttttagtagagacagatttcaccatgttggccaggctggtctcaaagtcctgacctcaagtgatccacctgcctcagcctcccaaagtcctgggattacaggcatgagccaccacgcctggccaattttttttttttttttaagatggggtcttgctctgtcacccaggctggaatgcagtggtgtgatcatagttcactgtaacctcaaactcttgggctcaagcagtcctcccacctcagcctcccaagtatctaggactatgggccaccaagcctggctatctatctgtctaatctatctatctatctatttatttgagatggagtctcaaatatattgcccagtctggtattgaactcctggcctcaagagatcctgcagcctcggtctcccaaagtgctgggattataggcatgagccactgtgcccagcacacatatatatctatatataatacacacacacactttttttttttttttttttttttgagagacaaggccttgctctgttgccaggctggagtgcagtgatgtgatcttggttcactacaacctcctcctcccgggcttaagccatcctcccgagtagctgggactacacgtgtgtaccaccatgcccaactaatttttatattttttgtagagagagggtttcaccatgttacagcctaggctggtctcagactcctgggctcaagtgatctgcctgcctcagcctcccaaagtgctgagattataggcataaaccaccacaccaggcctagcccacatatatttttaaataaaaggaaacatactctacatgtgctttcaatgaaaatgcttatctatatcatttttaataactgaattatattctattaagtgtagcacaatttcatcaatcctcaattttttgttcattcaacaaatacttagtgagcacctactatattacaggggttaccttgagactggaatatagtggtgagcaaaacaaatattgtttgatattgtttgcagtttttcactcttataaacagtactgtaataaacatcattttacatacatctttaaacacttattcaattgttgacttggaataataataattgaatatatactatgtgccaggcagttggttgacttcattacatatattatctcatttaatcttcatgatccaagaagtgagatcattatgatctcaattttcaaacgaagaaataggaacatagagaaattaagtaatttgctttaagtcatatagcagggaaatacagagctggaactcaagctcagatttgtgtgatgctggattccatgcactgctggcaatgttggttaggcatcagagggtgtaagcgtttttaagatgcaaaattactaaactgccggccagaaaaattttattatacctgtatagtatatacacataatagtgtgtttatatcttcacatcatgcccgtgccaaccctgaggttagctgctgctgattcttaaaaataaaatttaggctgggcatggtggctcacacttgcattcccaacactttgggaagccgaggcaggtggattgcctgaggtcaggagtttgaaaccagcctggccaacgtggtgacaccccatctctactataaatacaaaaattagctgggtgtggtggcgggcgcctgtaatccagatactcaggaggctgaggcaggagaatcatcgcttgaacctgggaggcagaggttgcagtgagacaagatcgcaccattgcactccagcctgggcaacaagagcgaaactccatctcaaaaaaataaaaataaggtaaaataaaatttaaaaattatcagctaggcacagtggcacatgcgtataatcccgatgctttcagaggtcgagacaggagaatcacttgaggccaggagttcgagaccaatctgggcaacaaagcccagactcttttttttgtctctaaaaaaaaaaaaaaaaaaagtatttttagccatgcatgatggcatgcacctgtagtcccagctacttgggagactcaggcaggaagatcacttgagcccaggagttaaaggttacagtgagctatgatcacgccactgcactccagcctgtgtgacagagcaagactatgtctcaataagtaaataaataaaaattatcaatgtgtatggagaaggtcagttaaaaagcagtttacttcaacccagatgcagagaaagaaggaagaaacagattaatagtgtgaagcttaaagaagagaccaatgaataaatgagaaagaaatggaggcaagagtcagcaaggtagatgttatctagtttcaaagcagccttccagttccagattccagggttttatgaagcaatgatcttcttacattaagtcagtgacagacacccctgccctgtcaatgccatataataatcatttttcttttgtgtaagctactttgaatgggtttgtttcctgcagccagaatgttgagttatgggaaaaagttattctctctcacaagtttgtaggatatgcctttttgtgtcatgtggaagatccaatacagatttgcatatttgtttcaggacttgtgtaaaactaaaaagttaaaaatgtaaggaaaaactcaaacatgcttaactctgtatagtgagacagaagtgacctgtttacctcattatttccagtattatctatatttctgttttcatgatcaaaaaatattaaaatgttctaccaattttaaagagccatcaatttgatgccactggaattatttaaataataaagtgtccagttgattatattcaacacagccctgagttccattcctctgacaaaaccatacagtattaccttccccaaataaatgatgcatccttcagcacatatgttctttcactaggattatcattagagcttctgagcctaagtggaacctgttacttataaatcaccttttagtaccctttggtcttgttcgaagcagtgtaacataccaattaagagtatgggtttcagtgccagactaccttgtttaaattccagttttgccacatattcacttgtatgatctgagacaaatcatttagcctctttctgcctcagctttttcagctgtaaaatggaggtattaatagctccttcataccattgttgtgatgattagatgattaatatttgtaaaatgcttagaggtgatctggcagagggtaagcactcaatggatgttacctgctgttgctgttattactgttacattttggggagataaagtaaaacagactttgggtattcattatcaccacctctgtcatcacccttacttccaaataagttgtcttaaaaccctttaccataattcaaaggcagaattatattattattccaagtggaaatatactgaggcagtgataaaatgtactatgaagatagtccgatgtcagatgactttgcagtctgtgagaagaaaaatctttagtagttccatttccatttgtgttcacttaaaatttctcctttggggccccccagagtcagtaccactataattaaaagatgaaggccaggcgtggtggctcacgcctgtaatatcagcactttgggaggctgaggtgtatggatcacctgaggtcaggagttcgagaccagcctggccaacatggtgaaaccccatctctactaaaaaaaaatacaaaaattagccgggcgtggtggtgggcgcctgtaatcccagctgttcgggaggctgaggcaggagaatcctttgaaccagggaggtggaggttgcagtgagctgagattgtgccactgcactccagcctgggcaacagagcgagactccatctcaaaaaaataaagaagacttgcaaagagtcttcagcattcatggttgctacagctgggctatttggggcttcgtttcttgcattttttaatagtgttcaccatgctgcccctgtagttgtggttgttctgacacattgatgtgggcttgaatgttcccatacatctacacctctttttattctcagatgataactacctttcagatatgttctcagatgataaccacctttcagatctctgagttctgtccttgaggagtccatttttaaccctgtggacgatgagggtaattttttcctttctcttcgcatgacattccagtgaatgacacaaacagtgctagatccatgcagaatctcattgtttgcttttcttgctgtttcttctcaataagagaggaaatagtgccaagggctcctgtttgcttctttgttttgttttgttttgtttcatttcataaatcaggtggccagtactaaggagggaattccgaaggaatagctacattttttaataggcaattatatcatttgtaagaaagtgtcatagggtaaaataaccccagtggaattagttagaatcaaggaaatatcttatactttaattcagtgtattccaagacttattatatagaaaatttatttgaggagatattgataggtattccatttttaaaagggttctatagccaactaagtttggaaaacactctatccttctcttgaaaagtcaaaactcatattagcatattaaagattctgagaaaatctagggtaaagaaacccacttcacttttgtgttttttaattgtattttaatataatatttgataaaatatatgtagcatgtaagttagaaagcataatataataaatacgcttgagcctttcacctaacccaaggactagaaaattgccagtaacatagatgtatccatgtgttcctctccaattacatcccttatctccctacagcaggtaagtgctaacctagattttgtatttaattcccttgctttggtggaagaagattgtgtttttagcacttacctatgtatttctaaataacacattgtttagttttgcttgtttttgagctttataaaaatagtatcatacttttttcattaaactttgcttctaagattcatctgtattgttgcaggtaacctcaatcatttttcagtgctgtgtaacattccattatgtgaacataccacagtttacttttccattcacctgtccatagacgtgaggttttttgttatattttttattattactattgctcctctcaaggagaaacaagaagaaaatgtgagctaagaatattgacagaatattatgattatattgtttgggagcattaaggagtatatttattgagtggctgcctttactattcaaggcaggaactaaaacacaaacataaataaaacatccctgtcttcaatgatcttatggtccagtggaggagtcaaacaaattctgtatttttcatattaggatatgattagtctcaaagactaatggcacaaaataaacatgacacatcttttgaagtgcccagtttcttataatcagggggatgtgcaggggtagaattaaataatttaactgataagtaccttaaaatatgtttgtgtcaaaatttaaaaggtccttttatgaaaaataatataaaattattatgcatttttattttttattttatttatttattttttatgacagagtctcacacttgtcacccaggctggagtgcaatggcgtgatctcggctcactacaacctccgcctcccaggttcaagtgattctctagccttagcctccccaatagctgggattacaggtgcctaccaccacacctggctaatttttgtatttgttttagtagagacagggtttcaccaagttggccaggctggtcgcgaactcctgacctcacgtgatccaccctcctcggcctcccaaagtgctgggataacaggcatgagtcactgggcctggccagttatgcatttttaaaacaaaatactgaaagtcaaagaaagatgtaagctgatataccaatctggactacacccttaggactcataattcatttgcttctttttgtcctctgtcgcccaggctagagtgcagtggtgtgatctcagctcactgcaacctccgcctcctaggttcaagcaattctgcctcacccccctgggtagctgggattacaggcacatgtcatcccacctggctaatttttgtatttttagtagaaatggggtttcatcatgttggccaggctggttttgaactcctgacctcaggtgatctgcctgcctcagcctcccaaagtgctgggattacaggcatgaaccaccacgcctagccctgcttcttcctaggtataaaaatttgaggccgggtgcagtggttcatgcctgtaatcccagcaccttgggaggccaaggcgggtggatcacctgaggtcaggtgttcaagaccagcttgaccaacacggcaaaaccccatctctactaaaaatacaaaaattagccaggcatggtggtgcatgcctgtaatcccagctactagcagggctgaggcaggaggattgcttgaacctgggaggcagggattgcagtgagccgagatcgtcccactgcactccagcttgggcaacagagtgagactctgtctcaaaaaaaaaaaaaaaaaaaatttgaggccgggtgcggtggttcacacctgtaatctcggcactttgggaggccgaggcgggtggatcacctgaggtcaggagttcaagaccagcctggccaacatggtgaaaccccgtctctactaaaaaatacaaaaattagctgggcatggtggtggactcctgtaatcccagctattgaggaggctaaggcaagagaattgcttgaactcaggaggtggaggttgcagcgagccaagatcgcaccactgcactccagcctggacaacgagagcgaaactccatctcaaacaaacaaacaaaaaaaattgaaaagtgttcatgtacagaagttaaacaaaatgtatcctaaatataaataattaattctgacagagtaactaggaaatgcctcacagaggagctggtttttgaactagaccataaaggataagtaggatttccataggaagaaagagcagtcaaggctgaggaaaagcatgattaaggacaggagcaagatttaaaaaaaaaaaaaaaaaaggtgtaccacatttgagaaataatgagaagttcttcataagtaaagtctatctccagtgaggggcaggatgatctctgtgtgtgagatgcctggtatttccagatgtagatttgtttgtttgttttgagacagggtctcaccctatcacccaggctggagtgcagtggtgccatctcggctcactgcagcctccacctcccaggttcaagcgattctccagcctgagcctcccaaatagctgggaccacaggtgcatgctaccacacccagctaatttttgtatttttttgtagagacggggattcaccatgtttcccaggctggtctcgagctcctgaactcaaagtgatccacctgccttggcctcccaaagtgcagggattacaggtgtgagccaccacacccagcctcagatgtagatgttgaatgccaacctattcccttgctcctgataaaactgctgttggatatttagaaaaagtttagcacactaggtgacatttaagctggggtcttcttttaaaaatctgtatctgaatcatgttcatttggcaaacaattcatccactttatactaaggatgaagaaagtaatactcaagatgtgcactaactagtaagacaaaccattagaagagaattaggaggaagaaaacccgctcactgccttctgtcctgtcataggggatgaatgctcctagctggggctagctcttccacttgggcaccagagcccatctacctcacctacaccgggatatctctccaaactcccctttctttcccaaatcattttttcccacctgttgtattattcatagaagcatagaaatatcctgctatgctgggcacagtggctcacgcctgtaatcctagcacttttggaggctgaggtgggcagattgcctgagctcagcagtttgagaccagcctgggcaacacagtgaaacctcatctctactaaaatataaaaaattagccaggcatggcggcgtatttctgtagtcccagctactcaggaggctgaggcaggagaattgcttgaacccgggaggtggaggttgcagtgagccgagattgtgccactgcactccagcctaggcgacagagtgagactccgtctccaaaaaaaaaaaaaaaaaaaaacagtttgaaatatcctgctatgttctgcatctttaaaagccctctcttaacccccttactctttctaggctccatctcatttctgtgttctctttcatgggaaaattctccaagagttgtttacactcactgtctctaattccttccctcacatattctcttaaatccacatattctcctcaactactgcattcaggccttcactcccatcactctaaaatcgctgttgtcagggtccctagggacctccacatagctaaacatagagtcaactttcagtcctcattttgcttgacctatcagcagcatctgacgcagttcccttacttatttttttaaaaaaaatagagatgaggtattgctatgttgcgcaggctggtcgttgttatcacttagcttccaggaactatactgtcttggtcgtcctacctcactggccattccttctctgtctcatttgctgtttctcctatttttggaatccctgggacttggccacctcattcagtctcacggctttaagttgtatgtctcgactactaactcccagatttatatttctagtcctgagtttcattattgctatttggaggcagataatctgttgttgtggaggactgtcctttgcattatagatgttcagcaacattcctggcctatacccatgagaaaccagcagcactccaccagttatgacgaggaaaaacatctccagactctgccaaatgtcccctgagactaaaatcacactcctcaccccattgagaaccagtgtttcttgtccgaacttctcccccaaactctggacttgtatatccactgtctttttgacatctctacttgaatgtctaataaatattcatacttaacgtgatcaaaaccaaacttctgatctttgttgctcaatataatcctccctccgacttcccacctcagtggcacatccattcctttagttgcttaggcaaaaaaaaacttggcattttcttgaatctcctctttatctcacacctacatcctgacttatcaataagtcctgagagctttaccttcaaaatacacccagaatctaatgccctttcaccactactgctctggtccatgccaccgtcacttcccactgggattactgcagctgctttactcttgtcccccaacacccccttctcaatatagtagtagggtgatcttgtgaaaatgtgtcattcagggtatgtcacatctttttgcagaaccctccagatgtctctcatcttacccaaagtaaaaaccaaaattcttacaatgacatgccaggccttatatggtctctccttatagcccgctctacccattccttacctctccaatctcacctcttactatccaacaccttattcacttcactctagccacactaaccttctttctgttccttaaacatacagagccttgatccctttgcacttgctctttcccagatacatgctctgttgcctcattcaggtcttgactcaaatgtcagtttctcagggaggccttccttgggtactagtttttgtttttgttttggggggatgttttttatggtagcattttattcctcttcaagaaaagctattacctaacattgatgaactctctttttttttgagacagagtctcactctgtcacccatgctggggtgcaatgggatgatcatagctcactgcagtctctaaatcctgggctcatgctcaagtgatctttccacctcagcttcctgaggagctgggactacaggtgtgcaccacaatgcttggctaatttttaaaattttttgtagagggtcttgctatgttgtccaggctggtcttgaactcctggactcaagcaataggattaaaaatatcctcctgtttcggcctaccagagttctgggattataggcgtgagccaccatgggcagccagtcactagttttattttatttttgttgttgttgttgttgttgttttgagatggagtcttgctttggtgcccagcctggagtgctgtggtgcaatctcagctcactgtaacctccgcctcccaggttcaaacgattcttgtgcctcagcctcccaagtagctgagattacaggcatgcaccaccacgcctggctaatttttgtatttttagtagagacagggtttcaccatgttggtcaagctgatctgaaactcgtgacctcaagtgacctcaagtgatcctcccgccttggcctcccaaagtgctgggattacaggcgtgagccaccgcacccagcccagtcactagttttaaaatctcacaccactaccatctccaatactccttttttaaacctgctttatcttttcccatagtatttcttcatctaacatattacaaagaggcagtatagcattatagttaagaagacaaactgaagccagattgcctgggattatatcccaattccatcacttctggtgtgtgtgtgtgtgtgtgtgtgtgtgtgtgtgtgtgtgtgtgtgtgtgtgtgtgtatttaaagtggaatggtttctgtccattagagcagtactttgcatatagtaatatgtgtacaccattattattgtattattattattaactactaattaattttattttccttctctcccattggaatataaattccatgagagcagaggggtttttttttactttcttcattgctgtattcacagcttctagaacagtgcctagcacatagtagacactcagtaaatatttgttgatcaaattatgttatttctggagtgatgaggataaggagggtcaaggaagacaaggtatatgtttagaacttttacaaagagaatgtactcatgtatccttgtgcccctaaaagcttcataagcttgcatggaaaatggacatacagacaaataaattacaacacagtatatttacaagatatggaagaatgagtacgtaactctaaggggaaagcaatgcagttgaggaaagcttcctagaggagtaataatgtgagagttgggtttttaaagatgcatagttccaccaaacaaagtgtgagatggatgggacagcctttgaatagcaggtgcaaaagcaaagaggtatgaaacatagcagtggctctgaaaactgcaagccgtggaagttgagaggtgaggagcattttcagtgttttaagctattaataatttcatcttatccttctgccttacccactcccatactcctaacttctccaagtaagtgtttggctgtaattaggagcttattactccattaagacaaatatcttggggtttttctcattattttcctgaaagtctttttctatttttctgctccccacaagttctatttttttaattattataacactattcaggttctagattccccttggtgtctttggtataagaaattcacatgtaatttttacctgtggagtatagtgaaaaaggaggaagacatatccttaaattatatacacatacacacacatagtttttgttacagtatgatagctttgtttaggaatagaaacacagttgttcagctgaattattttagtaattaatatttttaatcctataaacattggtctctagtcccttaccagtgatgtaagtggagaagcttgcttttcagtgtgtgactcaagacttctcaaggttgactttttaaaatcagggttggggttctgcttttttccacccaccttccttctatacatggagtcaggaaaacacccttgatgacagcacaaactaaaaaaagcagtagcattaatccactctgttagtttctggcactgcctctgtttatactcatattggattgtgattgtgtatctgtctctgagagtcccttaaggtaggaatcataactaaggtgtacatttgtacacctagttcaacacctagttcataatggatgctcattaaacatttgttgaattggattgaattgaactgaattgaactggactatggcaccaacggagaaggggatttttgagtttgcttttaagtgagattgatttaaaatgaatttagaaagaaaaattattctttttgttttgtttttaaacatagtctaaatttggggtacagctagcaatatgttcattcgccataattttttaagcattctgagcaatgactcattagagtccccaaatagtttttttttaagtcatagtggccctaggaaacaaaattaggctggtaaatataaatagtaagtgtgttctcattatagtcaggaatgtggggtcttgttgatatacagaggaggatctttatttcttccctttgtagcagagttggaaatgaaccaaagatcccctgataaaattcctatagggcttcccagcacatttatttcattctttctagaagtcatcaagacttattgtgttattgttcaaaaaaaaatcagtgctacctcatttcctaacacttgttttctgacctccaattgtgtctagtccaactggccaaaaagccaggccaaagatgtctgtatttccatagaggaacaaatgaacttagcttctactcctttccctctactttgcaattttttcttttgcaaaggagtttggaatttaaattctccaagcccagaatctttcaatgcaagatggtaataaaactgcaaaacaatggtaataactggtcattcctccagtcctctgtcttttaaatatctgtctgctctgagagagagtcctgagcatccaaataacttgttgttgttgctgttgttgttgttgagacagggtttcactcctgtcgcccaggttggagtgcaatggcacaatcttggctcactgcaacctctgcctccaggctcaagcaattcttctgccttagcctcccaagtagctgggactacaggcacctgtctaatttttgtattttttatagagatggggtttcactatgttcccctgcctggtttcgaactcctgggctcaagcgatccacccgcctcagcctcccaaagtgctgggattacagcgtaagccactgcacccgtccatccaaataacttttatattataaagaaggctgtcttgccaatgggtagctattttattcatttactcagcataactttattggatacctctgtgttaagccctggagatctaaggtgagtaagacttccccctacctcccaagaagctcacagtctgtcttggcaacaattatacagtgctaagataggagtgggataaagtaataacagtaattagttcagcatggaggggtctggaagggctttacagaaaaagtgacttttatgtttatgtatttatgtatgtatgtatgaatgagaccatgcctggccagaaaagtgacttttaatccttagtcttgaagaataaggttcttgccaggcgcagtggctcacgcttgtaatcccagcactttgggaggctgaagcaggcagatcacttgaggccaggaatttgagaccagcctggccaacatggtgaaacccgtctctactaaaactacaaaaattagccagcatggtagtatatgcctgtaatcccacctaatcgggaggctgagggaggagaatcgtttgaacctgggaggcagaagttgcagtgagctgagattgtgccagtgcactccagcctgggcaacagagcaagactccgtctcaaaaaaaaaaaaaagatttcagcagagaaagaatagtcaaacataggacatagtaagaataactacttgaggtaggaaagctcatgacgtgtttaggaacagtgagtagttgggcatggatggcatagaggctgcactctgagagatggaacagacaagtgggaagcagtattgcaagatgctgaaaggcacagaatctagagcctggatctgaatcccagctgagccacttactagctgttgtgaccttggcaagtcacttaacctcccctctatagctttgtttcttcgttttttaaaatgaggataatagtagcatctgtttgacagggccgcatgcatatatgcatatatacacacacatggctttaaacggtgctcagaacaaaatgaatataagtattctttattagggcacattatgaaaggccttgaactgtacattttccataagtaaaagaaaggttttaaagcagaagaagggagagtatacaacaggatataatctgtattttgttttattttttaatttttttttttattagagacagggtcttgctctgttgcccaggttggtctcaaactcctgggctcgagcaatccacccgcctcagccttctaaagtgctagcattacaggcctgagccaccgcgcctgcctgtaatctgcattttagaaaagtaactctggtgccactctggagagtagattggataagaaagaaactatagacaacatacaagctctgagacagtttcaagagtacagataacaggtgctgatgtaacatggtactgagttaatatagtggccttgcccttaaaaattctgggatcctaaatagaaacttcaaacttgaaatgttagtcttaatagatcttacaaatttaattctaaaaaaaaaaatgaagaccctggggaagagcacagaaggactgtccttgcagtatggatgttgtagtgctcaactgatgcttccattctatacccaaatatcagaccagtacctcctgcctactattcatgatatattttcatctggttagatgtccagagcaagacattctatttttggagatgcttttgttttttccttcaagtaacctcaaactacttatcagtttcctagaggaagttctggcttctggactgcacagccgaagcaaggagagctctcaagtcacatcaaggtcagcgagcagaagatgaaacggtggttgggggaagggcacagcttcctctcttgtccccactacaggttttccctactaaacaaaggtgttggagagcagctttgggttctgtgctggttgttagaactcatctccaggtagcccacggatacgtggttggcacagacacaagactcccagagttgtcctaacaataagtctgagcccatctcaacccacttttctccggtagtctttatgtatctgttagcacaatcacttcagttactgatgaattttgttgggatctgacttggggaaagggttatcagagcctagaggggcttaaaaagtaatcatttgatgtacataccacactccttggcttcctttctcttcccttaaccctttctgcttttcattaaccacattcctgcacaactcatttctgaaaacctaccatgtttctttacagagccatccaaaaattttttgtccctacatagcaattttctgtggcactgagaaaccatgtatgaccacaataaaaatccattttgtgaaagga

SEQ ID NO: 2159 - DNA, 7632 bp, Homo sapiens
  source 1..7632: mol_type = genomic DNA
tcctcttcttaccctgcacccagagcctcgccagagaagacaagggcagaaagcaccatgagtgggggcccaatgggaggaaggcccgggggccgaggagcaccagcggttcagcagaacataccctccaccctcctccaggaccacgagaaccagcgactctttgagatgcttggacgaaaatgcttggtgagctggggatctcctgcccccgccccgtccccaccgtttcttcctcttcctctcctccttctctctcttcccctcctcccgctcctcctttccctctccatcatctcctctcctagaatttcccgtcataatccacccttcccaggaagatctcaatgtctacttgccttccctctggctgcagctcttcctttgggcccatgactgtcatgaggcaggaaggaccaggtctggctccaagaccttgtggctacccctgaccagactccactgacccctgctttcctctcccagacgctggccactgcagttgttcagctgtacctggcgctgccccctggagctgagcactggaccaaggagcattgtggggctgtgtgcttcgtgaaggataacccccagaagtcctacttcatccgcctttacggccttcaggtgacccccccacccccgactggacttgcaagccagttctcaacccgcaaacccagatctgtgtccatatgtgtccatagcttcaagacctcagacctgatcagtgaatccctgagccccagaaccaaagactcatccagatggcaaactctgacttgcctttctaagtctgcaatgactggccccagtctccgtatcaagatctctaaagcccccagtattagtctgctgcctaagcctaatcttttccacaaattccaataaatgagcactgtatttgtacctgaacctcaaatctattctaaactcaacattttgcatcccaggaatctctcatcaaaactcctgaaccccagatgtttgccaagctcctaagtcataaatctgttcaacaaaccccaaagttgaatattccattgatccttgaactccaaatctgtccttctaaatccacagcacagaccccagagttcccatattaaaattcctgaacactcaaataccgaggtagttcttaagcaaaaagtcttttccacaatcccctgacctgaactttctaggtttaagccccaaattcatccttttaaacccataaagatggacccagcataacttccagatcccaaggctatcaaatatccaccaaactcctaaaccataactctctccacaaaccccaaattgcacttactttagctggactccccgcgaaactcccaagtctatgtgtctgaacttcaaatctcaactccaacccccaaatactagaatcctacctgtcatgaattggggctggggtggtgggggagggcatggattgaatctgtgaatgagcctcaacttcctaagactagagtcctaaattatgaaattcaagcccccaagtcccagatctagggccccaaaccccaaatccaaacctctcacaaaagtgtatggctcccagactataccccacaatccacacccttagacaccaactctctggtgctgagctgaaaatctccaaaccagactatgaggctcccaaatccagacaccctgctccctgcccagctaacaaaagcctgccacccccggcgtgcctcagtgccactgtgcctcccaccctacacctctccaggctggtcggctgctctgggaacaggagctgtactcacagcttgtctactccacccccacccccttcttccacaccttcgctggagatgtaagtgatcaaccagccctcgggcctcacttggggtgtggagaggagatgggaaagttgcgggggacctgggaggcggctgaccccaaggtatgtgcaggactgccaagcggggctgaactttgcagacgaggacgaggcccaggccttccgggccctcgtgcaggagaagatacaaaaaaggaatcagaggcaaagtggaggtgaggaggccacaggggaggaaaggaagttgggcagaggtgagtgcaagcctggggaactagaaaagtcccctctcatggtcctggctcccaatccatctatccacagacagacgccagctacccccaccaccaacaccagccaatgaaggtgagtcctctagtgcaagtaggggtaataaggggctagcccaggaacctgtggcagggctgtgataactctctacacattccatcttcccagagagaagaggagggctcccacccctgcccctgcatccaggtggagaccaaggaggtgcgtgctgattcttccctgtgtctctggatggatgggtaagagtggatggaggaatgaggagttggatgggtgcgtaagtgggtgaatggataggtagattgataggtatgtggatggacgagcaggtgcatggatgtgtggactgatggatgggtggatggattggcggtagatggctgagtagagggatgaattgatgggaggatgaaagtctaagtagatagatgcataggtgaatgggtatgtggataaatgaatgaaaaggtagatggatgactgagtaaattaatcaatgagtgaatgaatgaacagtgaataaatgactaaatgacaagtttcagtcagtgaagaaagcatgattgaatgaataaatgagtaaatgaatattttaacaaattcattagtcaatgagccagtgaatgataaagcatgagggaatgaaaacatgaatgaatcagtgaatgtatgaatggtttgtgggatccacccacttctccatagaccctacttgaacccttcacccactacctccatgaccatccaacacacacacagatttccctcaaggcttccgtttcttgcccctgtgctttggttggttggtaagtgggtcaatgagccaaccaccctattttccccacaggccctccagtgggtccgctctccctggggctggcgacagtggacatccagaaccctgacatcacgagttcacgataccgtgggctcccagcacctggacctagcccagctgataagaaacgctcagggaagaagaagatcagcaaagctgatattggtgcacccagtggattcaagtgagagccactccccagtggacccacagattcctgggggcagaggggcacatgaacaagtggacagctgagtgaatggaaggatgggcagatgggcagatggctgggtggctgagtgggtaaatgggtggttggataggtaggtgcagggctgggtctagggagaggtaaataaggcaccaagggtacaaaatttaaggaggcactcactctcagaggcatgcaactgtaattcctgactctcagagtgagtgactcacttaaattttgcaccctaggcaccttacttgcctcaccctgggcccactctgggtgggctgttaggagagcaggtgggtgggcaggtgaacaaatggatagatagatgaggtagatgatggatgagaagggctggtgggtaggtgggtgagtggatgggtggatggatggataaatgaatggatgaatgaatgggttgaagaatgaatggataagtggttggatggacaagtttatgggtggatgggttgatgggaggtgcgtggatagatagatgggtgagtggataggtgtgtggacagattgatatgcaggctgattggctcacagacaaggtggatggggatggacaggtggacagatacgtggatgaatggacagttcaatggataagtgaacagaagtgtgtggttgcatgggtagaaaaatgagtggatggatagatggaaaggtgggcacatgggtaggtggatgggtggatggacaagtgtgtgtgaggacagactggtggacaaatgggtgaacagacatatgtgggcagatagttgcagagacagatgtatggacagatcagtagtccaacagatgaatgtgaatgaataggtggacaaatgcatgggatagatggggaaagagggatgggtggatggatcagcaccacaaactatggagcccttctaattccataactcctgcctatactcattcactcattcagtctcattcattaattctggcccctcagagtctctttgggcaggagagggcaagagggtttcactatgaagggagggaaggaagggcagtgaggattcactggagtctcttcacctctcccaggcatgtcagccacgtggggtgggacccccagaatggatttgacgtgagtaacttcagagtctcttggactccactaaacttccacccacccttccaaagaccactgctgagaccccacccccagatcgtgcccttcccacacccctctcagatcccttgctgggatggacccaacgacaatccatgtcgcttgtctcctcgccttattcctctactcctgcccctggcctttttcctcctgggcaggtgaacaacctcgacccagatctgcggagtctgttctccagggcaggaatcagcgaggcccagctcaccgacgccgagacctctaaacttatctacgacttcattgaggaccagggtgggctggaggctgtgcggcaggagatgaggcgccagggtgagaccctgcttccatacgctcccttctctagcccaagcagctcatagctaagatacgcactaagtcactcagtccttatgggagcacctatactgcttcagtcaggagttggtcagtgggggtacccattttacaaatgagcaaaactgaggctcagaagaaatcaatgagagttacagctatgtgttataccccctccacagagccacttccgccgcccccaccgccatctcgaggagggaaccagctcccccggccccctattgtggggggtaacaagggtcgttctggtccactgccccctgtacctttggggattgccccacccccaccaacaccccggggacccccacccccaggccgagggggccctccaccaccaccccctccagctactggacgttctggaccactgccccctccaccccctggagctggtgggccacccatgccaccaccaccgccaccaccgccaccgccgcccagctccgggaatggaccagcccctcccccactccctcctgctctggtgcctgccgggggcctggcccctggtgggggtcggggagcgcttttggatcaaatccggcagggaattcagctgaacaaggtgaggacaggcaggatggaggattgggggtctaggactctggggtgtcccgtctaagtcaggatactggggggctgaggccaggactgaggagagtgccaggccttagggattcagtgatagggttgaaaggttggtgggaagccttgaaggggactggagtgtgtgggagagaaaatattgatggaggggcggggagaaatgctcctttcccaggccctaagccctctgtgctgatccctgcctgctgcagacccctggggccccagagagctcagcgctgcagccaccacctcagagctcagagggactggtgggggccctgatgcacgtgatgcagaagagaagcagagccatccactcctccggtgagctgatcctgccggggcctcaaacctggctcccagggctagcactggcctcaaaacaatcccagcagtcaccaccaatagtgacatcagccccatctgtttgacagcattaacatgaatcttgtgtcagcctcgtttttgacaatgttaacattaagtcattatgtgacaataatataattaactccaactttgacagtaatattaacattaatgccagggtgtgtccacaatattaatgtcattcccacatgttcagtactactaacatcagctggccgggcgcggtggctcatgcctgtaatccaggaactttgggaggctaaggcaggaggatcacttgagcccaggagttcgagaccagcctgggcaatatagtgagacctcgtttccataaaaactaaattcaaaaaaagtagtcaagcatagtggtgtgtgcctgtggtcccagctacttgggaggctgaggtgggaggattgcttgaccctgggaggtcaaggcagcagtgatccatgattgtgccactgcactccagcctgggtgacagagatcctatctcaaaaaaaaaaaaaattaacccattatgtgatgacaatattatgaagaacactattgttgacaatattaattttaattccatgtattaacagatttacattaattcattatgacgtaacctaatctaatcttttaaaaaatttttttgaaacagggtctcgctctgtgtcccaggctggagtacagtggtgcaatcatggctcagtgcagcctcaacctcccaggctcaagcgatcctcccgcctcagctcccaaagtagctgggactacaggcgtgtgccaccatacctggctaatttttggtgtttttttggtagtgatgagctctcactaccaagctctcactactctcatgttgcccaggctgctctgcaactccagggctcaagcgatctgccccgcctcagcctcccagagtgctgggattacaggcatgagccaccaggcctggctgttaacctaatctttttataataatgttactattactctcttaatctgtcagcaatactgtcactaatccattatatgatgcaaatattagtatcaacctactataggaacttcatctttcgacaatgatttttttttttcttttgagacggagtcttgctctgtcacccaggctggagtgcagtggcgcgatcttggctaactgcagactctgcctcctgggttcaagcgattctcctgcctcagccttccgagtagctgggactacaggcacgccactacgcccagctaattttgatgttattgtcattaaccccattatgtgtcaaaaatattagcgttaaccagacaggaagcaataatatattatcacacctttgctaatattatttaaattcaccctattatgtgataaataggttaacattaaccctttgtttgacaatatctcgactaaccacatttttgacagcataaacttcaactccaactagaactcagaccccaactataatccctttcttgtcccaaatggaaactctaacttgccctcctctagcatgagacctcagaaccccagggtccagtcctcacctcccaggccctatgaagccccccaccaacctcccagggcatcttatctttctctttccctccagacgaaggggaggaccaggctggcgatgaagatgaagatgatgaatgggatgactgagtggctgagttacttgctgccctgtgctcctccccgcaggacatggctccccctccacctgctctgtgcccaccctccactctcctcttccaggcccccaaccccccatttcttccccaccaacccctccaatgctgttatccctgcctggtcctcacactcacccaacaatcccaaggccctttttatacaaaaattctcagttctcttcactcaaggatttttaaagaaaaataaaagaattgtctttctgtctctctataa

SEQ ID NO: 2160 - DNA, 16086 bp, Homo sapiens
  source 1..16086: mol_type = genomic DNA
ctgagactggacctgaggagacctcagcctcggtgctcgggccgccccgcctctgccggaaagtccgcgccgccgctgccgccaccgtccgcagcccgagcgccccggagccgcaggccgccgccgcgcagagacgccgcggctgcgactaggcgcgcccagccgcacgtggcggacccgcccccaggcccgcagtgtcctggaccccgcaggcctccgctctcctgtcctcggccccgtccccagggccgcgatgagcttcctgagccgacagcagccgccgccaccccgccgcgccggggcggcctgcaccttgcggcagaagctgatcttctcgccctgcagcgactgtgaggaggaggaagaagaggaggaggaggagggcagcggccacagcaccggggaggactcggcctttcaagagcccgactcgccgctgccgcccgcgcggagccccacggagcccgggcccgagcgccgccgctcgcccgggccggcccccggcagccccggcgagctggaggaggacctgttgctgcccggcgcctgcccgggcgcggacgaggcgggcggtggggcggagggcgactcgtgggaggaggagggcttcggctcctcgtcgccggtcaagtcgccggcggccccctacttcctgggtagctctttctcgccggtgcgctgcggcggcccaggagatgcgtcgccgcggggttgcggggcgcgccgggcgggcgaaggccgccgctcgccgcggccggaccacccgggcaccccgccacacaagaccttccgcaagctgcgactcttcgacaccccgcacacgcccaaggtgagagcggcgggcgcgggcacccggcggccggggccgcggcgccggaggggccagcgccgctgcctgggttcggttacagaagcggccggccgctcccccctcgctttcctgcgccgccccccaaagttggcagcccttgtgtttggccctgccccgaggttgtccgttgagattatgtaactgaacaatgggcctcgtctggaacttcatcttacaaaggggccgatcggcccgtccgggtggccaaggatttgccgcccgttgagtccgggccgccccgagcgtgtcagccccgagtgcggcaccgataacgcggttcgcgaggatgctggagggtgccggcccggccacctgacactcccgagccataggatgccttttaaacgcggcgatcgggcctgtaatttgggcggcgcgggcagaaggagtttaaagaaaaataattgtcccgccctgatcgtgtcgtgtcgtgtggcgtggatgggggaaaggtctggggcatgcagggagactacgcttggacttgggagtaaaggctggccttccaagcatttacagtcctacagactcatcctaagtccaggcagtactgaggcctgtttctggacaaggtcttggcccagcatttgtttttatcgtgggtttgcggtgcccagagtttggccggcctccgtgtgattaggaacatcctaccgtagataaggtatcttaaagaaggaggtgttcagcacctgtgttttgaaaggccttcgagtactgcgcagatgaccacttttaaaactgcagattttaaagctgatacttccagagattaagacaagcctcgcatttgtaaggttaacagggaagatgcaccttttaaagtgagtttgttttgttttcaatgtactgtttgtcatcagcctaggcaatctgtgtgctttcgagctgtactgtttattggccgacttgctcaaggcaaaatccctctggaagtgaggggaggagtccagcggaggtggctatggaagccctatctagatgggggaggggagattttatggggctctcggactgctttctatttttggatgggttgaaagaatttgttaacttttagccactagaatgaacttagttttaggcagcatttatattctttttagggttagaggcagattttacttggctatttttttcaagaaaagatagttaatatccagcttcagtcttcctaaattagccacaatttattttgcttgaactctaacaaaggcttgtgtgttgctttcacctacgcattcagccctatgaaaggctcgttgaaggttaggttgagaaggctgactataggacttggatcctaaaaattgtatttgtatttttctttccctagagtttgctctccaaagctcggggaattgattccagctctgttaaactccggggtagttctctcttcatggatacagaaaaatcaggaaaaagggaatttgatgtgcgacagactcctcaagtgaatattaatccttttactccggattctttgttgcttcattcctcaggacagtgtcgtcgtagaaagagaacgtattggaatgagtaagtcgtttatttaacagtttggttctccaaataacctaagattggtttggtatacttatcaaaatttagttcctatttaatggcatggatgtatctgtcagatatattgatagaaaaataacattttttttagttcctgtggtgaagacatggaagccagtgattatgagcttgaagatgaaacaagacctgctaaggtaaatagctttttatttttatttttttgaaatttacttttctgccacttaaagcatgctatgaatatgttaataagcattaacacataaggtagaatggtttttaaatttcacacatagccctatcaccatagcaagaaataactgttttcgtatatttgtattacatatatggaaacactttttattacagagaattacaattactgaaagcaatatgaagtcccggtatacaacagaatttcatgagctagagaaaatcggctctggagaatttggttctgtatttaagtgtgtgaagaggctggatggatgcatttatgccattaagcgatcaaaaaagccattggcgggctctgttgatgagtatgtattaaacattttgtcttttgctcttttgtcccctatggtgttactaacattaaggtttcagctggtcaaacactgaattccatctctaacttttgagaagctgtaatgatttaatcaggtccttttcacttaataccatcagttcttattggacttgttgaataatatgagtctgattttggaacctaacttaaatttcttatttctagtcagcatccatgaattcacagtaaaatggagtttattcttacctgagtcctagggcaagcaacatttcttctttctgataaatctttaatggaatctgcctttggaaaaatctcttacaagtctaaaccccttctctcttaagcaagttgctttttagcataacaatagataccaaaaatttattgtatgaagtttcagataaattaattcagtttaagcttgagtgaaaattatttaccattctattaatctcaaatttcttctaggcagaacgctttgagagaagtatatgctcatgcagtgcttggacagcattctcatgtagttcgatatttctctgcgtgggcagaagatgatcatatgcttatacagaatgaatattgtaatggtgagtgatgtaatggttttcttgtgagcttgagaaaatgaacatcgaggaaatatttatggttatctaaaatcttgctctatttctgtcacttttatcttttataaatttaaagatcagagacctaacataaatttcaagtacaaggttaaaaaccttgtcctttctgaagcaccttgtacatatctcagtagtagaacttcgcatactatttatgtgcttgtcgctccaactgagctttttgacaagactatggcctcgacacatatattttggtgtccgtagtacctagcgtagtgtgtgaagcatatagtattatgaagtgttaagttgaatagattcttcctgtgtctggtctttgatttccatttcatgtgaggtgctgctaaaactgatgtttgttagtcactgagtctctgttgatctaaattcagctgtttctttaagcattctgtagtccggccctactcccacgtatccaacctagtctaccctagaatccactaacgctttattatgttacattcttttagttctctagcttgtcgtctctccctcctctcccctaaggatgaaacaaaacaggcatgtatagattcaagtttggatgtcttgtatagctttcagtttcggtaagtccttcaagggccgacttatgtctctccttttctattaaaaacctttaccaaagtcttggtcagaattctggttcttatggacgtctgtcattattatataccaaatcttttatggattatttctcaacacttttgtagtttataagtgtgatgattgggttttcatactcaagtgtgaaatgtgcctccctcaaaccttgttacgacatcagcacattaccagtctgaaatgaaaaatatctgtagtttgtttctatttctgtatatcttctgtgaatatagacaatttagagtttagtgaacacttgagaggagataacaaaatttatttttgttgattcttattattccttaaataaacaagaccagttatctcataacttgtaaataaataagtggtgtaggtatggattcaggttccccatatttaaaaacagtgaacaaaacagaagtaaaagatccatttttcaaacctgattcctcattatttaataaagttctccacacttgaaagaacttgagtgtctagtatacagccttgctgctagtttttttcacacagctcttgaaatgtttctattcataccatcaaaatatttatgtaactatcacaaccttatggattattctatttcttaaccttcatttttcaggtattgcatttaacctagaacaacttgaccacaatgtcgtctccatttgatatttgttagacaccatctcttttcagtttccttctttctctttctcaccttcttgatgtgaataattctcttaacagaatagttcattagtagtccaggaatgtcaaatatgtagcaacctaccaatacatggttgtgtaaatcagatgattctgagaaaactcacgtgggcctgggagatagggaactgagtgagtagtcttgctaccctctcagattacaaaaaccttgtcctgtaatgttagattataaaataatctattgaaaataagtttttatttatttatttatttatttatttatttatttatttatttttgagacagagccttgctctgtcgcccaggctggagtgcagtggcgcaatctctgctcactgcaacctttgcctccagggttcaagcgattctcctgcctcagccttttgagtagctgggattacagatgcgcgccaccactcccagctaatttttgtatttttagtagagatggggtttcaccatgttggccaggctggtcttgaaccctgacctcgtgatccacctgcctcggcctcttaaagcaatataaaactcttgaagaaaataaatagtcctgcatgaaacaggactgcctctttgtgtggctatttgtcctacttagataaaagaaaatacgactatctggatgcatttgtgatctcttttgtttcctgtgtccaccgttcctctctccacataaagctttgaatataccaatagggctcatcttcacatcttttccacagtttcactggaaaaggattctgatatttatttgtacatgagtaactgattccctttattgtgatttaatttccttattatcttattcatttgcattataagccttttatcttggtttggtgatagattggaattaacctgtataaacaagtgtagaaaaatattgatggatagggaaagagaacctgaaatgtcagaacctgttttgctctcatcacctttcttgcccttctagcaataagagaagaaatgggcacagctatggttgctggacctgctaaaaaagagaattagccatattctttcttagcacatttgatctaggacttagcctatcttgtctgacagcgttattggtttgctcccttctagagcactctttcccctccctcagttcaagatttgtacaagtaaggagaacatacttaagactaagataccgagatgtataatttattttaaaaacacatttgacgttatgttattttcttatttaaattataggacctccttttctgactaatacatcattgaccttcctaattttagtacccagctctgatttttttattcctaagccttaaacaggagatatttaaaacaattcctcattgcctttgagatgaaatacaaactttaaaagtttgaaaaaatataaacaaattaactgattgatttaactaattctataaaagcaggttatggtctcattcatagtaagagtagtataaattataactatactaaaatactgtctttttacctataacatttatagacttgtcaagggtatggggaaacaggtatgctcatgcattgacaatgggcatatatattggtacagccttctctgtggagaagagtgtgtgtgtgtgtgtgtgtgtgtgtgtaaaacacaccatctccatatattacaaatgtgcataccctttaacccagcaatttggcttctaggtgatatactaaatgtacgtgaaattaccaatgtacaaggttatttattaggccatagtatgtaatagcaaaggcttggaaataattttaaaatgtccatcaaatgagggactgataaatgcatttctttctttctttctttttttttttttttttcgggggactgagtctcactctgccaccaggctggagtgcaatggcccgatatcggctcactgcaacctccgcctcccaggttcaagcaattctcctgccttctgagtagctgggattacaggtgcacgccaccacacccagctaatttttgtatttttagtagaaacggggtttcgccatgttggcctgcatggtctcgaactcctgacctcgtgatctacctgcctcggcctcccatagtgctgggattacaggcgtgagccactgtgcccagccaataaatgcatttctactcaattatacaatggaattctataaagacaagaagaaatgggttgtctttgtatattggtatagagtgatctttaagataatgaacatatgctgttatttatgcaaaaagttgaaaagaatacatagacctgagctgggcgtggtggcagtgcctgtagtcccagctgcttgggagtctgaagcagggaatttgaatttgggtttgggaattctaggctgtagtgccgatctatgttgagcatctatgccgatctatgccgatctaagttgagcatcagtatggtgacctctgtggagtggggcaccaccaggttgcctaaagaggggtaaactggcctaagttggaaacagcacaagtcaaaactcctatgctgataagtagtgggatcaagcctgtgaatagccactggattccagctgggcaacatagatagaccctgtctcttataaattaaaaacaaaaacaaacaaaaaaaaagccaacctgataatactggtttactctgagaaagaaacaggtggattgctgaggtgtatgattgagagagagactttacattttattttgtacccatgcaaatgtattacctattgaaaaaacaataaaattttgatttcacaagcaggttgaagggagaaggtcctataaaataacactttcttggttgagattggttggttgagactcatttggtaaagatggaagaaagaaaatatttcagaaagaagaaaatgctaatattttctatctttgttaggtggaagtttagctgatgctataagtgaaaactacagaatcatgagttactttaaagaagcagagttgaaggatctccttttgcaagttggccgaggcttgaggtatattcattcaatgtctttggttcacatggatataaaacctagtaagtattgcagatcttctgacctgtgttctttggggttatagagaataaattacttcattatgacaacattgaaaaaatatatatcttctgttttctcattgttagttttaaaaggccttagatccacttaccaatattgttttatgatttctattcatctcttcccttgttaatccccaaaatttgagataaacttttttgagacagtgtctcattctgtggcccaggccggaatgcagtggcaccatctccgctcactgcaacttccccatcccgtgctcaagcagtcatcccacctcagtcttccgagtagccgggactataggcatgtgccaccatgcccagataaattcatttttattaaaagccagaaatttttgctgcatcttacaggaactacaggtgggatactaatgagggcactaaaaatctgtgtttaaagccccactcttccactaggccagaccatattaaaatttccccagttgactcaagtccttaatagttgatttgttcaaattagtatctacttaaggatcatgcattgcatctggttatatcagtttttctttttcagaacccatcctctgctttgtaaaaataatatacacttatcttgcaagctatccctttttctggatttgactagttgcttcttgtatcatttagcttgttcctttttctcctatatttcctataaattggaagttataactaaggattatggattcaagttaagcatcttaggctagatgaatttagtgaggttttattaatctttggaaacctgttgatttgtgagaatttcagtcattttgtacaactttatgagttatatgctagaatttcatatgcgtatgttaacaagtcactaaagtttcttctttctttttttctttttttgagatggagtctcgctctgttgcccaggctggagtgcagtggcacagtctcagctctctgtaacctctgcctcccacgttcaagcgattctcctgcctccgcctcccgagtagctgggattacaggcatacaccaccatgcccggctaattttttgtatttttagtagagacgggtttcaccatgttggctaagctggtcttgaactattgaccttgtgatctgcccaccatggcctcccaaagtgctgagattacaggcgtaagccaccgtgcccagcatgttttttattttcaaaagacaaaaatatatttggatttaaggcagtaaatgtgaattcttaaggaatagctgtactcatataaagtgttagacaaatataatagacccttataaggtataaaagttgaaaatattaagggatgtgaagtttaaaaatcttcaaatttagaccaggtgcagtggctgacgcctgtaatcccagcactctggcaggccaaggcaggcagatcacgaggcaggagttcgagaccagcctggccaatatgatgaaaccccgtctctactaaaattacaaaaattagccaggtgtagtggtgcgcacctatagtcctagttactcgggaggctgaggcagaagaattgcttgaacccgggaggcggaggttgcagtgagccgagattgcaccattgcactccatcctaggcaacaaagtgagactccgtctcaaaaaaagaaaaaaaaaattcgccgggcgtggtgcctcacgcctgtaatcccagcactttgggaggctgaggcgggtggattgcctaagcttgggagttcaccaccagcctggacaacacggtgaaacctcgtctctactaaaatacaaaaaattagctgggtgtggtggcaggcacctgtagtcccagctactctggaggctgaggcaggagaattgcttgaacccgggaggaggaagttgaagtgagctgagatcgcaccactgcactccagcctgggcgacagagcgagactgtctcaaaaaaaaaaaaaaaaaaccttccaatttacaaataccatcacaaaataagttgtcctataaagaaagtaaaacgtatagatgactccagtaaatgtaacataaatttaatactaaatatttgtgcgtgtgtgtgcgtgcacgcgcgcgcacacacacacacacacacacacacacacacacacacacacatatatatatatatatatatatatatatatatatatatatatatacttttttttttcttttgagacagggtcttgctctgttgcccaggctggagtgcagtagtgcgatctcggctcactgcaacctctgcctcctgggttcaagcgattctcctgcctcagcctccctagtggctggtattacaggcgtgcaccaccatgcctagttaatttttgtatttttagtagagatggggttttgtcatgctggccatgctggtcttgaacttctgacctcaagtgatccgcccaccttggcctcccaaagtgctgggattacaggtgtgagccaccactcccggccttattttttagagatagtctcactctgttgcccaggctagaatgcagtggtgcaattatagctcactgcagctttgaattcctgggctcaaatgaacctcctgcctcagactcacaagtagctgggactacaggcatgcaccaccattcccagctattttaatttttttctttttctttttgtagagacagggtctcactatcttgcccaggctggtctcgaattccaagtcttaggtaatcctcctacctcagcctttcaaagcactgggattacaggcttgagccaccatacctggccaatactatactgataaaactattaaaatagaatctgccactaaaagctcatgttaattatgatcttacctgaatttgaagaaaaaaggtaatgtgtatacaataggaaatagtgaatcacaaagccatattgcaaggtagatgctatatggtcagccagactcactggctaaatgactcattctgctcacaccagccttatagcgctacattaaaacttgtgctttcacagaatttcacaaattactgatactaccttttttgctgaagggtaatgtgctagaagacaagggcctcatccagtttaaagtgtttaggatcagtgctaggctggaaaatatattcccagaggcccagagtggtggctcatgcctgtaatcccagcactttgggaggctgaagctggaggatcacttgaggccaggagtttgatcagcctggccaacatagtgaaaccccgtctctactaaaaatataaaagttagctagatgtggcatgtgcctgtagtcccagctactcaggaggttgaatgaagcatgagaattgcttgaaccttgttgcagtgagccaagatcatgccactgcactccagcttgggtgacagagcacactgtctcaaaaaaaaacaaaaaaaattcccagcaactataaccctggtttctgtcccctgagatgcttattccatgggtttgggctagaacttgagaatcggcattttaaaaagcattatggatgattctggtatatgatcttgtttatgaactctggttttattattattagtttggcttacataattaactgtttgacaggtaatattttcatatctcgaacctcaatcccaaatgctgcctctgaagaaggagacgaagatgattgggcatccaacaaagttatgtttaaaataggtaagaaaggtaatcagattattaccttcagataaagagaaggctgttttgtttttgctcttcactgtaagtttttcaatacttctaggtgatcttgggcatgtaacaaggatctccagtccacaagttgaagagggcgatagtcgttttcttgcaaatgaagttttacaggaggtaatttttcttctcccttaatcatagtttgctttgtaacacttagcagttgatagaagaatataaattcagatatattaaactttgaagttaactaatagaatggaaataaaatctaaaccgtcatctgagggcatttaataagcaaaaagtcatgaaggcaaagatttataatggagttgtcgtaaaaaatatgttctcatacaccactggtggaactttataatggcatatcctttttggagatcagagtattagtattgcattaatatttaaaaatcatgtacccattgactcataattttcacttctaggagtttttcctatagaactattcatatacaaatacaagttgagaacagtgtaaataagtgtttactaataagagaatgattaagtaaattatggcacatagttattagtatggcctatagtttcaaaagagtgtgacagtatttcttgataaaaattttgaatgaaaatagaataagtagaaaaatataaagtgtaattgtctgatcccattgctctttgtaaatatgtgtatatatatgtttgctttatcacgtatatgtgtatttgtaacttgtcagtgtgtttctacgtgttttgtgtttgcatatgaatgcctagaggtagagggatttcttttgagagttgaattgggctgttgataaagaagaggcatttactcttatctatgtgtttgcatttttcccccaagagtgtgtattactttgtaatttaaaaaataaacatcctcaaatttagcagtttattctctgaataggtcccaaacttaaatgtggtattagacactttgattaagtcctatttttcacctaagtcatctttgaggtgtaatcttgttttattttgaccatgtttacattcctttaaaaaattgttttaattttacagaattatacccatctaccaaaagcagatatttttgcgcttgccctcacagtggtatgtgctgctggtgctgaacctcttccgagaaatggagatcaatggcatgaaatcagacagggtagattacctcggataccacaagtgctttcccaagaatttacagagttgctaaaagtgagcattttatatatgaagccctttattgacatggttctatattttattaaatgcatgtctttaccttcattttacttttctttttaaggttatgattcatccagatccagagagaagaccttcagcaatggcactggtaaagcattcagtattgctgtccgcttctagaaagagtgcagaacaattacgaatagaattgaatgccgaaaagttcaaaaattcacttttacaaaagtaagtgagggttttatgttttctttttgctttttcattcactttaattctcaaattttaatgagagatgatttaagctttctgtcaacaaaggatgtagtggttttttgtgttttttgttttttgagacagggtctcactgtcatcaggctggagtgcactggtgctatcatgactcattgcaacctccacctcctgggctcaagctatcctcccgtgtcagcctcctgagtagctgagccacagatgcatgccacaacacccagctaatttttatattttttgtagagatggggtttttgccatgttgcccaggctggtcttgaactcctgggctcaaaccatccacctgtcttggcctcccaaagtgctgggattataggagtgagccacctcacccggctccagtagttcgatatgttgttatacggtgaaagcttggggacttctgccatgaattagtatttggcctattaaatttgtgttgtttctaaactttcaaattacgaactttaaaaatgttgagactaacatatatttgcaagtggtgatagtccccaagccataaatggtagtaaaagctaagcgagcctataccaatcttttcttcccagactctcaccaaaagttaacgttgtccttgaaacattctgttcttattttatgaaaggatgaaattaatgtcaatttggttaggagatgattctcatatatatgtttttaatttctggctaaatctttatatactgaatgaagattctcatattggacttaatgacttgatattttcaaaaagctggttgcaatggtaaaggttattaaaaagagaatattggagaatattaagttaccacagatcacatttctaattcttttgatttattgcagccattttgcttttaacctaataaaactgacttgaaaaggttatgttaacaattaatattaacatttaatatttaaattataagaattgtatattaagaggtttacttgccactagtttgatatccatcatagttcatacaaataggaaataaagtgttcctttcatctctcttatgtaaggatagattcgcaatataaattggagtttttgaaattattatttatttttaattttttttttattggggataggtttgtctggaaattgtttattattatttatttaaaaagatggggtcttgctctgtcacccaggctggagtgcagtggcactatcatagctcactgcagcctcaaactcctgggcccaagcgatcctccagcctcagcttcccgagtagctgagactacaggtgtgagtcaccacatccagctcaaattattttataagaaccaaagtcattactagcatctttactacttgttttcaagtatgtgtgatactgtaattcaaaaagcataaaataaaataatttcataaatttaagttgttttaatagaagcttcagtttcctgttttatttttcaattacatcttagaataatgatggcatgcaaatatctcccaatcgacaatatagtttgtgttagtttcttagaatctcttcctaggaataataccttgttttctatttttatgtcagagaactcaagaaagcacagatggcaaaagctgcagctgaggaaagagcactcttcactgaccggatggccactaggtccaccacccagagtaatagaacatctcgacttattggaaagaaaatgaaccgctctgtcagccttactatatactgagctactcctttcccacctccccctgaacactgtgacaagaggaagctaggttgaaatcactgatagaatccagtttgcaattactttctcgattggtgtcagtagttttactgattaggacttttattgtgaattacagttgaaagctgtattttgatgattgctatgtcaggctttcatctaatcttaccagtctgtcttctgtaggatgtgtcactgttggatgttacaccagcctttccagggttaaccactgtggtggtgtgctgcttatagtttgctgttgcattgtaataaaaggtgtctttccctgtagtgacctgtaaaaagtactcaagggctttattacagacataccctccctttgaaaagggacatgctaaaagactcattactactcagccttcaatgtacctgtgtgtccatcttatatttcttttttttttaattgtgaattagacttgtatatcccactgggagcactttgtaggcattgcatgaaccatgggatgatgattctgtggaggtattgccttgtgaatttgctgctattttagttttgtctttgctgtaaacttgtagcattaaacaatcattgttgttaataggtcttctttttgaaacaattatgtgaaatgtatagctgcttttgatgaaaagcagctatttgcctttttttttttttcctttgaactttgaagctagtgcattggaaaaatgcaccctttccctcctttggaatgctgtattaatgtagtataataattactggttttgtaacttgttctggtaatgtccttcccggactctttttaaatgtctccccctaagttttatacttgattgtattattagtctgtttttaaatgttttgcccggtttttctcttcaatatttgtgtatataaaccgatcttcgtgatactgtacatagctgtttgaaatgccagaatgacttctgacattccaagtttttcacaaaatatattttatctgtgattagccatttgactaataatactggctaacagatgttgaaaaaaattgtctgtttgttttctcattaattttggtctaaaacatgtttgcacttgtctttgacttgtgttttattaacattgattggcatattaaaagtcactctgagcttaccttaattgtctaa

SEQ ID NO: 2161 - DNA, 15080 bp, Homo sapiens
  source 1..15080: mol_type = genomic DNA
atgtaactgaacaatgggcctcgtctggaacttcatcttacaaaggggccgatcggcccgtccgggtggccaaggatttgccgcccgttgagtccgggccgccccgagcgtgtcagccccgagtgcggcaccgataacgcggttcgcgaggatgctggagggtgccggcccggccacctgacactcccgagccataggatgccttttaaacgcggcgatcgggcctgtaatttgggcggcgcgggcagaaggagtttaaagaaaaataattgtcccgccctgatcgtgtcgtgtcgtgtggcgtggatgggggaaaggtctggggcatgcagggagactacgcttggacttgggagtaaaggctggccttccaagcatttacagtcctacagactcatcctaagtccaggcagtactgaggcctgtttctggacaaggtcttggcccagcatttgtttttatcgtgggtttgcggtgcccagagtttggccggcctccgtgtgattaggaacatcctaccgtagataaggtatcttaaagaaggaggtgttcagcacctgtgttttgaaaggccttcgagtactgcgcagatgaccacttttaaaactgcagattttaaagctgatacttccagagattaagacaagcctcgcatttgtaaggttaacagggaagatgcaccttttaaagtgagtttgttttgttttcaatgtactgtttgtcatcagcctaggcaatctgtgtgctttcgagctgtactgtttattggccgacttgctcaaggcaaaatccctctggaagtgaggggaggagtccagcggaggtggctatggaagccctatctagatgggggaggggagattttatggggctctcggactgctttctatttttggatgggttgaaagaatttgttaacttttagccactagaatgaacttagttttaggcagcatttatattctttttagggttagaggcagattttacttggctatttttttcaagaaaagatagttaatatccagcttcagtcttcctaaattagccacaatttattttgcttgaactctaacaaaggcttgtgtgttgctttcacctacgcattcagccctatgaaaggctcgttgaaggttaggttgagaaggctgactataggacttggatcctaaaaattgtatttgtatttttctttccctagagtttgctctccaaagctcggggaattgattccagctctgttaaactccggggtagttctctcttcatggatacagaaaaatcaggaaaaagggaatttgatgtgcgacagactcctcaagtgaatattaatccttttactccggattctttgttgcttcattcctcaggacagtgtcgtcgtagaaagagaacgtattggaatgagtaagtcgtttatttaacagtttggttctccaaataacctaagattggtttggtatacttatcaaaatttagttcctatttaatggcatggatgtatctgtcagatatattgatagaaaaataacattttttttagttcctgtggtgaagacatggaagccagtgattatgagcttgaagatgaaacaagacctgctaaggtaaatagctttttatttttatttttttgaaatttacttttctgccacttaaagcatgctatgaatatgttaataagcattaacacataaggtagaatggtttttaaatttcacacatagccctatcaccatagcaagaaataactgttttcgtatatttgtattacatatatggaaacactttttattacagagaattacaattactgaaagcaatatgaagtcccggtatacaacagaatttcatgagctagagaaaatcggctctggagaatttggttctgtatttaagtgtgtgaagaggctggatggatgcatttatgccattaagcgatcaaaaaagccattggcgggctctgttgatgagtatgtattaaacattttgtcttttgctcttttgtcccctatggtgttactaacattaaggtttcagctggtcaaacactgaattccatctctaacttttgagaagctgtaatgatttaatcaggtccttttcacttaataccatcagttcttattggacttgttgaataatatgagtctgattttggaacctaacttaaatttcttatttctagtcagcatccatgaattcacagtaaaatggagtttattcttacctgagtcctagggcaagcaacatttcttctttctgataaatctttaatggaatctgcctttggaaaaatctcttacaagtctaaaccccttctctcttaagcaagttgctttttagcataacaatagataccaaaaatttattgtatgaagtttcagataaattaattcagtttaagcttgagtgaaaattatttaccattctattaatctcaaatttcttctaggcagaacgctttgagagaagtatatgctcatgcagtgcttggacagcattctcatgtagttcgatatttctctgcgtgggcagaagatgatcatatgcttatacagaatgaatattgtaatggtgagtgatgtaatggttttcttgtgagcttgagaaaatgaacatcgaggaaatatttatggttatctaaaatcttgctctatttctgtcacttttatcttttataaatttaaagatcagagacctaacataaatttcaagtacaaggttaaaaaccttgtcctttctgaagcaccttgtacatatctcagtagtagaacttcgcatactatttatgtgcttgtcgctccaactgagctttttgacaagactatggcctcgacacatatattttggtgtccgtagtacctagcgtagtgtgtgaagcatatagtattatgaagtgttaagttgaatagattcttcctgtgtctggtctttgatttccatttcatgtgaggtgctgctaaaactgatgtttgttagtcactgagtctctgttgatctaaattcagctgtttctttaagcattctgtagtccggccctactcccacgtatccaacctagtctaccctagaatccactaacgctttattatgttacattcttttagttctctagcttgtcgtctctccctcctctcccctaaggatgaaacaaaacaggcatgtatagattcaagtttggatgtcttgtatagctttcagtttcggtaagtccttcaagggccgacttatgtctctccttttctattaaaaacctttaccaaagtcttggtcagaattctggttcttatggacgtctgtcattattatataccaaatcttttatggattatttctcaacacttttgtagtttataagtgtgatgattgggttttcatactcaagtgtgaaatgtgcctccctcaaaccttgttacgacatcagcacattaccagtctgaaatgaaaaatatctgtagtttgtttctatttctgtatatcttctgtgaatatagacaatttagagtttagtgaacacttgagaggagataacaaaatttatttttgttgattcttattattccttaaataaacaagaccagttatctcataacttgtaaataaataagtggtgtaggtatggattcaggttccccatatttaaaaacagtgaacaaaacagaagtaaaagatccatttttcaaacctgattcctcattatttaataaagttctccacacttgaaagaacttgagtgtctagtatacagccttgctgctagtttttttcacacagctcttgaaatgtttctattcataccatcaaaatatttatgtaactatcacaaccttatggattattctatttcttaaccttcatttttcaggtattgcatttaacctagaacaacttgaccacaatgtcgtctccatttgatatttgttagacaccatctcttttcagtttccttctttctctttctcaccttcttgatgtgaataattctcttaacagaatagttcattagtagtccaggaatgtcaaatatgtagcaacctaccaatacatggttgtgtaaatcagatgattctgagaaaactcacgtgggcctgggagatagggaactgagtgagtagtcttgctaccctctcagattacaaaaaccttgtcctgtaatgttagattataaaataatctattgaaaataagtttttatttatttatttatttatttatttatttatttatttatttttgagacagagccttgctctgtcgcccaggctggagtgcagtggcgcaatctctgctcactgcaacctttgcctccagggttcaagcgattctcctgcctcagccttttgagtagctgggattacagatgcgcgccaccactcccagctaatttttgtatttttagtagagatggggtttcaccatgttggccaggctggtcttgaaccctgacctcgtgatccacctgcctcggcctcttaaagcaatataaaactcttgaagaaaataaatagtcctgcatgaaacaggactgcctctttgtgtggctatttgtcctacttagataaaagaaaatacgactatctggatgcatttgtgatctcttttgtttcctgtgtccaccgttcctctctccacataaagctttgaatataccaatagggctcatcttcacatcttttccacagtttcactggaaaaggattctgatatttatttgtacatgagtaactgattccctttattgtgatttaatttccttattatcttattcatttgcattataagccttttatcttggtttggtgatagattggaattaacctgtataaacaagtgtagaaaaatattgatggatagggaaagagaacctgaaatgtcagaacctgttttgctctcatcacctttcttgcccttctagcaataagagaagaaatgggcacagctatggttgctggacctgctaaaaaagagaattagccatattctttcttagcacatttgatctaggacttagcctatcttgtctgacagcgttattggtttgctcccttctagagcactctttcccctccctcagttcaagatttgtacaagtaaggagaacatacttaagactaagataccgagatgtataatttattttaaaaacacatttgacgttatgttattttcttatttaaattataggacctccttttctgactaatacatcattgaccttcctaattttagtacccagctctgatttttttattcctaagccttaaacaggagatatttaaaacaattcctcattgcctttgagatgaaatacaaactttaaaagtttgaaaaaatataaacaaattaactgattgatttaactaattctataaaagcaggttatggtctcattcatagtaagagtagtataaattataactatactaaaatactgtctttttacctataacatttatagacttgtcaagggtatggggaaacaggtatgctcatgcattgacaatgggcatatatattggtacagccttctctgtggagaagagtgtgtgtgtgtgtgtgtgtgtgtgtgtaaaacacaccatctccatatattacaaatgtgcataccctttaacccagcaatttggcttctaggtgatatactaaatgtacgtgaaattaccaatgtacaaggttatttattaggccatagtatgtaatagcaaaggcttggaaataattttaaaatgtccatcaaatgagggactgataaatgcatttctttctttctttctttttttttttttttttcgggggactgagtctcactctgccaccaggctggagtgcaatggcccgatatcggctcactgcaacctccgcctcccaggttcaagcaattctcctgccttctgagtagctgggattacaggtgcacgccaccacacccagctaatttttgtatttttagtagaaacggggtttcgccatgttggcctgcatggtctcgaactcctgacctcgtgatctacctgcctcggcctcccatagtgctgggattacaggcgtgagccactgtgcccagccaataaatgcatttctactcaattatacaatggaattctataaagacaagaagaaatgggttgtctttgtatattggtatagagtgatctttaagataatgaacatatgctgttatttatgcaaaaagttgaaaagaatacatagacctgagctgggcgtggtggcagtgcctgtagtcccagctgcttgggagtctgaagcagggaatttgaatttgggtttgggaattctaggctgtagtgccgatctatgttgagcatctatgccgatctatgccgatctaagttgagcatcagtatggtgacctctgtggagtggggcaccaccaggttgcctaaagaggggtaaactggcctaagttggaaacagcacaagtcaaaactcctatgctgataagtagtgggatcaagcctgtgaatagccactggattccagctgggcaacatagatagaccctgtctcttataaattaaaaacaaaaacaaacaaaaaaaaagccaacctgataatactggtttactctgagaaagaaacaggtggattgctgaggtgtatgattgagagagagactttacattttattttgtacccatgcaaatgtattacctattgaaaaaacaataaaattttgatttcacaagcaggttgaagggagaaggtcctataaaataacactttcttggttgagattggttggttgagactcatttggtaaagatggaagaaagaaaatatttcagaaagaagaaaatgctaatattttctatctttgttaggtggaagtttagctgatgctataagtgaaaactacagaatcatgagttactttaaagaagcagagttgaaggatctccttttgcaagttggccgaggcttgaggtatattcattcaatgtctttggttcacatggatataaaacctagtaagtattgcagatcttctgacctgtgttctttggggttatagagaataaattacttcattatgacaacattgaaaaaatatatatcttctgttttctcattgttagttttaaaaggccttagatccacttaccaatattgttttatgatttctattcatctcttcccttgttaatccccaaaatttgagataaacttttttgagacagtgtctcattctgtggcccaggccggaatgcagtggcaccatctccgctcactgcaacttccccatcccgtgctcaagcagtcatcccacctcagtcttccgagtagccgggactataggcatgtgccaccatgcccagataaattcatttttattaaaagccagaaatttttgctgcatcttacaggaactacaggtgggatactaatgagggcactaaaaatctgtgtttaaagccccactcttccactaggccagaccatattaaaatttccccagttgactcaagtccttaatagttgatttgttcaaattagtatctacttaaggatcatgcattgcatctggttatatcagtttttctttttcagaacccatcctctgctttgtaaaaataatatacacttatcttgcaagctatccctttttctggatttgactagttgcttcttgtatcatttagcttgttcctttttctcctatatttcctataaattggaagttataactaaggattatggattcaagttaagcatcttaggctagatgaatttagtgaggttttattaatctttggaaacctgttgatttgtgagaatttcagtcattttgtacaactttatgagttatatgctagaatttcatatgcgtatgttaacaagtcactaaagtttcttctttctttttttctttttttgagatggagtctcgctctgttgcccaggctggagtgcagtggcacagtctcagctctctgtaacctctgcctcccacgttcaagcgattctcctgcctccgcctcccgagtagctgggattacaggcatacaccaccatgcccggctaattttttgtatttttagtagagacgggtttcaccatgttggctaagctggtcttgaactattgaccttgtgatctgcccaccatggcctcccaaagtgctgagattacaggcgtaagccaccgtgcccagcatgttttttattttcaaaagacaaaaatatatttggatttaaggcagtaaatgtgaattcttaaggaatagctgtactcatataaagtgttagacaaatataatagacccttataaggtataaaagttgaaaatattaagggatgtgaagtttaaaaatcttcaaatttagaccaggtgcagtggctgacgcctgtaatcccagcactctggcaggccaaggcaggcagatcacgaggcaggagttcgagaccagcctggccaatatgatgaaaccccgtctctactaaaattacaaaaattagccaggtgtagtggtgcgcacctatagtcctagttactcgggaggctgaggcagaagaattgcttgaacccgggaggcggaggttgcagtgagccgagattgcaccattgcactccatcctaggcaacaaagtgagactccgtctcaaaaaaagaaaaaaaaaattcgccgggcgtggtgcctcacgcctgtaatcccagcactttgggaggctgaggcgggtggattgcctaagcttgggagttcaccaccagcctggacaacacggtgaaacctcgtctctactaaaatacaaaaaattagctgggtgtggtggcaggcacctgtagtcccagctactctggaggctgaggcaggagaattgcttgaacccgggaggaggaagttgaagtgagctgagatcgcaccactgcactccagcctgggcgacagagcgagactgtctcaaaaaaaaaaaaaaaaaaccttccaatttacaaataccatcacaaaataagttgtcctataaagaaagtaaaacgtatagatgactccagtaaatgtaacataaatttaatactaaatatttgtgcgtgtgtgtgcgtgcacgcgcgcgcacacacacacacacacacacacacacacacacacacacacatatatatatatatatatatatatatatatatatatatatatatacttttttttttcttttgagacagggtcttgctctgttgcccaggctggagtgcagtagtgcgatctcggctcactgcaacctctgcctcctgggttcaagcgattctcctgcctcagcctccctagtggctggtattacaggcgtgcaccaccatgcctagttaatttttgtatttttagtagagatggggttttgtcatgctggccatgctggtcttgaacttctgacctcaagtgatccgcccaccttggcctcccaaagtgctgggattacaggtgtgagccaccactcccggccttattttttagagatagtctcactctgttgcccaggctagaatgcagtggtgcaattatagctcactgcagctttgaattcctgggctcaaatgaacctcctgcctcagactcacaagtagctgggactacaggcatgcaccaccattcccagctattttaatttttttctttttctttttgtagagacagggtctcactatcttgcccaggctggtctcgaattccaagtcttaggtaatcctcctacctcagcctttcaaagcactgggattacaggcttgagccaccatacctggccaatactatactgataaaactattaaaatagaatctgccactaaaagctcatgttaattatgatcttacctgaatttgaagaaaaaaggtaatgtgtatacaataggaaatagtgaatcacaaagccatattgcaaggtagatgctatatggtcagccagactcactggctaaatgactcattctgctcacaccagccttatagcgctacattaaaacttgtgctttcacagaatttcacaaattactgatactaccttttttgctgaagggtaatgtgctagaagacaagggcctcatccagtttaaagtgtttaggatcagtgctaggctggaaaatatattcccagaggcccagagtggtggctcatgcctgtaatcccagcactttgggaggctgaagctggaggatcacttgaggccaggagtttgatcagcctggccaacatagtgaaaccccgtctctactaaaaatataaaagttagctagatgtggcatgtgcctgtagtcccagctactcaggaggttgaatgaagcatgagaattgcttgaaccttgttgcagtgagccaagatcatgccactgcactccagcttgggtgacagagcacactgtctcaaaaaaaaacaaaaaaaattcccagcaactataaccctggtttctgtcccctgagatgcttattccatgggtttgggctagaacttgagaatcggcattttaaaaagcattatggatgattctggtatatgatcttgtttatgaactctggttttattattattagtttggcttacataattaactgtttgacaggtaatattttcatatctcgaacctcaatcccaaatgctgcctctgaagaaggagacgaagatgattgggcatccaacaaagttatgtttaaaataggtaagaaaggtaatcagattattaccttcagataaagagaaggctgttttgtttttgctcttcactgtaagtttttcaatacttctaggtgatcttgggcatgtaacaaggatctccagtccacaagttgaagagggcgatagtcgttttcttgcaaatgaagttttacaggaggtaatttttcttctcccttaatcatagtttgctttgtaacacttagcagttgatagaagaatataaattcagatatattaaactttgaagttaactaatagaatggaaataaaatctaaaccgtcatctgagggcatttaataagcaaaaagtcatgaaggcaaagatttataatggagttgtcgtaaaaaatatgttctcatacaccactggtggaactttataatggcatatcctttttggagatcagagtattagtattgcattaatatttaaaaatcatgtacccattgactcataattttcacttctaggagtttttcctatagaactattcatatacaaatacaagttgagaacagtgtaaataagtgtttactaataagagaatgattaagtaaattatggcacatagttattagtatggcctatagtttcaaaagagtgtgacagtatttcttgataaaaattttgaatgaaaatagaataagtagaaaaatataaagtgtaattgtctgatcccattgctctttgtaaatatgtgtatatatatgtttgctttatcacgtatatgtgtatttgtaacttgtcagtgtgtttctacgtgttttgtgtttgcatatgaatgcctagaggtagagggatttcttttgagagttgaattgggctgttgataaagaagaggcatttactcttatctatgtgtttgcatttttcccccaagagtgtgtattactttgtaatttaaaaaataaacatcctcaaatttagcagtttattctctgaataggtcccaaacttaaatgtggtattagacactttgattaagtcctatttttcacctaagtcatctttgaggtgtaatcttgttttattttgaccatgtttacattcctttaaaaaattgttttaattttacagaattatacccatctaccaaaagcagatatttttgcgcttgccctcacagtggtatgtgctgctggtgctgaacctcttccgagaaatggagatcaatggcatgaaatcagacagggtagattacctcggataccacaagtgctttcccaagaatttacagagttgctaaaagtgagcattttatatatgaagccctttattgacatggttctatattttattaaatgcatgtctttaccttcattttacttttctttttaaggttatgattcatccagatccagagagaagaccttcagcaatggcactggtaaagcattcagtattgctgtccgcttctagaaagagtgcagaacaattacgaatagaattgaatgccgaaaagttcaaaaattcacttttacaaaagtaagtgagggttttatgttttctttttgctttttcattcactttaattctcaaattttaatgagagatgatttaagctttctgtcaacaaaggatgtagtggttttttgtgttttttgttttttgagacagggtctcactgtcatcaggctggagtgcactggtgctatcatgactcattgcaacctccacctcctgggctcaagctatcctcccgtgtcagcctcctgagtagctgagccacagatgcatgccacaacacccagctaatttttatattttttgtagagatggggtttttgccatgttgcccaggctggtcttgaactcctgggctcaaaccatccacctgtcttggcctcccaaagtgctgggattataggagtgagccacctcacccggctccagtagttcgatatgttgttatacggtgaaagcttggggacttctgccatgaattagtatttggcctattaaatttgtgttgtttctaaactttcaaattacgaactttaaaaatgttgagactaacatatatttgcaagtggtgatagtccccaagccataaatggtagtaaaagctaagcgagcctataccaatcttttcttcccagactctcaccaaaagttaacgttgtccttgaaacattctgttcttattttatgaaaggatgaaattaatgtcaatttggttaggagatgattctcatatatatgtttttaatttctggctaaatctttatatactgaatgaagattctcatattggacttaatgacttgatattttcaaaaagctggttgcaatggtaaaggttattaaaaagagaatattggagaatattaagttaccacagatcacatttctaattcttttgatttattgcagccattttgcttttaacctaataaaactgacttgaaaaggttatgttaacaattaatattaacatttaatatttaaattataagaattgtatattaagaggtttacttgccactagtttgatatccatcatagttcatacaaataggaaataaagtgttcctttcatctctcttatgtaaggatagattcgcaatataaattggagtttttgaaattattatttatttttaattttttttttattggggataggtttgtctggaaattgtttattattatttatttaaaaagatggggtcttgctctgtcacccaggctggagtgcagtggcactatcatagctcactgcagcctcaaactcctgggcccaagcgatcctccagcctcagcttcccgagtagctgagactacaggtgtgagtcaccacatccagctcaaattattttataagaaccaaagtcattactagcatctttactacttgttttcaagtatgtgtgatactgtaattcaaaaagcataaaataaaataatttcataaatttaagttgttttaatagaagcttcagtttcctgttttatttttcaattacatcttagaataatgatggcatgcaaatatctcccaatcgacaatatagtttgtgttagtttcttagaatctcttcctaggaataataccttgttttctatttttatgtcagagaactcaagaaagcacagatggcaaaagctgcagctgaggaaagagcactcttcactgaccggatggccactaggtccaccacccagagtaatagaacatctcgacttattggaaagaaaatgaaccgctctgtcagccttactatatactgagctactcctttcccacctccccctgaacactgtgacaagaggaagctaggttgaaatcactgatagaatccagtttgcaattactttctcgattggtgtcagtagttttactgattaggacttttattgtgaattacagttgaaagctgtattttgatgattgctatgtcaggctttcatctaatcttaccagtctgtcttctgtaggatgtgtcactgttggatgttacaccagcctttccagggttaaccactgtggtggtgtgctgcttatagtttgctgttgcattgtaataaaaggtgtctttccctgtagtgacctgtaaaaagtactcaagggctttattacagacataccctccctttgaaaagggacatgctaaaagactcattactactcagccttcaatgtacctgtgtgtccatcttatatttcttttttttttaattgtgaattagacttgtatatcccactgggagcactttgtaggcattgcatgaaccatgggatgatgattctgtggaggtattgccttgtgaatttgctgctattttagttttgtctttgctgtaaacttgtagcattaaacaatcattgttgttaataggtcttctttttgaaacaattatgtgaaatgtatagctgcttttgatgaaaagcagctatttgcctttttttttttttcctttgaactttgaagctagtgcattggaaaaatgcaccctttccctcctttggaatgctgtattaatgtagtataataattactggttttgtaacttgttctggtaatgtccttcccggactctttttaaatgtctccccctaagttttatacttgattgtattattagtctgtttttaaatgttttgcccggtttttctcttcaatatttgtgtatataaaccgatcttcgtgatactgtacatagctgtttgaaatgccagaatgacttctgacattccaagtttttcacaaaatatattttatctgtgattagccatttgactaataatactggctaacagatgttgaaaaaaattgtctgtttgttttctcattaattttggtctaaaacatgtttgcacttgtctttgacttgtgttttattaacattgattggcatattaaaagtcactctgagcttaccttaattgtctaa

SEQ ID NO: 2162 - DNA, 123326 bp, Homo sapiens
  source 1..123326: mol_type = genomic DNA
tcattctgcttttctttattgtctggctaacttacaaagatgcagatgtctagggtagtctctaccctaccacttacactatcctgatgacacagatagcaaaatgtgtctgtttacatagtgcatggtatgaaaaaaaagtttttcttcctctacggtccttgactataaggagggaaaaattaatttcatgccaacatttttggggaactttaacaatcatcccatttctgctactaaaataacaaaactggtattacactttaaaatataaagacctaacagtttttacaaatatgcaaataatctactacttagacataaaaaaaagttgatttcttttaaatcacaaagtaaggcaccattggattaaacatttctcctggcttttactaaataaaatgcatagtgaaataaatactgaacactgagttttaatactgtaatacatttcaatataaaataagaggtgaatgttaaaatactgtattacatgttgaatacatttatctgaaaatgttataaaaaaacacacatgtaagctctgatttcagggaagaaaaattcatttttgtaattttccatagtttaagattttaccacagaacttattcatagttttagatgcaattaggttgcaaactttcaaagaaagggtgtaggtgtattaatgaaacagtcacttaaacactacattctaaaacaatctattctggatgaatggcaactttgagctatcaccctgtttcagatttagaacggtacctgccaagttcagatatgcaaaggaattgtccaattcttactaccccttataaaattcagacccactttctctgagtcagacttttctccgtcatattttctaggaagggcaaattccatcttttgtgaaatgggtcattaggctttatcatagggatgtttttcactgttgaaatcagataaaagaatcccaaataaatgatgctgctaaattaccaaactgctagagattaaaaaaatttttttttaaaaagccaacactttgccaagcttgttataccttattatttcttgattctctttgagtaaaaagcccaaatgactgtatggaagagagatgaatggtagaggagagaggaaacacaggttctctaatgtactaaatcaggactttggcaaggaagttatagaaatataatatattcaaatcagtaacttcataatttattagacatcccatttattagaactctaagttcttttgcttttatataaatgaaacatttattctataaatagaaatgtatttttcagaattttctttgggttggtttcttggtagcatctcccagtaatacatgaataacatactgaaaccatgatacaatgtttaggtagatatacatatacatatgtggtcatgtgtttttaaaaaacaagtaatggtaattttaaacaaaaccatgtaaaatatctaagtggaaatattttttcccaactctatagctagatttaaaagtcccagtaaaattttgtaaacaaaatcatataagaaaaggcaaggctggctcttccctatggtcctttagtggagctatatttgcatagatcctagacaaatgatgcaaaacaaattccctccaatttccactagcaatctccctaattcgctcaacccttacataagcatcagatttagatttttagagttttgcccaccaactcaaatcggttcccttcttcttccatgtttctgatttgatatattttcctgacttttttcccctcctaccaagccttcctagtctctcccagcctcaggagcttgctcagccagaaaggaacaaaggctgcttccatttcacaaggcagaagtccagctgacaagtggagtgcgtgagccagctggttctgagcccagaagtcccgacaggctttccatttgtttccaatggctttattccacatgactttagtaaaccgtactcaatcaatttctgaccttggtactttgaagcaacacttgtatacagatattaagggaagagggaagttaagggaggaaaatcgaaggtcaaactgtgtgtcaaacaaggtgctgggtcctaattttatttttagttgcctcttgaatcgctcaagcccatcttgccttttttgttttttaaacaagaggtttctgcactagcttccatcttccagactcgtgctgtctaatccagtagccaccagccacatgtggctactgagcacttaaaaatgtgactagtctgaatggagatgtgcggtaagtgtaaaatacactctggattttgaagattcagtaccaaaaaataatataaaatatctcattaaaattttatgttgattacaggttgaaatattttggatgcatattaacttcacttgtttaaaatatattagaaatgtaaaaattgtatatggggctcacattatatttctattggacagctctgtcctagagccaagctcggactgccaaagattggacatcctgtgactgcaagtttccagtgagcccttactcagcagcttgcttaggtggtctgtggttcatagaaacagagaggaggccaagcatgcgaaaaaggaacgggagaaaacagctctcagggactttaataattacagtctgtaacaaataagcagtgaatgtttgaatttggttggtggaaagctgggatgcaagtcatctctgcctattacgacaaaagcctatcgaccccagcagccagcacaggcaggctgcagctgaagcaagcaatagcctggagaataaacacaatatgaaaagctaggtgcatttcttaccgattcccacccacacacgcatattcccactccccctcccacctttcctcctgcccatacatgaggcacaagggaagaagcagggaggagggtatgcagttcttagatagcaacagaagcagctcttgagcttgggtagagaagagcaggcaaagatcacctcgggatgggagggagtggtggagcacccctttctcttcggttggatccaccttggtgaaaaaacagacaaaatataattttggttagaaagctgatgttctcatcgtggaaactcggggatggttgcacgggtacccactacctcatccctatgaccagggctgtcagctaactggcgtatgttgtggatgagaagtgagaggtgaaaacaagcaagtaatgttctgaataaacatcatggtgggtgatccatcactggctcccaagtacttgcacaaagttaaaaaaaatcattttcttcttatcacagtgtgtgcttattatagatttagaaaatatggatgagtaaaaacaaagaactcacccattcctccagcacccagagataaccaattatgtgtatattttttacttagaaacagttccccgttttcttccagaaataagatcatatagtcagtttgaacatctttcgaaggcattactctttgcaaagattattaatgacagtctgcattccaaaatatgactacactacagtctacctagtcaattcccttttgttgggcatttaggtatcttctaattaaaaattagaaagcttttctgacagtagccattctaatgggtgtaaagttgtatctcactatagttttatttgcagtttcataaaagttagtgatgttgaacaccttttcaagtactctgtcgatgtgttcttttaaaagttattcacggcccagttgcagtggctcacgcctgtaaccccagcactttgagaggttgaggagggatgatggcttgagctcaggagtttgagaccagtctgggcaacatagcaaaaccctgtctccacaaaaattagccgggcatgttggtgtgcgcctgtcccatagtcccagctacctgggaggctgtggtgggaggatcacctgaacctgagaggtcgaggctgcaatgagccaagattgcgccactgcactccagcctgggtgacagagtgagaccctgtctcaaaaacaaaataaaaaccaaaaccaagctattcatgggctatcagtccactgtaactaggcttaaaacccattcacataaaaaaaattcatttactacacaaacatttgttgaggatttaacaggtgtttggcatgaggtcaggtgctcagatgttgtgaacaggtctaactggggcatgtgtcaatcaggtaggtctgctctaaccactgctctgagactcagtgggctggaactggcagattcctcaagtaggcatcttgatagggaccctactggtccacttagggatttctgagaaagaaccaaatttctgagcaaggaagggagttaggagaaaacactgaaagaagcacctcttcctctcaccatcccaaccaaatattttcttgggcaggcatctgagaaaagactcatctggatgtaaaccagacacctatcatggggccttgaccatcaactgacccgccacaagtggttagtagaatgagggctggccttgtccaaagctgtaattagagggcactccaagtgcattcggtactgctcagggctgtctgggtgcgctctcaggctgtgggcttggaggctgaggctgctgcagagcagaggaaaacttggtactcgacggtgccttatttatttttgttagatgatccattatcattataaaatattaaacatgcctaatgctggaaatatttaaggcaaatctacaaaaaaattttggtagactgtggaaattaattcaccaatttaaaaactacttttaggcgaggcatggtagctcatgcctataatccagtgctttgggaggttaaggcaggggactacttgaggccagaagctcaagaccagcctgggtgacatagagatatcctgtctctataagaaaatttttaaaaagaaatacttgaaaatgccctttatgtttcaggctctgtgcccctcaaggaaggtgcaatagtgagcaggacacagttctagtccttacattgcctactcaagtcttaaaggaggatgggagaagatatatgcttagctattccattaaagatctagagggtacagggaagatggtctattaccaatttaaaaatagaaataatatttagaataagaagcaaataataagttaggaaaaatatttggagtctatatgaacaactccttaaagtcaattcatttattggtgcccaagaaggaagaagggctgtactcttatcaaacagaagcccttcttctggtgcacacacacacacacacacacacacacacacacacaccattcaaagatatctgtcccatgtgaaaacttacttttcactaacactttttttttttttttgagatggagtttcgctctcgttgcccaggctcaagtgcaatggcgacttctgctcaccgcaacctccacctcctgagttcaagcaattctcctgcctcagcctcctgagtagctgggattacacgcatgcgcccctatgcccggctaattttgtatttttagtagagacaggttttctccatgttggtcaggctagtctcgaactcctgacctcaggtgatctgcccacctcagcctcccaaagtgctgggattacaggcgtgagccaccgtgcctggccttcactaaaaatttcaatcatcaactcttgtataataattttattatagctatacttcttcattaggtattgtctatgaatgcagtcttccacagaaacaaatcttttcaggaattaaagttttccttttaagcagtagtattctgttttcttctagcatttgtccatggaaattttcctatattttctaactctttaaatttttctacagaggcacaaagcacagtttgactcaattaatttaattccatttaacccaatagaaattcaacccaacagaaacatctggtgttgtcctgcgctgtgacacacagcacagccatgttcctgtctcctcctctgacctgggactgccatctgtcacttctctcccatgtcagtgattttgcttctcaccagtcttaactttagctgttattaatctcctataaggtttggaaccaaccaaccaaaaattactttaaactgtgttaggaaagaatcagtaggctttgagtacatgtaaggtgctctgttagggagtggggccatcgctaggggtgttgtgacatatttgacttgtttgcttaagttttctctatttctggtttgggaatttggctctgaggctaaggctgccacgaacctcagcctcatggatgacatatgcatatttcatgctaattctttcttcgttgtatacatttttttttatttttattttttttgagatgaagtctcgctctgtcgcccaggctggagtgcaatggcgcaatctcagctcagtgcaacctctgcatcccgggttctagtgattctcctgcctcagcctcctgagtagctgggattacaggcacacaccaccatgcccagctaatttttgtatttttatatttttagtagagatggggtttcaccatgttggtcaggctggtctcgaactcctgacctcgtgatccgcccacctcagcctcccaaagtgctgggattacaggcgtgagccaccatgcccagctattgtgtttttttaaaagtaaatttcagaggctttccagcaaaaccctggaaagcctgctagacaaattctcaaagagctgtaacacttcctatacatttactgttataaaattccagtttgtctatttttcctttcttgttgacattcttcttcaatggaggaaaagcaatttagttctttatggtagcattacctacattagcagaacaacagaaataatttaaatgtccatggtaatggtaaattactatatgctgaaataaaaaccatgtgataacatgggcactatttactaagcaatgttatgtaaaccccgccaaaaaactgtacatcgtcattataactacataaaaaaacagaattatatggataaaaaattggatgagaatctggtaaaatgaaaatatctattatgtggagagattatggatatatttacattttcatgtaatgctctgtaaagctatgattacaatacgtttaaaagatcaaggcagttaaagggagtttttgttataattaatcagacattatgccaatttcaaaactagaaggaatagaagatggctctacttgtgctgtctcaggaagatgaaaacagaggaagacgtccaaagaagtaaaataataaaatttaatactagcaaaccacggtattttgagcttgtaatgacacattaaaataactgtttctcatatgcattctgggcatctgcaatttcctcactgcctgtggaaggggaatttactagaatgtagatggctccaaagggttctctaccccactccaggcaagaagcctggactttctatatagcccgagtgtcactcaggctactcaagcgtgaatcttcaaaaaccttggcagaaatactcactccggctttcgtttcttgccagtttgctgggataacttttggtcgtttgtacatatggctctggaggtggcaaatcggaaatcggatggaagtagaatctgctttcccactcatctgggaagagaaacaagcagtatcttcagtgacagacaatgtgctatgaagacttacgtaacgaaaggcacagaatgaaagagagagagaaccacagacatcagtgctagtttttatgcctagaagtttacagaaaagctggaagtgctacaaaggtcacgaattagtacactgacatatatacaggcctgcaaatcaaagcaaagtggttttagtgagagtgattaggatccagccagtccctcttaggagctgggggctaaggtatgggacacctttttccccattgataacaatggcagagataggcaacttagtatctgcaggccgtcaggcctcttacctacagtgaactgtttagaaatgtacataataagaagctataaaaagattcttttcagaatcctggaatctctggaaagttaactaaaatgagacccaaacaaagaacagatcagggaaaaatgatccgcctttttgggaagtggggaagggggattactatttttaatttgaaatcatggtgggccttagaatggttagatagttagatcagtgcaatggagtgtgataatgatggaacaagaaattaaacgcaaacaagcaaaccacatatacaaacagatttaccatttagttgctgccctatagcccagggagctgggaccacacctcaccttcacatggagagtcttggaagccatttctaatagatgttgatggtggaggtgggggaggtgccccagcactgggcctatcaggaggaaggggaggcctgggtccactcctgggactgtctactccactcctggatggcaactgaggggtagcaggcagggcccgagatgtgctgccgtttctgcttactggaggaggtggtgggagggggcctggagcaaaaaaagacacttagtgcagaaccttacatccacattccattaccgtggtcaccattggtgtacagctgatgaggacttgctggacacatgccctttaattagggtgattttctaggatatttggctgagaaatgagtaaacacacagaaacacaaaaattgcacatgtgtacacatgtatatgcaaaacaagtgcatactgatagctaaatgggtgttttggctttgaattagcactcagattggagatggcacagtgaaattgaaaacaggtgaaaatctgtttacacggacaaccgtatatttaaaaaaacattttataatcctttaaagagctattgaactaattactgtgacatgatgaaagaatttttttaaaaagaataagatagttatgaaattattttaggtcttcagaagaacaaagttctttaaatgcatagttttgttgttaattacagaagcatgtttctgtgatgtatatgatctgtttccaggcagaagtggcatcaggaaaccaaataccagtcatcctgagagcagtaagagtttcttcttggttcttcctctttggggaggcagataaacacagggagtgacaaacagctaatcaacatccatggctataaatgctaatgtgaatcttgaccctgagcaagctggtaccctatggaacttggtttcctagctgtaaaagagtgccagatggtcacctgtctcacagcactgctgccaggaaaaactagtgaaaatgcaaataaaaaatactatgtaagtacttgaaaccattttttaaaaaaatgtagcagtatggtataaccataagtttttaagtttctaagaaaaattcaaggaaatttttttgataatacaaaagaaaaccatcttgcttttcctatcctccaaatgcaggggctatttgagtagtaagtaaattaaaaaaaacaaaaccaaaaacttgagcattttccaatgtaaatcaaaatggccttagtaattatgcctgctcttcagcagtgtgttccgcttgtaagatgctgacattttatgtgaatacaatgtcttaaggtgctataaataaatatcttattagctatagattcagaatccaattaggaaccttaaactgaacaacctgcccactgcagatatccctgacagaaagtcttggctccaacattttacagaggtgggaggcactgcccagccctgattggtctctcaaggagtcttcagtgcctcacctgggagtggttatttattaccctatctgcttgtcattgctggagtcccaggcagcaagagttgatttactgaggaaaagtgtctcatttgctgtggttttaacttcattggtgataccaccacacaactgtcactacatgcaaactcaacttccaatattatggggccctgtactacgtaacttcatctcattttctttttaaagtaaatggtcatgttcatgttcctaactctccaaccttgtggcaccctgctccaaatcctggcaggcacaatagaaaagaaaacagatttctatttcccactggcagaataacagaaatgatcatttattgaatataactatatgccaggaaataagataaccactatacatgcttgtctcatttaattcttataacaactctgagaggtacagggataggagacaaggcctcagaggttttggaagcttgaaaagctcatcagaagactgagtggaggagccaggatctgactccaaatctattagattccaaggcccactccccataacactgaagccaaacaactcagaatacacagggcctttgatgaactctcatacgctccttgtgggaatgtaaattggtaggaaattcctggaaggcaatttggcagtacctattgaaatccatagtttactatgcacactcactgacccagatattccacttataggaattaatccaaaggaaatacagagatgtgtacacatattttgctacaaaaatatatcactgcattatctgcaacaggaaaaatctagagatggcccatatgaccaagtgaggggattggttaaataaatcaaggtacatttgtaggatttaatattaggtagctgttacaagtcaggctgtagaataatcatatcagcaaacattaatgagatactgttaaataaaaagcaaattagcaaacaatatatgtagtgggataccaagtttgtaaaaacatgcattttaaaaagactgaaaggacacattaaaagaatgttatcaatgattatttctggatagtggtggtagaaggattaattttaattttctttatatttttcagtatttctataataaacaagtatgacttacgtaatcaaaagaaataataaatgttatatgtcaatgcctgtcatattttggggaagatttaatctgctgactcatccatttggtagggccatggcacaatggtttcaaggtgtggttctcacattctgctgcacactataatcaccagggagcttttaaatatcctgattcccagtctgcaccccagaccaattatgccagagactccgggaagggacccaggcattggtggtttttaaagctccgcagatgattccagtacgtgagcaagtttaaagaatggtgattatgaggttcctgaggtcacagggtcaaaggtctcttatctctgcgtaaaggaaaaaaatgccccatttccagacataataaggtctgtacgatgagattcaattttaaaagtgggtggttctactgagttcatccataaccactataaaacgcatcaagtgagcatattctactaaaaatgcctattataattcggagagggcaaactctaggcaatcctcacatttcctttcatactctgaaagtttgtccctcagatcaaggtttctcaactgtggatgggggcattggaagggtctcagatgggcttcagcaggctcttcaagccatgtgacagcaggcaaattttgagtttatgcctgagtatttttgtaaagatagtctatacctttatttgattctccaagggatttatgtaccagagattacaaagagcaaaatggactttttaaacattagtctttaatgaatagggaaatggcctcaaagcctggcgaatgaagagagaagtacaggagaagttcattagctcttgaagaacttcccctcttgttggaataacagagccctcctgcgggaggtggggacttattttcccaattaagaccgccgaaattctctctagggaggcagggtagtggactggcaagtacacttcagagatggaagatgaaagttcttgcctcttctttattaactagctcgtgaccatttaactttattagctactcagtgtcctcatctctaaaacaccaacagaaatattggtcccactttcccccggggtttacacgaggtcacgatcacacgtgtcgtgtgccacttaaaagcacaaagcagtctgagtttacttatgcctgcttttgttagactatcttgactgacaggattattggtacatttgggcaggctgggttttggaagcaactcactccacgtcttgtcatacctgatcggcctggcgggtccctcactggaggtgggggtctctcactgggcgggggaggaagaggacctgaacgtcctggcgaaggtaacgggggcgtggacgaactgagggacagattccgctgtgggagtcttggggtttcgtcattgccgctggaacttggaggcagaggaggcggcccgggcctgctgggaggtggcggcggaggtggggcctgtgaggaggccgaaggccgcggagtggaaggcactggaggcttgttgttctgaggaggaggagggggaaccgcttccctgtggatggagggcctgttgcccactggaggaggtggtggagggggtttgtcatccaaggccctgctgggggtaggcggcaggggaggccggttggagaagggcgaggaggagctcaagggggactgacgtattgagcctcctcccaaagcagtgccgcggtttccagggaaagggggaggagtgggcccggggctgggctgcctggggcctccgggcactggtggggacccccggttgtgcggacttgattgaatgggtcttggagtactaggtactggaggaggaatgctatcaggctttgagcccacgtcgggccttgggggcggcattcggttcctctgaggctctgggggaccacttctgtggcctggagaaggcacaggaaacctccctgggccacttgggggtgaaaagggtttcgcagatgtggatcttcctcccggtggcaacaatggtggtcggcttcctccagaatctgaagaacaggaaaacaaacatcagttaggaaatcaggaaccctgaagaaatcagagagctagagtctgttcccagtgactggaagtcccttcctcagagggctataaaatacaggaaactattatttatataaattgggttttgttggtccttcttgggagcagaaaatcgaccatagctctatttacctgcgagtcccaacttctacagcctatgagctttcaaaaggattctgcaaatatctcttagcattatgtataggcaagagccaggatgaagtgggcgagagttctggtgagatgcctattcattatgagaggacaagaacaagatggcattggtagaatcatgattttcatttttcctcatcaccatctctgtctcccagcccttgtacctctcagttttgaaactaagtcagctgtcttaggtgaaaaaattaattatcccaatgtaaatctccaaatgtgagggcttatctagtccctatgaagagaaatgccccaaaaaaagtggaaaactgtaaggggaaattataagaaaagagttatgactgcaataagaaaaaactaagaaaggaaaaagaaccatcagtaaagtttaattgtaagagttgacaccagtggatggaattcatctacaaagaagcaggcaactacacaacttttttttggtaccacgtcaacctctgcttcagtattggcaggacagaataatcccataactgctctggttcaacaagggagaaactaaagggggaaccaaagagatggaaaatttcaaaccaccatcccagaatctcttggaactcaaggtaattctgaaaaaaaaaaaaaaaatctacccatttatgagttaataagtgtaccaaataattttgagcacttgctatgcgcctgccattaatctagagactagagacagaggagtaaacagaatagaaaagattctgcattcctgtagtttacattcttgtggggggagataaacaataaaccaggaaataaatactttcagataattatatgtactaaaaagacactaaaataggccgatgagatcaagagtgcttggagaggccagggtacatggagtggctggggacagctcttctgagaatgtgacatgtgagctgaggcctgacaagaaggagtcagccacggaaagatgaggaagaccagcactttgggcagggttggccagcaggtgcagaggccctgaggtgggaaagagcttcaagttcaaaaacgggcccatgtgcccggggcacagtgagaatgggagagatccatgggaagtggagcctgagtggccagcaggggttagtcacaaggagccctgcaggacagaaggggttccgattttatctaaggcacaggaagaagcatttggacagatgtatacagtggagtatcatgaacttaagagagaactttcttcttctttttttttttttttttgagacagtgcctcctctgttgcccaggctggagtgcagtggtgcaatcacggctcattgcagcttcaacttcctgggctcaggcaatcctcccacctccgcctcctgggtagctgcgactacaggcaagagccaccatgcccactaactttttgtttttttttagtagagacaggattttgccatgttgcccaggctgttcttgaatttttgggcttcagccatctgcctgccttgacctgtgaaagtgctggaattataggtgtgagccaccatgcctggcccattttattattttatttttctttgtcttttgccttaatttcttcacctgttgttaaagtactaaatgtatacatttatcagctgccttaaatccttttggtgagttttaaataaatttaaattcaaatttaaatggtggtctggcaagatagaacctctcatgtgactgagtttctctctagatttggaccattcagtgataaaatagtaggctaaccctgaggattcagtgattccatattcatgtaaatgtgagagtttcattctttcccaggggacatcttataaaaggtctaaaaatgaaaattattataacatgatcaacattacaaaagcagttttatggtaaaatttcttgagtttctgtagtagctgggagagagcctcatgccctctgcaaagttttttatctaggcattcatgagcaagttcagtttttttctaccatcaggttcatagacaatcctgaaggactcatgtccatggctccctgcagagactcctgagaaccactggcactgaaataccaaatatctgtcatgcaaaacactttttcagatttagtgagatttgtaatcatattccacaagatgtgctccatcgtgtttgaaaagcggctcacaagtatttactctactagacagctgggctacctcacaaagaaagctgaatctgtcaggtcaccaggcagatttccagggccagcaagttctatttgctcctcccttttcttcccactccagctaaccctttagaaaagtaaaaaaaaaaaaatgtacaggttacccccaaagacactgggtgaaaatttcatagttctgtgtagctgtctgatcctggttaataataataataaagcctaaattgagtctcttataaaacagtggtaatatttaaaacaatgtacaatattttaataagggcgaagagccttagaggctatgaccagcctccaaactgccaaactctgccttgtcttcagtcactcagagacagggaaactctccttaccattatccctgttggccgtggatctcagcttcggcattccagcctggaacaatcctcccagacctggaggtccgccccctccaaaacttccaccgcctccgccaccacctcctccgccaaatccgccgcctccaccaaagccaccaccaccgcctccagcaccagctcctttaggttctgtagaagaagagacacccgacagactatgccccctggtctggcccaggtaaaccataaaacaacagtacaacagggagctggccggctctcggcctccagtggacaactgggatttcttcattaaaatgcaggattttaagagttccctcagctcagtcagaactgcccgctccaggcagtcccaagcccagtggtggaagaaacgaaaataaaggatgatttgtccccacactccccacttgactggctgccacatgggtcagtatctgtttgttccgtatcctaagatttggcaaatagaaggatcttcaggctgggtgcagtggctcacacatgtaatctcagcactttgggaggctgaggtgggaggatcgcttgagccagggaggtcaagactgcagggagccaagactgtgccactgcactccagcctgggtgacagtgagaccctgtctcagtaaaaaggatcttcaaagaaagagggtcgcaagggaggaggagatgccataaaaggcgagaagaaaggaaagagttaaaaagaaaagaaaataaaatatctcataatttcacaaatatacaaatatccaggctaggcacagtggctcacacctataataccagcactttgggaggctgagactggaggatagcttaggccccagaagtttgagaccaccctgggcaacaaagtgagacctcgtctctacgaaaataaacaacaacaacaaaatgtagccaggcatggtggtgcacacctgtagtcccagctacttaagaggctgagtgagaggatcacttgaacccactgaggctgcagtgagctatgattgcaccactgcactccagcaaaaaaaaaaaaaaaaaaacactaagcaaatatccacaattgagttatactttttcccatcagtatttttcattttatgtgttttttcttaaaattaagaacaaattcactaagcagtattaagcctgcttttttcatttaacactttgttagcacttcttgtgtcatactctttgaaaacatgagtttaaaggattctattgtattgtagaacatgaatgtattacattaaaatttatttaactactcatttgatggccctttagattgctattaattttttaatatcatgaagcccaatagtaggctttagtaatttaaacattctttgcaatttgagagggtataaagatcttgttttattttgaatttatctgcaaaaaattgtgaaagattttgatgggaggcaaacaaacaaacaaacaaaaagattactgagtattctgtctagtcttctgggttactttccattgtctttgagccacagtatcttatcactctgaaaggcatagaaaactgatactaatgcaatggtatttgtccaaagaagtgcaaattagttgtgtttaagccatgcttataccctctttaaaaaaattatctcttaatttatgtatgtatgcatgtttgtatttatgagcttaaacattatttaaagtcctcttcccaaaaaactatgttgagtttttgataaatagtatatgaaatctacaaattaatctgggagaactgatacttttatgatatttagactttccatttggagatgtggtatattttcccatttatttatgtcttctggattttttggcaaagttttttagtttttatgatatacattacacatgctttttgttagggttacttcaaatgtatttttgtttgctgaaattgtgaaagggatgtttttcctgttatattttgtaattggttatttttggcaccaggaaattgtatttaatatctaataagccactttgctatgttttctaaataaaatttactaaaaatgtattatcttgcattttctagtatgcacatggtcttcaaataatgacagtttaaagcctcctcttctctaagagttgtatgtcttatttctgttttatataagtaattactttgatgggtaaatttccataacaatgtaaattattaacgtttctaaaggcaatcatgttctgatattaatgagaatccctctgatatttcaaagttaatatgaattattggtttgaaataggttttttccctttctaaatattcagtctgtggatccttctattttaggtttacaagaatttattatagcatgaaattttatcaaatgcctattcaagatctactgaggctttttgatggtcttttttatttgatatgatggatagactttctaacattaaaaatgggataggccaggtgcaacggctcacacctgtaatcccaacactttgggaggccaaggcgggtggattgcttgagctcaggagttcaggaccagtctgagcaatatggtgagattcccatctctacaaaaaatgagccaaatgtggtggtgcatgcctgtagtcccagctagttgggaggctgaggtgggaggatcccttgagcttgggaggtcaaggatgcagtgagctgtgttcataccattactccagcctgggtgacaagacaagaccctgtctccaaaaaaaaaaaagggggataaaccctggtgttggtgaattattcttgtaacatctgattgatttagatttgttttttggtattttagtgttctcttatctatgatgataagtggtccataatagggtttcttaattataaacattttgggacagataattcttttttgtgggtggctgtcctgtcctgttctttacagaatgtttacagcatccctggcctctacccactagatgtcagtagcagccctccctgtcccccaaagtagtgactaaaaatgtcttcagacattgccacatatcccctggaatgcaaaaatcaccctcagttgaaaaccactaatgtacagctttctttttttatgtgctgcctttgtcaagttttgacattaggatcatgccaatttcattacaattattagacagccttccatctcttaatatattggggaatgacttatacagcatttgaattagctgtttcttaaaatttgaaagaatttgctaataaaataatctggctccaaaactttttggagagaaagtaatttaataaagtttttatcttttcccttgctcattgaggtttcctgaataaatatatgcttttcttagaaaagtactttctttaatatcttaaaacattttagcagataactttattacactactttaattttagaaaatatgctttgaatctcttattttatctgctttctgagttccacttttattcatttttatttccattttctggattaggtttatcataaatttgtgttagttctgtatcttttctagatgtggagctttctgagatgcttatggtagctctgctgtggaagaaataatctgataataactgacaagaattacttcacctaacaggataaatcatataagactaacaatttctagaagtgtatgcaaaattgtttccatataaaatttaaaaattttgctattaacatcgcccttgtcattcaaacactattcattgatgaatgacacattttggaatactgcacttcacaggacacgtttacatggtactgaaactttagagggactcctgcactatcagacatcacccattactgttcttttttttgtttttttgagatggagtttcacgcttgttgcccaggctggagtacaatggcacgatcttggctcactgcaacctctgcctcctgggttcaagcgattctcctgcctcagccttccaaatagctgggattacaggcatgcgccaccacacccggctaattttgtatttttaatagagatggggtttctccatgcctcaggtgatcccagcctcaggtgatcgacttgcctcagcctcccaaagtgctgggattacaggtgtgagccactgtgcctggcccattagtgttcttaacctgcaacatctgtccatctttcagaaagagaagctaaagctgaggattaagctttcagattattttttcagtaattaaactgtaggacagggctgagttatcacacataaccatggtcaacattttgacatacagcccagggaagtttcacatgcaaacagatacaaaactgtggataaacactgctgcttgcaaagagcttgtgacagcagtataggtgtccagttgagtgtgtggacaagggcctgcactggactgtatcttccttccatcaaggaaagcacattattaaacatcatggaagagagaaggactaacactatttccattaaataagagaagtggacattgaagaatacaattcttcaaggtttccactagtggattcaggaataggtctagactgtccagcctccttcaacagagccctaggctccctcttgcagtgaggagaaccacaggcctctgtcctagaggtcagctcctctggcctcataccagggaccatgattcagatggctattggagggcttggagggctgagggattagagggaatatattataaccacattcgttttgtgggcattttgacttacaagtcagactgtgtcaagagttaaataccttagttccttttttttttttgagacagagtcttgctctgttgcccaggctggagtgcagtggcacaatctcagctcaccgtaacttccacctccttggttcaagtgattcttgtgcctcagcctcccgagtagctgggactacaggcatgtgccaccacacctggctaatttttgtatttttagtagagatggggttttacaatgttgtcaaggctggtcttgaactcctggcctcaagtgatccacccgcctcagcctctaaaagtgctggaattacaggtgcgagccactgcgcccggccatagttcctttttgaaagcagtgcattctcactcgcagcactttgcccggtaacagaacaacattcaaaggccttatctaggtctttcacttttcctttttcctcccaaaccagtagtccacctaactctgatccttcttcttccttctctactcattaggtatttctcccagaaagttccctgaagcacttctaatcctttactttgcaaagattctgcctcattattcacttgttgacaaagatccatctggtgattttggaaggtcagtctatttcctgttccgtccaaatgggatctgtagtctaggatgaatcttggggacatctggcaggcaaaggaagggtctaggaatgtgaggagacaggcttaagatctacttattaattgccagtagaattctagtcatggattattttttgtcctgttgtaaatgttaataagtagctttgttccagaaagtacctcagacttaggtgggttgataactgaagttgtgacctcattttctttctctctaagctcctaataattgtatcttacacttgaattacactttccagacaacaaaacattttacaggcattatctcatttgaagctcatgacaaacttgtgaggtcaatagaacatgtattatcatctccattttaaaatgaagaaaacaaggcttggagatggtacaggatggatgtgccaggtcttgaacccacagcttttgattccaaggctagggctctttccatattttatgctgcctcctcatctgtggtgccaggagcaatgggttaatctccagaaagtgttgtgaataatgcagagaattgctgctgtgtatgtcttggacaaagaattattatactggcttcttgcagcattagaggggaacccaagccaaagctgcggcctacagggagtgatacagtcccttattttgctagctttgcagctgttgttaaccaaaaaataaaataaaataaaaattgagtggtgagggtagggttgattattaggccataaactgttcctctccatggtagatagcctttttttacttactgtccagtattggtgcacttctgtcattggtgaccgtcttctttagtttcttccctttgctgatatcagaaaggagagcatttctcccagcctgctctgtcttattcaaggtaggcttctctgtattggcctgaaagggagccatacaaacaagtagtcatctcttgggttaaaatcatgcattgtaacactcggctgggaaaggttgggtacgggaagcttgttgttaaggttcttggtgataggttgtaaattctcgacaagttttagaccccatatctttctttttaagatccagacgtttggaagcagatgcagcaataaattatgttcatttttaagggaggaagagtcagtccttgattaaagtctctgaaaattcagaccacaatctgactgaaactaacagggccaggttagggtgagatgactagacacgagaaaagaattttaagtctgggaggattctgcaggacattaccagacgtcattcactagagggtaccctgaagaataacttccttttcccatcttttagaactaccccagtgcaagggaaaaactgtctctagcaaaaagagtcagctgtatgttttttaaacccactaaagttctagaaaataattccctctgtgtatattgccaaagatgctttttttctctttttaagtcagatttattaaggtgtaatttacacatagtgaaatcaccctttttagttacagctctatgagttttgacaaacatatacagttgtgaaaccaccgtcacaatcaagatatagaatattttcattacttcaaaagttccctcatgtcctgttggcatgaggtgtttctgatgtttaattctgatgaaagcttagctcatggaaattgtggaatggacaaaaatgctgctttaacatgtctgattattttcttatatttccagaattcctaggaaagatccctacctactatgaaattgggatcttgttccttcagggagttggggacactaagagaccagcaaatggacttagatgtaggcacctgcctgtgtgcctgtgtctatcacacttggaaactggctaggtcttgtctgtctcagggagagtctggctgccccaaacccacaggtcctttctaggctggccccagcccttctgacagggatatgatttcagatttgccagttagggccacaggaggaaaagctggggaaatgtatggctcaataccttacccagcctttaaaaaacaatttttttttagagacagagtctcattatgttgcctaggctggagtgctgtggctattcacaggtgtgatcatcatgcaatacagcctcgaactcttgggctcaagtgatcctcctgcctcagcctcctgagtagttgggattacaggcacgagctactgctcctggcctaactcagccttttattagcagagttagaggcaaaggaagaactcagaaaaaccctgaagtaggctaaccagaattgcagtggtaaagttggaagcatcttgaaataactaaatgatgaagtattacttgcttatgataataatagttaacatatactctgtgccaggcactgttttcagcaccttatgtgtattacttcatttagcccttatcaaccctgtgagttattatttccattttacagacaaggaaactgaggtatagggagtttaaatcatttgccccaggcacctagttagttgaggaggagctgggattcaaaccctggcagtcaagagccttccctacaagctgatagaaggataaatgtgggctctaaaatgcccctccccatccagccccaacacaccgctgaagcatgcttgttaaaagtttctctgctgtccttccagaaatgctctctgcatacacagtttgcttttgctaatgggattctcctctattgttctgcaacttgtttgttttcaacttaacatactttggatgtcctggaaaagagctcttaacattacctgctgtcttcattttaaggatgaaaaaactctgaggcctagagaggttaagtgatgtgtcacactggatctcttaacagttttgggtcagcaaccttcagtagcctcctgttctgcctcaaaatttattttgacagctgacctccctgggtgctaacttctctcatgttcagggcccttaattatgttgtttcacaagggcagtgttctatgatggccaccaacccaccttttccctttcttcatctctatattctatttatccaaaatcttgctttgaattaggtaacaacggatagaaatgagttgataagataagcaaggtttcccaaacttcaagcattctggtataagattcatgatttttgtcatcttctcataccacctgtgttatttatttaatattttttattaagtcagttcactatagcccacacttttggggaaacatggataaatgaatcctgctatgtaagccagattggaggttctcaaacttacccatgtgaaggaccaactttttttttgttttttgtttttttgcgacagagtcttgctctatcacccaggctggagtgcagtagtgcaatcacagctcactgcagccttgacctcctgggctcaaacaatcctcccatctctgcctccagagtagctgggactataagcacgcaccgccatgtctggctggctaatttttaacattttttttgtagatatgggggtctcgccatgttgcccaggctggtctcgaactcctgggctcaagttatccttccaaagtgcacgcctggccaaggaccagtcttttgaaaaatattttcatcaggaactgacgcttttgtaaaataacaatgaattattagaaaaatgaattagttttttaaaaaagacacacaacatccaatcttagaaacagaaaactactgtcaaattgctagaaatgcttctaaatgcttactttcaacttttgtcctcatcactttggggactcttaaaaagcagttggaaggccacactctgagtaacaataagctaattaataggcagttcttctcactaggtttcaacctcagatgagttatataaatgtgtctcatggaaacctggggcaagaaactttctctccaagcctcagtttccccatgtgaaaatggtgaaaatgaaggaaccatcagtgtgaggctcctcctcagtgaaggcttcacaagctggagagggctttgtaacagagcgtatcttggggcctttccatatgaccaagtggagagttgccaaattcctgaagagggcacactaacttccccaaagaggtctatcaaaggagcaggatgagccgggcacagtggctcacgcctgtaatcccagcactttgggaggccgaggtgggtggatcaactgaggttaggagttcaagacaagcctggccaacatggtgaaaccccgtccatactaaaaatacaaaaattagctgggcatggtggtgcttgcctttagtcccagctacttgggaggctgaggcaggagaatcacttgaacgggaggtggaagttgcggtgagctgagatcgtgccattgcactccagcctgggtgacagagcgagactcaaaaaaaaaaaaaagaccaggatgaatccactgaagaaattctttcaggaaataaacatctaaatgcctaaatgcaagtatagatttaaaggaggatgtgaatgtgtatggcagaggtggtggagggagatatttgtcaaaaacagattgggaagaagaggggaaaaggcagaaaaaaagaaaggagtgagaccggaagacactttaatggaatgcactgcaggcagagacctgggtttctagaccgtccagcccagaagttaaaggccagacattgagttcatctgaatgaaaacagtgcacactggtctcagaactgatcctgcaaaccctatcttgggccagcacatgtccctgcgcagatgcggcagaaaacacctcatcagccacattccacccttgtactatccatcacacgagaccttaaacaaacaaaacccttcgtgttgtttgtatttgctgggtttcaggatttggcttaccctgggcactgggaaagcctgttgtatcacatgtgagccagaatgcaaacacatttaatacaaacacatgcacgccaggttttggcttcatttggcttgctttatgcatagaaagtgtttggggaggagacactcaccagtgcaaacgtcgggggcggcgggggtgctggagggggagggacaggcatcttgggcagttatgcgttcaacagtcttgctgataaatctggaaaaacaagaatgcgatcatgtattagatgtaatcttagtaatactgtcctaatctgtcttcactttcccaccaaagtgacagctccacctagctcaactcttagaagagatgggcttacctttacacctcactgctaaaacattactgttctggaaggatcccggcagaggggcttctgacccgaggtgcttggagagaatggaggccacatccagtgccttactcggctccattcccccacccactacagtaggccatgaccgacccaggtgggcccagttaagcaggaaggtctcacacaactgctaggatgtatcctggccaagtttcactgaaaacaaattcacttcaagtggcttctcctcttcgctaatttccatgacaatcctttcatgctctcccaccccctctggctttctcctcccattcttcctgacattcgccaagtctgtgtgtgcactgcaggaatatgaaaatgaatctacttctagtcccgccctcaaagttcctagtcctccagggagagggcatggagaatgtcaggtggaaagcagggagcagcagctgaggcggggtggacgtgtggggggtcaaccttatgtttggagcactcaaagaccagccatccctatctctgtgctccttagcatttcctcagaggatctaagcgaaaacagagcgggcatgagaagtcagacctaggactcccaggctgtttaccagaaatgcatttcatttagaagagcctgtcttagctttgtttgggtaaaaaattatatataaataaaataaaaaagaagagcctttctgcagagtgtgcttgctctgaaaacaaagggaagaccagattccgtagctgggtaggaaagtttagggaccccaggtgggtgagggggcagggcggagagggcagcctggcaaacaccagggccaggagagacgatggccaggaagtgcctggtgagttacaccagccaggagccctctccccatttcctctaatccttgcagtcctgttccttcgcctcactagaacccctgctccctctgccctgtctaggacaacgcctcacccactgttctcatccctaagcaatgccagcttctcccaccccatccttgctacacaaactgtggtcctggataggcagcgtgggcaccacccagaagctgttagaaatgtcaactcccagtcccttttgcccccagctgaattcgtttcagcattttaacaagatccctgggtgattcatacgcactaaagccctatgtagagatcgagccttaagccagcgggcagtctgggtcactggccacctgaataacattatttctacaggacatgtgtcccaaattttaaactgcagaattatatttctttaaaaaatttttttaaatttttttttggagatgaggtcttgctctgtcacacaggctggaatgcagtggcataatcatagcttactgttgcctcaaattcctgggcctaagcaatcctcctgcctcactcctgagtagcttagctaggactgcaggcatatgccaccacgcctggctaatttatttttatcttttatttttgttgtgatgggtcttgctatgttgcccaggctagttttgaactcctggcctcatgcgatcctcctgccttagcctcccatagtgctgggattacaggtgtgagccactgtgtcaggctttttaaactcccaatagtcccttaattgcaaaaaacaatttcttagaatttaaaatattcatttagttcaaccactacaagttaatgtggaaaactgaaacctaaacaaatactttctattgagataatgctaaatggcttgctttctgtgaacagaaatggactggagaagctaaaaaagacactgctggacttgtcacagccgccgggaaacaagaattaagacagttcggaagagtcccattcaaagtgggcggtctagaaaatgaaaattttaaattccacagcagcaacagcagctctcatgtatggagaatctgctggatccagggctctatccttgcgtggtctctgactcctaagacagcggaagccagcatcgctgtgctcatttgatagactcagagaaattaaatcactccctaaaacaccctgaagcaattcattcagtcatgtccttttgcttcctgctcttctgctggataacactgcctcactcactcactgcccttttaatggtctgataaacactttcaggcaggcgaattagtgccacagctcacctgttaactaggctggaatctgttttcagtaagagactgtctcaggcaaggattcttttaaagtctgtttcttaaattgctctttctggcatgacatcaattagtcacccatagggccacatgggcattgtgagcaggactgggtgcctgtgttagggggtcctccatcaaggggcatctccagcggcacattcagaggccttggagtcagacgtctcctaggaccagcaggaacgaaagggatctgattcaggcctgactactgcgaaagatgctggagccaaatcaatggtatgatcagagttgggaaaggcttaccaaggaagggggatagcctggtctgcccggtgggcccaagagatgggctgtgggaacagtgcatccacgtgcttggttgatgaaaaatccctcaagactattttgtctgactccacgttcaccgattaactttctgtcattctgtgatcctaatatctaggaaagggtggatattctggtcaactaacaggaacctcttatgggtatggttgtcatgagttcggctctcgtaacagagatcaaattgaacttctgtcctgcacagcttagggggcagactgtggaatggggaccctttcaggggctgccaccctgaaaggcctccttaattattttacaattctctgttgctgctgttttagtactgtctgtgcactaactgacttgtatattaacttctggatgacagctccagggagggcgtgttaacttcatggtccagagggctagtgtgggagaaatggcaacagtcatggctggggccagagccaaggccagattgcagaaattagcaggcaaaaacaaggttcagggagcaagatgctattaaagggtctgaggtattgaaagaagtgctgcctttccttcctggccacttcagatggacagtggggagagggtctacgggtgagggctctcactttttagagggtgatgcagaactaagtgctctttcctctcttcctctgcgaacttgtttgcatggcttgctttccctggccccatctctcactcccctccagattaactgtccctttccaatctcaatggtaacacagatgagggaggctgccatgtcctctctcctcccttctagctgaacaactgctgggcacggtctggacttctccaggctggggcctcaagggaagtgtgtgagaaaccccagactccaatactgccacctcactcagcccctggatcaaagaccaagctcgtgtgccccaacactgggcccaccggccacaccaggcccacttcttggctgtctttccaccagcctatggactccatggggtcttgccaatacctggcacaaagtagggttcttactaaatatatatgcagtgaaagaactgtgtatcacacaaacaagccgagtgcttgccacttgaagggctcccagcatcaccccaccgcactgtgagatctgggcaaaagaatcagccctatttcagaggggcttgctagtgttgcagactggaacttactttcctggcagcctccaacttccccagagaagtagagccccaaggccctgggagaggagggcttccctcctctcatggacttgacagcccacatcagagccacagccagatcttactgaaggccttggccctagagcacggatcctaacagaccaggcattcctgcctggatcctcacacccagagtctgtggatagaattcaagggttcatgaacttgtatgaaaaaaaagtacatattatttctactaagcactaactgaaatgtagcatttcctttgattatgaatgcaggccacaaaccataatatctgatattctttcacccatagttttcacgtgatatttcacatcatattacaactacacaccaacaattttcaacatgctggcaacgtttagatccattgctagatcttgttgtttaaaccattaataaagaagtacatattttaataaattagtttcctttgtaattctctgtattttattttatgcatttaaacgtagacacaaaagggtccctttgggactgggagtggtgacttatgcctataatcccaacactttgggtggtcaaggtgggaggactgcttgagcccaggagtttaagactagcttgggctacaaagtgagccctttatctctaaaaataaaataaaataaaataaaaacaaattaaaattaaattttttaaaaaaaggagtcctttgggctttaccagtgggtttatagaatgaaaaagggagaacatgagaccttggtcaggcaaatttggttctgaatccttgctctgccacctggcagattcagatgggaatttgtttttcccatctgttaaatgggaagttgctgagcagattaaatgaaatggtgtgtgcaaggctttcagcatggcctgggggagcaaagctgtcagtggacagggcttagctctgtccttcagagggtgaggatgggtcctgctggtacaagctgctgagtgcctggcagaggagggatggacctggaggctagtctgaggggccacagctttgctcagtggctgtgggtggatctgcctgggtgggaatgaggctgactgatgactgggcctcccagcatttggttcttcccttggagatgggagcatggcaggaaaggcagctgattcgggtgcaggagagacgcaagaagggaagggactcagcagcagtttcccagtgtggtcagtcatctcctgcatcagaatctgctgtgcctgtgtccggcttcccagactagttgggctctcagtagtgtcggatcacatgcctacccacttgctgggccttgccctcctaccccaccccaacccaagcaatgaacttttaagaagtcacacttttcagaattaatttctttttaagaataatttcaatgttaagtaactttcatgatagaaaagccagactttctaaaatctttacttggtgtgttgacttctacaaacacaaagaaaactcaagggacagaaaaggcttttgttttcacatacagtattacggtctgaactatgtcccctgcaaaagtgatatgctgaattcctgaccctcaggacctcagaaggcaactgtatttggagatagggtctttaaagaggtgattaagctaaaatgaggccattgggtgagatcttaatccaatttgactggtgtcctcatacaaagaggaagagacatcaggcatgtgctcacacagaggaaagtcttcaagtgaagacgcagtgagaaggtggcaaaccaaggaaagaggcttcagaacacaccaaacctgcccacatcttgatcttggacttccagcttccagagctgggagaaaacaaatttctgttatttgatctacccaggctgtggtattttattatggcagtcctagcaaattaatacacatggttttaacaacatacgtttgtctattatccattgtggaaacaataagataatggcctttgaataaactatccatcaactgatttctcagcaagatatttctggattgtcatacgttaaaaaatttaaaaatcagccagaaccctagagtatgtaagtgactgccaaaggtttatttaataagtgaatgaatcattcaaaaataatgaaattttaggtgaaaatagctgaagtaaggggagggatctagcaataaccctttcgtaaggaactggctttatgggttgagagaacagagtgaaataatttgcataaatgactttaaaaatttaattactgtttcttctttgttgcttacacacacacacacacacacacacacacacaccaccccaacatttagaaattctggacttcctagttcattctgtgaatgaaatggctggcatcgtttgtcttactagaatgctattaggtcaacatcatggtttaacacttacatttagacaacattcactgatcccagatcaactagggcatcttgcagcctcgactcacttgttaaacatgcaatgttcgctacaacgagcactgtgagagaaagagaactgctcagcccactcccaacagtacaggggacacattctcctcaatggcatggccaactagaggtcaaccatagctcacagttcagtccagacgtgccccaggaaactcagggtttcttcttcaatgtgctcatctaggaaagcagactcatccctgaatgtaaaatgattgccttccttgggatcaagaaagtggggtagttatttaaataagctgtttcttagtttcatagccaacttacaattaattctagattgcactgcctagggcccacactacagaatgacatgaggtggggagtgattcctaatagtccccagtgaacacagttgacaatcctccaaaggccggtctctaatcccaagtgggcaggggttctattagagaagataagaagcagctttatccaattacatttatcattaatttggactattcaaaaatataaagcattttgctctataaatgttgctaaaagtaacccttaaatactatcatacctaaaatgaatggtggaatattaaacttcttttccccaaaaagattgaatcaatagaggaatattttatttgctgggggtgggggagggtatcagaaataatataactggatagattcaaaaatccaactgctctcttgccctcattattttctatttttatttacatttatttattgattttttttttttttttttgagacagagtctggctctgttgcccaggctggagtgcagtggtacgatcttggctcactgcaacctccacctcctgggttcaaacaattctcctgcctcagcctcccgagtagctgggattacaggcgtgtgccatcacacttggctaatttttgtattcttggtagagatggggtttcaccatgttggccaggctggtcttgaactcctgacctcacgtgatccacccgcatcagcctcccaagatgctatgataataggcatgagccaccatgcctgaactcatttatattttactttatatataatgctcttaactcattttcatctatgtatttcttgagtgcttttggcatcttcaggttagttttttgtttgttgttgttttcttcaagatttcttttttttcttttatattgtagagaatacaaaaatatacaaagatgaaaaaaaaaagcactgaagttgtatttaaccactaaaggaagcactgaataataattaatttttatatgaaaaagggttgggggtaataaccagaggtaactctttgttattttgatacatgtccttccagcttataagtacatgtacatctctctctctctccctctctctctctgtgtcacacatacacatatacacacaattgtttgacaaaaaaatattaacagaacaaaatttataatacatgtaacacaaaagtgttttcctgagaaaaggtttttaaattcatattgagttattacaaccataaaaaataactgcaagggcattcattacaaagacagtgaatccactccaagtcaccctgcaaaaataaaatcatcgagcaaactcaaattgctgctaagacggtgaattttaaaaagcatgtcgttttgggattcctactcaattattcttgattctattctttagatactcctccatgatgcaaacttagctggatgtatttaagatctgaaaaccattagaactaattaagatgaatttggctttgttcttcaacttcctgtaaaaaatgctcaacaggaaaattgatgctcgcagtaaaccacagtcatcctgtttctttaacacaatcttttcacagctgcagttgcctggagtttctattttatgacgcgagtcactgcaacagctctaccatcccttccccccagcatgtggtctggccattttagaaactttcaatacctttgcagaaaggttcgtttctattattgctactcttcctctctccaagctgaaggtccttgctcagagcaataagccatggatacaagaggggaaacagaaaaggcagctggactccagaggaagcaaaaggcagagaagaggaaaacagctttattagcaaatcagcagcctcacccagttggttcttatgcattgttagtctccatttgagctgaatgtggagcacacgcttgccatacacagaatccctcatttctcaaaatgtactgctcttttctcagtcaatcatcattgaaaaacaatacttcagcaacgtctgattaggttgtcttcttaatggtaaatgtcaatttaagtctgctgaacctagaaatgcttcttttatagttcttttagataaggaggtgatttattttggcggggagtaggaaaggtgtttttcaaagaagacattttgaagcatctcgaacatcactaagactggctaggagcttggacacaattttactgcaagagtactgctagggaaataaaggttgctatgaagtaaaattattttttaatccactattgtgcacatttaattttaaaattaatacaaattcacagacatcgaagacccttttaatagtgagaaaatgaaggtgagctgaatgacacgcctacctgtcattatttaactgaaggaaagggaaaggaaacatttttattttatccatataattaaagagtagcaggttttctcccatacttcccatctctttaaggggttcaaatctccaagctaaaatctgcctaaatcgctatcaccacatttagttctaccagaggattaagatgtgccactgtttctctctctctctttctctctctctctctctcacacacacatacacacacagcatatatgtcagcacacttgatatatactgtattcattttatcattgaaagtacagctttatgatataagcagaagtgtcaccaagtttacctctgaagaagtgaaaagacttaaaaaggaaaatatcttacttgagattgttagttttaaagatatttactgttgctgtgacatttaaagcaaaacatttgtaatctcagattcccaaggccggaaaagcacctcaagaaatcatactggctgggtgtcgtagctcatgactataatcccagcactctgggaggccagggtgggaagatagcttgagcccaagagtttgagaccatcctgggcaaacatagtgggaccctcatctctacaaaaaaaaaaaaaaaaaaaaaatatatatatatatatatatatatatatataattaactgggcatggtggcacacatctgtagttccagctacttgggaggctgaggtgggaggactgcttgagtccaggagtttgagggtgcagtgagctgtgatcatgccattgcactccagtgtggatgacagagcaaaaccctgtctcaaaaaaaaaaaaaaaaaaaacagaaaagaaaaagaaaaacagaaatcatacaatttataatgttgcttccaagctgcacttgtgaaaaaaagctcttacaattcagataacttcctccacatttagttgttaggtggccttgggtaaattacttagcttatgtaagtccggttttcaaaataatagcacctacttagtagggttattcaagagttaaatgaaggagtgcttaataagtattagccattttcaaaaaataaaataagcaaaggtgaagaacgtaacacaaaataagtggtcagtaaatatcacagtctttccccctatttaaccacgagaaagagaaaccatgagctgatttaaatcagcctatgtgtgtacacccatgcaaacttccatattacaagtgaatggtgaagggagatgtgtataaagtgcatttcaaatttctcagaaaagcatactgattaaggcattccttattctagtatttttttacagttttaattttcaggacagacagaggtatttatggaagtccaggagaaatgctttcttcaacaacaagcacatgtttaacaatttggacaaaatgagtcaaaccttaaagcagaaatatatcataatttaaacagccagaaacttccaaagtaaatgatgtgtgttcataaaatgttaagaaggcttcaaaaggtcataacacttaaagggtccaggaattcagtatcacttcatctcatattttaggtaggctggggaacttccagcctacaggccagatttagaatttgatcagatctgaagttgctgctcgatcccaggaactaattttcaccacagggagttctctgaatatttcagtccacccagagtatgtgtaacccttaaaaggttagatattagagtagctgaagcgctatgagcaaatagcccatgaataaacttttcaaagagcaatagaaaacctgacttagtgaaaaatgactttcaggtaagtcatttaatgaccttagactgataaaaggaagagttttgacatgatgatattccagtacagaagaacaaagcttgataaagttaacacatagcactgtagtccaagtgaattgtaagagtatgatttccacacagatcaacctcaaaaccttttcccagtttctcatcttcctttctcactgtcctgtcctattctttccccagtctttcatctttctctctaccaagctgtcttactttgcttagttagaatctttcagtagccttttcatttaccacctctccattctctactacatatactagttatgccattaaattatttaaaataacttgtatgcctgtaatcccagcactttgggaggccgaggcgggcagatcacttgaggtcaggagtttgagaccagcctgaccaacatgatgaaaccctgtctctactaaaaatacaaaaacaaaaaaaacaaaaaacttgtacttagtgactaaagttatatgtgccttctgagttttttaaagctttattttatatttcttcacggggagaaaggaacataagtcaaattgtttcttcctacatattctagaaaaaagttttttaatgtaaaaagtttccttagttctgctctataagcctctgagtagatggcttgaaattttaaaaatcacaatattttatgccaaaacattaatcatattaaacataaagttataactaatgctgtagaatttgatttgcgatagtaattgtgcacacactgttataacaggaatagacttattctaaaagacaaatcgtattataaaagactctgcttagaaatggtttagtttgagttttgaacttaaatagcacattggcagcaacagaactgcaacagcttagttccatggtattttcgtttgaagcttccaatggctccttgtactttaaagcacttattgttgctggccacaccaaagattcaaaggcagttgtgtggacaactgtatcatacaccaaaaggatatatttaccgacataagcccccaatttaaatgggaaaataaattcctgtggatccaaacttgtccagtggtcaaaaaaattctattgaaaatcttgcttacattttggctcaaagcataagttatgaatcattcacaatcaccatagtggtgaaactagcattctgggcaacaggaatagctcacatggtgctctacagaaaaattaaacaactttatcttgacatactatggtccattaaaagccatttagttcttccctgtagctgataaatgaaataaacttagtttgaatataatttttcttaccgttaaagggtactgcagggagccatggtcagggacacaggcagacagagggccagcgggacaggagccaagagagaaaactgtccctgaaaaaggtatcatcttctaacgcaagtgtggggtcgtttttggacagccattttggacaagctctggcctcttgttaaatgtgacatactgagtcagaggcagacgtccttctgtggttattcgcttcctgtctgattaatttgttgtttgttgttccttcctcctttgctgcagaaaaagaaactagattggttttgcttaagaagcaagcaagaaaaaaaacctaaattaaaaaaaattaaatgtttctcctccccacaaggtgtaatacacagctatttggtacagtgacaagaggagatgagcacctccactcagtgaagagtccaactttattctagatattcccacaaaaataactgttcatggaacttgagattcctttaggaaaattatatttgaaagtatcactgtaaatactgactattccattgagtaatagggaaaagagtcactcaagaaagaaaagctcttacctaccttaccttatcgcttcattaggctaagggcttcttctcatttacagggcattcaagtgtgtggggagaaagttacaaatgcaggtaaagagagcaggtcaggtgtatgaaggcaaatgaggttctttttttggttttgttttatttatttctttttttttagagagacagtcttgctgtcacttaggctggagtgcagtggcgtaatcatagctccctgtggccctgacctcctgggttcgagcaatcctccagcctcagcctcctgagtagctgagactacaggcatatgccactgcacctggctaatttattttatttttatatttggtagagatgggatcttgctttgttgcccagcctggtcttgcactcctagcttcaaagtgatccttccatcttagcttcccagattgctgggattacaggcttgagctaccatacttggcagcaaatgagttttgaaacgtgattttggtgcccaagtcagggtaataatatacagcttaagtcagctgcagatccatagctttctatgccaaatgtttctgtcccccacacttaatgggataacagtaactctcctagaagatgcttgacaaaagcatagagataaagagggtggaaggaagaaagtcagatttctcattattaaagaactcaagaggtggatggcaatggaatacatgtagaaaacattttatcaaaaccttgagttatgtatagaacgatctgaaaatgctcataattttttcttaacccatcttaaaggttcagacttacatatgcaacacatagtatataactctgagaaaacagtaacagtcaaagaatttaaaagagaggcatatttcagaaactagcttcattgtaaaatctgaatgttgggtcctgattctgctaggatcagaggccagaggcatgaaaagaacgtatgttgtctaacattgccttacctgtaaagtgatggaactgggctagatgagtaattttcaactcaggtagctgttgggggtggtgagcagtgagtgggaatggtgggggcaggggcctgtagcattcagtgggtggggccaggaatgggaaatttcctatggtgcttatgacagtcccacccaaaataccagaagtgctcctactggggagtactgggacagatgatgtctaaggatcttttaaactcaaaattccctgagataggagtctaattgcatgagcagattcatgatgccaggccatgggcacagttcctggagtggagtacccaagaataagtgactgagagtcctctgctttgcctggagccccttgaaggcagggaccgcctcttgtctaactctggcctggtgtccacccgtgacttaggtcacaaataaatacctgcaggcatggggctggacagaggtggaggcctacagctatcagccacttcccgcgatacaaaccctcaggaaaacagaaaacttgatcaactattaagtaaatgcctgagtgaatctttggggaagtctaattatagttgggtctaaaaagagaacatgggcgatatgacaatttctctacgtattttcagaattattttgaagttctctaagtaagacaccccaaacacacacacacacactctctctctctctctctctagctatctctctctctctctctctctctcagtacacataccattcatggctatttccatcccttaggggagtggtccctaacctttttggcaccagggactggttttgtggaagataatttttccacggagtgggggcagggggtggggatggtttcaggatgaaactgctccaactcagatcatcaggcattagattctcataaggagctcgcatgcacagttcactttaggattcttgctcctctgagaatctaatgcgcagctgatctgataggaggcagagctcaggagggaacacttgctcaccagctgctcacttcctgctgtgtggcctggttcctaaggggccatagactggttggagacccctaccttaggaaaagctcacttagaagggagtatgtcacctagaaggctgcagtccccaagacatgcaagggagtagttgtgtagtttgagtctattcctacagtcaactttggacacatttatcaggtgtctactatgcatgttaggacataaattagataatgttcctcccctgcttaaaaccctccaatgacttctcatttcacttaaaaagtccaaactcttaggtccacagggacccacgagatctggcccctccttaactctctgccttcatctcaagtaatattctgccttgctaatttaccttccaaatctttctgttccttaaatgcaccaagctcatttgcatcttcaggccttttacttgcaagcctggtactcacgcctggtacactcatctttttgttcctttttattcttcaaatgtcagcaaaaatgctctccctcatgacccatttctgctgttttcttttatgcatagcatgcgtcaccgcttgacactgtcttatttatctgtttatttacttgtatgtttctctccactagaattcaagctctatgagagcagggaccttgtccatcttgtttctgctgttgcttcagcatctaatgcaggtgtttgactgctgttgcttcagcatctaatgcaggtgtttgaaaatagtgtttgttgaatggaaaagaaaatcaatgtttcttacgaattctactacagcataatgttccttttttttttttttttttttttttttttttgagacagagtcgtactctgtcacccaggctggagtgcagtggcatgaccttggttcattgcaatcttcacttcccaggttcaagcgattctcatgtcttggcctccctagctgggactacagtcgtgcaccaccacgcctggctaattttttttttgtatttttagtagagacggggtttcgccatgttggccaggctggtctccaactcctggcctcaagtgatctgtccacctcagcctcccaaagtgctgggattataggtgtgaaccaccacgctgcccagcataatgttcctttaaaagcttaagactgttccccctgaaatggtaaataacaaatgccaagactagacttaagccttcttgggagaagctgttaaagggaaattttccagagaaaaggtcagcaggtaaaacccttggcccatcagtgggcctggcagtgcaggcagagtcttatgcagtgcaggtggcttacaccattgggcaatgtgaagagaaaaatggattaagaaaattgaaaacaaatagaacaatcagaaaggaagggggggaaataaaaagataaagaaaataaggcaagaaaagctggagatggggagagatcatgtggtgggtagaggagagctacaaccacactgctgacctcagaggctttggaagccacctctgcagtggatgacccacaggtgctggatgtaacagtgctgtctggccttccgcagtgaagcggagttctcagctcagtgtcagcttttccagcagccacgttctttaaaaagaaaagaactttaaggctgcaggagacttgcagagatcaaagtctacatcaccacttacagaggaagaaacaggggtccagagaagttaggcatcctgctcatgtcacacagctggcagcagcagagcagtggccaaagcctgggctccactccactgtccagcgccattaatgtctttagcctcatttcaggttcgggtgataccacctacctcctttctgtaagtacaagaagaggcagaagaaagagggtggagagaaaggctgtgatgcggatgggagaggttgttatactataaccaaaggcctgagataagtggattgaaagcctggatgaataaagacaatcacaattctggacttaaagagaattttaaatgcgtatctctttcccatttaatatgcatcagtctgagcttaatgacagagtaaaacaataaccaataggctcgcagaccaatcacataaagaatcctccatattaatctatagaaataaaaaaccaagagcaggcagaagattataaaacaataatgtaggtctagccagtgtagaaaaagtgctgaagaatcacagcctcctgccgtggcccccagtcaacatggactgaatcagtgcaacagtggcatgtgtaaaatatggcaacataagttttaaataattctggtttttcaagttgtgtttccatgactacctgttatggtgcagtatttccccagtagtggaaaggtgttttataatactgcatcccgcagttctaaaacttacattattccttcttatactgcagaatgactccttatagatttttagggtgaaaaagaaacactaccagattaaagatatgcattagttgtaagaatctattttcaaaatgttaaaatatgggaattatttgatttaaaagagcagaaacaaaggaataatcctctccaccacataattatcagtacagctacatacagggttgatcatttaaaaataatctcagaaacatagataaattaaaaacaaaccttgtagtattctgcaccctgttaatataaattgatgtaatcttacttggggaaaagtctgcagtgtattctgttgtgttttggcagctcagcaaccattccccctacttataatcacgtccatttgtttgtatggagaatcatcccgtgctcactctcaaaccatgtgcatccagaggcattcactcccattccagacagaggaaaagcatgtgattcaaggctggctaatcagagccttgcattcatttggccctagagacttctggtgatggcttgtgatcatcagaatcaaggaaatttgtaggctgaggcgagctctatccctgagggatgaggctggaaccagatctgttgaggatgtaggggatgggcctgctgcactcatcctttgaccacatggggtctaaaaccaagaccaacaaaatgggaattggaagagggagaaaaaccaagtgctggtgttgttggttgagccctgaatctatctataactgaagatggcctttttctagacctttaatttatgcaaataaattctctattttatttaagctggtatggtcacgttttctatcattagcaatgcaaagactcttaagtgataaaggaattggtactagaagtgagtgttgaatgtgactaagcctaaaatgtgcaactggctgatttgaggttggggaaggctagcgcaggctggcctggactggaaaattggcagtccttgttaagtgacaacaaaatagctagttatgctgccacctattgactcctcggtctgagacaggagcctactcatggtacaccattaatggattcactggaaaagcatttagaatggtgcagtgtgttggctatttcttgtgtcttttagtaagatccacaggaaagagataaatgtaggctcaaaactgactagaggcacagagggaaaaaatacggctttgttaagagaggcctttttttggctgtgatctgcaaccaagatgggtgagagtcaaataatttggagacttgcaggttggaaaacccaaattctctacagcatgctaacattagatagagtggggagggacccgatcataatcctgagagacacaattccaaacaccagaatcctgaatactgaaatcccaaaagatcaaaatcctgaaaatataattctggaagaaataatagagaattatttgaaagatatttatttacattttaaaggaggatttatttaagaaacatataaaaacatgacagaacacttcataggccattttacacaataaaatagacaataataacacaaatatttttgcaagcataaacactcaggtattccaacgacagtagcacaggtatagaagttataagcagacatctgtattcataaagaaatagggcaagaagagaagtgtacaaatgcatatcactacagttggtattgtttgtgcccagctttataaatttggtcatctgaaatactgtgacaaagaatcttttgatgagatcaataaaaaactgtgacatgcagttaccacataggcagttgcccaaagagctgagatctcaagaaattttcttcacaaacgcagatttgtataaaaggccatctcttcatttattgaggatgtttcaacatttttatgtatatgcgcaatgcttacacacaaagtcaatgctgtgctgatgcatttttatggagttaaatttgcaaaaaaggcatttaatgaattagaattttccaaaagtctcttcacaatgtatatgtccagtattggaaatgatgaaaagatgaaatagatggcatagtgaattataaaaaatcatgctgaaactttaaaatagtggaaaaaaaactaaaataagaaaaagaactaaaaagaaaattcaacatatgaaaagagtattatggggatagattatgggcaattgcatggagatagtccgaagagctggcctaacatgatgcagctattctgtgattgtgattttggggattttagatgttcaggattttagactttagagatttatactttagggattttcatctttgggaatttcaacattcgggattatggtgttctggactgtgtcttttgggattatgatccagatctggagtaactctactctgactccaggaatggaaagtgaccagccctggctaattaaagccttgggttccctggctgcagtgactggttcagagactacttttgaaccaaggagatgtagtgagacttattctaaggtgtgtggggctgaattggtagtatgttatccacattagaggtgtggggctggaatggcagtattatacccacattatagacgtggagactgagcatgaagccaatgcagtaagagcgaggggagcctgagactcaagaggtacagcaatcaaaagcaacatgtgggccagcgcaggggctcgcgcctgtaatcccagcactttgggaggcagaggcaggcggatcacaatatcaggagttcgagaccaatctgaccaacatggtgaaaccctgtccctaccaaaaatacaaaaattagctgggcgtggtggggtggtgcgcacctgtaatcccagctactcaggaggctaaggcaggagaattgcttgaacccggaaggcggaggttacagtgagccgagattacgccactgcattccagcctgggcgacagagcaagactctgtgtcaaacaaacaaacaaacaaaaggcaacgtgtagatgttacttggatcctgagtcaaataaactaaaaaacaaaaatgaggcaattggaaatttggatattgttcagatatttaatgatattaagatattgataattgttaggtgtgataatgttactgtggttatattgtattttacaaagaatccctaacttttagagatatatactgaaatatttgtggatgaaatatgatgcctgggcttgtttccaaagtaatatagaaaaggagggaaagtgggtaggggtacaaatgaaacaaaattgatcatgaaatagccattcttgaagctgggtgaggagtacacagcagtttgttacacagttctgtctacttttcatatatatttaaaatgtttccataacaaaaagcattaaaaaaaaaagacttgtggctcattcccttccttatccactagaggctgttaaagaggtttgcttaatctagtgtaaaaatgctcagacttgtagaggtaacttacagagttacagaagttaccttttacttctcaaaataatttcttttgctcttggagaaactggatagaatgagggctcccctacaatggtcaaagaacaagtggttcttcccagaaaaggagtaaactctcaaaatctgaacacccattattagtggcaataaaaaagtaaaaataaaagtccaaccaacaaaagaacagacccttttttctagatcagcactgttcagtagaaatataatttgagttacgtgtgcaattctatattttctacgagctatgttagaaatagtaaaagtaaataggtgagattgtaatattttcttttaacacactacttcaaaaatagtatcaaaaaaaccaatgaaaatccccccaaatagtatcattataacatgtactaaacatttgaaaagaactatgaattaggtattttatactctttttttcacaagaagtcttcagaaactggtgtttactttactactggcagcacttcaagtgctccagagccactaccacactgggcaacacaactctagacagtgagggcctgacacgcaggccccatcttactcatcttttatgctggcaggatgcctgaatgacacttaacagatgttcaatcaatgtcagtcccggaaaagtcttggtccacctagagccaactctgcgctttatagttataaattcttaggaagagtttattctgcttgaagccatctcttaaaacaaggaattgactaggtattgttggatttgtggccagtagaagagctaaattggcttctcttccccgaggtcttagtgctaacacttctagtaccacatgtgaagagatactgcagtaaagaagttttaaattaagggctcagaaaaaatacattgccttagtctgttttgtgctgctgtaacagaatactggcgactgagtaatttatgaaaaggccagatacggttctggatgctgagaagtccaaggtcgaggggccacatctggtgagggccttcttgccgtgtcattaccatggctgaaggcaagagagcatgcacaatgagaggcagggaaggaaggaaacagaattcatccttttatcaagaacccactcttgtgataactaacctagtcccatgataaggacattaattcatttataagggcagagcactcaggacctaatcatctcttaaaggttccacctctcctttgggaggctgaggcaggcggatcacgagggcaggagatcgagaccatcctggctaacacggtgaaaccccgtctctattaaaaatacaaaaaattagctgggcgtggtggcgggcgcctgtaatcccagctactcgggaggctgaggtaggagaatggagtgaacccaggaggcggaggttgcagtgagccgagatcgcaccactgcactccaacctgggcaacagagcaggactccatctcaaaaaaaataaaataaaataaagaagtcccacctctgaacatggttgcattcaggattaagtttctgacaaatgaacttcaagggacacatacaaactacagcattcacggactcaaacacttcagtggctttccattttataccaagtaaaacctaaagtccttgccatgactagcaaggtcctcgaggatttgacactcccccacttcccctctccttccttgacctctttccctaccttctccccccatctctttgccttagggattttgtgcttgctgtcccctcttctgaggacactgttctcttggctgctcccctcactccactcatgttctgcagtatttgtgcctgatctgctcttcccaccagagaggcagctccacgagggcagagtttgtcttggtcactgctgctgccccaacaacttagaacagtatctggcataatgcaggtgcttgaaaatatttgtaagtgaattttacaagcttccagctctaagtttagttctaactttcacttaacctggggttgtgattatgctgctccacgtttggctctaggcaaaaaggtgccaggataaagtggaaattgttagatttgctctccaaaaagacctggggaggctcttgcttctcccaacaggttgacacaagacagccatttaaaaagacaataatggggggccctgccaacagatttaacgactctttctcacgcagggctgtttgccagtgtcaggaagagaatgagttagaaaatagtgagatgactgacttggaaaagaggcaggggaaccaaactagggtgaaaaaaaagaggcccaggactatctagaaaggacagtcccataacggcttcacgtactcatatccaacaaatctgcattctatgcccctgtgtgcctgatgccagtaccctagatgctgaggacacagcgtggaagttcacctctccatgctgagtttggcagttttgtgctcagcaaaaaccaagaaacaaaaagcaaacaaatacaagtgctgaggttggaacatcacttgccttatttctttgaagagaaaatgatttcacatgtggaaagaccattcatgtttttttcttttttttttctaagcactatcttgtcttaggtaatttaattaaaatgcaaacatttcccagttaccagcatccaatataagtggcccccaggggaaaacccatgtgaatgatagaaagaggcttcttgcaacccaagggagaaactggtggaaagccccattttcacatcctgccaggtacatacttgtgcacacacactgagagaagctgctggcatgaagatagctgtgtgttccctatggttgctaatcattaggtataaaggccagaatgggcctttacaattacttctgggctggtgaaagtagccatattgttccttattcagacttctctgtagctaaatggctactcagtatcacctgctggaggacagaactatatggacactaaaggcccctcccttggattctcaggaacaagggtaaatagctctgcacctctgggcctgacaccacccatctgaacactgtgggaagggctcagtgacctaagactcccctaggggccctctgactgcatataagccaggcctggctagtgcagctgcctgggagaggcagacccaactactctgcaggtggacagtaaatggtgggcatttgtgagtgccataagaatggggggccttcctgggattcagatgatctgcaatgtaccacactgtctcactcagtaaagaattgtcccacaggaccttcaaaggtcctgttacatattgatgtggttgaaaaaactatttctagttatctgagcctagaccttaactccaatttatacataaactcaaaatagttattgcactgttgtattcattccctgtattttccggtaatgcaaatgtcatacaaatgaaatactttgttttgttcagatatttaccaagagttagttgcccctttggaaaatcatgagcccaaggacaatgtcaatggtgttactgaagtctttaactcaagagagcctgcaatggcagctgtcacacccaccgtgatcctacgcatacacgcaaacacctgaccatgtacttttgttttctgatgagttgtacctgatcacttacaaactgaagttattttataataaattactttcatttctcttttaaattaagactacattgatttggagggaaattgtgtgtgaagtcagattattttatttgtgaaggttcactgaagattttgaagagggcattagaaaatactgttattacaagtgggcacggggtcagtcggggctgggagccactgcttctggtggtcctgggatgtctacatgtgcctgagctccgtttaaagtcatgaaaggccaatcagacgattctgctcatccagcctgggcagtggagaccaccacagctactcacctctgatcctgtgaaggagcttcacattttgttaccaaacatatcacagaggcgtgggtgattctttctcctgtttctcagcagatcctgcttttctcagtggcttggccagaacagaatttgttctactcgaatgaccccagattccctccaagaacttccctcctctcattcagcttctctggattcttcaaatgactgactggggaaacagattgttggaaaaacactttcgggttgcctcgatggggtcaataccttatcaggccacaggaaagacaaaggaaaatgcttcctgctggagcatgtgcacatatgttgttcctttaactccaaatacgtatgcaggggtggtggtaggatcagaaaatgtgtgatcagaaagtgaccagttccccaccattttgtgtgggttttattttctttctgctccgtgttgactcttttccccacaacacggaagctgcttaatccaaagacttggaccatttcattctgtttcagatccattccaacaaaatgatcagttggtggcttatgtaaaaagcagctccatgactacatttaaatattgactagtttgggaataacaaaccacaaaaatttggggtataaaaaccacatgtggtttatgttttgtaggacaccctcaggaagataaatggacaaagtagaaaaaaaatataaatggtctctccctgcctcacccccaccatcattaaataaaaacaaaaaacacacaaaaataaaatgaaacaatgattaaacaaaactcaagctgggtgctactcctggctttggatggcagttgtgtcttggcaaggcaagttaagtagtggtctgggaactgtggctaaggtcaacgtgtcagaatagcccgacataacctccaccttggtcaacagctcacccagctcctgaccacggctcctctctgtcaccagcacttcctccttccagatgagcttctccaacctctaggtccctgcagtcactgaccttttcccccagatctggccccacactcaacctcccggccctcttctccagccaaaagaaaaacgcacaaaactgtagatgactttctagaaatagaagtgttttataatctttgtgtgtctctaatgccactgttaactagcgagcagctgtgctagggctccatgcacagcagccattcaacaaatactcagtatcttcatgttccaaggttgctttaggggatactacaaagattaaacagacaaaattgtccaccgtcatggagcttacactcctatctgcgttgatgatgtgtggaaggaaatttaccctctgttttatgctgtgcaggtgttcatttaggcccagctcatattatattatgaagagcagcctcaccaagatcactgtcagagcagcactaatccaggcaaactaggatgcaaatggaaagggctccaaagtcctttgggggttagtcgtttcaatccaaggaccatttccataaaacaaaaacaaaaacaaacaaacaaaaaaacttgatgatatattgctaggccagcccacaaaagtatatttagttcataatgtcactaaactaaaacttcagttctgagtcctcaaaggaaaggactttaaggtggtatcaggaggaggaggagggagggtcgtccctctctggggctccccagcctcagcttctgcctctgcccccaccttcaggccacctccaaactttcccttggtctcatgcaagacactaaggggctcctgtcccccaaatatttcttaccctaaattgtaattccctttcctgggataagatgatctcattgaggcatcaggaggaaatcaagttgtcttttatttaaaagagaagagaggtgttaacccatgttaacccatatgatgttgaatttttttgagatcagagaagacatttagttggaggaagacaccacatagtacagtcacacactgtctagggttaactttgttaagtttctcccacttttcatagtttgattccttcacttaaataactttatttttttttgagacagattcctgctctatcacccaggccagagtgcagtggcatgatcaactcgctgcagcttcaaactcctaggctcaagcaatcctcccacctcctgagtagctgggactacaggtgcatgctgcctcgcttggctaatttttacaaattttttatttttgtagagacgtagtcttgctatgttgcctaggctaccttcaaactcttggcctcaagcaatcatcctgccttggcctcccaaagtactgggattataggtgtgtgccaccataccccacctatttttaaaaatcacccattaatacccagagaaaaccagttatcatcttagaatttctttccagtgtttttctttctttttgtgtttgtatttaaaatgggatcatactttggatgtgtacgtgcgtctgtatatatccttctttttcacatttccccatattattctcttaacacaattttaatagttgcatatctcattttctggatgttctattatctatgtaaatattttttattgttagacatttaaattgcatccaatttcattattacaaatcctattataattaatatacttgcatctgaatgttttgtaatcattttatagtatttccttaggataaatttttagagtacaatcactagaagacatgaacagtttttttttaaggaatcttgatacatacgattaaattattttctcaaagttttagcttgcatactcccatcagtactcatttcttctttttaacatgtgctattatgacgtttcaaaatctttgccaatttgataggtttatttattgtcttctccattattagtatatcttactccattagtggtttgttatctggatttaaaaaaaaatcacagggatttagtcttttccttatttcctcctatttgaacctaaaggttacctaaaagctccatgatttttcataaacaaaataaaatattctaaccattcgtagactgactgggtggaaggcagtgaccgtttctgtgtgtttataaaccaaatgttcataaaccaaggactacctttattttattagctgtggctaattttgtgcagtctatgagaatttttaccactgtaagaaatgtttctatcccatgctgggaggagagggtaggacctctaggcacatcttaccatagctcttcctgcctcaaaggcaaaagcaggaatgccttggtttatgttatgcacatgcagacgtgtaaacttctaaagtctaaggtacagaaaacagcagttgtgaccctgagtcaccttattttagtgttcacaagaccaaagttcccagaaatcaaggtgtaatttaggctgacctaatgaatactcaagcttctctcatttttaccattttcattagccattatgcaaatattttagaaaaggtagaatctagtttagaatttttttatgattgcaaacttgatgataaaaacctcttttgagcacaggtcattcaaagcaactctagcagtctacttggtgggctgtaatttccagttgtcctgggctagaaggacaactgatctcctttccacctggctcttcccaagtgaagacctgtgacaggatgttcctcactttgcacagttcttcatcctgcacttaggagatatttgatatttctaaattagacaggcagatgctttgagatgaagtgcctggtacatactaaacactcaacaacattagctactattacgattattaagtgagcagaacttctccccagttcgtgctacttggtaaaagaggaaacaagggtaggttgggcagggagggcaagattgataagtaagaaggcaaacatgggaacacagctggtaaagtggctccttttgtttacagagggataattcaatgcaatgtaagaatgaagacttttataatgctgagttatgggttattttttaaaattttaaacaaaaaagaataaataatttactctttgatatttgaaaaaagtaggtgctaatcatttgagtctccatttatgtcatttatctaaaactcattttcagatacacttagccctatttaaaaaagctgcactgatccattcaatttgtgctggtcactctcattcactaatacctctgtatttttgtgtaattccaaatatcactagactcaatgaacacaaattcagaaagaaaatgccctacaaatttcctaaaaacacagttgctcctaaaagttaagaaacggggattaataagttggttttatgttcattaacttgttttcatttcacctggagagagccattgctaattagtagttaagttaaaattccaagagccgaatgccgagccacttgtctccaaatcctccactgcagagaacaggactcctcttcatttcactaagaaaatgttcaaaggcttttcggatagtctcacccaactagggaatggaagactgcttattttcaagtctgctttattctagtggttgaggagtaaacaaagagaacagtaaacgtctgggaatgttttcagaggtgacacataacaaacagagagaaaataggccttgaggcaagatctgatttaactacgtaagtgagaaaaaaaaacatgccacaattcctatcattattcccaagttctgccaccacaagctgatggcattctgacgtgaaaggtactagtgccaagagtcaaataaagctttggcaaaattgaacaccacacagaaaacagagtatccaactctcattgtcagggcattcatggaaaacaagtatgaagatcaatatgaaatcttattttccaaagtacaaaggcttctgtatacagaatttcctactatccaagctatactcttaacctgctgcaaaacaccttgtggaggtacatcttactcttcactagcattgttcactgcaatgctttccaacctctgtttgcaccaatgttgagattaagttttctcctatgttccctctgccccaatatcttgagaatatagatgagagtttctcagaagttctaagatgcacaaagatgagaatatctcaaaaatatttacagcataagtaacatggagaagttcaagcaatggagaacaatagcgacatatattcattctactctggattctgtgacatgtatataatcagtcttaaaagcgcagctttaaaaaagttttaaagttatgactttattctaaaatgccaccaaaccataataaagacagtgtacaatatattacttagggaagaaactgatacctgttattgctttgctagaatttgggcttaaaaaaaaataaagttgataaaaggatgggtcaattcagtggtgatttgcctcaaggataactcctcccacttcctatacaaaataagcaattacattaaaaaaatacagtcagaattttatggaatcacatcagtttttaatgtatgaatcagagaacataacaatcactataaatgtagcatggttatgtattttaagtctctagtcctattttccttagtgtaggcataaaagttcttaaaggcttagaatttactcttaaaatactataaaatattactatttttatgacaaaagcaatttatgaatttatggaaaaggaaatatttataaaatatgttagtaaaagcactgtttatgtttgtatagcaacatttaaaagtattcaaaggtcattcattgctaaaaatatttaaagcaaaataaaagggaagttaaaaacagcttcacttaaacttgcagtttctaaaacttatcaggacccaagagcctggaagtatcaaagattaagtggaaatccatattcaaaagagttctgtggaattcttataaagagaagagcaggcaaaggtcatcggaggacattattttagctgaaattctgagtatcattcaaacaggggagccaatgcttggtattaacaaagtgctgttttctactgctgagctcagatgacagcccaccctctatttgccaaaattagtggatgagaaatcatttcatgaactcatccaaaaacatgaagtgcactaataaagctttactgccatccctcagtcatcactttgcttggctaggctggtggccagcaggaatatctccctctacaaaactgtttcaaagtaatgacttggaggaagtggtgtgctgataccatgaaaaaaaattccctcaaacacaaagatagttcaaaaagcatctgtatatggctcagaggaaacaaacagctcagctcatttcaactcaaaagaaacccaagagaccagtttaccttggccatggttacacacatgcaggcaaacttaaggttggcatttatccagggattttgatccgtgccaaaagggatgatgagttatccatcctgaggtcaagatggaataaagaaaatacactgaaagagaatcatgtgtctataagaggatttcacaccttcctcttcacgagacagggaggcctcgacccctgctggaatggcaagtctggcgtcccttcctgaagccactactagatcagaagtccactctgagcctccatcacatggtttctcccctgctgaggcctttccagtcttccttccacagtgtggtccttaaggagctaaggagggaagaggatacctaaagcacttgtttgtcaagcttgggctgaaatacatctagaatctttaagatgaccaacattgaattttccatttttgagcgtttaaaaatattcttcaaattaagggaatacataagcaataaagaccatgttttactgggttttgaaaattatttagagttttctgtaaaagcagttacttttctgagagaacaggtggcaactgctaccaaaatttcaaaaagatccttatttttattttcaaataacttttatttgacaagaactttgtcagtaatggtctttaaattcttttcaatcctggctttgtattgctattttgaggtgtttcttgctaactggattaaggaagcccaaagagccctctggttttggtcatcaaggaaatttgtctcacaactgatgatttatttgatttttttttcattttttttaataggaagacaggaaacagtgataaacctttaatatctgaaacttgtgtcattgaccttcaactacatagtgaggttttcagttcagaacatttagggcccatgttacatgtggggataattaaaatgttttaagtgatgctttctattcttcaagtgttggccataatattcaagctgggtacaagcagcagagatttttgtctgagctcagtccaagctctgcagtttctgctgtttgtctttctaggtggcaccagtcagtcatcctctgcagctcatgaaacccagcataaccttttgggctgctctggaaaaacacattgagcaataagggttagaatactttgtgttcaatgtttccagtgctactctctggccaggagaaataccaaatcataggcatctggaaaagagagacagcccagaaagaatgatgatgttacaaagcctgtgagcacagacccctcgtacatgttcatctacctgctgtctgcttaatactgagctataggcatcggagcaaatggtaatttctatcagtcatgactcaagtgctggtgtggtcttcaagtagcaatggattgacttccagggagtgaaatgtcattgttctgatcaccttgtggacacagggagtggtgaaaagttgagtccatggcagcatcagagcaagaaggaagtgcggttggttggaacgcgcaccctgtggtggtgatgttctccattagcatttcccaaaggtctcacccagccatagtaaattattaggaggccctcagcatctctctgtgtagtttaaatatcgtattgtattttcttggccagtccatgaatggaaagaagtgaataaagatatcagaaagtagacaaactgcaatgtgacctgatgcagaggtggaaagggtgtggtctggaaaggcagaggttcaataaaggcctttgaggtttcctttcatttccacagttcttagtcacacaatttcctttgtggattttaacggtaactaataaggctttgaaaaggaatcgaattggtatgctaggtgggaaatgacaaaggtcatcttgccacttcagcagggttattttaacctttcttttatactcttcaagtcctctttccagaataattgaaaatcccataattaaaagaccttcctttgtgcccacattccccttctgagatcaactagagctgggctcaccccaaccatggtcaactggaccaggccagccaggcctcaggctggagagcaggctgtgagctggtctgtcctgaaaagctcggcacagacaaggaaaaggtaatgcacgaggcaactcatgtccttccttgtctcagaagtatgaactgaggatcaaggaggggcaggcagttagcactagggaaacaagagcaggcaaaaatggacagctgagccagtcaatcagtggacttaagagaggaggggagatctgccatctcctggaactgagggtgcactgtggcttttcaggtacctgaaccacatcctagtcccaataattctaataatattaatactaacagtaataacaacagtaacaatgagcatgtactgagctctgattatgtgctaaggagtgttctaggtgcttttataagtattatcaactcattcaattctcacaaccctgtaagatacatctgggtgctgctgatgctgatgaacagacaagttaagttatttgaccaaggccacagagcttataagtggcagagacataatttaagctcaagtggtctggcttcatgcctctgctcagtctgtgcctccctgtggggctagtcctgagtctcctgtctcctttattgcccatctttacaataaagcccctcctattaaagaggccctacagagggtcttttactcttctattgtctcacaattagcattttccttggctccactcattatgaatcttattaactgacacatacacacacacacacgcacacagagtttttgagaaagggtctcactgtgacacacaggctggcagacagtggtggaatcactgcaacctcaacctcctggactcaagtgatcctcctacctcagcctcctgagtagctgggaccacagacgcatgccaccatgcccagctgtttcttttttttagatacggggtcacactatgttgcccaggctggtctcaaactcttgggctcaagcaatcctcccacctcagcctccaaagcatgaatgtagttttgaatccagtttttgttatcctttcatgccactaaatattctttgaaagcatgacttttaatgactgcattatattcatttatttaacatttacttaatcacttatttatttaacacttaacattaagtgatcacttgagtccaggaggacgacgttgcagtgattgtaccattgcacgccagcctgtgtgtcacagtgagaccctttctcaaaaatagtcatctagctatctcttactttgcttttataattgtgctaatgtcaatatctttatacacaaatccttgtgcacaggtaggattatgctatagaataaattatagaaacagaagtattggatcaaagagtttgaacaatttaagttcacttgatacacagtgcagatggccttcggggaaggcctagaccccctttggctacataaaagctccagggtctgggcatggtggctcacacctgtaatcccagcactttgggaggccaaggtgggaggatcacttgagctcaggagtttgagaccagcctgacagtacagtaagaccctgtctctacaataaattaaaaaattagccaggtgtagtggtgtctgcctgtagtcccagttacttgggaagctgaggcaggaggaccacttgagcccaggacgtcgacgttgcaagaagccatgactgcgccactgcactccagcctgggccacagggcaagactctgtctcaagaaaaaaaaaaaaaaagaaatctccattcaccatacccttgacaacaatgaatgctgcaggtttagaaaacctttatcttaatttgatttcttgaatgggtcagaataatgcatacatttaaactctatgctccttaataaaatgtcaaagggccatttgcgtgtttattaagagcaaaagcctataacctacagtctccaatgttgagaccactgacgccttaaaatgctttagaatttcagaaatggaaatcagagatcactgagtaaacagcttcagtgaatatctaaggtaaccaaaactcagagaagttaaatgacctgggtaatatacttgacttgcaactagaatctaggtgtcttgccctgtgattcatttctttagaacagattccttcattaacctaatggaagcaacaagccattgttaccggggtgaaagtataaggaaaaaaactgcacaagaatatatttgaaaaagaaactacagttgttctaaactctattttatcttcatagtaccaagttagaaaaagttattttatagacaaaagtaaaaattcacacctagttactactttattttcaagatctctgctaaaatctacaaataatttttttcctaggaccattaaaatattcagcacatacccattatcctctcatccagccaacatttactaggtctatactatggccagaccctgtgctaggtgctgtagtaaaagggggcagagtaccaaggtaagaaaagagggattcattttagggacatgtgagcaaatcatcacagtgagtgtgactgggcagtaacggggtgcacatgatgccgtgggggtgccggagcaatgaacatggaaggcttcacagaggcacgtgagctgtgcctgtgcttgaaagcaggggaagaagtggattaagataaaataagaagaataaggagtggaggggcagggcccactggagaaggctgctgtcacatgtggctaaacacagcagcctgggaaaattagtgctggtgggagatgaggctggaaaggtggtctgggatcaggcagtgttcaggagtttggacttcgcctggaggtgttaggactcatgtaagctgtttaagcagcgatgccatggtcaaagtggcgcattaccaagctcattctaatggcagtacggggaaggactggagactctgaaggcaggagctttatctgtgttggtacagacaaccaggttgcaggcttaaattagagagaggcagaataaatatgaaagaggagatgagtttgagtaatatatattagaaagaaataataagacatagagactaattagatgtgtgggtgtcattaatgagacaggcaatgaaggaggaaggccaggttttggatgaaagggatttgtacacattgagcttgagatcgagtgaggtatcagaaagtgaatgaaatatccagaaagcgaatgaaaatacaactctggagatcaggagaggtataagcagagtcatagatctgaataattagtatacagctacaactctcctaccaatctccccctcccctccacccccatcgcccacacacttggatacttcctcttgtctgtatataggtagaacagcactgtccactaaaaatacaatgcaagccccatgcatattttgcaattttctaatagccacattaaaaaagtgatgtggaaaacaggtgacattaattttaagaatatattttatttaacctaatgtatttacaatatcatttcaacattaatataaaaattactaacgagatattttatattgtcctttcatactaagtatttaaaatccaatgtgaattttccactcatgacccaggccatctcaatttggactagccacatttcaaatggcccctgctttggactgtgcaggactacacagtagcctaccagggtgattaggcaccaacatgaacttttttaacccttgaaatttgtggaattaaattaaatggaatttaattttactgatgagagaacaatgaggaagcccgctgggccctccaaatcactgcccaccccaccctcccttctcagagggagtgcaaaggggcagtgttacatgctgttggaagtttaggagacatgaagcatagaaaatcatttcctctaaatgttgccttttaggttattaaataccctgacagcaacctgactgaatttagagccatgaatttgttatctcttaatgtggatatatatctggtctcctgataaatttcctaaggctgttgttcctaaacttcaaatatttgcaaactaacttcataattttgtcatgcctgcataccaccaaaactatatgatttgtttaatatttttatttaactcaactaacctaaaaaaatctaaagacatatttagtgtcatcctaagtaactatatccatgaaatcatgaatttcatatgttgttgtacattttttctactacacattaaaacaaatacatatttaaataaagaacgtttatccatgtctcctaaaatcacctcacaaaccacctgtggtatgattatcaaactttgaaaacactgttcttggggaagggaaaggaacgtaacactataggatcccctctctatgccgccagtgctccgtggggtgcgcctatcctaactcaccgaatccccactctcctatgagcaggctgatggtcactgctacccactggttgtctttcaggcttgcatttattctggctgattagcacttgtgtctgccccgcggtcagaaattttatatggcaacctgtattaactataaggaaattcttaacaatttttatttttgtttttaatttttgtgggtacacagtctttgttttgattttccagaggttacagagctgccaagtctgggatttgagcttttacctataaacatcacaaggcagaggcaactacaacacctaccataatgccctcctaagaggtgttctatttgttgttgttaacaaaatgattttcaattatgaattatcttaaagcccaaagactttaagaaataagagttggtaaatttcaatgatggggatgcgtagtaccaaaatggtttaaaacaaatgtgttatatattaacataagtgcttcttagtgtattaaataacaagatctagtggctagtctaataattactataatttcaaatggtaatacatataaacaatattaaaagatatctgaaattgtagtgtgtattagttagtctattgttgtgtaataaattagcccagaactaagtagctgaaaccaataaacatttactttatcacagtttctgtgggtcagagatttgggcacagcttggctgggtacctctggctcaaagtctatcacaagactgcactcaaggtgtcagctggggctgtgttcccatctgaaagtttgggggagaaactgcttccaagttcactcacatgttgttggcaggattcatttcctgactggctgttggttacaggtctccctcagttctctgcacatgcatctctctataaggcagctcttaacacggtagctggcttccctgagagtgagcaagagagtgagagaaagctcctaagaaagaagccaccgtctttttatacccaaatctcagtctatgaactagatgggaaaaatagtacctctttttcactaacctctagctgaaattttgcatttctttgattatgaatgtagccaacaaactgcagtagcattaacagcactgtgacaccatcaccaatagagctcatagatattttatttcattttgtggcaggcagcttataagatggtccccagtgatctccacctgctgaaattcatgccttggcataagtccctcctcctgaatatgcactggatttaataattcacttttggtgaatgaaatgtgttaaatattaacacagaaaaaacccctgtgttaaaggatgcagtctatcttgcaccatctgaaaaatcagtctggtgctttgtggatgggcacagggattcctcacatacccctggaatccaccatctgtgggcatttactgtgtttgtgaaagattcttaaaaaaagaaaaaaaaaacatgtggtactgctagtgcagctcagaaatagatcaactttgaaaacttccctcacagctgcaaaaggcaagtgtttggcactaataaatcagaattagtggagctcaactaataatgaacctttcatctcctctgggcaggtggtcaccaactgaactatgggagcaaacaagccatggttagatgtaataaccacatttctaatgacaggtaggactagagcagaaagtgagtggaggagaagtcttcccgcaaaattcaaatcttcttaaacttggggccctctgaaaacattaatcaaagttgtgtttctaggggctgggctgacctctgcttattacctttccagtcataaccactgcaggtatttttcttctcgctagtgaaaaacagcctgggatgctatcgacaggcccctatcagagaaccagtgaactagggacacaattataggtttcaattttcccctcctagacgccaatccaaatttgtcatcacctgttcagagaaatgccttccatgtttcatctcacttgggtggaaattgggtgatattcaaaatatttaacaaccaatgaggcacaggcactaaccaattaggacaacataagatgctggagcagggtccaggggcaccctgtgctgtgctggcattcatcctttagttgttgaattatgggagaagtcttaggggttctgggggtgtgctcagggggctgagggtgatgacaattcgccaactggtttttaggcatctcattattttaatacccaggatgtctgcaccagtgcacacaagattgaatattcactgtggaggggggttggggctgctgctcccaagggcccccatggaaggctactggtgtggaagctgaccccatcgccctacagcgttctgacaactggcactatggggacagagccctgtccatttttctgagccctgagctcaggccagagccttaaggtcctggaccacttccaaggcttgcagaacccctcactcaggtctccttggggcggctggctggcagtctcccagttaccaggcactttctgggagcagccagggacagctgctgccggctggcatcaatgggcttctgtgcaactgagggttgagtggaagtttccttgtgggtttgatggagggcatgttctcagtccacaggtgtcataccacccgagtagcctcaccactgtacaggatacaggcctaagaaaagacttggctcatgaatcccctcacttcgaggattggtttagcaacttcctcagctttctgaatgaggtctcaggttttaggcttatcacaaaggagatcattctgcatgacctcttggtctgcattatttcactgaaatgcccgggtttgttttactttactccatgcttctggaaagcaggctggggggctctggatgcacatagacctgggtctgaattccagctctgtggaatgcatcaccacttcacttcacctctctgaggcaatttccacctctgtcaatggggctcatgggagtgcctgcctcataggctggtggagggtccaatgagataatttaaagacaaatttgataactgttttcttgtaagttgagggaaagattaattcaaaacttttagtctcagtttgggctaggaaatgccagtgttattccagggtactaacataggtattttaaaaataagatgctttttgctttcacaagctgactaaaaagtaaagacaaaaagtgacttcagaagtcaaatgtaactcaatagtcttacatgcttagatccaacccagaagaactcagggttctccttcctgaatgaagataatttgaagttgcatatttcgatccatagttggctgaacccacagatgcagagcttgtgaatatggagggccagcggtatctccttttctacaggaagacggcatagtttaattcattaaaatttgtaaaactacataatatctgtttcaatgacaaaaagcaatttcaattatatttaagatgacatttacataaacataaaaattataaccgtctcacaatactctcaactaccttgacataaaagcagaggaaagcttgatttgttaaggtattgcttttgctcattttgtttaaaaaaacttctttttcttaaaataagaattatggaatcattaagttttaagcaataagaagcaaagttcgaaacaagaatcctgattcttcacttctgtttacccaaaagaacattctctctctgatttcagtcccagaaatcaaaccagtgaacacatcactatgcagagtcacattccatgtttttaatggaagttttagaagctacagatgaatttaggagtgatattaaaccaagaccattaagaaagatgacttttttctaggattctaactcctatattcagacacacatatccaactgcccacttgacatctccacttggctgtctgtctcatagacatttcaaactcactatatcccaaacaaaagtcttagtatctcccctccaccccaaattgctgtactcacagcccgccccatctcagtctgatggcatttctattcttactacacttaggccacttcctattttccttaactcctctcttttgcttattatttttcaatccaactgccaatcttgctggttctaccttcaaaataaccagactctaattactcctcaacatctttactgctaacccttgtccatggcaccagcatgtctcactggagtatttcaatagcctcctaactggtccttctcttccactcttgtgctcccacagtctattctcaatacagtggccaaagggagctgttaaatttaaagtcagatcattgtctctttttggatcaaaatcctcccctcactcccagactctggggggaaagccagagtcctaccatgaccaacatggccctccaggatctcacctccaaattactggctccatgttactccttgaatactccaggcatgttccgcttctgcgtcctcaggctttccccatgtggctacatggtgaattatctcaccattttctccatgacagctgcccttaccagctcacctacacccatcctccaccactgtgctctgctcctcctagccccgctagacttctttctccacagcatgtatcccttctaaattcctaatatacatcacctagtattttttagatttattgttttttgtccacatcttttaacttgaatataagatccacatggaagatacttaataaataaatctgaattaagggaaaatgccaaacaagaaaaacaaagagaaaaaactttgaaaacatccagtgtccaaaaaaaggtcttatgattttcttttctttttcttttcttctttccttctttctttcctttctctttctttcctttctttcttcctttctctttctttctctctttttccctcccttccttcctcccttccttccttccttccctccctccttctctctttctttctctttcttttttttttttgagacagtcttcctctgttacccaggctggagtgcagtggtgtgatcatggctcactgcagccttgaccttgacctgctgggctcaagtgatccccctgcctcagcctcctgattagctggaaccacaggtgaatgccaccaaacctggctaatttttaattttttgtagagatggggtcttcctacgttgcccaggctggtctcgaactcctggctcaagcaatcctcaaggccatctcggcctcctagagtcctgggattacatgcatgagacatcacacctggccaggccttgtgatttctaatagcaggacccatgtattacatctcattttttaattttaataatgtttgtggcattttgaagaggagcaacaacaaagtaagcctgacacttaggagaggctgctgtttaccctgaaaagacccctaagagtggcattcttggggaggggtagaacactacatcaagcacagagcgttatcatagaggtccccacatctcccttttatctgggagccagagggatcagactcagaatgtctgagtaaaaattcacaagaggctgctgggcaccccggaatctacaaaaaaatgccatttctttccagtgaccatgtccattgtccagaatatacctttctgagctaatggtacccaggaagttgacttagcattcagaatgtggttcaggggtgttggaatcagtgctaaggatggctaacccttctgaggactgcttaatccatgccgtggtgagccctgataatgcatcacaacagacacttcacaaaagatcttcatccatacttaccaatccacactcatgtccacaagattcaggacctattttccaggccaatactgggcaaccattggaaatttttcctctctgctccatgaggaccagttcattgcccacaacctttctccaggtaggatggattagctttctacccacaaaattccaaccatatggctgtgctgtcttccaggaattacgtagagctcactttgctggagttctggaagttcctcaaatcttcaatctgttactctactcccattaggcacagatctggcctctgtagatcccagaggtgcacctactttcagattcccaagtccttggggcccttcaacatttcccccttatgtcaccagtgtgtagccaggggccttgttctgcaccctctaccatcattaatgagctactttgaccatagacaaatcacctaatctctctgggccttagtttccaaatctaaaaataaaaggatataactctctaaggtcccttctagttgtaaaaaatccaagattatttttttcctacctctttaagatttaaatgatgacaacagcatctttcctaaacttttcctgaggccagatgttcctggcactgaagtagaggaaaaaaatagtttttgaataacctaacatttttgccttttagagaaaattatcctctggcctttttagttccccttcccttacagctacctccttatggacccttaaaggaagtctttaaaacatagagaggctgaggcaggagaattgcttgagcctaggggttcgagactgcagtgtgccatgactgtacctgtgaatagcaactgcactccagatggagttcggcaacatagtgagtctctctctatcaaaaaaaagtaaactatttatccttcctgattcatcaggatcttataaaaaacattgttattttccaaattatttttcttacataaaacctcttaaacagttttattctgataactatgctcatcagccttgactttcctctgttttgcagggaaggctattaaatgctctggggaagaggaataaaaagctcagagacagggccagggaaggaagcatgctgtccatgtaggtaaattctgccctgagctttcacaaggtgatgggcatgaaatggcagaggcgaaagtagggagtggagagaaggggaaaagaagagggaagaagagaaagtctgaaagcatatattgtttgcttagaaaaaagttttaggagaggtctggtggcagttcaagaatgttcacttagttagatgacttctaaactgggacttgcctaagaagccacactgcagggaggaggcggaggtggaacagcagttctcttcctttagcagccctccatctagccttccgcgtagcaggctggtgaggtattgagcagcccctctattggccccgcacccagttttcagaagttaagttcattctacaggtctctaaatgcttcaaggacgaccaaatctatccattgttggcctggaaatcaaagaagacattccaaatcttcaccattcagtaaagcagtgacttactgaaagaattacagtttactagcaaaccccccaaatgaatctctatgtataatacatgcataacttcctagtctgaagatagcagtattccaaataattgtaggctccaagatatcacttagtgacttctaatttaggaaacatatgctctagagaattcctcccattatacacacacacatacacacacgtatatttgtgtgtgcgaacacatatcctactataacaaatgactctgtttttaagccactctaggttacaaaacaatacaatgagttaacttaaaatatgtcatattaaaatctgggcatgaacgcaactagaaaggaagcctaattcataccagaaaatatcaaaacaaagtctggtaagtgtctagctagttagacagtctcaaagcagtagcttctcattagcattgagaaataacaatctgagtggtaatgtgaatacctactgtggaactggtactggatgttgtataagctgggaacagatgcctcttaaattcagtttgttgcactatgacagggttctacttcaaggactcatcttttcccagtttattcttttccaggaaaagctttctatgcactttcatagacaaatgcaactcttcttgtcattttctggttcctttttttgggagaaggggacacttagagcttttttttcccctttaaacagcaccaaccttctgactgatgacgaaatagagggaaattgaaatggcagagtaaaaaatcaatcaggcacataggcaatcccttccctggtagagttacagagtatacattagtattcatgatattttagttaggagacaacatctccagcaaaagaatcaccacacagcactgtgtcaggccgtctatcacatctttcctaccacttccttgcacagaatctgtaatccaaacacctaccatggtcacccctccagaatagccccattggtcttgctccttttcctgggacaacagcccaagtcccctctgcatccttactgctcagaagcaagacatgaacattttgtttgaggcattcctgaagaaaaatgataatgatcttataatatgaggtatcttcaagtttgtgttttgggaggaagagtggtataagaagacacaattgctggataattctcagaagccaaacatagaattacctatgattcagcaattccacttctggggacataccaaaggaactgaatccaggatctcaaagatatgtgcaaacccacgttcatagcagcattagtcacaacagcgaaaaagtagaagcagcccaaatgtccactgatgaatgaagggataaagaaaatgtgatatatacatacaaatatgtttggccttaaaaaggaaggaatgtttgacacgtgctaacaacatggacggaccttaaggacattacgctaagtgaaataaagcagaaacagaacgacaaatattatataattctacttatatgaggtacctagaaaagtcaaattcataaagacagaaagtagaatggtggctgccaagagctgggggaaagggaatggggagttgttgtttaatgggtttaagtttcagttttgcaaaataaagagttctggagattggttgcacaatatgaatatacttaacgctactgaactgtatcttaatggttaagatggtaaattttgttatgtgtcctttatcacaattaaaactcccccaaaacctatagttcttagtatttcccaatatgatggtgataacaataataccttacaaatgtccgggaacttctttctgagaaatccagagacctgggcctccagatttgttcatgccaactcaaaacgataccaaggatgagttcagttgtaaaagttgcacttatcagagtttaactttcttttccccactagcatgaatgtttggtatatatcaccattttatccctctgaaaccagggtcactcagacatctgtggatgtcgacccgcagtgccactctggtattatctgggattcagggaggagaggcctgcctatgttgaggaagaagagagatttgtgaagttagcctcattcctcttctatttagagagttcaggaatgtgtccatactgttcctccccacaaaatttaccattttttctccagattaaaggtgacttcatctctttccactttgacctttaaacttaactcagtattcaacttggcagtcattcctatctaaaaattacacacaagattaatactccaggtgctctctaccacccaacaggatctgttaccttctgccattctgtgtctccactcgttctttcagaacctggggatcagaggttttgtataatgatgacactttataagccattttttgcatctcaaacacaatggaacacagcgcagtgaaagtggaaagatggggaaggggctgagaaataggagagaataaggacccccagaagaaatacaaacagcttttggaaggatgcatttacaaaaatgacatcaggcagctgggtgcagtggctcacacctgtaatcccagcactttgggaggctgaggcgggcggatcacctgaggtcaggagttcaagaccagcctgaccaacacggtgaaaccccgtatctactaaaaatacaatattagccacgtgtggtgatgcatgcctgtaatcccagctgcttgggaggctgaggcaggagaattgcttgaactcagaaggcaggggttgcagtgagccgagacggtgccactgcacttcaacctaggcgacaagagcaaaactccatctcaaaaaaaaaaaaaaaaaaaaaaaaaaagacatcaggcccatctggaaagtattctaacaaaataaaaagataaaaagtccctttctactgtgagcagcagatttgcagaatataaaacttctgaaacagcaaggctgtatagccaactaacaaagcaaaacaaaactgaaagaagagctccttcgagggatgtccagccactgctaagttgtaagcctcttcctggggctcaagggcagtaccaggtacaagaggccttcctactgcagttcccaagtgcgtgtctcctacaggcatttgtgcaaagggctccaaccagtgataaatccaatcttccctccatccctccaaacctgataacaatgtgggctggctctgtcagagctagcacggggtttctgaaaccactagggctgatatgtccagcttagaatcttctcttattctctgtcagctttgtctccattttcttgtacaacttggtggtaaaatatgaaaaaaatgtggcaattggaggacagaatcaaccatgatttttctctttcatcactgttctagttatttggcattactaggatataaacaagttgagtccacgagcccctcaccccttcgttgtttatcatacagacacattttacaacactttgggctagaatgaagacatgaaacaggaagttcctgatcttgctctcctctcctccttatcctccctgtctcagttaacacaataacacagtcaaagatgccgtctagtatgtttcccaaaaacacccagaaagagttcagcagcctctctggctaacctgtcctagagctgcacagcagtccaataatgtaggaacttccttctcttaacttggatttgagacgttttctttttccacatacaggtctgaaagcagcaggccactgcgtaattaaactgtccctcattggcctcaggaagaataatcttgggccctttctatgtttctggacggctgcttcccaaccctctagccgtctttctggctcttttgcagactcttctctaggaagcacaaggctgaagacataaagctctggcaaccgtcacacctcacggcctcttcacggcctgctgggctttgctctgggctgtgcctgctccttaaactctggtgccgggaaaaggatttcctcgtctcatattcaagctgtccctactgctgcttctctactcctgttttgtgttagtaaaagaaggaaggaaagaaaagggggaaggaggacagtagaaaaaataaaaaaaggaaacttaagaatttataatgacatactattttaacatgaaatacaagccaaaagatgagttttatgagatgaaaaccccacaaaacaacaaacttttgcatataacctcgcaagcacgtttttatgcacagtatttctgtattttctaacaccctttgaatgccccacagatgtctgcaaacacaggctgatctgtcccgtttcacatttacattaacaggtaaaaatgacaagaggcctagctgaattccacgaaataagttatttaaagaacatccgaagttttgttctttcagaagcagagaagttctaaacagggaagcaagagattctgagaatttcattttcaccataatggctcagcgtttgttcctctaacaacgtgcagttaacagctgtgcgctggctcttacattcaaagccaaaaagcaagttcttcacattaaagaaatcgttaaagacagttcaaggaaagagaattaggtattttagagtggctacgaaaagttttccagggggcaaaaagcactaacctgtattgttttaatctgctgaaaacaaccaacttctcgagttcccctgctgtcttctagccagtttcctgtaaatgttgcatgtgacattatacttcctcactgcaccttctttgactcgcctccctaaccggtcagaggcatgtgataagatcaatttgctgcttgcttcacatgggggtaaccctgtgtctgcagaaatgattgtctcccccagcttctttcaggtgttcccaggacacaggtaaagaggagataagccagggggaagtcatgcctggactccaggcactcctgactccaaaggaacctgaagggggaagggagagacagtcttgagccccagggtcacctatcttgagactggagttcagcagctgagaaggggcagagcgctcacagaggagcctggggcttgggtgctctgctgtcattaggacagcccctgggactgccaccctcagggcagctgaggaagggccctcgacagtgctgcacccaggatgtccccacactcctctctggagggcaccaacatcaagggaacacactcaggccttggttcatatttctggatcctgcagcaaccatggctacacaccctgaatttcctgggactctctcaagttcacatgtggtcatgctgtcagacagtgtgccccaattgttggttcggaaaacaaaaccactgtattctcagccttccagggctaaataactgggagacatttccctcctgctgacctccaaaatatgccagcattttggtttcccttgaaagggctgggcatcatcttcctccaggatggtgctgggttcctggcagcgtgtgagtcctggccatgggggctctgatggtggcctgacaagagcaccagaagagtgccggctgtgaccctctctgccctgtacagctagagaggctggaggagagctggagcagggactaagcaacaagcccaagggcaccatatctagctttcttgttctactcactggtgccttctgtttgtttttttttttttttttttttttttgtgattctctcagccatcaggagggtccaaacatactggaatttgtggatataggaagtggtggtgtgtgggagtcaaatgatctcctggaccaaggggaatattccacaatttataagacttgactctgcaaaaaccccaaagttgcttctatttggctaccctggcatgattatttttaaaaaaatgcttttaaatggatttttttgtttgttttttagaaaggtaactgtagacatattccaagtcttgaaaatattaccctataattccccgatgaagttttccatgggagaataccgagtaaggaaaccagtcctgggactcagaactgtggacaacagtaaaaccctgaagtctcaccacatgattgcacttctggctttgaaaacacacataactgtttttaccattttgacagttgatggctggttttctgattgaaatgacatttagattagacagttgagtcaaaatggctgtccaagctatagtagacatggcattaactttaacataggaataatggtacaattttgccatcttggagtcagaaattgtaagaactttggaaaaacaaaatactacatagatgaaaaatgatgatgactcaatttgaatgtatttagaagtctcacattctgggttaagctgccagttccatttttcaactaagcagctgcatatgttctgcttaagccgtgttctgtgtggaatttttaaaggccttaataaaatgctttataattttccatgaaaatccctaacctggctttctgtccatgattttttttttctggttaggcatttaaaaattttaatatactttatatttcagaacagttacagatttacagaaaaactgagaagacagtacagagttcccataaatcctacgcccagtctcccctattattaacttcttaaatttagtatgatacataagtaccaattaataaaccaatagtgatacataattattaactaaagtccacagtttattcagatgtccttagttcttacctgctgtcctttatctgttccaggagcccatccaggactccacattacatttagtcgtcgtgtttcttacgctccacttggctgtgatggtttctcaggctttccttgtttttgacaaccataacagttttgagaaatactggtctggtattttgtagaatgtaccacaattgggcacacaaatgggtgtttttctcttggtaagactggggttatgggttatttggaggaggatcacacagataaagtgccattttagtcacatcgtatcagatatatgtactatctacatgatttaatactgctggtgttgcccttgatcacctggctgaggcagtgcatgtcagttttctccactgtaaagttgctccctgcttctccccacctttccatatcatactctttcgaagaaagtccttcagggtagagtgtctatataaattatttggaatccttctgcatggaagatgtctcttctacatatttattaatgtattcaatcatttatttataccagtatggctgaatggatatttattttatgccttgcattttaattcaacagtactttattctgttgctcaaattgttccagcttcggccactgggagctcttaccattggtttctgtgctcctttgacatactcctatcaattttttttttcttttttgtttttaagtacttcctcactttccagcactacaagatgctccaggctcaccatgtatagtacctccccaactgtttatgattttggtttctttttttgttttgttttgacaaaagaatacaaaaataaactgatgggcctaagaaatgtgtcttcaattttaattagttctgctcatatgtattaataaaaaattttgtttaattacattcataaaattagtcctacctacctggcctctaccagctgcaaaacaccataattccagtggctcacgcctgtaatcccagcactttgggaggcctaggcgggtggattacgaggtcaggagatcgagaccatgctggctaacacggtgaaaccccgtctctactaaaaatacaaaaaatgagccgggcatggtggcgggtgcctgtagtcccagctacttgggaggctgaggcaggagaacggtgtgaacccgggaggcggagcttgcagtgagtcgagattgcgccactgcactccagcctgggcgatggagcgagactccgtctcaaaaaaacaaaaaacaaaaaaaacccaccataataccaagtgagtgaaattctgcactggcttaatcccaagatgcatggttgtgctggtactgttttttcccctacatatttttaacattcctggaatcgaagtgcacacttaatgtcatgtctttttttcctccttacctgttattaatttgatgttataccttatagttgatagttttctgagaatggaggaaatagatcagtcaattactttttgtttggactaagagatgtaatttattttcactgattttttttcccactgaacaaatattttgactaaagtggtttgatgtgtagcatgtgcggacattaaaaaaatcccaagatacattgtactccaaacatattctaactttaactcaagctacaaattctcatcaagtcctaaatatagataaatacagatattgatataaagtaaaaaggggagtctatttaattttattttttaaattgacattgtaactgtacacatttatggggtacaatgtgatattttgatacatatctatattgtataatgatccaatcagggtagttagcatatccattaactcatgcatttattatttatttatgatgagaacattcaaacacctctctcctggctattttataaaatacaatattttaccattaaccatagcctccctactgtgcaagagtgcaccagaattcactcctcctgtctaattgtaactttgtacctgttgaccccatcttcccctccctccccaatctctagtaaccatctgttctattctctgcttctatgatatcaacctttttttttttaagattccgcatatgggtgagagcatgtggttatctgtctttctgtgtctgccttatttcacttaatacgatgtcctccaggttcatccatgttgtcacaaatgacaggagtttattcatttttatgcctgcatagtattctattgtgtatatataccacgttttatttgttggacatttacgcagattcccacatcttggctattgtaaacagtgctacaataaacacggagggcggataactcttcaacataatgatttcatatcctttggatatatgtatccagtagtgggactgctggatcatatggtcatgctatttttaatattttttagaaatctccatactcctttgttttttgttcatttgtttcttttttcttttttgtaaattcttccagatcctgacccatactattttccataatggctgtactagtttacagttccaccaacagtgatgagtatttccttttctccacatcctaacccaacacttgtttccttttgttcttttgacaatagtcattctgaatagagtgaagtatatctcactgtggttttgatttgcatttccctgatgaatagtgatgctggacatttgtatgtcttcttttgagaaatgtctactaaggtcttttgctcacttttatttttgagacagggtcttgctctgtcacccaggatggagtcttgtggcatgatcatagctcactgcagcctcaaactcaggcttaagtgatcctcctgccttggcctcttgagtagctgagattagaggcatgcatcatcacgcttggctaatttttaaattttttgtagagacggagtctcactttgtcacctagggtggtctcgaactcctgggctcctcccatctcatcctcccaaagtgctgggattacagttttgcctgttttaaatcaagttatttgtttttggtttttttgtttttggttttttttgctattagttccttatatagcctggatattaaccccttgtcagatgtatggtttgcaaatattttctcccattcggtaggtgatctcttcactctgaatagttttctttgctgtgcaaaagctttttagcttgatgtattcccatttgtctattttggctttgttgcctatgcgtttgaggtcttatttttaaattttgtccagaccaacgtcaagaagaattttccctatgttttgtctagtagttttacagtttcaggtttcacacttatgtttttaatctatgttgagttgatttttgtatatgatgaaaggtagggatctagtttcattcttctgcatgtcctatctaaagcaattaggcaagagaaataaatagaagcatccaaattggaaaagagaaaatcatattgtccctgtttgcagatgacatgatcttagatatagaaaaccctaaagacaccaccaaaaaactgtaagtacaaataaacaaattcaataaagttgcaggatacaaaatcaacgcataaaaatcagtagcatttctatatgctaatagtgaactatctataaaagaaatcaagaagacaattctatttacaatagctacaaaaagagatacctaacaatgaacttaaccaaggtgaaagaagtctacactaaaaactataaaactttgatgaaagatgttctcactcataggtgggaattgaacaatgagaacacatggacacaggaaggggaacatcacactctggggactgttgtggggtggggggaggggggagggatagcattaggagatatacctaatgctaaatgatgagttaatgggtgcagcacaccagcatggcacacgtatacatatgtaactaacctgcacattgtgcacatgtaccctaaaacttaaagtacaataaaaataaaattaaaaaaaaaactttgatgaaagaaattgaagaggacacaaatatatgaaaagatatcccatgtacatggattttatattttttatgtatgtatgtatgtatttatttattattattatactttaagttctagagtacatgtgcacaatgtgcaggtttgttacatatgtatacacgtgccgtgttggtgtgctgcacccattaactcgtcatttacataaggtatatctcctaatgctatccctccccgctttaattttaattctttaatttaaagaatttaaatttaaagaattaatattgttaaaatggccaacctacccaaagcaatctacagatttaatgcaatccctatcaaaataccaatgacattcttcacagaaacagaaacaaatcctgaaattcatatgaaaccataaaagatccaaaagagcaaaagcaatcctgagcaaaaagaacaaagctgaaggcatatctgacttcaaaatatactgcaaaactatagtgaccaaaactgcatgtactagaataaaaacagacacatagaccaatagaacagaatagagcccagaaataaatttatgcacttacactcaactcccattcaacaaaagtgccaagaacacatactgggtaagagacattctcttcaataaatggtgctgggaacattggatatccatgtgcagaaggatgagggaaggtgttaaattcttttctgggtttactgactccttttgtgtttactccattacttttccaagacctcatgagtccattatcatgcctgggcaacctaatattgatgctgaggggttgcaagaatggagtttcagtctggctgatgaggagcaaatgtgctgactggtcagcaggcagatccaaaggtctccttgcttctgctttcctactgagacagataaataagtgcacagtggcaggactgaccaggagtcccctctctgtggccaggattttctctccagctaatgaaccgctgttattttgggagcatgatgttttatagatcttttttcttttaatggacagagactaattcaaccatttcccactggcatatcttacaaatggtcacagacaaaatgcccaaccttttcatccaggtaggcagaacttggctactctaaatactatttactgtcccactcctgtataaagtgtaccaaaatactgatagtgccttactcatctcaccagtacccaggagggactggaagagatgctgcactgacttttttcagcaaccatttaccaagcctgtgccacatgctttgacattgagctgagtgctttatatacatattttcatttaattctcattataatcctgtgaggtaggtactgtgatctccactttacagacagagtaattaagatttacgtggttaactaacctctccagagtctcttgataagtctgaagccaatatacaggttcagttctatcggtgcagagactcagagcctaactgctactctttgctatagagagatttaccataccaaccataccagatttaccataccataccaagatagaataccaactctatattcataaatgaccactttattgaatagtcctattctttattttctgcacatgcctttcacttcaaccaaacctaagctgcaaggagggcaaggacaatgtttaacattcccttatctcagctttccattctcactgcagcagctctcctagggaccctgcattcttgctttcctgtcaattctaattttcttttatttttatgttattttaaattctaattttcttctgctttatcttcattacttccttcctccacctttttttttttttttttttttgagacagagtctcactctgtcgcccaggctggagtgcagtggcgcaatcacggctcactgcaagctccgcctcccaggttcatgccattctcctgcctcagcctcccgagtagctggaactacaggcacccaccaccacgcccggctaatttttttgtatttttagtagagaaggggtttcactgtgttagccaggatagtctccatctcttgagctcgtgatccacctgcctcggcctcccaaagtgctgggattacaggcatgagccgccgcgcccggccttttttgttgttgttgttgttgagactgggtctccctctgtcgcccaggctggagtgcagagacatgatcatagcttgcggaaaccttgaactcctgccctcaaatgatcctcctacctcagcctcccaaagcagtgggattataggtgtgagccactgcacctggcacctcctccacgtttcttatttccttttccccactttgttttgctttattttattagcttcttaagtcacaatcttattttttccagtccttttaaataaaagccttaacttatttaagtgtatttttagtcctattccacacattttgatgcattatattctcattgttaacttttaaatagtccatagttttagtactggttttcttgacccaaggattatttagaaggatcataccttaatttctaagtgcttagatggaggtgggggaaggaaccatcttgtgttaattttcaatgctactatactattatatgtggccaatacatgtctagtttttgttaattggacatcttctttgtggttgagtatttaatcaatttttgtaaatgctccatgatcttttaaaaaaattgtgtgtatgtcctatttgttgggttaagtcaataatgataatggaaaaatgctattcaaatattctgttcctatttatttttgtctacttgatgaaatattgaaagcattttgttagcctcccactatcacgatgaaaaacttcatttgtattttaaatttttaaattttatttatatgtattttgtgtgtgtgtgtgtgtgagacagagtctcactccattacctaaggtggagtgcagtggtgcaatctcagctcactgcaacctccgcctcctgggtccaggagattctcgagcctcagcctcccaagtagctggaattacaggcacgcaacaccaagctggctaatttttgtatttttagtagagccgggttttgcatgttggctatgctggtctccaacttctgacctcaagtggtctgcccaccttggcctcccaaagttctgggattacaggcgtgagccaccatgcctggcctgtattattttatttgtatttttaacagatttttcagtgctaggatactcagtgcataaaggttcattattgttaaatcctcttgttggatttgtatttcttattctatgtctcatttagtattttttttacattcaatcctacatttttaaatattaatattactgtcctgatttttgttagttagcattcactaacctatccccttttcatcctttctgtgttattttgctatacatatgactcctaaagatggtatatagctagattatctttttaaacaatgagagtcactgattttattagaagaatttaacctagtcacatttatttttgtttaacttattcctgcaattttatcatgtgttcagttatattattttcttcctgtctttcccctcttttctagactttttctgactgatcatgctcttaattagtatagtaccctccaccccagctgtgtatgtgttttaatatgtaatggtttagaaatcctacttaatacttttttcaagagatcaaatacatgtgacctttcttcataaacatcagagaactacatagtaggactctattaattggtaaagtcattctgttgttttgagaaatgtagtggtaggttcatgttaataagaataattgtataagaggttgtaatattacacaggcatcagaaatctttctaaaagggtatgctgccaggtatccatattcactcccccacccccctccctatatggaggacaagctacagctttcacaaataatgtgggtaagtgtggggtagaggcagcaaggaacccactggctatgacataaccaaaaacatcctggggactgcttctacaaattttggactcttgagacatgcaggcaatctggagatctacagaggtatctgtagaagggaggctctcagggtgggtttcctactacctcatttccagtcactaaaagccatcataactgaggaatctgttctagattaggtgatgtcacgaaaaatgtaaacataattgctaaagagttgaggagctcaattgagaaaataatgttgctagacctgctgaatggctagaattctgagtttcctaatgtctaattcaggaggcacagtagtaaacaagaattcacaatctttttttcttctcttttaaaaaatgaagtacttttcaatttttaaagctttgatatcactggagggatatggcggaaattctggccataaaatacaaatattgttgtgtggttttttatgtgtttgaatgaaagttaacactaaaattccttatttgatttttcatagagaagcctagagtagaggggaaggaatagggataaaggtatagcaagtaaacctgtcagtcactcgatttactgaaatgaaaccttggtttggaccacgagaaagtgtggtaaaataccttaaaagagtgtttctgttttaatattacatgtttaaaaaaatcaatttagcttaaacaaccctttgagttaaatattatatgtaattattcttatattaccaatgaggagattaaggttccaagaattgaagagatttgttcaaataagtaaataagtgataaaattggaatttgaacccgtttctgactataagtcaagtgtcatttccagtacacaccataactgccttcttgttgttctgtctctgagagaaatttaaacccatgcacaccacatgagttgtgcagcaggtaactgtggcaagatatggtctgtgctttacaatgtacgtcaaatggtccagccagaccccagggcaattgtttctaaaatgaccctgagggatttttggagtattatgtcatgcaaagcctctcctcattaacaatcctgcaaaagccagcaaatgctgtttctgacccttggaacagctaaaggaagttgaaaggtcaagaaagttctcttgctggtagactatacactggtaccttgttgataccattgtgatgtgatctaagccaaaattctcaagccctttgaccagctgtcttcaaagctagagccctacctagtggggttattcttcttcggcataacacagggcctgatgccaacaaccaaactggcgctttccaacgttgtgcaactgaattccaaataattaggccctatattcatctttgttgttgaccaaaacattgaaagaaaatggcaaatttccttgttcataaaatgactggctagggacacataggaaagccttgccattcatccagggtgagttttaagaaggctcataaatacagaacaacagacgtagcagaacgacagtactgagaagcaagacaccatcttacatttggtgctcctttcttttgggcagaacagtgaagagattaacataggcaatgtaaacaattcaacagcatgcgaaaagtgtcaggagtgatcctgaacagtaaggtgtctctcgttatggagattggtggctttgattcagaatttgtgttttcctcacatatatgtaacacgggaccaagagaacacctaattaataatctatttgtatattcttcctactcaggagcatccctctcctccatatttaggagcacatcaaacggggcaaaattggtaaacaagttcatatcactcccgaaagaaagaattctgaaatcaaactgcctgggttcaaataccaaatccattacttactagttgcaattaattgctttattcttttgggtcacagttttctcatctataacatggagataactttagtattattcaatgtgagtattaaatgtgatgctgcaaagagtttagccactgcagcgcataaacggtggttactgttactattgtaggtggaaaattttattctcgggaaatctatattagaatttctcacaagaaaggcaaccagagtcaagcaaagaactttctttctttctttttctgagatggagtctcattctgtcgcccaggctggagtgcaatctcggctcattgcaacctccacctcccaggctcaagcaatcccacctcagcctcctgagtagctgggaccacaggcactcaccaccacacccagctaattttttgtatttttagtagagacagggttttgccatgttgcctaggtgggtctcgaactcctgggctcaagcaatctgcccacctccgcctcccaaagtgctgaaactacaggcgtgagccaccacgcagagccatgaactttatttctgagggtgttttgcatgcaggaaataaaggatattcagaaatcaaacggaacagagctgcagattatcccagagaggtacagtctagctagaaagcaggaaaggaaatccattaagggtactttgagcctggaggtggtgaagcacatactttcctaaatttggaagagtgagaatatttgtgtctgatcaaaagtaaggaggaaagctgaggcaggagaattgctttaaaccaggagttcaagactggcctgggcagcagagcgacatcctgtctccaaaacattttttttttttttaattagccatgcacagtgtcacacacttgtagtcctagctatctggcaggctgaggctggagtatcccttcaggccaggagtccgaggctgctgtgaactatgattgcaccactgtactccagcctgggcgacacagtgagatgctgttttttttttttctttccgagactgagtcttgctctgtcacctaggctggaatgcaatggcgcgatctcagctcacggcaacctctgcctcccgggttcaagccattctcctgcctcagcctcctgagtagctgggattacaggcgcgtgccactatgcctggctaatttttgtatttttagtagagatgaggtttcaccatgttggtcaggctagtcttgaactcctgacctcgtgatccgtgcccccttggcctcccaaagtggaccctgtcttaaaaaaaaaaaaaaggcaggaaaacggcatatgaattacatctccatgataaaaaaaaatgaggaaagcctcatggctaatgagaaaatatgttagataagaaagataaagagaggtttcagcagaagccatgaaggtaggtagaggaaaaggtggctacaaagaattttggagaaactgtttatgtagcataaagcataaaacctttaagccatgccttttagaagaacctagattaaagagataggttattcttcaatgcttctgggattgggatatgttttgtttgaaagagactccaggcagaatccggaccatgtggggtctcaagatttattcaggttacaattagagagtgggttacatccatttgagcaacatcaaatccaaccgtgtgttagtcacattttttctgggttatgattcagattttgaaatggccgcagacaggctgacttacatgattctgtgaaggaagcagacttacaaaacagaaacatctctcgagattttattaattagtggcagtcataatgaatggggaacattgtacgttgtatagtgacatctattattttgtttgccttcaatcaacttccagaaataaggttggtgctctgggtggtgcctaaagtagaacaagggtgctatttactaaattactatcgcatacttctcaatgatataagcaaggtactaaaagcaacataatatccaccaattagcttccaatgacacatctgcatacagaaatgatcagccatctctgtgtctaataacataagtgtgtttactgaaatatgtctcctgaacattttgtgtaaactgccttttaacctttggtgcactgtggagcattagtaacactgatgcaagtggagggagaataggagttaatggaatattgcagtaagttgataatggtttttaataaactctacttcttttattattggaaaattagcaacatgaactgtaatattcatgaaagcatgctgagatttctagtaactaggttttataggcatgaatctctcccaaagcaacaaagaatatacagggggaaaataggttgtgaccaagtccagtgtgctatggaatgtacaattagatgcaagaattcggcttttaaaaaacacatctagcctgattaaaaacaaggatttagggttataaaaacaaaaacaaacaaagcaaagcaacccctcccccttgtcattaatgacagactgccttgggctatgcaaattattaaaaaagaattcggttaggaattcccaaccaatgtagagattacatttcacatttgtgcagtttgcataacaggcacatttaacttacataaatccaacttttaatgcttgagggagaaggagaaagaaagtaatttaaacagtgatggccatttcccccaccactcctcatagtgaacgtgcccccacagtatcctgagatgacagacatgaatctgcaggttcttcttcaagactctcagtgttttcatcatcaggccatactaggggtgattccagcctttaaaaatacacgtatttcagatgctgagcccataaatggcaactagctacttcatctgtgtattgggtacacacacgtatatatttcctgtgttttattatgtttgagacaactttaaaagctttctggctggggagagattgctccttctggggctagccaactttcagagataacaagggttcagtcaggaaaatgcttttgatatgcaaactaatcaatccagagtcagctctcccctatctggcccatataccccaggagacaatattcctctgccttggtcatcccagggctacgtgtcacccctatagtttagagcctgctgaagttattcaaactagccaaccctaaactgttttcatcctgccctgccttgcctttcccaaggaaaccccaataaaagctctggcctaaatgttccccttgttcctgttttctgcctcctgaccaccctggtgtctttcccatgtggccctatgtggtgtgctgtgcctttatatgtaggactcgtaagtacaataaatgttgttttcctgagcctctcctgtgtcttctcccaaggctactcctgactgaccatcacataaaagaatacaaaacaatctgaaagtcaaccaaggaaatagtaatcaagaataattctgaatagacgtaatttctactttatgcatgactgtaaaccttaacttcactgaactagaccaggtaagactttatctccacatggttcctccagtcctgacaataacagactagaacctgtgctgctgcagtgatcttaaggctaaataaattctaaatcacccttctttctgagtagcccctccagtgtgtcagttctccttatcccaagctgatgaagtaaagatgagtatttggggttttgtcaacacttaaggcagtgagcacctcagaaagaggtgttttgtctcttggccttggttcaggggacctcttccttctagaccctcccaggtacagctgtgcccccttactctaccactgcaccagtatagtccactagaaatcctcctctacatgtctgtctccttctgggtggggaaaatggtctggcaccttgcaggtgtttcctgaatgaacgaaagatgactgcctcccagcaactgagaacagaggaatccctcattctcaaaatctgcagtttagtttgacagttttataaatgatcagttcactctgtgtacacacaacatgtaagagcttcaaaatttttaaatgctgattcagtctcaattaacctgttgggtaatttacagttatacggcaaacaccgggatacgaaaccacctttgttactcctcctataagctcctgtatatgggagttgtttcctggaccttctactttcactgaatcttaagaccatcctgactgttcttctccatgatgattgactctctttagcttttcagtttcctttttagtattaaacagtacatctcctgacaatattttaaacagagaaacaggtatctaaataagatagaaagtctttgacaaatagaaagcatccaatctattatttcttcatccctatgctagggacccttgctctgattcaatgtgcgcatgagctctttcagaaggctgggcagtgaggaatgcccaggcaggtgcctgccatgagaacctgcatgtgatcaccacacagcttggatgagaacaataccatggcaaacttatgtctacagagacagccctacagactggcatcacacgtgctgtggatttgccatccctaatctaggaacacaacttttgattcacagggaattggctttcgcattgcttgttgggcttttaaaccagtgaatggaaagaataaaaagttttctccacacaacttctcggaagagatctgccctgtgatctgcaatgtcctgacgttcaaacttctaagtcatctgtggagaccgctcaactgattccaagtggaagtactaagactgtcatttcaggtcagctgcttcttaagcaccagctacctcaggccctaacagcctcatcttcctgtatatgctcagattactctgcaaatgctctttgtagcacaaactagtagcattatccattaacctaaaataattattacattaagtatttacatgaatcaacactactatcttttttaaaaaaaaacaacaaagtacttttttatgcactaattcatcatcaccgagcaaagttgttgtttctacttcagaatgataacactgagttactgctaaatgaaaaacaatagtaacataccttttcaaatacactataaaattgcagcagagcttggttttgttgcctctcactctgggtcccagctcaataaatatctgttaactggttagcgaactccccaatgtttatcttgtatggaaaaaaactagcagtaatacagcacactttgatgcaaccaggtggttctcacaatcaagatcttacaaacacaacgatgtgttatatggtaactacccaagctatgaagccagacaactttattggatgagtgctccagttatctactgctgcataaccaaaggaccccaaaactcagctagataaaaccactaccatttcattatcctcacagattcttggctcaggaattccgaaatggcacagtggagacagctattctctgttccataatatctgtggtcttagctggggtcacttgatgaactgggggctagaacactggagctggacaatctacttccaagaaggcttcttcatgtagatgcctggtacaaggctaggaaggataaggtatagactcaaccaagactgtcatccagagcacttacatgaagcctttatggcatgtagctggactttttacatagtggctcaagtctcgaaatgcaagtgtttccaatgaacgaggcagaagtatagctttttatgtcttagccttggaagttacacagggtcatttctgccgtactcccttggtcaaagtagtcacaacctctcccccatcacatttaaggggaaggaccacaggcccacctctcattgtgaggagagtcaacgtatttacaatcatgttttaaaatacctacagtaaatcttcagcctcttgtctggtgcactaacattttgaacttgaaatttttaatgataagcctgtgtgcttacagaatatgagccactaagtgtctgcgattatatttctagaaaatcagcttctgaattgtgggaggccacagtcccagggcaatataatgcctacatggacgttatgtaaatattaatttggaataacaacaaaaggatacaactggtggaaaatctgttgtctatctttggccctttagtattttcctttggtgatttttcccatctccattaaggctatatagcaatcagatgcccgaggttaaattaaagcatttaaggagctaggaaccttagggggaaataatttaaatttatagagctaaccattaggcttgaggtggcaaactcaaactcctaccacagccaggctggcagaggagtaagtgtggctggggtaagtcagtggaagtactggggactgaagttcactggaaacatttgccttaaggtatgtaaattccatttaaaaaaaaaaaaaaaacaaaaaaaaacttcattttccaaaactggcctttgaaccatagcttataatccttaatttagattaggtggcgggtatttcctagatttatggttttttgccctagttctgttggtctgttttccactcctctatgagattggtctgttttccactcctctatgagaaaataaacattgaatatataattctgtagctaataacaaacatataatgagaatgtactatgtccaggtgctaagtattttatttaatgatcagtagtcctttggggtgggtattactgggcccattttacaaataaggaaactgggcttcaggaaatttaaattaacctgaaaaaggtcctaaagctagtaagtggcagagattaggttcatactgaggtatgtctgcccccaacacctatggtgttaaccactccatgttagaatatggtgctctggatgaacgtggctcccctaaggtgagtggccaacaagcaggggcctatctttgctgacacttctttgggtgtaacccacccagctactctaattttgggatagaaatggagcttacctgtgtcagtgaatatatggggatagtacctcttacctaggaatcctgtcctggaagtctaagactgcgtaagaaacagagttcaggccgggtgcggtggctcacacctgtaatcccagcactttggcaggccgaggcgggcagatcatgaggtcaggagatcgagaccatcctggctaacacggtgaaacacccatctctactaaaaatactaaaaaaaaaaattagccgggtgtggtggcgggtgcctgtagtcccagctatttgggaggctgaggcgggagaatggcgtgaacctgggaggcggagcttgcagtgagccgagatcacgccactgcactccagcctgggcaacagagcaagcctctgtctcaaaaaaaaaaaaaaaaaaaaagaaacagagttcacagtacttctgacccctgacaaagtttctctggatacctgaaaagaaagttcgggtctcagtcttctagaagatgggcagtgctttgccactgatcacctgacataaaaccatccatcagcaaggtgctactcacatatttatcagagaaagcacaagtcatggactgtgtgaggcaggcatttccgtactcaacaacctctcctggtagaccaccacagattctccccttagtaaatctatttttaaaaagccccctttaaaaatcctcctctacttccttgaagagaaaattcaaatagagttctcatacatcaaacatatgacagaggcagtttttaatcatttaaattatttatcctttattgtttaatgctttatatcattcttccatgcataatttattgtaccatttatgtttattaaaaattgatcatggagacatgctctctctccattctctgaggctacagatatttctttgtcaaatcacttgggaatagacaacaaagtgttctactaaatttctttttcattcactttaactgtttgtatgtccctttcttttcttaggagtccttttcttccactaaaaactagagtttatctttgtgtattaactgctcagtttcttttttatataaagagaaagcttgtctgaaggccccctttctattcattaaagctttcagaaaaaaaggcttattttacttttctaatttttgaacgcaaatgtaaaaaggaggcacaaaagaacaagattctagagtcttctgtgctacaggccatagcttgtggaaccaaccccctttctctttgccttttctactttattcctttttttttttcctcctcagatgattcatactttccttgcccttattatgtctgcagtcagttcttaactctcttctgactagtttggtttttttcccttctatatcttccgattgctccccaattcctctcacctttgcgcttctcaaccctatgtcctgaactgctctctgcaacccaccaaccccagtcctgaactgtgcatcaccagcgtctctgacccactgccacaaacctggtcattctactcttctctaccagaggacaggggagaagcaaaaaggagcaaagtatgtgagaggcaaggaagctaagcagagctaagaagcacctaagaggctcacaacatattagtcctgaaaaaggtttgtggcagaccactgaattcaaaggcatctaacttggtatgtccacgctggctctcctcagtattccagcccatttccatgaggtccaaccatgttccacttccagtgttccctattgcaagatgagaccatgactggctgcccaagccagaaatctgaggatcacccttgccccttccctcgtattcacccccataatccccaacacttgcagatctactccttagtatctctggaatccatcccctgagatccataccattggccatccacctccctcccttgcccggccttctgtagcattttccttcaggtcccaggcccacctccctccgttcttagtatgctataactaatattatgaccactctgagaggcggatctgcttaaaatcctcttcccaccatgactgggatcaagtccagtgttcttaacatggcttacttagcttataacatgtgatgaggcccctgcttaattctcattaattctcatgccttttattttgcaaaccctaggtatgacagctcctctcccaacagctctactttctacatctactctctaccaccacaaaacttctttcagttccatgaaagggccatgtttttctggtctcttggcctaggagcatgttgttcttctgccagcaaccttcttcaaccatctccacaggatgactcctctattggatacttccatgaaaagtccaggcctgggttatgtacccttcccaaagtgcaccccagacacccaacagtttttccagcccagactcaccacactgtgtggtaatttcctgatcactcagttgtgctccccacagactataagctctatgagggcaggggccacagtttgcttgttcactactatatgctcagtacctggtaaatattagttgactgaagaatgactatgtggtaatctattccattggtggcctccagtgaaccatgtcttctggtatttacatcttgtgtggtcccctccattaaatttgggctttaaccaacagaatgctgcagaagcgacaccctgccacttgtgcttttgtgatcctagccaccagtaagaagccctgtgaccttgctgagaccctgaagagaccacatagagaggccacttgaagggcaaggggtcctgactctacatggagagagaagcccagccatccctgtttcccagctgagtcctgaccagataactcactacaagactgaccacaggcaagaacagcagaagagctgcccagctgagcccatccaagagtgcagaatttcaagcaagtaaaatgactaatgttgtaagccactaaaattctagggtggttcttacatagcaatatgtaactgtgataaactaaataaatgaataaaagggaatgaagaattacttcacagaataagtttcatgcaaagacatctcaatgtctctaagaaacacttctaaggaagagcagagtcaagaaaatagcaacagaactaacaggaaatagaggaactcataccaccagcttccatttacattacatcacatttttcctctgtcagtttctttggttttaagatattctccaatgaaaagatattcctactcttttgtgaaaaagagattctaggtttgacattaaagttaagaagtccaaccaaggaggggatgtgaacactaacacacaaatggaaactgcttagaatcccatggccaacctatccctgctgttctatttcctcttacttgccagcagagcagatctacagctgtggatgagggcatagaggctgctgtgctcaggggaaactggaatactatggagactcctggcttaactgggcaccaaatgttcagttcagtgtgaaaaataccatccaaagatcagaatggttaatttttatacagacagttaatgacttgtcagtgaactagtaaaaacaaaatagacagctactcagtgcctttaacccaggcatccaatcagttacactatacacatatgcacatacaccccctagagacagctgatacacactgttacataatccagaatattttctggctagactatattttgaatcctaaatattagctagcaacattagcatgcacatctcagaatgagaagacagactgctacatttatactggcttgatggaatcttggattgctacttctaataattgcttttcttcctgaaagaaaaaaatcattatgtaagaactatggcctaagcgaagtatctgtcttttgtaaaaaaccataaaacaaaatgccaagaatattttctaacgtattatactggactaatgctttgaaatttctgaatgatgtttagtaggtaaaattatcaatgtatgtctagaatagcatgcctcttaaacctacctccaattaataaattttatgtgatagatatttaaagtaaagaagtgaattcaggaacaagccagcggcttgaatgctgcatgcttgggaagggaaaaatcagctcccagggttttcaaagctccagaactaagtgacagaaaaggggcctgcagcattaatgtcgatgtcctgtccactagtgaaactgaacatgaactcctttcaaacatggctgagaataaaagctagacttaaaaaaatcagaaggctgggtacagtggctcacgcctgtaatcctggcactttgggaggccaaagcaggtggataacctgaggtcaggagtttgagaccagcctgaccaacatggtgaaaccccatctctactaaaaaaaataaaaaataaaaaaataaaaaattagctgggcgtggtggtgcatgcctgtaattccagctactcgggaggctggggcaggagaattgcttgaacctgggaggtagaggttgcggtgagccaagattgtgccattgcacttcggcctggacaacaagagcgaaactctgtctcaaaaaaaaaaaaaaaaaaaaaaaagagagagagaaatatttcctattcttttttttctccctagataaaagtgctctttgactagatgccccctcggatgttccctgggacctagaaaccctagagaatgaaaaacttattctttaacttttcttcttctgtggagtaacttctggtggaggcattaggctgtggggagaggacaggatgcacaggcagggaaaatgagccaggaacccaattctcgccttctaggagagagaagaagctggcctaggagcagcgggtttctgcaacaaaaggaacctgagagattatcatggtcaacccaataacctcacacccacacaaaaaaagagacctatgctttgtctgtagtacagatgaacacttgttctgctcatacgccagccactaggctgaaccctttcacataattttatttagtagatatttaattgggtgagtagatgaatgataaaagtgagcaagtaacatctagagaagacccaagtccattactgatacaggtgggcctggaattcagcagggcaaggtgagaaacaggatggagagggtcatggctgagccttagggagaagggaaacaaggctcctagcaaagactgagttcatgccactgctccaagccctgtaatgatttgcccaagtgacttggaatcatagtgaagttaattaaatgcaacaagctcacatagaatgaaattgtgcagaatctcatgagcatcccatttccttgaaatgggtaaaacagtgtgaggcagcttagagaaagtgcagggttgttcagaccatgttctatagcgggatggtctggtggagccccccacagaaggcaggtacaccccacagcatccagcaaagccttgtttctgcttgaaaaaaatgagttctacacttacaaaaaacatacacaaaatgaaaactatgggaatagtagaaagatgactgaaaaggatcccgcagacatgaatgtgaattgcagtcccaccaccacctaccagatgtcctcggacaagtcatttcagcccttaagcctctgtttcaatatctggaaaatggagataatatctactgtacacagacatttttgaggatctagtaagataaattatgtaaaacactgaaattatttgcagattcaggttttaggaaatataaaatgtaaatcttttaataaagccattcctcagaaagtcaacaggtagtttctctttttcatagatgaggtcttgctatgttgcccaggctggtcttgaattcctggtctcaagcaatcctcctacctcagcctcctgagtgtgagtagcaaggactacagacatgagccaccacactcagctctcaacagctactttcaatggaggctcagttttctgtttcctgtttcctgtttgtgtattaacaaaatccatgggtgtctcaaggagaagcattatttaaagaatatagtgcatgggacaatttcatcaacactccaaaagcaagctagataggggtgatcctgctgggactctaaaaatctacctctagggtttagcgagtaatggtatacgagtgctcaactcacaggaaacagatcaaaaactccaagttccatgttggtggcttctaggtgaggatgcagaccactgcttatgtagggaaggttgacagaggatcatagtttcaggactggaagggactccggattatcaacattattttgctaatgaggaaactgagaacttggggtaggagatgactcatccaggatcacattagtgattacagaactcagtcgttcattgagcacctttccactgcactaaggttgactaaaagcagacagacttctaaaacctaacgatttcccatccataatttatctgcgtatagtaagtttaactttcctatattccacttgaacacatcttcagaaggcattccaagcagtgcctttccaccgtggcctgggagtagggtcaagcacatcctcgtttgcccaggacagtcctcatttatgcttgtcactccagcgtaattattaatagtgcgcccttgcctctcaccagtacctggatgtggatggtaatttatacagtactctttgtgcttttctgggagaaacagagagatccagggtagaactgctccccaagagcttggcaaggtggtttggaaccaggagagatgtgataactgtcttcaaatatttacaggtctgtcctatgttagtaaaattaggccattctgtggctatcaggattagaacacagactaccatgtggaaaccacagtgggtggaattcttcttcgctataaagaagtgtattctaaacagactccagggccagactgcctgggtccaaaccccggtcctgccatttactagctccgtgaccctaagcaggttgcctaaattttttgtgcttcagtttctccatctgtaaaataataataattttaaaaggcagcaagatacatagtaggtgctctataaacatttgctgctactattactactgactgttacttggcaggtagtcaacattcccagggcagagattttcacatctgcaccaggacaggacagctgggttcaccctagggaggggggaacagggagcactggctcagctgatgctggagacaccaacctaatggagaatgtgttgggtctcgggggaaacagttccaccctatctgctcactgcttgaggcacagtgtgtcagcagggaggtactgcactgatggcagtacagtggttgatgtaagtgtatgagggtggactggatcagaccgtctgcctttaatcttggctcaaccatgttctagctatggactggagttgcttactcactctgtgcctcagtttcctccactctaaaagaaggttaccagcagtgccactctcacagcattgtcaagaggactgagtgcaatacaaataaagcctgggacagaaaaagtgcatgataaatactgttattacgatcacgcaacaaccactgatgcctagggctggtgctggaaagcacctgacggaggctggaactgaagtcaagaggggcgaggggcatgtccaaggcctcacagcctagaaggcatctcaatatcttccctgcattgcactgcagtccggctcacagcagactgattcacccatcctttgaatcccaaggcatagctgatcagttggtgctggggctgcagaagtgacctgcactaggacagctgcaacagggaggccagcgtgcagcaggtagacctgcctgaggggcagcctgaccgggcaggcaggtgtgaggccatgaggtcagagctgggtggagatgggattgacgcaagggtgattttattaaaaacataaatctcattctatcaccccactggcaaaaagcctattacattaaggtcctcagagacctcaggagcacctgcccttgcctacacctctggcatggcccccacccctctccccacagccacactccctctctctcttttccggacttgtccagtgtactctcctcagggcctttgcaccaggcatgccctcagcctgacgcacacttccccaggtatcatccatctgtctccttgtcattcacatctcagctctagaagcactgccctcccttgactgccatgtctcgagcgtatccctatcattcttcatcccatcagcctctctgcttttttcacagccctcatcactgtcttaatttacctgcataagcatctgtttgtttcctgtgtgtttttcccctgtagaacataaactccactttatgatagggaccttgccttaagcacacctcaacagtgagcacttaataaatgtttgttgaatgaatagatcaagcaaaaacaggttgcagaggagtgaagaggagcaagggtgaccaccttggagagctgggttcaactccatgggtcactgggtgtgtggtgtctgggggggtgtggctgccttaaagaccagaggcaggagtgcttaccctgaagaacaggaaaatccctggaagaaaagaacagatgaaatgactcttccttcaccctcttgggagagcagaagactgtatctccatggttgcagagcacctacccttgccccaagttgacagagtcatccctccatacatatgtggggttggttccaggacccctgcagatatcaaaatccttgggtgttcaagtcccttatatgaaatggtacagtatttgcataaaacctatgcatatccttcagtatattttaaagcatcgctagattacttataatacctaatgtaaatgctatgaaaacggttgttatactgtactgtttagggaataatgactatagaatgtccatacatgttcagtacaggcaaccatcataggcataacgacattttctatcctcgcttggctggactgcggatgtagagggtcaactgttccccatacatcggtgaggcctgaattcgtaactctttccctggattggtggtctagactgttagcctctagaggacaggatacaggtcagctggacctttggttagtgctgaagagaatctagcagagtcccagtcctagtcatatacacagtttagtttactatgtacagaattacaactatgtccaaccaagtagagctaatctgagccccctgaaatagggtggccagacacgtgagtttctagtaagtgtttctatcttcatgtcatgtttgatttccagcccgtcacggcagcaacccagatgactcaaaccagagtcataaacatgctctctccaaagggaataagagggctgcttggaccagaagcttctacacaggagaacccagaagcaaaacaaataaagaatgtggtccctgctaagagtcttttggcatccatcagcctactgtcttgagagatttttccagaaagtattcagaaggaatatcctgggtctatatgaggacatgaatgcaacacctttaacaagtgttggtaaaatatttacagattcctaattactcagatttcatttctaggaaaaatacctccactttacaaaattaacgtttaaatgttaacatcagtgggagactaggcagtagagaagttagagagagactgaaaggggaacaaaaaccacttctctataaacatgcccttttcaataatatcctttcccaagaattacggtcaggagtgaagagagggtgggagaaaataaggtccggaggaccatctatggggatcagggccacagctgaggctttgtgagcaaggtggtgctctagaaaaagtcactttcctgacctgaatttaggagtaaatgccctgtgcctccagtttacaagttaccagataactgcgacccaaacctccaaggggtgcagaggagaaacacaggtaaaggtttcacttggcagagaaggaaccaataaaacattttccccttcaaagctcttggctgatgtttcagccagccattaatagtcttcattttaacagaccagagagaaagattacaataaatgtgggaacattatggtcccctccacgcattccccttccccccaccccgccgccccctgcaagtttcctcaggcctgaagtttcctggggaaaaaggcaaagtggcctttggcctcaggagagaagcagttcactttgtgtttatcaggatttttctgtgaagttccccaaacccactggcacgcccctgccatagcatgggaaagcaaattgcacgagggattccagatatgaaagtcactgtgggaggaaaacagaggaacacgcatgcaggttttttatctttttccatttaccaccaccaagctcttctgtttcgggtgagctcagcagcactagtgccttggataatctagaaattgcttccatatgcgggcacaggaaagaatgtgcgcactggctgcctgagaaggaagctctgggcagcctctctttcctgccagaaaacattgctcaggcctgagagccatagagcgttggagccaaaggagatcagaggaagcagcactaaccttcccaatttatggataaggaaactgaggcccaaggtcacacatacagcgacagagctggcagtagaacctggggctctctggctctatccctaagtcaggtactgtctttccctctcctccctgcaaatccctgcctccctcaccagccagcacacccttctctcctctctgtccctctgtccctctctctcacacacacacacacaccccaagtgcttgaatgaagggcttcaatctaatttagtgtagcagtatgactggtctgggtctgaagcgccaggccttggggcaggacaaccagaacagagcttgcttttgagaaagccagcgcagggagtgcggaggagctcgttcactctctgcactgggacctgtgccagggtctccagggccccaagaccactcctcagcctcaatgcccccttagtgctgggttagtccaggacttgaaacaaagactccatttaggatccaacagagagtggtctgcaagcaccctcatctctacagaaacctaccacacagaaacttggggtgatttaagcctgaatcacaccatcttgaactgctgacccaagtgggaaaactcagtgcagtttcaaatgagcagtaggggaaaaccaagaatgccctctcttgtgttccgtggtggccagtgtcgggctcggcccacaccactttgacttcttgtctctaggccaagagccagggcaagctgtcccagggcccacttacaagtcaaaccagacaaacctcaacctttaaaagcttgctctaggaggacctgaaacccagatggggtctgcagttctgctacataacctgaactcttctgggtcttcctttttctcatttttaatttttaaatagagacaaggtcttgctatgttgcccaggctggtctcaaactcctgggctcaagtgatcctttcgcctcggcctccaaaagtgctggaattacaggtatgagccaccgcgccaggcctggatctttcttatctaaaccatcatatcccatattatgttaatgttttattaacattaataatattatattaacaataccactatagaaattgattaccagtctagttgcaagtacaagtattctcaggtaacactgtctttcaatacagatttattgaatacttattacagaggagacagaggagaggcagaccgagggtataacgctgcatacatccctataatatggtttctcctttcagagaactcagaatgaaggggcctcaggttacctgcatcattctggttttttgctcctgttttactacgaagcaaacacctcgactataagccgccatagaccagggtctgtgtctcattcgtgtctggacaatgcatcacagacactcaactgttttctgcctgagcagaattaagacttggcctcctaactcctccatcaccatcttctccactctcttccttggccttcatcaccaacaccacctcatcaaccgtgaaagattcaaagagtaaggaaaaccatttctaggaccatgaaatgtgtcactggatctcctgcagaaatctgccagagctacaatgtgactggtttctacatgtctgacaaatttctatttaaataagtatttttcaaaatgcaaattgctacctattctttggccatcaaatcactttagtgggttgcaaccggctttttcttcttaatagaaaaggaaatgtgttgcatttggtaaacatggaaattgttttataaaacttttgtttttgtttctgtttatctatcctgtatacactgggtctcaatgaaaaatgtatttcttactgtaggtcataaccaaaaaaggtttcagaaccctggtttagacaatgtgtctttctacaatggactctgctcagagaggctcatttgtagatactgcatgcagacaccgtcccacttcatgtctgtcattcaagtggaggaatggggctctactctgagcatgcttcttttgctgttgtttaaactctaacccataccacttgtagcctcttaaattttctctcttaaaaatattttgggccaggtgcagtggctcatgcctgtaatcctagcactttgggaggctgaggcaagaggatcacttgagcccaggagtatgagaccagcctgggcaacacagtgagacctcatctctacaaaactgaaaaacttagccaggcatggtggcatgtgcctgtagtaccagctacttgggaagctgaggcaggaggattccttggctgcaagtgagccatgattgtgccactgcactccagcctgggtgacacagtgagatctcatctcaaaacaaacaaacaaaaatttaactctggcaagagttgaaggtatccaccactgtctattttgccagccccaggaatctatacaatgtaaggttccttgcctatggcctccaaattaggactgagtttattcctacagtttttctgtcttgggtccttttgatgtacctcagggggtaaaaaaggaggaactcactggactgtcttatgcaaccagggtcagttatggcacaccctgccctctagttcctcaagcaagcaagccattactggtttcatgagagttcattagtttacattggagctgggacagtaagtttagaaggtaaagcccattctgcacccagctcagtgcctggcctacctgccacaggcccctccacattccttgaccactaagaaggagagctggaagccactttctgcatcatccaggtttaaggcaatagcctgcacatgcccaggggcctggctttgcaggaagctggctgatgctgacacagaatgctcggtggtgggatgtgcctctaaaactgccattttaatcaaggacaaggcagggagaccacagacatgggaatcagaaacttctcaatttgaatcctagctctgcctctagtttcttgtttaattctagaagggtccaggctcacatcagaaaaacacaaagagatccctttgccctctgactaagaacaatgtcccatggatttgaggctggaagggccccatgggcttggagcagctgcactccctgaaaaccttgctgtatcagatcgggtttaagaatgcagttggttttgttttagcttctgctcctctaagctttttattttgtccttctctggacttgaaaagaagaccagataaactgccagcacagagctcaccactggggctgacagtgagcgaggcccgaagggagggaaggaataaagcatttcccaccctcgaacagtctaccaagtacggcaccctcttcctgggactggtcgaggtctctgcaggaattgtaaagaattcccctcaagtttctttggccttatagtttcaattctcccaaaatgctcttcctgtgggtgggatcatgcaagatcagggctgaaatcagtcctaggccaatgacactttacaaccctttccacctccacccccgtccctgggctgttttgaagtgtctagctcagaggtgggaacacagttctggacctcttccagccctaggtttctgtctctatctgataaagagctgatctcctctccagtcttgcctgtgaggatccctggtcattgttttgcaggtacaaaggtaacctgtggtcaactttcagctctgatcccaggagcggcaaatcctgcctaggttgctggtgatgcagagcaccaggaggggaagcctctgcaggccacctcagcctttccgggaggggcttaaagctcttcctcccagcagcctagcaagagccctgcagcttgccggcctccaggctgaggctaggctgcctaagaattactctccgcagcaggttttgagatacatttttctttatggaaaggaagtagccatttccctcctcttcctgccctcctcctgctgaactctgctataaactccgctagtttgattctctcacccccaaaatgacttgagccagaagttactggagaaaggtatctgcttttttgcctgggactgtccagaaggcaggggctgtgcagtgcaaactctacaggacagctaccctttgaacaccaccttgctaagcaccctccccagccctacgtcttgttacgttttgtacctgaaggaggtttccagctgcgtctctcacctctttaaggcactgttaaccttggtcctgcccagtaaaaaacagattgttctatgttttgcctataataagaaaatcatctatggaacattttatgcaatctcaggcagggggaagagaaacgaactggaacccagcaggcctgcgttcttatctcatctctgctaccaactggccattagccttaggcaagctacctgacttctccggggctctgtctctttacctgcgaaacgcaaggttgggcaaaatgatcttcactttgcttccctgctctaatgctctgggatgttacatttttttttagttaaaagaaaaaagggtgtgcatttttcagttgagtattatattccttctctaccagctgaacgtaacttactattattcttgataatgtgacactagtcagtgccaccagttttaggcagcatttgtgacactctaggaagattttcttcctcattaaagaccactgaagtcttaggggacatttagaatgtatgtctatgatgggtatcagggcagtgtggatgattcagagcaaagttaatgctggacccaaaacaccacacaaagagctaatgggtggaccagcagtcagccttcactgcttcccgctgccctttccacagtggatcagtggccctaacccagaagcatgcatgcaacaaacagagggacatgaacaacactgggtcagtggtcagtcagctgcctgaacaaagctggggccatctaggtcctttaaactgaatatccttgaccaaagaggcaggagggcctcatagttcagactgggctgaagccacgctgcctggactgaatgttgaccttgccagattagctgtgtgaaactgggccagctgattaccctcaaattcctcacctgtaaatggaaacaataatggtgcctgccttagagggtggttacatgggttcaataagttcattcagagcatttagaattttacctggtaaacagtaaacaatgttattttatcattccttcttcaaaaatgattactggtaatctaaataggaataattcatccctgacttctgtggccatggcaaagtactgctgagtggtacccaggctggcaagaaattaggaaacagtacccagacagtgaatccagatgaagaccccttatgttcccatgcattcctgagaaataagtaaaattttggtaaattaatttcataattccattggcctccaatataagtgaagaagtgctctatctctagacctgtttaattgtggtcaatagtttcccagaattcttagttaataaaccattaaaacaaaactgagataactgcactagaaggacacatgatttcattcagctggtatttattaggcaccaggtatatgccaagcattacacttgtcactggcaataaagagggtaaattgctgcaattatctgctatcaagtagttcacaatctaatggggagacagatactcaacatacattaacgaaattaactgtcagagctgggcgccgtggctcacgcctgtagtcccagctacttgggaggctgagaactgcttgaggccaggtgttcatgaccagtctggccaacatagcaatactccatctctacaaaaatgaaaaaatgttagtcgagcatggaggtatgtgcctgcagtcccagctactcaggaagctgaggcaggagaatcatttgagcccaagagtttgaggctgcaatgagttatgattgtgccactgcactccagcctgggtgacagcatgaaacactactttaaaaacaaataaaatttaaaaataattttaaaaagaaatgaactgttatgctggagaggagtgcggaagtgtttcaaaaaaggtgacatgaattaagatgtaggacatgacaaggagttttcaaggggaggaggggagggcactcttgcaagagtaagcatgagatgggcctcctctaatctctgtttcctaatgagttttcctaaaggcagatcccagcttagtccagctcactgagttcctggcaccgccaggagtccaacccagcagccacacagatgaagattaggattccttgcttttcactccctgcccccccatcccactgatgggggtctctccctgcagctcagaaccaccagactctttgtcttatttcactgctggcctctgcaccctcccccatcacaaggaacctcctcccttttcctctccctgtctgtgttgctaggaccagagctgacagggagcacagggaaagcttctattaggattctgctatgctctcttgggcatctaagttagaattcagaaagcccttgtcacaaccctatctacaaagggtaactgagttgtcgagggcacttgtcctaaagttcagcttcccaggtagacaagttggtctaacctctctgcaaggaagaaagtccacaggggaaccattgaccagtgtgttggtccagaatcttgccatgcataaatggaggcctgtaatgttagcaccaattttgaggagcaagagcagtacagttcctgctggctggctgccatctagcatggtctgctgctgagccaaaacagcaatgcgttgttccttagaccaggactaagaattacaaataggaggctcaactagccatggccacagtcaccaactaacagtcaggtcagaattctcaatggcaatgccccgcattaagtatttgtatccactctcagcaatcgctgccatcatagtgaatgccctccaaagcacttacagtcacctggttaggcatagggtgttttgtctgagactgtacaaagtattcattagttagcgacgacctctgccttctatgaagctacaaaggctgacacatactgacacataaaatggacagcaatatattgacttttccaaggaagtccggaattggtgcttcctggttatatctgaagtgctccttaaaaggggtaagtcaatgacacatgtgtacatgtgtgcagatgcaactgtgtgtgatagattgttgcatgaagtcagggaccccgaatggagggaccggctgaagccatggcagaagaacataagttgtgaagatttcatggacatttattagttccccaaattaacacttttataatttcttacgcctgtctttactgaaatctctgaacataagttatgaagatttcatggacatttatcacttccccaatcaatactcttgtgatttcctatgcctgtctttactttaatctcttaatcccgtcattttcgtaagctgaggatgtatgttgcctcaggaccctgtgatgattgcattaactgcaccaattgtttgtaaagcatgtgtgtttaaacaatatgaaatctgggcaccttgaaaaaagaacacgataacagcaatgttcagggaacaagggagataaccattaggtctggctgcctgggagtggggcagaacagagccatatttctcttctttcaaaagcaaacaggagatatatcgctgaattctttttctcagcaaggaacagccctgagaaagagaatgcattcccaggggtaggtctctaaaatggccactctgggaatgtctgtcttttatggttgaagataagggataaaataagccccggtctcccgtagcgctcccaggcctattaggacgaggaaattcccgcctagtaaattttagcctagtaaattttagtcagacaggttgtctgctctcaaaccctgtctcctgatgttatcaatgacaatgcgtgcccgaaacttcattagcaattttaatttcaccccgtcctgtgatctcgccctgcctccatttgccctgtaatattttattaccttgtgaagcatgtgatctctgtgacccacaccctatttgtacactccctcccctttgaaaatcaccaataaaaacttgctggttttgcagcttcaggggcatcatggaacctgccaatatatgatgtctcccccagatacccagctttaaaatttctctcttttgtactctttccctttatttctcagaccagccaccacttaggaaaacaaaaaagaacctatgtgaaataatgtttaattatcaggggcgggttcccccaataatagatggtgaggacagatggtttcaaggttatgcactaatacagaataaaagtgaatataaatgatgtgtgcttacatatagtgaggtagtgtgatttttattggatgtaaataaaatctgcccagtgtacctggacagcatctggctcaaattccatttccacaaatactattacaaaaaacaacctcggtgcaatagaaagacttcagtgtttcagctaatattccttctttagcaagtatacaatgagattcaagtataaacgaagaactccatgagttcgctaaaatataaattgatctttatatattatacatacactattttagctaaatgagaaatgtgatggatatatacatctttcccttattaaatacttagtcaaaaacaggcatggtaaaatatcaggcttcggctcctcaggcctctgaatgacaagttacaacgttgattgcattgttaggatggaccttacgtggagatgttaatggtgtgtcccatcggaggcatcacagacatgctggccaccatcttctccctgttcctgcagattctctactctacttctgcacagtgttgtcaagcccagcttgactactaggcaacaaagctgggattagactacaactggtgaactcctcatttactgcccttttcatgttacctttctgcctttaacagaggacgcaatgcacaaggaatccagtaaatgagctggtcaatatcaggtcttaacctgaaagtaacttaattttttaagatggtttcactatctgtcaggattgatggacatcccaaaccagggacagtgtgaaggtgggcaagaggacatcagccttcaggcatcagcatatgggggcctcaaaaagatgcaagtttttacaaattccagtgccaaaaccacagtatgccgcaagagaaaaggtgccaactggtcctgattcctcactatgcccctcactggctaaaatgtaatgcagctccctaccaaggttagatccacttcacagcaagccaggcacttggacctgctagttgaggcaggcagatttctggccttgaaagtaacccacctgttattttcaagtggtggagagttcagggtcccttaggattgggtcccatatggggactcagggtctagagattttccttttctcatcagacctcctgtcgcattgtactgaagtctccgcaacactgcctgcttagagctatacaacagggcttcattccataaactcattcagcccccatggacctctgggttctgcataaggacacatcatctcgaggaactcctttgaccatgctgtgtcggaacttcagcctcagtcttgcttgggaacttctgtcttctccctgattcagcgcagctcccgctagtcagggacatccatttgcctgcctggtctgtggcgttcttcccagcatggggcccttggcttgtttctatcctggacgtttggcagaatgtacgcacttatctttcaggggacactgatctggacaattcaccctcattcaagggacccagcccatagagggtaaaactctgatacattctttttaaaacaggacttccttttgtgaatcttcctaactttgaaaacactaatattaaaaaaaaaaaaaaagagtaacacttttattatggcagacatcaagcattcacagggtttcttaattttcagttccaacttctgttgcccaaatgcaatctttttgacatctgtgtcaggttagttacaaagcattattattctgggctgcacaatgttggcccaacctacccaaatacaagaaattttgctgattgatttagttattccgttcctataaatgaatccagttgtgcagctgtttctgattaaccaatgtactgctggagctttatataaataattttataatgaactcagcaacggcaaggacatgagaagcagaatctaaactcacctcccagaaaaataagcaggagcaatgagcgcaaggactttcaacaacagtccaggtttaaattcctatctgctatgattcactttttcctctttatgtaattcagcacaatttataactaatgctctcaaagaacctttgtcttcagatttttggattcaagagagaaactcagctttgcagtcttaaagctcctttaaaatttcccatctttgtattttgtaagtttctgtttttcccattaaaacatttatatttcctgagacaatttcttaaataatgcacttttagaagaggaaaattggaattgaaaggtctacatttactttactataaacagaaatcaagtgttttgttttatttcaatacagaacaattaagctctgtaagtccagccatgaacttttctttttcagttctagaagacaaatcatatgtattatgattaagaaattacaaaattaagcaaaagacaggtaagaataaatcaaataagtgaatttttttaatgtagagacagtgacaagtgctccctaaagaaaacttgaaacaaaacaggaaaaaagagatcataaagtttatacttctaaaatgaattatgctggcaaagatatggggaaacagatattttcaaatagtgtcagtgagactgtgaattactacagcttttggaaagtaatactcctttagagactctgacagacagaaataaaaaagcttctgtaagttggcaggttcaaatacacacacacacacacacacacacacacacacacacacacacacagatgttccaggaagaatggttgtagtagaagaaaacttgacacaatatgaacagttaaattgtggaatattaagcagccatgccataagtgagttttttattctggagagaatgtctatgatgctttattatattaaacgcaattgtggcataatgtattaataagtaatataattctatttttaggagaaaaaactatatatgtgcatatatacttatacatagttatataagcaaggagaaagttcaggaattgataatattgattacttcaaagggttagtatttaagggagataggagaaatttattaactttatatatttccattttcttgtcttctttatagcaagtacatatgcttttgtaatctgaataaatttacaactacaatgtaatttttatttttatctacttatttttttttagagacaggtctcgctctgtcatccatgctggagtgcagtggcatgatcatagcttactataaccttaaactcctgggctcaagtgatcctcccgcctcagcttcccaagtagcaaggactacaggcatatgccaccatgcctggctaatttttattttttgtagagacagagtctgctatgttgcccaagctggtctcgatctcctgggttcaagtgatcctcctgcctcagcttctcaaagtgctgggattacaggtgtgagccaccatgcttggtcaacagtacaatataatttttaaagagtgataaagagtcatattttcagcaaaaacatagaagcaaagactataaattacaaatactgagcacctggacttgtggttaacaaaaaccttttccaagttctaagagacaatacgttgtttttgcttgtttcctctgtgtgtggggtggaggcgggggtgtgaggggaggagtgggagggtgggccgtaagagttgggaggatgggcatgaaggcgtggggaagagatgttacccgatttcttttttttttttttgctttcattttatttatttatttatttttgagacagagtctcactctatcacccaggctggagtgcagtggcatgatcatggctcacttgcagcctccatctcccaggcacaagcgatcctcccacctcagcctcctgagtaactgggctacaggcacatacagccaccatgcctggcttttttttttttctttttggtattttttgtagagactgggtcccactatgttgcccaggctgctctcaaactcctgggctcagccatagcacctggctgcttttattatttttaagaaacatataataattgtacatatttataggatacagtgtgatatccctccctccctccctcccttccttccttcctccctcccttcttttttttttttttttttttttttgacagggtctcactctgttgcccaggatggagtgcagtggtgtaatcacagttccacttccctaggcttgagtgatccacctcagtctcctgagtagctgggactacaggtgtgcaccacgacgtccagctaatttttgtattttgtgtagagatggggttttgccatgctgctcaggctgttcttgaactcctggactcaagccatcctctcaccttggcctcccaaagtgctggggttacaggagtgagccaccacacccggtcttgcttagacttctttctaggttttatcctcttctcagccaaagcaagggatgcaaaactcctgggcaaaagagttgaacttcatttatgtggaagtgaatcagatacaggtattagaccaggaaatatcacttcttaggttctacaataataacttctactttccccacaagaacaaaacttcccacttcttaattattagaatcatggttattttttaatttggaacacataaaaagctaattatgtataagaattttaaaatgtcacattgtggccaggtataatggctcacacctgtaatcccagccctttgggaggcaaggcgggaagatcgcttgagcccaggaattcaagaccaaagggagaccccatttccacaaaaaacaaaacaaaacaaaacaaggcacggtggtgcacacctgttatccgagcttacttgggaggctaaggtaggaggatcatttgggcctgggaagtcgaggctgcagcgaactgatggcaccactgcactccagcctaggtgacagagtgagaaactgtctcaaaaaaaaaaaagtcatcttatatacatcacttatcgtaaaggaccactcttaggatcaaatttgtttcttggcatcttcagaaacaagatactcttctgcaaaacaaagatctgtttggctttcatgaaaaattcactcaaatcttacagagtggaataaataaaccatcctttaacaaacattgacaacctactatacaagaatctactgttttgagaaaatacaaaaggattttttaaaaagtgattgtcttgaaagagcttacaatctaacaaggaagaagagatgcctgcaagtgactgcaatacaggatagggtgaatttcaagccacatgtgaagcccagaacaatagcgatggaaactaagagaaggcagaatcagcaaatggagaagagaacattttggctcttgttaagaagcatgttcttacaacgtgaaccatgcttatcaaagctcctaaactagtgaaatttgtaggtaattgtgtctcctgttaattttagcacattcttcttttactgagtatcagcaaagtctattatttcgacttttcagcaagcaatgatgatcaatctgaagattcttatagcgttcaacaaacaaatgaagagaaggggcagtgtggagaggaggaatggcaatgcaacagcatacgaaaggaaagtgcagtttagctggaacccagtatatgaaaagtagtgcataataaggctgatgttgaaattaaaggttaaaggtgcgatgcttggaatcagactgctccacatttgaatactagctctgtcactaactgtgggaccttgggcaagttacctaagttctctaagcctcaggttccacataaataaacagaacttacctctcagggtaagtgaatatcaaatgactcaaataacatacagtaagtgataatgttacagaaagggaaagagggagagagaataaaaggaagaaagaaaggaaagaaagatatttttaaatgtttgggccagatcatagaaagttttgaagatttcattcacttaaattaatgtaattgagagagaaaaggaaattaaaagaagaaatttagttatgctggaaagatggcttattagaagaagaaaaatatatatacccatagtaagcaatgctaaaatgttacatagcaacatattccttcaatgtgaaccctgcttatcaaggctaacaaacattgtagctaattgtatctcctgtttagctacatttttattttattgactattagcatagtctattatttttgacttctcaacaaatatttgtgacctgcaatctctgtaatgctgagcatgcttcctaggactcaaaagtttctgatccctggccacgagaagaagcagtggtaccctcaccccatggcgtgggtgctgtagttgtgaccaaagcagcctggcctggggccaagtgttattgggtgttttacatcagatatctcatgcaatctaatctactgtcatctctacactgatgatggccactgtgtgactgccacaacacattaacctggtatttcccagtgtcaaagggccaggaaaagtgacaagtctggtttttgcttcctcatcctttatctgtccagacaacctcaacagagtaggttttcctgggtaagcagatactgcgggctggcagcccctcaatactaagattcttttcagtgagatctctccttgggggctgttaaaatatgagatgaccgacatgaaacacttggtaaactacagacagctaaggggttattgttctatgttaatttacatcgaaagcagttcctgcgtttaggcttttttggtatttacctatggagaaaggaatgccaacagtattttgttcaggctaacactgataaatgtaatgctaatgctaataataataatagtccacaaatactgagcagtgacactgtcccagccaatctgctaagtaattcacatacatcacctcatctgacccttagaacaatccttttacagaaggggtgttactctcatttcaaaattgaagatacagggctgggtgcggtggctcacggctgtaatcccagcactttgggaggccgagataggccgatcacgaggtcaggagtttgagaccagcctgaccaacgtggtgaaacaccatctctactaaaaatacaaaaattagccgggcgtggtgcacactcctgtaatcccagctacttgggaggctgaggcagaagaatcacttgagcctgggaggcagaggttgcagtgagctgagatcatgccattgcactccagcctgagcaacagagtaaaaatttgtctcaaaaaaaaaaaaaaaggtgaagatacaaagaatttgtaaaagacagcattgggactggcccatgctttacccattaggaaactctgccctctggtagcacatcagcatcacctggggaagttttcaaaaaatggattcctgggccttaccacagacttatagaatcacacctttataagcttctcgtcacacccatggctaaggattagcatactagttaaagtgtattaagcagaatagcatcactcaactaactgaagatattctgggggctttggtacacctagagttttcattactcaaaactatacaagggacagacttaagttattttgacctgaccataatacctacagagtgaggaacaactgacaaatgtccgccctagtgaacaaaagttagagctgagtgaggaagtattcatctgtcaaagggaggtgaagcctaaactgttcctcaattggagaagagatggtgggacacggtgtgaatgtgctgattaatctttcgatgcctggcacacagtaaacacttaataaatatttgttaagtggacaaacgaatgaaggagtgcctccatccagctggactcctctgaattccctgttccctgtatttggtctgtaccttttttaccttatttaccaaattctgcctgcatacctgctgtttgaaaccatgtctcatctctaccagaaagtaagcattcaggcgcagacttcatctctttctgagctacatcttcctttctacccttacctagcacagaggatagctataacctctagcagggacccacaatactcaatgagtatctggcttgattccaactgtgacctgattcgacgtgggtccctgctagccacaagggataaataagcctaccaagccttcaagaaccatggtataattgtggcttgctgggaaacagcagcagagagagctttgtgtggaaaccattaagaattcagtagaccacactggagggaaggcttcaggaagaccacagccctgggaggtaaaatgacaaatatcagatgcttaaaagtgaaggggttatggcaacaaataaaaggcacttttgtttcatttattctctcagtatgtgttgtggaaaccaactatgttcctaaaattacaaccatagttaggaacaccttgaaatagcaaagacaatgacacagacccagtaatgaatactgtctgctaaaagggtctcatgcctgaccatagcacctgagacagtaaatgtacaaggtcagggcatactaccctctcttcaccacccacctttctgctcattatagctttcgtgtcttggtgctacacactgcatggtatctggatggcccctgtatcatactccttttgctgcttccttcacaccccattatcctactagatcctcataccctgcagtggatgtagagcaaagattatcaagcccatttcttggatgagataagtgaggctcaaattgtaatgatatgcctaagggcaccagaaagtggttgaacacattacagacaatttttaaaatgaacaaatagaaggaggcatgaatccccccaggaggaaagtctcattctcttgaaatatcccagaatttgatcttaccttgcttacaaatctctttgcactacgtcacacaacctcaaagagttgatgtgttttcatggagccaaagttatggcaggggttgggtaagtcccagggaggaagacaatattacggaactggtttcataacatctgcagagtttagtctgaacatttccattcaacaggtaatgggctctcacaggtggctgggatttgcagactatagcacctccaggtccccgagaaactcagccttgtgcggctgataggcaggtagacacacacagtcacagtagaaggcagtgttgtgtgcactgcaaagggattaataggcagagtgctgatagcctatcaagggttttctcacctcaagaacctaaaaggtgatttacaaactgaagtagaacatttcttggagttattttatccattacaaaaataagcatttttgaagatggaaaaatctaccaacgactcaaaatgaagctacagtattgttttgaaattgctttgggaagctggcaaaagaaaacccacccagcgtggaatctgttcacgggctctgcggctgcatccgacgggagtctggggctacacgcagccagggatgggggaatgggagtggggtggggtccagagacgatccagggggcaggacggacacacgcttttcagtaaaagggaccaagtccacttggtcactgagccaacttgagaggcttcccagagaactcaataaggccaggagcccgtggctgaagaaggaatactccatcgggatttaagcaggaccagaagacctcaccaggctcagttcctcacacagccacaccctttgttaatcccaaagagctcaaagtctaaccaaccaccagtggtctgatttagagctctttgcgattaacaaaggctcacagcgactgggtcagctgctttcccttacactcacaacgctaacagttctttctttaaaaagaaaagtatgtatagtagaaaaaggtaggggacgcgagactgaagtgaagctgtctctggagagttcgggggatcaccccccctcaacccccgtccccactccgggcgaaaagcactgaccgggactggagatgtctctaaggtcgacgcagacccctaacgcgcgcgtctacgccgacctggggcgagcgggccgcccgggagggccgggagggaggcgggctggagcgcgggaggggcacggttcccatagacaggcaggcgggcggtgccagaacttgagccggccccaggggatgcccgaacgtccccctctgtcctagctggggtgtaggtgcagccccagggcatcgccgcgaagcccctgctcgagacctacggagatagtgggtcccgagccccacggggcggccccgggtccgcggagtccagcggtgagctcagcccgaggcgcgggacccaggctgtccacggccccttcctccccgggccatcagcgggcagcagaacgcgcgggccgctggcctggaattgcgcccctcccgaggccgcgcgcccgcgcccaccgctcgcaggggacgcggcctcgacgtccccagccgccccacccgcgtcaccggtgccaggcggcacttccgtgccccgccgtcgagcccagcccctcccggcgtctcccccggcccccgggagcccggaacccgggtcgcgccagaggcgacgcgtcccttaccgcgcagcggctccggacgactccgcagccccgcgccgcgctgggcattttttctgggaaacttctcccggggtccgcagggctgagccgggcgggcaggaaaagcgctcagcgccgggaggctgc

SEQ ID NO: 2163 - DNA, 75006 bp, Homo sapiens
  source 1..75006: mol_type = genomic DNA
tcattctgcttttctttattgtctggctaacttacaaagatgcagatgtctagggtagtctctaccctaccacttacactatcctgatgacacagatagcaaaatgtgtctgtttacatagtgcatggtatgaaaaaaaagtttttcttcctctacggtccttgactataaggagggaaaaattaatttcatgccaacatttttggggaactttaacaatcatcccatttctgctactaaaataacaaaactggtattacactttaaaatataaagacctaacagtttttacaaatatgcaaataatctactacttagacataaaaaaaagttgatttcttttaaatcacaaagtaaggcaccattggattaaacatttctcctggcttttactaaataaaatgcatagtgaaataaatactgaacactgagttttaatactgtaatacatttcaatataaaataagaggtgaatgttaaaatactgtattacatgttgaatacatttatctgaaaatgttataaaaaaacacacatgtaagctctgatttcagggaagaaaaattcatttttgtaattttccatagtttaagattttaccacagaacttattcatagttttagatgcaattaggttgcaaactttcaaagaaagggtgtaggtgtattaatgaaacagtcacttaaacactacattctaaaacaatctattctggatgaatggcaactttgagctatcaccctgtttcagatttagaacggtacctgccaagttcagatatgcaaaggaattgtccaattcttactaccccttataaaattcagacccactttctctgagtcagacttttctccgtcatattttctaggaagggcaaattccatcttttgtgaaatgggtcattaggctttatcatagggatgtttttcactgttgaaatcagataaaagaatcccaaataaatgatgctgctaaattaccaaactgctagagattaaaaaaatttttttttaaaaagccaacactttgccaagcttgttataccttattatttcttgattctctttgagtaaaaagcccaaatgactgtatggaagagagatgaatggtagaggagagaggaaacacaggttctctaatgtactaaatcaggactttggcaaggaagttatagaaatataatatattcaaatcagtaacttcataatttattagacatcccatttattagaactctaagttcttttgcttttatataaatgaaacatttattctataaatagaaatgtatttttcagaattttctttgggttggtttcttggtagcatctcccagtaatacatgaataacatactgaaaccatgatacaatgtttaggtagatatacatatacatatgtggtcatgtgtttttaaaaaacaagtaatggtaattttaaacaaaaccatgtaaaatatctaagtggaaatattttttcccaactctatagctagatttaaaagtcccagtaaaattttgtaaacaaaatcatataagaaaaggcaaggctggctcttccctatggtcctttagtggagctatatttgcatagatcctagacaaatgatgcaaaacaaattccctccaatttccactagcaatctccctaattcgctcaacccttacataagcatcagatttagatttttagagttttgcccaccaactcaaatcggttcccttcttcttccatgtttctgatttgatatattttcctgacttttttcccctcctaccaagccttcctagtctctcccagcctcaggagcttgctcagccagaaaggaacaaaggctgcttccatttcacaaggcagaagtccagctgacaagtggagtgcgtgagccagctggttctgagcccagaagtcccgacaggctttccatttgtttccaatggctttattccacatgactttagtaaaccgtactcaatcaatttctgaccttggtactttgaagcaacacttgtatacagatattaagggaagagggaagttaagggaggaaaatcgaaggtcaaactgtgtgtcaaacaaggtgctgggtcctaattttatttttagttgcctcttgaatcgctcaagcccatcttgccttttttgttttttaaacaagaggtttctgcactagcttccatcttccagactcgtgctgtctaatccagtagccaccagccacatgtggctactgagcacttaaaaatgtgactagtctgaatggagatgtgcggtaagtgtaaaatacactctggattttgaagattcagtaccaaaaaataatataaaatatctcattaaaattttatgttgattacaggttgaaatattttggatgcatattaacttcacttgtttaaaatatattagaaatgtaaaaattgtatatggggctcacattatatttctattggacagctctgtcctagagccaagctcggactgccaaagattggacatcctgtgactgcaagtttccagtgagcccttactcagcagcttgcttaggtggtctgtggttcatagaaacagagaggaggccaagcatgcgaaaaaggaacgggagaaaacagctctcagggactttaataattacagtctgtaacaaataagcagtgaatgtttgaatttggttggtggaaagctgggatgcaagtcatctctgcctattacgacaaaagcctatcgaccccagcagccagcacaggcaggctgcagctgaagcaagcaatagcctggagaataaacacaatatgaaaagctaggtgcatttcttaccgattcccacccacacacgcatattcccactccccctcccacctttcctcctgcccatacatgaggcacaagggaagaagcagggaggagggtatgcagttcttagatagcaacagaagcagctcttgagcttgggtagagaagagcaggcaaagatcacctcgggatgggagggagtggtggagcacccctttctcttcggttggatccaccttggtgaaaaaacagacaaaatataattttggttagaaagctgatgttctcatcgtggaaactcggggatggttgcacgggtacccactacctcatccctatgaccagggctgtcagctaactggcgtatgttgtggatgagaagtgagaggtgaaaacaagcaagtaatgttctgaataaacatcatggtgggtgatccatcactggctcccaagtacttgcacaaagttaaaaaaaatcattttcttcttatcacagtgtgtgcttattatagatttagaaaatatggatgagtaaaaacaaagaactcacccattcctccagcacccagagataaccaattatgtgtatattttttacttagaaacagttccccgttttcttccagaaataagatcatatagtcagtttgaacatctttcgaaggcattactctttgcaaagattattaatgacagtctgcattccaaaatatgactacactacagtctacctagtcaattcccttttgttgggcatttaggtatcttctaattaaaaattagaaagcttttctgacagtagccattctaatgggtgtaaagttgtatctcactatagttttatttgcagtttcataaaagttagtgatgttgaacaccttttcaagtactctgtcgatgtgttcttttaaaagttattcacggcccagttgcagtggctcacgcctgtaaccccagcactttgagaggttgaggagggatgatggcttgagctcaggagtttgagaccagtctgggcaacatagcaaaaccctgtctccacaaaaattagccgggcatgttggtgtgcgcctgtcccatagtcccagctacctgggaggctgtggtgggaggatcacctgaacctgagaggtcgaggctgcaatgagccaagattgcgccactgcactccagcctgggtgacagagtgagaccctgtctcaaaaacaaaataaaaaccaaaaccaagctattcatgggctatcagtccactgtaactaggcttaaaacccattcacataaaaaaaattcatttactacacaaacatttgttgaggatttaacaggtgtttggcatgaggtcaggtgctcagatgttgtgaacaggtctaactggggcatgtgtcaatcaggtaggtctgctctaaccactgctctgagactcagtgggctggaactggcagattcctcaagtaggcatcttgatagggaccctactggtccacttagggatttctgagaaagaaccaaatttctgagcaaggaagggagttaggagaaaacactgaaagaagcacctcttcctctcaccatcccaaccaaatattttcttgggcaggcatctgagaaaagactcatctggatgtaaaccagacacctatcatggggccttgaccatcaactgacccgccacaagtggttagtagaatgagggctggccttgtccaaagctgtaattagagggcactccaagtgcattcggtactgctcagggctgtctgggtgcgctctcaggctgtgggcttggaggctgaggctgctgcagagcagaggaaaacttggtactcgacggtgccttatttatttttgttagatgatccattatcattataaaatattaaacatgcctaatgctggaaatatttaaggcaaatctacaaaaaaattttggtagactgtggaaattaattcaccaatttaaaaactacttttaggcgaggcatggtagctcatgcctataatccagtgctttgggaggttaaggcaggggactacttgaggccagaagctcaagaccagcctgggtgacatagagatatcctgtctctataagaaaatttttaaaaagaaatacttgaaaatgccctttatgtttcaggctctgtgcccctcaaggaaggtgcaatagtgagcaggacacagttctagtccttacattgcctactcaagtcttaaaggaggatgggagaagatatatgcttagctattccattaaagatctagagggtacagggaagatggtctattaccaatttaaaaatagaaataatatttagaataagaagcaaataataagttaggaaaaatatttggagtctatatgaacaactccttaaagtcaattcatttattggtgcccaagaaggaagaagggctgtactcttatcaaacagaagcccttcttctggtgcacacacacacacacacacacacacacacacacacaccattcaaagatatctgtcccatgtgaaaacttacttttcactaacactttttttttttttttgagatggagtttcgctctcgttgcccaggctcaagtgcaatggcgacttctgctcaccgcaacctccacctcctgagttcaagcaattctcctgcctcagcctcctgagtagctgggattacacgcatgcgcccctatgcccggctaattttgtatttttagtagagacaggttttctccatgttggtcaggctagtctcgaactcctgacctcaggtgatctgcccacctcagcctcccaaagtgctgggattacaggcgtgagccaccgtgcctggccttcactaaaaatttcaatcatcaactcttgtataataattttattatagctatacttcttcattaggtattgtctatgaatgcagtcttccacagaaacaaatcttttcaggaattaaagttttccttttaagcagtagtattctgttttcttctagcatttgtccatggaaattttcctatattttctaactctttaaatttttctacagaggcacaaagcacagtttgactcaattaatttaattccatttaacccaatagaaattcaacccaacagaaacatctggtgttgtcctgcgctgtgacacacagcacagccatgttcctgtctcctcctctgacctgggactgccatctgtcacttctctcccatgtcagtgattttgcttctcaccagtcttaactttagctgttattaatctcctataaggtttggaaccaaccaaccaaaaattactttaaactgtgttaggaaagaatcagtaggctttgagtacatgtaaggtgctctgttagggagtggggccatcgctaggggtgttgtgacatatttgacttgtttgcttaagttttctctatttctggtttgggaatttggctctgaggctaaggctgccacgaacctcagcctcatggatgacatatgcatatttcatgctaattctttcttcgttgtatacatttttttttatttttattttttttgagatgaagtctcgctctgtcgcccaggctggagtgcaatggcgcaatctcagctcagtgcaacctctgcatcccgggttctagtgattctcctgcctcagcctcctgagtagctgggattacaggcacacaccaccatgcccagctaatttttgtatttttatatttttagtagagatggggtttcaccatgttggtcaggctggtctcgaactcctgacctcgtgatccgcccacctcagcctcccaaagtgctgggattacaggcgtgagccaccatgcccagctattgtgtttttttaaaagtaaatttcagaggctttccagcaaaaccctggaaagcctgctagacaaattctcaaagagctgtaacacttcctatacatttactgttataaaattccagtttgtctatttttcctttcttgttgacattcttcttcaatggaggaaaagcaatttagttctttatggtagcattacctacattagcagaacaacagaaataatttaaatgtccatggtaatggtaaattactatatgctgaaataaaaaccatgtgataacatgggcactatttactaagcaatgttatgtaaaccccgccaaaaaactgtacatcgtcattataactacataaaaaaacagaattatatggataaaaaattggatgagaatctggtaaaatgaaaatatctattatgtggagagattatggatatatttacattttcatgtaatgctctgtaaagctatgattacaatacgtttaaaagatcaaggcagttaaagggagtttttgttataattaatcagacattatgccaatttcaaaactagaaggaatagaagatggctctacttgtgctgtctcaggaagatgaaaacagaggaagacgtccaaagaagtaaaataataaaatttaatactagcaaaccacggtattttgagcttgtaatgacacattaaaataactgtttctcatatgcattctgggcatctgcaatttcctcactgcctgtggaaggggaatttactagaatgtagatggctccaaagggttctctaccccactccaggcaagaagcctggactttctatatagcccgagtgtcactcaggctactcaagcgtgaatcttcaaaaaccttggcagaaatactcactccggctttcgtttcttgccagtttgctgggataacttttggtcgtttgtacatatggctctggaggtggcaaatcggaaatcggatggaagtagaatctgctttcccactcatctgggaagagaaacaagcagtatcttcagtgacagacaatgtgctatgaagacttacgtaacgaaaggcacagaatgaaagagagagagaaccacagacatcagtgctagtttttatgcctagaagtttacagaaaagctggaagtgctacaaaggtcacgaattagtacactgacatatatacaggcctgcaaatcaaagcaaagtggttttagtgagagtgattaggatccagccagtccctcttaggagctgggggctaaggtatgggacacctttttccccattgataacaatggcagagataggcaacttagtatctgcaggccgtcaggcctcttacctacagtgaactgtttagaaatgtacataataagaagctataaaaagattcttttcagaatcctggaatctctggaaagttaactaaaatgagacccaaacaaagaacagatcagggaaaaatgatccgcctttttgggaagtggggaagggggattactatttttaatttgaaatcatggtgggccttagaatggttagatagttagatcagtgcaatggagtgtgataatgatggaacaagaaattaaacgcaaacaagcaaaccacatatacaaacagatttaccatttagttgctgccctatagcccagggagctgggaccacacctcaccttcacatggagagtcttggaagccatttctaatagatgttgatggtggaggtgggggaggtgccccagcactgggcctatcaggaggaaggggaggcctgggtccactcctgggactgtctactccactcctggatggcaactgaggggtagcaggcagggcccgagatgtgctgccgtttctgcttactggaggaggtggtgggagggggcctggagcaaaaaaagacacttagtgcagaaccttacatccacattccattaccgtggtcaccattggtgtacagctgatgaggacttgctggacacatgccctttaattagggtgattttctaggatatttggctgagaaatgagtaaacacacagaaacacaaaaattgcacatgtgtacacatgtatatgcaaaacaagtgcatactgatagctaaatgggtgttttggctttgaattagcactcagattggagatggcacagtgaaattgaaaacaggtgaaaatctgtttacacggacaaccgtatatttaaaaaaacattttataatcctttaaagagctattgaactaattactgtgacatgatgaaagaatttttttaaaaagaataagatagttatgaaattattttaggtcttcagaagaacaaagttctttaaatgcatagttttgttgttaattacagaagcatgtttctgtgatgtatatgatctgtttccaggcagaagtggcatcaggaaaccaaataccagtcatcctgagagcagtaagagtttcttcttggttcttcctctttggggaggcagataaacacagggagtgacaaacagctaatcaacatccatggctataaatgctaatgtgaatcttgaccctgagcaagctggtaccctatggaacttggtttcctagctgtaaaagagtgccagatggtcacctgtctcacagcactgctgccaggaaaaactagtgaaaatgcaaataaaaaatactatgtaagtacttgaaaccattttttaaaaaaatgtagcagtatggtataaccataagtttttaagtttctaagaaaaattcaaggaaatttttttgataatacaaaagaaaaccatcttgcttttcctatcctccaaatgcaggggctatttgagtagtaagtaaattaaaaaaaacaaaaccaaaaacttgagcattttccaatgtaaatcaaaatggccttagtaattatgcctgctcttcagcagtgtgttccgcttgtaagatgctgacattttatgtgaatacaatgtcttaaggtgctataaataaatatcttattagctatagattcagaatccaattaggaaccttaaactgaacaacctgcccactgcagatatccctgacagaaagtcttggctccaacattttacagaggtgggaggcactgcccagccctgattggtctctcaaggagtcttcagtgcctcacctgggagtggttatttattaccctatctgcttgtcattgctggagtcccaggcagcaagagttgatttactgaggaaaagtgtctcatttgctgtggttttaacttcattggtgataccaccacacaactgtcactacatgcaaactcaacttccaatattatggggccctgtactacgtaacttcatctcattttctttttaaagtaaatggtcatgttcatgttcctaactctccaaccttgtggcaccctgctccaaatcctggcaggcacaatagaaaagaaaacagatttctatttcccactggcagaataacagaaatgatcatttattgaatataactatatgccaggaaataagataaccactatacatgcttgtctcatttaattcttataacaactctgagaggtacagggataggagacaaggcctcagaggttttggaagcttgaaaagctcatcagaagactgagtggaggagccaggatctgactccaaatctattagattccaaggcccactccccataacactgaagccaaacaactcagaatacacagggcctttgatgaactctcatacgctccttgtgggaatgtaaattggtaggaaattcctggaaggcaatttggcagtacctattgaaatccatagtttactatgcacactcactgacccagatattccacttataggaattaatccaaaggaaatacagagatgtgtacacatattttgctacaaaaatatatcactgcattatctgcaacaggaaaaatctagagatggcccatatgaccaagtgaggggattggttaaataaatcaaggtacatttgtaggatttaatattaggtagctgttacaagtcaggctgtagaataatcatatcagcaaacattaatgagatactgttaaataaaaagcaaattagcaaacaatatatgtagtgggataccaagtttgtaaaaacatgcattttaaaaagactgaaaggacacattaaaagaatgttatcaatgattatttctggatagtggtggtagaaggattaattttaattttctttatatttttcagtatttctataataaacaagtatgacttacgtaatcaaaagaaataataaatgttatatgtcaatgcctgtcatattttggggaagatttaatctgctgactcatccatttggtagggccatggcacaatggtttcaaggtgtggttctcacattctgctgcacactataatcaccagggagcttttaaatatcctgattcccagtctgcaccccagaccaattatgccagagactccgggaagggacccaggcattggtggtttttaaagctccgcagatgattccagtacgtgagcaagtttaaagaatggtgattatgaggttcctgaggtcacagggtcaaaggtctcttatctctgcgtaaaggaaaaaaatgccccatttccagacataataaggtctgtacgatgagattcaattttaaaagtgggtggttctactgagttcatccataaccactataaaacgcatcaagtgagcatattctactaaaaatgcctattataattcggagagggcaaactctaggcaatcctcacatttcctttcatactctgaaagtttgtccctcagatcaaggtttctcaactgtggatgggggcattggaagggtctcagatgggcttcagcaggctcttcaagccatgtgacagcaggcaaattttgagtttatgcctgagtatttttgtaaagatagtctatacctttatttgattctccaagggatttatgtaccagagattacaaagagcaaaatggactttttaaacattagtctttaatgaatagggaaatggcctcaaagcctggcgaatgaagagagaagtacaggagaagttcattagctcttgaagaacttcccctcttgttggaataacagagccctcctgcgggaggtggggacttattttcccaattaagaccgccgaaattctctctagggaggcagggtagtggactggcaagtacacttcagagatggaagatgaaagttcttgcctcttctttattaactagctcgtgaccatttaactttattagctactcagtgtcctcatctctaaaacaccaacagaaatattggtcccactttcccccggggtttacacgaggtcacgatcacacgtgtcgtgtgccacttaaaagcacaaagcagtctgagtttacttatgcctgcttttgttagactatcttgactgacaggattattggtacatttgggcaggctgggttttggaagcaactcactccacgtcttgtcatacctgatcggcctggcgggtccctcactggaggtgggggtctctcactgggcgggggaggaagaggacctgaacgtcctggcgaaggtaacgggggcgtggacgaactgagggacagattccgctgtgggagtcttggggtttcgtcattgccgctggaacttggaggcagaggaggcggcccgggcctgctgggaggtggcggcggaggtggggcctgtgaggaggccgaaggccgcggagtggaaggcactggaggcttgttgttctgaggaggaggagggggaaccgcttccctgtggatggagggcctgttgcccactggaggaggtggtggagggggtttgtcatccaaggccctgctgggggtaggcggcaggggaggccggttggagaagggcgaggaggagctcaagggggactgacgtattgagcctcctcccaaagcagtgccgcggtttccagggaaagggggaggagtgggcccggggctgggctgcctggggcctccgggcactggtggggacccccggttgtgcggacttgattgaatgggtcttggagtactaggtactggaggaggaatgctatcaggctttgagcccacgtcgggccttgggggcggcattcggttcctctgaggctctgggggaccacttctgtggcctggagaaggcacaggaaacctccctgggccacttgggggtgaaaagggtttcgcagatgtggatcttcctcccggtggcaacaatggtggtcggcttcctccagaatctgaagaacaggaaaacaaacatcagttaggaaatcaggaaccctgaagaaatcagagagctagagtctgttcccagtgactggaagtcccttcctcagagggctataaaatacaggaaactattatttatataaattgggttttgttggtccttcttgggagcagaaaatcgaccatagctctatttacctgcgagtcccaacttctacagcctatgagctttcaaaaggattctgcaaatatctcttagcattatgtataggcaagagccaggatgaagtgggcgagagttctggtgagatgcctattcattatgagaggacaagaacaagatggcattggtagaatcatgattttcatttttcctcatcaccatctctgtctcccagcccttgtacctctcagttttgaaactaagtcagctgtcttaggtgaaaaaattaattatcccaatgtaaatctccaaatgtgagggcttatctagtccctatgaagagaaatgccccaaaaaaagtggaaaactgtaaggggaaattataagaaaagagttatgactgcaataagaaaaaactaagaaaggaaaaagaaccatcagtaaagtttaattgtaagagttgacaccagtggatggaattcatctacaaagaagcaggcaactacacaacttttttttggtaccacgtcaacctctgcttcagtattggcaggacagaataatcccataactgctctggttcaacaagggagaaactaaagggggaaccaaagagatggaaaatttcaaaccaccatcccagaatctcttggaactcaaggtaattctgaaaaaaaaaaaaaaaatctacccatttatgagttaataagtgtaccaaataattttgagcacttgctatgcgcctgccattaatctagagactagagacagaggagtaaacagaatagaaaagattctgcattcctgtagtttacattcttgtggggggagataaacaataaaccaggaaataaatactttcagataattatatgtactaaaaagacactaaaataggccgatgagatcaagagtgcttggagaggccagggtacatggagtggctggggacagctcttctgagaatgtgacatgtgagctgaggcctgacaagaaggagtcagccacggaaagatgaggaagaccagcactttgggcagggttggccagcaggtgcagaggccctgaggtgggaaagagcttcaagttcaaaaacgggcccatgtgcccggggcacagtgagaatgggagagatccatgggaagtggagcctgagtggccagcaggggttagtcacaaggagccctgcaggacagaaggggttccgattttatctaaggcacaggaagaagcatttggacagatgtatacagtggagtatcatgaacttaagagagaactttcttcttctttttttttttttttttgagacagtgcctcctctgttgcccaggctggagtgcagtggtgcaatcacggctcattgcagcttcaacttcctgggctcaggcaatcctcccacctccgcctcctgggtagctgcgactacaggcaagagccaccatgcccactaactttttgtttttttttagtagagacaggattttgccatgttgcccaggctgttcttgaatttttgggcttcagccatctgcctgccttgacctgtgaaagtgctggaattataggtgtgagccaccatgcctggcccattttattattttatttttctttgtcttttgccttaatttcttcacctgttgttaaagtactaaatgtatacatttatcagctgccttaaatccttttggtgagttttaaataaatttaaattcaaatttaaatggtggtctggcaagatagaacctctcatgtgactgagtttctctctagatttggaccattcagtgataaaatagtaggctaaccctgaggattcagtgattccatattcatgtaaatgtgagagtttcattctttcccaggggacatcttataaaaggtctaaaaatgaaaattattataacatgatcaacattacaaaagcagttttatggtaaaatttcttgagtttctgtagtagctgggagagagcctcatgccctctgcaaagttttttatctaggcattcatgagcaagttcagtttttttctaccatcaggttcatagacaatcctgaaggactcatgtccatggctccctgcagagactcctgagaaccactggcactgaaataccaaatatctgtcatgcaaaacactttttcagatttagtgagatttgtaatcatattccacaagatgtgctccatcgtgtttgaaaagcggctcacaagtatttactctactagacagctgggctacctcacaaagaaagctgaatctgtcaggtcaccaggcagatttccagggccagcaagttctatttgctcctcccttttcttcccactccagctaaccctttagaaaagtaaaaaaaaaaaaatgtacaggttacccccaaagacactgggtgaaaatttcatagttctgtgtagctgtctgatcctggttaataataataataaagcctaaattgagtctcttataaaacagtggtaatatttaaaacaatgtacaatattttaataagggcgaagagccttagaggctatgaccagcctccaaactgccaaactctgccttgtcttcagtcactcagagacagggaaactctccttaccattatccctgttggccgtggatctcagcttcggcattccagcctggaacaatcctcccagacctggaggtccgccccctccaaaacttccaccgcctccgccaccacctcctccgccaaatccgccgcctccaccaaagccaccaccaccgcctccagcaccagctcctttaggttctgtagaagaagagacacccgacagactatgccccctggtctggcccaggtaaaccataaaacaacagtacaacagggagctggccggctctcggcctccagtggacaactgggatttcttcattaaaatgcaggattttaagagttccctcagctcagtcagaactgcccgctccaggcagtcccaagcccagtggtggaagaaacgaaaataaaggatgatttgtccccacactccccacttgactggctgccacatgggtcagtatctgtttgttccgtatcctaagatttggcaaatagaaggatcttcaggctgggtgcagtggctcacacatgtaatctcagcactttgggaggctgaggtgggaggatcgcttgagccagggaggtcaagactgcagggagccaagactgtgccactgcactccagcctgggtgacagtgagaccctgtctcagtaaaaaggatcttcaaagaaagagggtcgcaagggaggaggagatgccataaaaggcgagaagaaaggaaagagttaaaaagaaaagaaaataaaatatctcataatttcacaaatatacaaatatccaggctaggcacagtggctcacacctataataccagcactttgggaggctgagactggaggatagcttaggccccagaagtttgagaccaccctgggcaacaaagtgagacctcgtctctacgaaaataaacaacaacaacaaaatgtagccaggcatggtggtgcacacctgtagtcccagctacttaagaggctgagtgagaggatcacttgaacccactgaggctgcagtgagctatgattgcaccactgcactccagcaaaaaaaaaaaaaaaaaaacactaagcaaatatccacaattgagttatactttttcccatcagtatttttcattttatgtgttttttcttaaaattaagaacaaattcactaagcagtattaagcctgcttttttcatttaacactttgttagcacttcttgtgtcatactctttgaaaacatgagtttaaaggattctattgtattgtagaacatgaatgtattacattaaaatttatttaactactcatttgatggccctttagattgctattaattttttaatatcatgaagcccaatagtaggctttagtaatttaaacattctttgcaatttgagagggtataaagatcttgttttattttgaatttatctgcaaaaaattgtgaaagattttgatgggaggcaaacaaacaaacaaacaaaaagattactgagtattctgtctagtcttctgggttactttccattgtctttgagccacagtatcttatcactctgaaaggcatagaaaactgatactaatgcaatggtatttgtccaaagaagtgcaaattagttgtgtttaagccatgcttataccctctttaaaaaaattatctcttaatttatgtatgtatgcatgtttgtatttatgagcttaaacattatttaaagtcctcttcccaaaaaactatgttgagtttttgataaatagtatatgaaatctacaaattaatctgggagaactgatacttttatgatatttagactttccatttggagatgtggtatattttcccatttatttatgtcttctggattttttggcaaagttttttagtttttatgatatacattacacatgctttttgttagggttacttcaaatgtatttttgtttgctgaaattgtgaaagggatgtttttcctgttatattttgtaattggttatttttggcaccaggaaattgtatttaatatctaataagccactttgctatgttttctaaataaaatttactaaaaatgtattatcttgcattttctagtatgcacatggtcttcaaataatgacagtttaaagcctcctcttctctaagagttgtatgtcttatttctgttttatataagtaattactttgatgggtaaatttccataacaatgtaaattattaacgtttctaaaggcaatcatgttctgatattaatgagaatccctctgatatttcaaagttaatatgaattattggtttgaaataggttttttccctttctaaatattcagtctgtggatccttctattttaggtttacaagaatttattatagcatgaaattttatcaaatgcctattcaagatctactgaggctttttgatggtcttttttatttgatatgatggatagactttctaacattaaaaatgggataggccaggtgcaacggctcacacctgtaatcccaacactttgggaggccaaggcgggtggattgcttgagctcaggagttcaggaccagtctgagcaatatggtgagattcccatctctacaaaaaatgagccaaatgtggtggtgcatgcctgtagtcccagctagttgggaggctgaggtgggaggatcccttgagcttgggaggtcaaggatgcagtgagctgtgttcataccattactccagcctgggtgacaagacaagaccctgtctccaaaaaaaaaaaagggggataaaccctggtgttggtgaattattcttgtaacatctgattgatttagatttgttttttggtattttagtgttctcttatctatgatgataagtggtccataatagggtttcttaattataaacattttgggacagataattcttttttgtgggtggctgtcctgtcctgttctttacagaatgtttacagcatccctggcctctacccactagatgtcagtagcagccctccctgtcccccaaagtagtgactaaaaatgtcttcagacattgccacatatcccctggaatgcaaaaatcaccctcagttgaaaaccactaatgtacagctttctttttttatgtgctgcctttgtcaagttttgacattaggatcatgccaatttcattacaattattagacagccttccatctcttaatatattggggaatgacttatacagcatttgaattagctgtttcttaaaatttgaaagaatttgctaataaaataatctggctccaaaactttttggagagaaagtaatttaataaagtttttatcttttcccttgctcattgaggtttcctgaataaatatatgcttttcttagaaaagtactttctttaatatcttaaaacattttagcagataactttattacactactttaattttagaaaatatgctttgaatctcttattttatctgctttctgagttccacttttattcatttttatttccattttctggattaggtttatcataaatttgtgttagttctgtatcttttctagatgtggagctttctgagatgcttatggtagctctgctgtggaagaaataatctgataataactgacaagaattacttcacctaacaggataaatcatataagactaacaatttctagaagtgtatgcaaaattgtttccatataaaatttaaaaattttgctattaacatcgcccttgtcattcaaacactattcattgatgaatgacacattttggaatactgcacttcacaggacacgtttacatggtactgaaactttagagggactcctgcactatcagacatcacccattactgttcttttttttgtttttttgagatggagtttcacgcttgttgcccaggctggagtacaatggcacgatcttggctcactgcaacctctgcctcctgggttcaagcgattctcctgcctcagccttccaaatagctgggattacaggcatgcgccaccacacccggctaattttgtatttttaatagagatggggtttctccatgcctcaggtgatcccagcctcaggtgatcgacttgcctcagcctcccaaagtgctgggattacaggtgtgagccactgtgcctggcccattagtgttcttaacctgcaacatctgtccatctttcagaaagagaagctaaagctgaggattaagctttcagattattttttcagtaattaaactgtaggacagggctgagttatcacacataaccatggtcaacattttgacatacagcccagggaagtttcacatgcaaacagatacaaaactgtggataaacactgctgcttgcaaagagcttgtgacagcagtataggtgtccagttgagtgtgtggacaagggcctgcactggactgtatcttccttccatcaaggaaagcacattattaaacatcatggaagagagaaggactaacactatttccattaaataagagaagtggacattgaagaatacaattcttcaaggtttccactagtggattcaggaataggtctagactgtccagcctccttcaacagagccctaggctccctcttgcagtgaggagaaccacaggcctctgtcctagaggtcagctcctctggcctcataccagggaccatgattcagatggctattggagggcttggagggctgagggattagagggaatatattataaccacattcgttttgtgggcattttgacttacaagtcagactgtgtcaagagttaaataccttagttccttttttttttttgagacagagtcttgctctgttgcccaggctggagtgcagtggcacaatctcagctcaccgtaacttccacctccttggttcaagtgattcttgtgcctcagcctcccgagtagctgggactacaggcatgtgccaccacacctggctaatttttgtatttttagtagagatggggttttacaatgttgtcaaggctggtcttgaactcctggcctcaagtgatccacccgcctcagcctctaaaagtgctggaattacaggtgcgagccactgcgcccggccatagttcctttttgaaagcagtgcattctcactcgcagcactttgcccggtaacagaacaacattcaaaggccttatctaggtctttcacttttcctttttcctcccaaaccagtagtccacctaactctgatccttcttcttccttctctactcattaggtatttctcccagaaagttccctgaagcacttctaatcctttactttgcaaagattctgcctcattattcacttgttgacaaagatccatctggtgattttggaaggtcagtctatttcctgttccgtccaaatgggatctgtagtctaggatgaatcttggggacatctggcaggcaaaggaagggtctaggaatgtgaggagacaggcttaagatctacttattaattgccagtagaattctagtcatggattattttttgtcctgttgtaaatgttaataagtagctttgttccagaaagtacctcagacttaggtgggttgataactgaagttgtgacctcattttctttctctctaagctcctaataattgtatcttacacttgaattacactttccagacaacaaaacattttacaggcattatctcatttgaagctcatgacaaacttgtgaggtcaatagaacatgtattatcatctccattttaaaatgaagaaaacaaggcttggagatggtacaggatggatgtgccaggtcttgaacccacagcttttgattccaaggctagggctctttccatattttatgctgcctcctcatctgtggtgccaggagcaatgggttaatctccagaaagtgttgtgaataatgcagagaattgctgctgtgtatgtcttggacaaagaattattatactggcttcttgcagcattagaggggaacccaagccaaagctgcggcctacagggagtgatacagtcccttattttgctagctttgcagctgttgttaaccaaaaaataaaataaaataaaaattgagtggtgagggtagggttgattattaggccataaactgttcctctccatggtagatagcctttttttacttactgtccagtattggtgcacttctgtcattggtgaccgtcttctttagtttcttccctttgctgatatcagaaaggagagcatttctcccagcctgctctgtcttattcaaggtaggcttctctgtattggcctgaaagggagccatacaaacaagtagtcatctcttgggttaaaatcatgcattgtaacactcggctgggaaaggttgggtacgggaagcttgttgttaaggttcttggtgataggttgtaaattctcgacaagttttagaccccatatctttctttttaagatccagacgtttggaagcagatgcagcaataaattatgttcatttttaagggaggaagagtcagtccttgattaaagtctctgaaaattcagaccacaatctgactgaaactaacagggccaggttagggtgagatgactagacacgagaaaagaattttaagtctgggaggattctgcaggacattaccagacgtcattcactagagggtaccctgaagaataacttccttttcccatcttttagaactaccccagtgcaagggaaaaactgtctctagcaaaaagagtcagctgtatgttttttaaacccactaaagttctagaaaataattccctctgtgtatattgccaaagatgctttttttctctttttaagtcagatttattaaggtgtaatttacacatagtgaaatcaccctttttagttacagctctatgagttttgacaaacatatacagttgtgaaaccaccgtcacaatcaagatatagaatattttcattacttcaaaagttccctcatgtcctgttggcatgaggtgtttctgatgtttaattctgatgaaagcttagctcatggaaattgtggaatggacaaaaatgctgctttaacatgtctgattattttcttatatttccagaattcctaggaaagatccctacctactatgaaattgggatcttgttccttcagggagttggggacactaagagaccagcaaatggacttagatgtaggcacctgcctgtgtgcctgtgtctatcacacttggaaactggctaggtcttgtctgtctcagggagagtctggctgccccaaacccacaggtcctttctaggctggccccagcccttctgacagggatatgatttcagatttgccagttagggccacaggaggaaaagctggggaaatgtatggctcaataccttacccagcctttaaaaaacaatttttttttagagacagagtctcattatgttgcctaggctggagtgctgtggctattcacaggtgtgatcatcatgcaatacagcctcgaactcttgggctcaagtgatcctcctgcctcagcctcctgagtagttgggattacaggcacgagctactgctcctggcctaactcagccttttattagcagagttagaggcaaaggaagaactcagaaaaaccctgaagtaggctaaccagaattgcagtggtaaagttggaagcatcttgaaataactaaatgatgaagtattacttgcttatgataataatagttaacatatactctgtgccaggcactgttttcagcaccttatgtgtattacttcatttagcccttatcaaccctgtgagttattatttccattttacagacaaggaaactgaggtatagggagtttaaatcatttgccccaggcacctagttagttgaggaggagctgggattcaaaccctggcagtcaagagccttccctacaagctgatagaaggataaatgtgggctctaaaatgcccctccccatccagccccaacacaccgctgaagcatgcttgttaaaagtttctctgctgtccttccagaaatgctctctgcatacacagtttgcttttgctaatgggattctcctctattgttctgcaacttgtttgttttcaacttaacatactttggatgtcctggaaaagagctcttaacattacctgctgtcttcattttaaggatgaaaaaactctgaggcctagagaggttaagtgatgtgtcacactggatctcttaacagttttgggtcagcaaccttcagtagcctcctgttctgcctcaaaatttattttgacagctgacctccctgggtgctaacttctctcatgttcagggcccttaattatgttgtttcacaagggcagtgttctatgatggccaccaacccaccttttccctttcttcatctctatattctatttatccaaaatcttgctttgaattaggtaacaacggatagaaatgagttgataagataagcaaggtttcccaaacttcaagcattctggtataagattcatgatttttgtcatcttctcataccacctgtgttatttatttaatattttttattaagtcagttcactatagcccacacttttggggaaacatggataaatgaatcctgctatgtaagccagattggaggttctcaaacttacccatgtgaaggaccaactttttttttgttttttgtttttttgcgacagagtcttgctctatcacccaggctggagtgcagtagtgcaatcacagctcactgcagccttgacctcctgggctcaaacaatcctcccatctctgcctccagagtagctgggactataagcacgcaccgccatgtctggctggctaatttttaacattttttttgtagatatgggggtctcgccatgttgcccaggctggtctcgaactcctgggctcaagttatccttccaaagtgcacgcctggccaaggaccagtcttttgaaaaatattttcatcaggaactgacgcttttgtaaaataacaatgaattattagaaaaatgaattagttttttaaaaaagacacacaacatccaatcttagaaacagaaaactactgtcaaattgctagaaatgcttctaaatgcttactttcaacttttgtcctcatcactttggggactcttaaaaagcagttggaaggccacactctgagtaacaataagctaattaataggcagttcttctcactaggtttcaacctcagatgagttatataaatgtgtctcatggaaacctggggcaagaaactttctctccaagcctcagtttccccatgtgaaaatggtgaaaatgaaggaaccatcagtgtgaggctcctcctcagtgaaggcttcacaagctggagagggctttgtaacagagcgtatcttggggcctttccatatgaccaagtggagagttgccaaattcctgaagagggcacactaacttccccaaagaggtctatcaaaggagcaggatgagccgggcacagtggctcacgcctgtaatcccagcactttgggaggccgaggtgggtggatcaactgaggttaggagttcaagacaagcctggccaacatggtgaaaccccgtccatactaaaaatacaaaaattagctgggcatggtggtgcttgcctttagtcccagctacttgggaggctgaggcaggagaatcacttgaacgggaggtggaagttgcggtgagctgagatcgtgccattgcactccagcctgggtgacagagcgagactcaaaaaaaaaaaaaagaccaggatgaatccactgaagaaattctttcaggaaataaacatctaaatgcctaaatgcaagtatagatttaaaggaggatgtgaatgtgtatggcagaggtggtggagggagatatttgtcaaaaacagattgggaagaagaggggaaaaggcagaaaaaaagaaaggagtgagaccggaagacactttaatggaatgcactgcaggcagagacctgggtttctagaccgtccagcccagaagttaaaggccagacattgagttcatctgaatgaaaacagtgcacactggtctcagaactgatcctgcaaaccctatcttgggccagcacatgtccctgcgcagatgcggcagaaaacacctcatcagccacattccacccttgtactatccatcacacgagaccttaaacaaacaaaacccttcgtgttgtttgtatttgctgggtttcaggatttggcttaccctgggcactgggaaagcctgttgtatcacatgtgagccagaatgcaaacacatttaatacaaacacatgcacgccaggttttggcttcatttggcttgctttatgcatagaaagtgtttggggaggagacactcaccagtgcaaacgtcgggggcggcgggggtgctggagggggagggacaggcatcttgggcagttatgcgttcaacagtcttgctgataaatctggaaaaacaagaatgcgatcatgtattagatgtaatcttagtaatactgtcctaatctgtcttcactttcccaccaaagtgacagctccacctagctcaactcttagaagagatgggcttacctttacacctcactgctaaaacattactgttctggaaggatcccggcagaggggcttctgacccgaggtgcttggagagaatggaggccacatccagtgccttactcggctccattcccccacccactacagtaggccatgaccgacccaggtgggcccagttaagcaggaaggtctcacacaactgctaggatgtatcctggccaagtttcactgaaaacaaattcacttcaagtggcttctcctcttcgctaatttccatgacaatcctttcatgctctcccaccccctctggctttctcctcccattcttcctgacattcgccaagtctgtgtgtgcactgcaggaatatgaaaatgaatctacttctagtcccgccctcaaagttcctagtcctccagggagagggcatggagaatgtcaggtggaaagcagggagcagcagctgaggcggggtggacgtgtggggggtcaaccttatgtttggagcactcaaagaccagccatccctatctctgtgctccttagcatttcctcagaggatctaagcgaaaacagagcgggcatgagaagtcagacctaggactcccaggctgtttaccagaaatgcatttcatttagaagagcctgtcttagctttgtttgggtaaaaaattatatataaataaaataaaaaagaagagcctttctgcagagtgtgcttgctctgaaaacaaagggaagaccagattccgtagctgggtaggaaagtttagggaccccaggtgggtgagggggcagggcggagagggcagcctggcaaacaccagggccaggagagacgatggccaggaagtgcctggtgagttacaccagccaggagccctctccccatttcctctaatccttgcagtcctgttccttcgcctcactagaacccctgctccctctgccctgtctaggacaacgcctcacccactgttctcatccctaagcaatgccagcttctcccaccccatccttgctacacaaactgtggtcctggataggcagcgtgggcaccacccagaagctgttagaaatgtcaactcccagtcccttttgcccccagctgaattcgtttcagcattttaacaagatccctgggtgattcatacgcactaaagccctatgtagagatcgagccttaagccagcgggcagtctgggtcactggccacctgaataacattatttctacaggacatgtgtcccaaattttaaactgcagaattatatttctttaaaaaatttttttaaatttttttttggagatgaggtcttgctctgtcacacaggctggaatgcagtggcataatcatagcttactgttgcctcaaattcctgggcctaagcaatcctcctgcctcactcctgagtagcttagctaggactgcaggcatatgccaccacgcctggctaatttatttttatcttttatttttgttgtgatgggtcttgctatgttgcccaggctagttttgaactcctggcctcatgcgatcctcctgccttagcctcccatagtgctgggattacaggtgtgagccactgtgtcaggctttttaaactcccaatagtcccttaattgcaaaaaacaatttcttagaatttaaaatattcatttagttcaaccactacaagttaatgtggaaaactgaaacctaaacaaatactttctattgagataatgctaaatggcttgctttctgtgaacagaaatggactggagaagctaaaaaagacactgctggacttgtcacagccgccgggaaacaagaattaagacagttcggaagagtcccattcaaagtgggcggtctagaaaatgaaaattttaaattccacagcagcaacagcagctctcatgtatggagaatctgctggatccagggctctatccttgcgtggtctctgactcctaagacagcggaagccagcatcgctgtgctcatttgatagactcagagaaattaaatcactccctaaaacaccctgaagcaattcattcagtcatgtccttttgcttcctgctcttctgctggataacactgcctcactcactcactgcccttttaatggtctgataaacactttcaggcaggcgaattagtgccacagctcacctgttaactaggctggaatctgttttcagtaagagactgtctcaggcaaggattcttttaaagtctgtttcttaaattgctctttctggcatgacatcaattagtcacccatagggccacatgggcattgtgagcaggactgggtgcctgtgttagggggtcctccatcaaggggcatctccagcggcacattcagaggccttggagtcagacgtctcctaggaccagcaggaacgaaagggatctgattcaggcctgactactgcgaaagatgctggagccaaatcaatggtatgatcagagttgggaaaggcttaccaaggaagggggatagcctggtctgcccggtgggcccaagagatgggctgtgggaacagtgcatccacgtgcttggttgatgaaaaatccctcaagactattttgtctgactccacgttcaccgattaactttctgtcattctgtgatcctaatatctaggaaagggtggatattctggtcaactaacaggaacctcttatgggtatggttgtcatgagttcggctctcgtaacagagatcaaattgaacttctgtcctgcacagcttagggggcagactgtggaatggggaccctttcaggggctgccaccctgaaaggcctccttaattattttacaattctctgttgctgctgttttagtactgtctgtgcactaactgacttgtatattaacttctggatgacagctccagggagggcgtgttaacttcatggtccagagggctagtgtgggagaaatggcaacagtcatggctggggccagagccaaggccagattgcagaaattagcaggcaaaaacaaggttcagggagcaagatgctattaaagggtctgaggtattgaaagaagtgctgcctttccttcctggccacttcagatggacagtggggagagggtctacgggtgagggctctcactttttagagggtgatgcagaactaagtgctctttcctctcttcctctgcgaacttgtttgcatggcttgctttccctggccccatctctcactcccctccagattaactgtccctttccaatctcaatggtaacacagatgagggaggctgccatgtcctctctcctcccttctagctgaacaactgctgggcacggtctggacttctccaggctggggcctcaagggaagtgtgtgagaaaccccagactccaatactgccacctcactcagcccctggatcaaagaccaagctcgtgtgccccaacactgggcccaccggccacaccaggcccacttcttggctgtctttccaccagcctatggactccatggggtcttgccaatacctggcacaaagtagggttcttactaaatatatatgcagtgaaagaactgtgtatcacacaaacaagccgagtgcttgccacttgaagggctcccagcatcaccccaccgcactgtgagatctgggcaaaagaatcagccctatttcagaggggcttgctagtgttgcagactggaacttactttcctggcagcctccaacttccccagagaagtagagccccaaggccctgggagaggagggcttccctcctctcatggacttgacagcccacatcagagccacagccagatcttactgaaggccttggccctagagcacggatcctaacagaccaggcattcctgcctggatcctcacacccagagtctgtggatagaattcaagggttcatgaacttgtatgaaaaaaaagtacatattatttctactaagcactaactgaaatgtagcatttcctttgattatgaatgcaggccacaaaccataatatctgatattctttcacccatagttttcacgtgatatttcacatcatattacaactacacaccaacaattttcaacatgctggcaacgtttagatccattgctagatcttgttgtttaaaccattaataaagaagtacatattttaataaattagtttcctttgtaattctctgtattttattttatgcatttaaacgtagacacaaaagggtccctttgggactgggagtggtgacttatgcctataatcccaacactttgggtggtcaaggtgggaggactgcttgagcccaggagtttaagactagcttgggctacaaagtgagccctttatctctaaaaataaaataaaataaaataaaaacaaattaaaattaaattttttaaaaaaaggagtcctttgggctttaccagtgggtttatagaatgaaaaagggagaacatgagaccttggtcaggcaaatttggttctgaatccttgctctgccacctggcagattcagatgggaatttgtttttcccatctgttaaatgggaagttgctgagcagattaaatgaaatggtgtgtgcaaggctttcagcatggcctgggggagcaaagctgtcagtggacagggcttagctctgtccttcagagggtgaggatgggtcctgctggtacaagctgctgagtgcctggcagaggagggatggacctggaggctagtctgaggggccacagctttgctcagtggctgtgggtggatctgcctgggtgggaatgaggctgactgatgactgggcctcccagcatttggttcttcccttggagatgggagcatggcaggaaaggcagctgattcgggtgcaggagagacgcaagaagggaagggactcagcagcagtttcccagtgtggtcagtcatctcctgcatcagaatctgctgtgcctgtgtccggcttcccagactagttgggctctcagtagtgtcggatcacatgcctacccacttgctgggccttgccctcctaccccaccccaacccaagcaatgaacttttaagaagtcacacttttcagaattaatttctttttaagaataatttcaatgttaagtaactttcatgatagaaaagccagactttctaaaatctttacttggtgtgttgacttctacaaacacaaagaaaactcaagggacagaaaaggcttttgttttcacatacagtattacggtctgaactatgtcccctgcaaaagtgatatgctgaattcctgaccctcaggacctcagaaggcaactgtatttggagatagggtctttaaagaggtgattaagctaaaatgaggccattgggtgagatcttaatccaatttgactggtgtcctcatacaaagaggaagagacatcaggcatgtgctcacacagaggaaagtcttcaagtgaagacgcagtgagaaggtggcaaaccaaggaaagaggcttcagaacacaccaaacctgcccacatcttgatcttggacttccagcttccagagctgggagaaaacaaatttctgttatttgatctacccaggctgtggtattttattatggcagtcctagcaaattaatacacatggttttaacaacatacgtttgtctattatccattgtggaaacaataagataatggcctttgaataaactatccatcaactgatttctcagcaagatatttctggattgtcatacgttaaaaaatttaaaaatcagccagaaccctagagtatgtaagtgactgccaaaggtttatttaataagtgaatgaatcattcaaaaataatgaaattttaggtgaaaatagctgaagtaaggggagggatctagcaataaccctttcgtaaggaactggctttatgggttgagagaacagagtgaaataatttgcataaatgactttaaaaatttaattactgtttcttctttgttgcttacacacacacacacacacacacacacacacaccaccccaacatttagaaattctggacttcctagttcattctgtgaatgaaatggctggcatcgtttgtcttactagaatgctattaggtcaacatcatggtttaacacttacatttagacaacattcactgatcccagatcaactagggcatcttgcagcctcgactcacttgttaaacatgcaatgttcgctacaacgagcactgtgagagaaagagaactgctcagcccactcccaacagtacaggggacacattctcctcaatggcatggccaactagaggtcaaccatagctcacagttcagtccagacgtgccccaggaaactcagggtttcttcttcaatgtgctcatctaggaaagcagactcatccctgaatgtaaaatgattgccttccttgggatcaagaaagtggggtagttatttaaataagctgtttcttagtttcatagccaacttacaattaattctagattgcactgcctagggcccacactacagaatgacatgaggtggggagtgattcctaatagtccccagtgaacacagttgacaatcctccaaaggccggtctctaatcccaagtgggcaggggttctattagagaagataagaagcagctttatccaattacatttatcattaatttggactattcaaaaatataaagcattttgctctataaatgttgctaaaagtaacccttaaatactatcatacctaaaatgaatggtggaatattaaacttcttttccccaaaaagattgaatcaatagaggaatattttatttgctgggggtgggggagggtatcagaaataatataactggatagattcaaaaatccaactgctctcttgccctcattattttctatttttatttacatttatttattgattttttttttttttttttgagacagagtctggctctgttgcccaggctggagtgcagtggtacgatcttggctcactgcaacctccacctcctgggttcaaacaattctcctgcctcagcctcccgagtagctgggattacaggcgtgtgccatcacacttggctaatttttgtattcttggtagagatggggtttcaccatgttggccaggctggtcttgaactcctgacctcacgtgatccacccgcatcagcctcccaagatgctatgataataggcatgagccaccatgcctgaactcatttatattttactttatatataatgctcttaactcattttcatctatgtatttcttgagtgcttttggcatcttcaggttagttttttgtttgttgttgttttcttcaagatttcttttttttcttttatattgtagagaatacaaaaatatacaaagatgaaaaaaaaaagcactgaagttgtatttaaccactaaaggaagcactgaataataattaatttttatatgaaaaagggttgggggtaataaccagaggtaactctttgttattttgatacatgtccttccagcttataagtacatgtacatctctctctctctccctctctctctctgtgtcacacatacacatatacacacaattgtttgacaaaaaaatattaacagaacaaaatttataatacatgtaacacaaaagtgttttcctgagaaaaggtttttaaattcatattgagttattacaaccataaaaaataactgcaagggcattcattacaaagacagtgaatccactccaagtcaccctgcaaaaataaaatcatcgagcaaactcaaattgctgctaagacggtgaattttaaaaagcatgtcgttttgggattcctactcaattattcttgattctattctttagatactcctccatgatgcaaacttagctggatgtatttaagatctgaaaaccattagaactaattaagatgaatttggctttgttcttcaacttcctgtaaaaaatgctcaacaggaaaattgatgctcgcagtaaaccacagtcatcctgtttctttaacacaatcttttcacagctgcagttgcctggagtttctattttatgacgcgagtcactgcaacagctctaccatcccttccccccagcatgtggtctggccattttagaaactttcaatacctttgcagaaaggttcgtttctattattgctactcttcctctctccaagctgaaggtccttgctcagagcaataagccatggatacaagaggggaaacagaaaaggcagctggactccagaggaagcaaaaggcagagaagaggaaaacagctttattagcaaatcagcagcctcacccagttggttcttatgcattgttagtctccatttgagctgaatgtggagcacacgcttgccatacacagaatccctcatttctcaaaatgtactgctcttttctcagtcaatcatcattgaaaaacaatacttcagcaacgtctgattaggttgtcttcttaatggtaaatgtcaatttaagtctgctgaacctagaaatgcttcttttatagttcttttagataaggaggtgatttattttggcggggagtaggaaaggtgtttttcaaagaagacattttgaagcatctcgaacatcactaagactggctaggagcttggacacaattttactgcaagagtactgctagggaaataaaggttgctatgaagtaaaattattttttaatccactattgtgcacatttaattttaaaattaatacaaattcacagacatcgaagacccttttaatagtgagaaaatgaaggtgagctgaatgacacgcctacctgtcattatttaactgaaggaaagggaaaggaaacatttttattttatccatataattaaagagtagcaggttttctcccatacttcccatctctttaaggggttcaaatctccaagctaaaatctgcctaaatcgctatcaccacatttagttctaccagaggattaagatgtgccactgtttctctctctctctttctctctctctctctctcacacacacatacacacacagcatatatgtcagcacacttgatatatactgtattcattttatcattgaaagtacagctttatgatataagcagaagtgtcaccaagtttacctctgaagaagtgaaaagacttaaaaaggaaaatatcttacttgagattgttagttttaaagatatttactgttgctgtgacatttaaagcaaaacatttgtaatctcagattcccaaggccggaaaagcacctcaagaaatcatactggctgggtgtcgtagctcatgactataatcccagcactctgggaggccagggtgggaagatagcttgagcccaagagtttgagaccatcctgggcaaacatagtgggaccctcatctctacaaaaaaaaaaaaaaaaaaaaaatatatatatatatatatatatatatatataattaactgggcatggtggcacacatctgtagttccagctacttgggaggctgaggtgggaggactgcttgagtccaggagtttgagggtgcagtgagctgtgatcatgccattgcactccagtgtggatgacagagcaaaaccctgtctcaaaaaaaaaaaaaaaaaaaacagaaaagaaaaagaaaaacagaaatcatacaatttataatgttgcttccaagctgcacttgtgaaaaaaagctcttacaattcagataacttcctccacatttagttgttaggtggccttgggtaaattacttagcttatgtaagtccggttttcaaaataatagcacctacttagtagggttattcaagagttaaatgaaggagtgcttaataagtattagccattttcaaaaaataaaataagcaaaggtgaagaacgtaacacaaaataagtggtcagtaaatatcacagtctttccccctatttaaccacgagaaagagaaaccatgagctgatttaaatcagcctatgtgtgtacacccatgcaaacttccatattacaagtgaatggtgaagggagatgtgtataaagtgcatttcaaatttctcagaaaagcatactgattaaggcattccttattctagtatttttttacagttttaattttcaggacagacagaggtatttatggaagtccaggagaaatgctttcttcaacaacaagcacatgtttaacaatttggacaaaatgagtcaaaccttaaagcagaaatatatcataatttaaacagccagaaacttccaaagtaaatgatgtgtgttcataaaatgttaagaaggcttcaaaaggtcataacacttaaagggtccaggaattcagtatcacttcatctcatattttaggtaggctggggaacttccagcctacaggccagatttagaatttgatcagatctgaagttgctgctcgatcccaggaactaattttcaccacagggagttctctgaatatttcagtccacccagagtatgtgtaacccttaaaaggttagatattagagtagctgaagcgctatgagcaaatagcccatgaataaacttttcaaagagcaatagaaaacctgacttagtgaaaaatgactttcaggtaagtcatttaatgaccttagactgataaaaggaagagttttgacatgatgatattccagtacagaagaacaaagcttgataaagttaacacatagcactgtagtccaagtgaattgtaagagtatgatttccacacagatcaacctcaaaaccttttcccagtttctcatcttcctttctcactgtcctgtcctattctttccccagtctttcatctttctctctaccaagctgtcttactttgcttagttagaatctttcagtagccttttcatttaccacctctccattctctactacatatactagttatgccattaaattatttaaaataacttgtatgcctgtaatcccagcactttgggaggccgaggcgggcagatcacttgaggtcaggagtttgagaccagcctgaccaacatgatgaaaccctgtctctactaaaaatacaaaaacaaaaaaaacaaaaaacttgtacttagtgactaaagttatatgtgccttctgagttttttaaagctttattttatatttcttcacggggagaaaggaacataagtcaaattgtttcttcctacatattctagaaaaaagttttttaatgtaaaaagtttccttagttctgctctataagcctctgagtagatggcttgaaattttaaaaatcacaatattttatgccaaaacattaatcatattaaacataaagttataactaatgctgtagaatttgatttgcgatagtaattgtgcacacactgttataacaggaatagacttattctaaaagacaaatcgtattataaaagactctgcttagaaatggtttagtttgagttttgaacttaaatagcacattggcagcaacagaactgcaacagcttagttccatggtattttcgtttgaagcttccaatggctccttgtactttaaagcacttattgttgctggccacaccaaagattcaaaggcagttgtgtggacaactgtatcatacaccaaaaggatatatttaccgacataagcccccaatttaaatgggaaaataaattcctgtggatccaaacttgtccagtggtcaaaaaaattctattgaaaatcttgcttacattttggctcaaagcataagttatgaatcattcacaatcaccatagtggtgaaactagcattctgggcaacaggaatagctcacatggtgctctacagaaaaattaaacaactttatcttgacatactatggtccattaaaagccatttagttcttccctgtagctgataaatgaaataaacttagtttgaatataatttttcttaccgttaaagggtactgcagggagccatggtcagggacacaggcagacagagggccagcgggacaggagccaagagagaaaactgtccctgaaaaaggtatcatcttctaacgcaagtgtggggtcgtttttggacagccattttggacaagctctggcctcttgttaaatgtgacatactgagtcagaggcagacgtccttctgtggttattcgcttcctgtctgattaatttgttgtttgttgttccttcctcctttgctgcagaaaaagaaactagattggttttgcttaagaagcaagcaagaaaaaaaacctaaattaaaaaaaattaaatgtttctcctccccacaaggtgtaatacacagctatttggtacagtgacaagaggagatgagcacctccactcagtgaagagtccaactttattctagatattcccacaaaaataactgttcatggaacttgagattcctttaggaaaattatatttgaaagtatcactgtaaatactgactattccattgagtaatagggaaaagagtcactcaagaaagaaaagctcttacctaccttaccttatcgcttcattaggctaagggcttcttctcatttacagggcattcaagtgtgtggggagaaagttacaaatgcaggtaaagagagcaggtcaggtgtatgaaggcaaatgaggttctttttttggttttgttttatttatttctttttttttagagagacagtcttgctgtcacttaggctggagtgcagtggcgtaatcatagctccctgtggccctgacctcctgggttcgagcaatcctccagcctcagcctcctgagtagctgagactacaggcatatgccactgcacctggctaatttattttatttttatatttggtagagatgggatcttgctttgttgcccagcctggtcttgcactcctagcttcaaagtgatccttccatcttagcttcccagattgctgggattacaggcttgagctaccatacttggcagcaaatgagttttgaaacgtgattttggtgcccaagtcagggtaataatatacagcttaagtcagctgcagatccatagctttctatgccaaatgtttctgtcccccacacttaatgggataacagtaactctcctagaagatgcttgacaaaagcatagagataaagagggtggaaggaagaaagtcagatttctcattattaaagaactcaagaggtggatggcaatggaatacatgtagaaaacattttatcaaaaccttgagttatgtatagaacgatctgaaaatgctcataattttttcttaacccatcttaaaggttcagacttacatatgcaacacatagtatataactctgagaaaacagtaacagtcaaagaatttaaaagagaggcatatttcagaaactagcttcattgtaaaatctgaatgttgggtcctgattctgctaggatcagaggccagaggcatgaaaagaacgtatgttgtctaacattgccttacctgtaaagtgatggaactgggctagatgagtaattttcaactcaggtagctgttgggggtggtgagcagtgagtgggaatggtgggggcaggggcctgtagcattcagtgggtggggccaggaatgggaaatttcctatggtgcttatgacagtcccacccaaaataccagaagtgctcctactggggagtactgggacagatgatgtctaaggatcttttaaactcaaaattccctgagataggagtctaattgcatgagcagattcatgatgccaggccatgggcacagttcctggagtggagtacccaagaataagtgactgagagtcctctgctttgcctggagccccttgaaggcagggaccgcctcttgtctaactctggcctggtgtccacccgtgacttaggtcacaaataaatacctgcaggcatggggctggacagaggtggaggcctacagctatcagccacttcccgcgatacaaaccctcaggaaaacagaaaacttgatcaactattaagtaaatgcctgagtgaatctttggggaagtctaattatagttgggtctaaaaagagaacatgggcgatatgacaatttctctacgtattttcagaattattttgaagttctctaagtaagacaccccaaacacacacacacacactctctctctctctctctctagctatctctctctctctctctctctctcagtacacataccattcatggctatttccatcccttaggggagtggtccctaacctttttggcaccagggactggttttgtggaagataatttttccacggagtgggggcagggggtggggatggtttcaggatgaaactgctccaactcagatcatcaggcattagattctcataaggagctcgcatgcacagttcactttaggattcttgctcctctgagaatctaatgcgcagctgatctgataggaggcagagctcaggagggaacacttgctcaccagctgctcacttcctgctgtgtggcctggttcctaaggggccatagactggttggagacccctaccttaggaaaagctcacttagaagggagtatgtcacctagaaggctgcagtccccaagacatgcaagggagtagttgtgtagtttgagtctattcctacagtcaactttggacacatttatcaggtgtctactatgcatgttaggacataaattagataatgttcctcccctgcttaaaaccctccaatgacttctcatttcacttaaaaagtccaaactcttaggtccacagggacccacgagatctggcccctccttaactctctgccttcatctcaagtaatattctgccttgctaatttaccttccaaatctttctgttccttaaatgcaccaagctcatttgcatcttcaggccttttacttgcaagcctggtactcacgcctggtacactcatctttttgttcctttttattcttcaaatgtcagcaaaaatgctctccctcatgacccatttctgctgttttcttttatgcatagcatgcgtcaccgcttgacactgtcttatttatctgtttatttacttgtatgtttctctccactagaattcaagctctatgagagcagggaccttgtccatcttgtttctgctgttgcttcagcatctaatgcaggtgtttgactgctgttgcttcagcatctaatgcaggtgtttgaaaatagtgtttgttgaatggaaaagaaaatcaatgtttcttacgaattctactacagcataatgttccttttttttttttttttttttttttttttttgagacagagtcgtactctgtcacccaggctggagtgcagtggcatgaccttggttcattgcaatcttcacttcccaggttcaagcgattctcatgtcttggcctccctagctgggactacagtcgtgcaccaccacgcctggctaattttttttttgtatttttagtagagacggggtttcgccatgttggccaggctggtctccaactcctggcctcaagtgatctgtccacctcagcctcccaaagtgctgggattataggtgtgaaccaccacgctgcccagcataatgttcctttaaaagcttaagactgttccccctgaaatggtaaataacaaatgccaagactagacttaagccttcttgggagaagctgttaaagggaaattttccagagaaaaggtcagcaggtaaaacccttggcccatcagtgggcctggcagtgcaggcagagtcttatgcagtgcaggtggcttacaccattgggcaatgtgaagagaaaaatggattaagaaaattgaaaacaaatagaacaatcagaaaggaagggggggaaataaaaagataaagaaaataaggcaagaaaagctggagatggggagagatcatgtggtgggtagaggagagctacaaccacactgctgacctcagaggctttggaagccacctctgcagtggatgacccacaggtgctggatgtaacagtgctgtctggccttccgcagtgaagcggagttctcagctcagtgtcagcttttccagcagccacgttctttaaaaagaaaagaactttaaggctgcaggagacttgcagagatcaaagtctacatcaccacttacagaggaagaaacaggggtccagagaagttaggcatcctgctcatgtcacacagctggcagcagcagagcagtggccaaagcctgggctccactccactgtccagcgccattaatgtctttagcctcatttcaggttcgggtgataccacctacctcctttctgtaagtacaagaagaggcagaagaaagagggtggagagaaaggctgtgatgcggatgggagaggttgttatactataaccaaaggcctgagataagtggattgaaagcctggatgaataaagacaatcacaattctggacttaaagagaattttaaatgcgtatctctttcccatttaatatgcatcagtctgagcttaatgacagagtaaaacaataaccaataggctcgcagaccaatcacataaagaatcctccatattaatctatagaaataaaaaaccaagagcaggcagaagattataaaacaataatgtaggtctagccagtgtagaaaaagtgctgaagaatcacagcctcctgccgtggcccccagtcaacatggactgaatcagtgcaacagtggcatgtgtaaaatatggcaacataagttttaaataattctggtttttcaagttgtgtttccatgactacctgttatggtgcagtatttccccagtagtggaaaggtgttttataatactgcatcccgcagttctaaaacttacattattccttcttatactgcagaatgactccttatagatttttagggtgaaaaagaaacactaccagattaaagatatgcattagttgtaagaatctattttcaaaatgttaaaatatgggaattatttgatttaaaagagcagaaacaaaggaataatcctctccaccacataattatcagtacagctacatacagggttgatcatttaaaaataatctcagaaacatagataaattaaaaacaaaccttgtagtattctgcaccctgttaatataaattgatgtaatcttacttggggaaaagtctgcagtgtattctgttgtgttttggcagctcagcaaccattccccctacttataatcacgtccatttgtttgtatggagaatcatcccgtgctcactctcaaaccatgtgcatccagaggcattcactcccattccagacagaggaaaagcatgtgattcaaggctggctaatcagagccttgcattcatttggccctagagacttctggtgatggcttgtgatcatcagaatcaaggaaatttgtaggctgaggcgagctctatccctgagggatgaggctggaaccagatctgttgaggatgtaggggatgggcctgctgcactcatcctttgaccacatggggtctaaaaccaagaccaacaaaatgggaattggaagagggagaaaaaccaagtgctggtgttgttggttgagccctgaatctatctataactgaagatggcctttttctagacctttaatttatgcaaataaattctctattttatttaagctggtatggtcacgttttctatcattagcaatgcaaagactcttaagtgataaaggaattggtactagaagtgagtgttgaatgtgactaagcctaaaatgtgcaactggctgatttgaggttggggaaggctagcgcaggctggcctggactggaaaattggcagtccttgttaagtgacaacaaaatagctagttatgctgccacctattgactcctcggtctgagacaggagcctactcatggtacaccattaatggattcactggaaaagcatttagaatggtgcagtgtgttggctatttcttgtgtcttttagtaagatccacaggaaagagataaatgtaggctcaaaactgactagaggcacagagggaaaaaatacggctttgttaagagaggcctttttttggctgtgatctgcaaccaagatgggtgagagtcaaataatttggagacttgcaggttggaaaacccaaattctctacagcatgctaacattagatagagtggggagggacccgatcataatcctgagagacacaattccaaacaccagaatcctgaatactgaaatcccaaaagatcaaaatcctgaaaatataattctggaagaaataatagagaattatttgaaagatatttatttacattttaaaggaggatttatttaagaaacatataaaaacatgacagaacacttcataggccattttacacaataaaatagacaataataacacaaatatttttgcaagcataaacactcaggtattccaacgacagtagcacaggtatagaagttataagcagacatctgtattcataaagaaatagggcaagaagagaagtgtacaaatgcatatcactacagttggtattgtttgtgcccagctttataaatttggtcatctgaaatactgtgacaaagaatcttttgatgagatcaataaaaaactgtgacatgcagttaccacataggcagttgcccaaagagctgagatctcaagaaattttcttcacaaacgcagatttgtataaaaggccatctcttcatttattgaggatgtttcaacatttttatgtatatgcgcaatgcttacacacaaagtcaatgctgtgctgatgcatttttatggagttaaatttgcaaaaaaggcatttaatgaattagaattttccaaaagtctcttcacaatgtatatgtccagtattggaaatgatgaaaagatgaaatagatggcatagtgaattataaaaaatcatgctgaaactttaaaatagtggaaaaaaaactaaaataagaaaaagaactaaaaagaaaattcaacatatgaaaagagtattatggggatagattatgggcaattgcatggagatagtccgaagagctggcctaacatgatgcagctattctgtgattgtgattttggggattttagatgttcaggattttagactttagagatttatactttagggattttcatctttgggaatttcaacattcgggattatggtgttctggactgtgtcttttgggattatgatccagatctggagtaactctactctgactccaggaatggaaagtgaccagccctggctaattaaagccttgggttccctggctgcagtgactggttcagagactacttttgaaccaaggagatgtagtgagacttattctaaggtgtgtggggctgaattggtagtatgttatccacattagaggtgtggggctggaatggcagtattatacccacattatagacgtggagactgagcatgaagccaatgcagtaagagcgaggggagcctgagactcaagaggtacagcaatcaaaagcaacatgtgggccagcgcaggggctcgcgcctgtaatcccagcactttgggaggcagaggcaggcggatcacaatatcaggagttcgagaccaatctgaccaacatggtgaaaccctgtccctaccaaaaatacaaaaattagctgggcgtggtggggtggtgcgcacctgtaatcccagctactcaggaggctaaggcaggagaattgcttgaacccggaaggcggaggttacagtgagccgagattacgccactgcattccagcctgggcgacagagcaagactctgtgtcaaacaaacaaacaaacaaaaggcaacgtgtagatgttacttggatcctgagtcaaataaactaaaaaacaaaaatgaggcaattggaaatttggatattgttcagatatttaatgatattaagatattgataattgttaggtgtgataatgttactgtggttatattgtattttacaaagaatccctaacttttagagatatatactgaaatatttgtggatgaaatatgatgcctgggcttgtttccaaagtaatatagaaaaggagggaaagtgggtaggggtacaaatgaaacaaaattgatcatgaaatagccattcttgaagctgggtgaggagtacacagcagtttgttacacagttctgtctacttttcatatatatttaaaatgtttccataacaaaaagcattaaaaaaaaaagacttgtggctcattcccttccttatccactagaggctgttaaagaggtttgcttaatctagtgtaaaaatgctcagacttgtagaggtaacttacagagttacagaagttaccttttacttctcaaaataatttcttttgctcttggagaaactggatagaatgagggctcccctacaatggtcaaagaacaagtggttcttcccagaaaaggagtaaactctcaaaatctgaacacccattattagtggcaataaaaaagtaaaaataaaagtccaaccaacaaaagaacagacccttttttctagatcagcactgttcagtagaaatataatttgagttacgtgtgcaattctatattttctacgagctatgttagaaatagtaaaagtaaataggtgagattgtaatattttcttttaacacactacttcaaaaatagtatcaaaaaaaccaatgaaaatccccccaaatagtatcattataacatgtactaaacatttgaaaagaactatgaattaggtattttatactctttttttcacaagaagtcttcagaaactggtgtttactttactactggcagcacttcaagtgctccagagccactaccacactgggcaacacaactctagacagtgagggcctgacacgcaggccccatcttactcatcttttatgctggcaggatgcctgaatgacacttaacagatgttcaatcaatgtcagtcccggaaaagtcttggtccacctagagccaactctgcgctttatagttataaattcttaggaagagtttattctgcttgaagccatctcttaaaacaaggaattgactaggtattgttggatttgtggccagtagaagagctaaattggcttctcttccccgaggtcttagtgctaacacttctagtaccacatgtgaagagatactgcagtaaagaagttttaaattaagggctcagaaaaaatacattgccttagtctgttttgtgctgctgtaacagaatactggcgactgagtaatttatgaaaaggccagatacggttctggatgctgagaagtccaaggtcgaggggccacatctggtgagggccttcttgccgtgtcattaccatggctgaaggcaagagagcatgcacaatgagaggcagggaaggaaggaaacagaattcatccttttatcaagaacccactcttgtgataactaacctagtcccatgataaggacattaattcatttataagggcagagcactcaggacctaatcatctcttaaaggttccacctctcctttgggaggctgaggcaggcggatcacgagggcaggagatcgagaccatcctggctaacacggtgaaaccccgtctctattaaaaatacaaaaaattagctgggcgtggtggcgggcgcctgtaatcccagctactcgggaggctgaggtaggagaatggagtgaacccaggaggcggaggttgcagtgagccgagatcgcaccactgcactccaacctgggcaacagagcaggactccatctcaaaaaaaataaaataaaataaagaagtcccacctctgaacatggttgcattcaggattaagtttctgacaaatgaacttcaagggacacatacaaactacagcattcacggactcaaacacttcagtggctttccattttataccaagtaaaacctaaagtccttgccatgactagcaaggtcctcgaggatttgacactcccccacttcccctctccttccttgacctctttccctaccttctccccccatctctttgccttagggattttgtgcttgctgtcccctcttctgaggacactgttctcttggctgctcccctcactccactcatgttctgcagtatttgtgcctgatctgctcttcccaccagagaggcagctccacgagggcagagtttgtcttggtcactgctgctgccccaacaacttagaacagtatctggcataatgcaggtgcttgaaaatatttgtaagtgaattttacaagcttccagctctaagtttagttctaactttcacttaacctggggttgtgattatgctgctccacgtttggctctaggcaaaaaggtgccaggataaagtggaaattgttagatttgctctccaaaaagacctggggaggctcttgcttctcccaacaggttgacacaagacagccatttaaaaagacaataatggggggccctgccaacagatttaacgactctttctcacgcagggctgtttgccagtgtcaggaagagaatgagttagaaaatagtgagatgactgacttggaaaagaggcaggggaaccaaactagggtgaaaaaaaagaggcccaggactatctagaaaggacagtcccataacggcttcacgtactcatatccaacaaatctgcattctatgcccctgtgtgcctgatgccagtaccctagatgctgaggacacagcgtggaagttcacctctccatgctgagtttggcagttttgtgctcagcaaaaaccaagaaacaaaaagcaaacaaatacaagtgctgaggttggaacatcacttgccttatttctttgaagagaaaatgatttcacatgtggaaagaccattcatgtttttttcttttttttttctaagcactatcttgtcttaggtaatttaattaaaatgcaaacatttcccagttaccagcatccaatataagtggcccccaggggaaaacccatgtgaatgatagaaagaggcttcttgcaacccaagggagaaactggtggaaagccccattttcacatcctgccaggtacatacttgtgcacacacactgagagaagctgctggcatgaagatagctgtgtgttccctatggttgctaatcattaggtataaaggccagaatgggcctttacaattacttctgggctggtgaaagtagccatattgttccttattcagacttctctgtagctaaatggctactcagtatcacctgctggaggacagaactatatggacactaaaggcccctcccttggattctcaggaacaagggtaaatagctctgcacctctgggcctgacaccacccatctgaacactgtgggaagggctcagtgacctaagactcccctaggggccctctgactgcatataagccaggcctggctagtgcagctgcctgggagaggcagacccaactactctgcaggtggacagtaaatggtgggcatttgtgagtgccataagaatggggggccttcctgggattcagatgatctgcaatgtaccacactgtctcactcagtaaagaattgtcccacaggaccttcaaaggtcctgttacatattgatgtggttgaaaaaactatttctagttatctgagcctagaccttaactccaatttatacataaactcaaaatagttattgcactgttgtattcattccctgtattttccggtaatgcaaatgtcatacaaatgaaatactttgttttgttcagatatttaccaagagttagttgcccctttggaaaatcatgagcccaaggacaatgtcaatggtgttactgaagtctttaactcaagagagcctgcaatggcagctgtcacacccaccgtgatcctacgcatacacgcaaacacctgaccatgtacttttgttttctgatgagttgtacctgatcacttacaaactgaagttattttataataaattactttcatttctcttttaaattaagactacattgatttggagggaaattgtgtgtgaagtcagattattttatttgtgaaggttcactgaagattttgaagagggcattagaaaatactgttattacaagtgggcacggggtcagtcggggctgggagccactgcttctggtggtcctgggatgtctacatgtgcctgagctccgtttaaagtcatgaaaggccaatcagacgattctgctcatccagcctgggcagtggagaccaccacagctactcacctctgatcctgtgaaggagcttcacattttgttaccaaacatatcacagaggcgtgggtgattctttctcctgtttctcagcagatcctgcttttctcagtggcttggccagaacagaatttgttctactcgaatgaccccagattccctccaagaacttccctcctctcattcagcttctctggattcttcaaatgactgactggggaaacagattgttggaaaaacactttcgggttgcctcgatggggtcaataccttatcaggccacaggaaagacaaaggaaaatgcttcctgctggagcatgtgcacatatgttgttcctttaactccaaatacgtatgcaggggtggtggtaggatcagaaaatgtgtgatcagaaagtgaccagttccccaccattttgtgtgggttttattttctttctgctccgtgttgactcttttccccacaacacggaagctgcttaatccaaagacttggaccatttcattctgtttcagatccattccaacaaaatgatcagttggtggcttatgtaaaaagcagctccatgactacatttaaatattgactagtttgggaataacaaaccacaaaaatttggggtataaaaaccacatgtggtttatgttttgtaggacaccctcaggaagataaatggacaaagtagaaaaaaaatataaatggtctctccctgcctcacccccaccatcattaaataaaaacaaaaaacacacaaaaataaaatgaaacaatgattaaacaaaactcaagctgggtgctactcctggctttggatggcagttgtgtcttggcaaggcaagttaagtagtggtctgggaactgtggctaaggtcaacgtgtcagaatagcccgacataacctccaccttggtcaacagctcacccagctcctgaccacggctcctctctgtcaccagcacttcctccttccagatgagcttctccaacctctaggtccctgcagtcactgaccttttcccccagatctggccccacactcaacctcccggccctcttctccagccaaaagaaaaacgcacaaaactgtagatgactttctagaaatagaagtgttttataatctttgtgtgtctctaatgccactgttaactagcgagcagctgtgctagggctccatgcacagcagccattcaacaaatactcagtatcttcatgttccaaggttgctttaggggatactacaaagattaaacagacaaaattgtccaccgtcatggagcttacactcctatctgcgttgatgatgtgtggaaggaaatttaccctctgttttatgctgtgcaggtgttcatttaggcccagctcatattatattatgaagagcagcctcaccaagatcactgtcagagcagcactaatccaggcaaactaggatgcaaatggaaagggctccaaagtcctttgggggttagtcgtttcaatccaaggaccatttccataaaacaaaaacaaaaacaaacaaacaaaaaaacttgatgatatattgctaggccagcccacaaaagtatatttagttcataatgtcactaaactaaaacttcagttctgagtcctcaaaggaaaggactttaaggtggtatcaggaggaggaggagggagggtcgtccctctctggggctccccagcctcagcttctgcctctgcccccaccttcaggccacctccaaactttcccttggtctcatgcaagacactaaggggctcctgtcccccaaatatttcttaccctaaattgtaattccctttcctgggataagatgatctcattgaggcatcaggaggaaatcaagttgtcttttatttaaaagagaagagaggtgttaacccatgttaacccatatgatgttgaatttttttgagatcagagaagacatttagttggaggaagacaccacatagtacagtcacacactgtctagggttaactttgttaagtttctcccacttttcatagtttgattccttcacttaaataactttatttttttttgagacagattcctgctctatcacccaggccagagtgcagtggcatgatcaactcgctgcagcttcaaactcctaggctcaagcaatcctcccacctcctgagtagctgggactacaggtgcatgctgcctcgcttggctaatttttacaaattttttatttttgtagagacgtagtcttgctatgttgcctaggctaccttcaaactcttggcctcaagcaatcatcctgccttggcctcccaaagtactgggattataggtgtgtgccaccataccccacctatttttaaaaatcacccattaatacccagagaaaaccagttatcatcttagaatttctttccagtgtttttctttctttttgtgtttgtatttaaaatgggatcatactttggatgtgtacgtgcgtctgtatatatccttctttttcacatttccccatattattctcttaacacaattttaatagttgcatatctcattttctggatgttctattatctatgtaaatattttttattgttagacatttaaattgcatccaatttcattattacaaatcctattataattaatatacttgcatctgaatgttttgtaatcattttatagtatttccttaggataaatttttagagtacaatcactagaagacatgaacagtttttttttaaggaatcttgatacatacgattaaattattttctcaaagttttagcttgcatactcccatcagtactcatttcttctttttaacatgtgctattatgacgtttcaaaatctttgccaatttgataggtttatttattgtcttctccattattagtatatcttactccattagtggtttgttatctggatttaaaaaaaaatcacagggatttagtcttttccttatttcctcctatttgaacctaaaggttacctaaaagctccatgatttttcataaacaaaataaaatattctaaccattcgtagactgactgggtggaaggcagtgaccgtttctgtgtgtttataaaccaaatgttcataaaccaaggactacctttattttattagctgtggctaattttgtgcagtctatgagaatttttaccactgtaagaaatgtttctatcccatgctgggaggagagggtaggacctctaggcacatcttaccatagctcttcctgcctcaaaggcaaaagcaggaatgccttggtttatgttatgcacatgcagacgtgtaaacttctaaagtctaaggtacagaaaacagcagttgtgaccctgagtcaccttattttagtgttcacaagaccaaagttcccagaaatcaaggtgtaatttaggctgacctaatgaatactcaagcttctctcatttttaccattttcattagccattatgcaaatattttagaaaaggtagaatctagtttagaatttttttatgattgcaaacttgatgataaaaacctcttttgagcacaggtcattcaaagcaactctagcagtctacttggtgggctgtaatttccagttgtcctgggctagaaggacaactgatctcctttccacctggctcttcccaagtgaagacctgtgacaggatgttcctcactttgcacagttcttcatcctgcacttaggagatatttgatatttctaaattagacaggcagatgctttgagatgaagtgcctggtacatactaaacactcaacaacattagctactattacgattattaagtgagcagaacttctccccagttcgtgctacttggtaaaagaggaaacaagggtaggttgggcagggagggcaagattgataagtaagaaggcaaacatgggaacacagctggtaaagtggctccttttgtttacagagggataattcaatgcaatgtaagaatgaagacttttataatgctgagttatgggttattttttaaaattttaaacaaaaaagaataaataatttactctttgatatttgaaaaaagtaggtgctaatcatttgagtctccatttatgtcatttatctaaaactcattttcagatacacttagccctatttaaaaaagctgcactgatccattcaatttgtgctggtcactctcattcactaatacctctgtatttttgtgtaattccaaatatcactagactcaatgaacacaaattcagaaagaaaatgccctacaaatttcctaaaaacacagttgctcctaaaagttaagaaacggggattaataagttggttttatgttcattaacttgttttcatttcacctggagagagccattgctaattagtagttaagttaaaattccaagagccgaatgccgagccacttgtctccaaatcctccactgcagagaacaggactcctcttcatttcactaagaaaatgttcaaaggcttttcggatagtctcacccaactagggaatggaagactgcttattttcaagtctgctttattctagtggttgaggagtaaacaaagagaacagtaaacgtctgggaatgttttcagaggtgacacataacaaacagagagaaaataggccttgaggcaagatctgatttaactacgtaagtgagaaaaaaaaacatgccacaattcctatcattattcccaagttctgccaccacaagctgatggcattctgacgtgaaaggtactagtgccaagagtcaaataaagctttggcaaaattgaacaccacacagaaaacagagtatccaactctcattgtcagggcattcatggaaaacaagtatgaagatcaatatgaaatcttattttccaaagtacaaaggcttctgtatacagaatttcctactatccaagctatactcttaacctgctgcaaaacaccttgtggaggtacatcttactcttcactagcattgttcactgcaatgctttccaacctctgtttgcaccaatgttgagattaagttttctcctatgttccctctgccccaatatcttgagaatatagatgagagtttctcagaagttctaagatgcacaaagatgagaatatctcaaaaatatttacagcataagtaacatggagaagttcaagcaatggagaacaatagcgacatatattcattctactctggattctgtgacatgtatataatcagtcttaaaagcgcagctttaaaaaagttttaaagttatgactttattctaaaatgccaccaaaccataataaagacagtgtacaatatattacttagggaagaaactgatacctgttattgctttgctagaatttgggcttaaaaaaaaataaagttgataaaaggatgggtcaattcagtggtgatttgcctcaaggataactcctcccacttcctatacaaaataagcaattacattaaaaaaatacagtcagaattttatggaatcacatcagtttttaatgtatgaatcagagaacataacaatcactataaatgtagcatggttatgtattttaagtctctagtcctattttccttagtgtaggcataaaagttcttaaaggcttagaatttactcttaaaatactataaaatattactatttttatgacaaaagcaatttatgaatttatggaaaaggaaatatttataaaatatgttagtaaaagcactgtttatgtttgtatagcaacatttaaaagtattcaaaggtcattcattgctaaaaatatttaaagcaaaataaaagggaagttaaaaacagcttcacttaaacttgcagtttctaaaacttatcaggacccaagagcctggaagtatcaaagattaagtggaaatccatattcaaaagagttctgtggaattcttataaagagaagagcaggcaaaggtcatcggaggacattattttagctgaaattctgagtatcattcaaacaggggagccaatgcttggtattaacaaagtgctgttttctactgctgagctcagatgacagcccaccctctatttgccaaaattagtggatgagaaatcatttcatgaactcatccaaaaacatgaagtgcactaataaagctttactgccatccctcagtcatcactttgcttggctaggctggtggccagcaggaatatctccctctacaaaactgtttcaaagtaatgacttggaggaagtggtgtgctgataccatgaaaaaaaattccctcaaacacaaagatagttcaaaaagcatctgtatatggctcagaggaaacaaacagctcagctcatttcaactcaaaagaaacccaagagaccagtttaccttggccatggttacacacatgcaggcaaacttaaggttggcatttatccagggattttgatccgtgccaaaagggatgatgagttatccatcctgaggtcaagatggaataaagaaaatacactgaaagagaatcatgtgtctataagaggatttcacaccttcctcttcacgagacagggaggcctcgacccctgctggaatggcaagtctggcgtcccttcctgaagccactactagatcagaagtccactctgagcctccatcacatggtttctcccctgctgaggcctttccagtcttccttccacagtgtggtccttaaggagctaaggagggaagaggatacctaaagcacttgtttgtcaagcttgggctgaaatacatctagaatctttaagatgaccaacattgaattttccatttttgagcgtttaaaaatattcttcaaattaagggaatacataagcaataaagaccatgttttactgggttttgaaaattatttagagttttctgtaaaagcagttacttttctgagagaacaggtggcaactgctaccaaaatttcaaaaagatccttatttttattttcaaataacttttatttgacaagaactttgtcagtaatggtctttaaattcttttcaatcctggctttgtattgctattttgaggtgtttcttgctaactggattaaggaagcccaaagagccctctggttttggtcatcaaggaaatttgtctcacaactgatgatttatttgatttttttttcattttttttaataggaagacaggaaacagtgataaacctttaatatctgaaacttgtgtcattgaccttcaactacatagtgaggttttcagttcagaacatttagggcccatgttacatgtggggataattaaaatgttttaagtgatgctttctattcttcaagtgttggccataatattcaagctgggtacaagcagcagagatttttgtctgagctcagtccaagctctgcagtttctgctgtttgtctttctaggtggcaccagtcagtcatcctctgcagctcatgaaacccagcataaccttttgggctgctctggaaaaacacattgagcaataagggttagaatactttgtgttcaatgtttccagtgctactctctggccaggagaaataccaaatcataggcatctggaaaagagagacagcccagaaagaatgatgatgttacaaagcctgtgagcacagacccctcgtacatgttcatctacctgctgtctgcttaatactgagctataggcatcggagcaaatggtaatttctatcagtcatgactcaagtgctggtgtggtcttcaagtagcaatggattgacttccagggagtgaaatgtcattgttctgatcaccttgtggacacagggagtggtgaaaagttgagtccatggcagcatcagagcaagaaggaagtgcggttggttggaacgcgcaccctgtggtggtgatgttctccattagcatttcccaaaggtctcacccagccatagtaaattattaggaggccctcagcatctctctgtgtagtttaaatatcgtattgtattttcttggccagtccatgaatggaaagaagtgaataaagatatcagaaagtagacaaactgcaatgtgacctgatgcagaggtggaaagggtgtggtctggaaaggcagaggttcaataaaggcctttgaggtttcctttcatttccacagttcttagtcacacaatttcctttgtggattttaacggtaactaataaggctttgaaaaggaatcgaattggtatgctaggtgggaaatgacaaaggtcatcttgccacttcagcagggttattttaacctttcttttatactcttcaagtcctctttccagaataattgaaaatcccataattaaaagaccttcctttgtgcccacattccccttctgagatcaactagagctgggctcaccccaaccatggtcaactggaccaggccagccaggcctcaggctggagagcaggctgtgagctggtctgtcctgaaaagctcggcacagacaaggaaaaggtaatgcacgaggcaactcatgtccttccttgtctcagaagtatgaactgaggatcaaggaggggcaggcagttagcactagggaaacaagagcaggcaaaaatggacagctgagccagtcaatcagtggacttaagagaggaggggagatctgccatctcctggaactgagggtgcactgtggcttttcaggtacctgaaccacatcctagtcccaataattctaataatattaatactaacagtaataacaacagtaacaatgagcatgtactgagctctgattatgtgctaaggagtgttctaggtgcttttataagtattatcaactcattcaattctcacaaccctgtaagatacatctgggtgctgctgatgctgatgaacagacaagttaagttatttgaccaaggccacagagcttataagtggcagagacataatttaagctcaagtggtctggcttcatgcctctgctcagtctgtgcctccctgtggggctagtcctgagtctcctgtctcctttattgcccatctttacaataaagcccctcctattaaagaggccctacagagggtcttttactcttctattgtctcacaattagcattttccttggctccactcattatgaatcttattaactgacacatacacacacacacacgcacacagagtttttgagaaagggtctcactgtgacacacaggctggcagacagtggtggaatcactgcaacctcaacctcctggactcaagtgatcctcctacctcagcctcctgagtagctgggaccacagacgcatgccaccatgcccagctgtttcttttttttagatacggggtcacactatgttgcccaggctggtctcaaactcttgggctcaagcaatcctcccacctcagcctccaaagcatgaatgtagttttgaatccagtttttgttatcctttcatgccactaaatattctttgaaagcatgacttttaatgactgcattatattcatttatttaacatttacttaatcacttatttatttaacacttaacattaagtgatcacttgagtccaggaggacgacgttgcagtgattgtaccattgcacgccagcctgtgtgtcacagtgagaccctttctcaaaaatagtcatctagctatctcttactttgcttttataattgtgctaatgtcaatatctttatacacaaatccttgtgcacaggtaggattatgctatagaataaattatagaaacagaagtattggatcaaagagtttgaacaatttaagttcacttgatacacagtgcagatggccttcggggaaggcctagaccccctttggctacataaaagctccagggtctgggcatggtggctcacacctgtaatcccagcactttgggaggccaaggtgggaggatcacttgagctcaggagtttgagaccagcctgacagtacagtaagaccctgtctctacaataaattaaaaaattagccaggtgtagtggtgtctgcctgtagtcccagttacttgggaagctgaggcaggaggaccacttgagcccaggacgtcgacgttgcaagaagccatgactgcgccactgcactccagcctgggccacagggcaagactctgtctcaagaaaaaaaaaaaaaaagaaatctccattcaccatacccttgacaacaatgaatgctgcaggtttagaaaacctttatcttaatttgatttcttgaatgggtcagaataatgcatacatttaaactctatgctccttaataaaatgtcaaagggccatttgcgtgtttattaagagcaaaagcctataacctacagtctccaatgttgagaccactgacgccttaaaatgctttagaatttcagaaatggaaatcagagatcactgagtaaacagcttcagtgaatatctaaggtaaccaaaactcagagaagttaaatgacctgggtaatatacttgacttgcaactagaatctaggtgtcttgccctgtgattcatttctttagaacagattccttcattaacctaatggaagcaacaagccattgttaccggggtgaaagtataaggaaaaaaactgcacaagaatatatttgaaaaagaaactacagttgttctaaactctattttatcttcatagtaccaagttagaaaaagttattttatagacaaaagtaaaaattcacacctagttactactttattttcaagatctctgctaaaatctacaaataatttttttcctaggaccattaaaatattcagcacatacccattatcctctcatccagccaacatttactaggtctatactatggccagaccctgtgctaggtgctgtagtaaaagggggcagagtaccaaggtaagaaaagagggattcattttagggacatgtgagcaaatcatcacagtgagtgtgactgggcagtaacggggtgcacatgatgccgtgggggtgccggagcaatgaacatggaaggcttcacagaggcacgtgagctgtgcctgtgcttgaaagcaggggaagaagtggattaagataaaataagaagaataaggagtggaggggcagggcccactggagaaggctgctgtcacatgtggctaaacacagcagcctgggaaaattagtgctggtgggagatgaggctggaaaggtggtctgggatcaggcagtgttcaggagtttggacttcgcctggaggtgttaggactcatgtaagctgtttaagcagcgatgccatggtcaaagtggcgcattaccaagctcattctaatggcagtacggggaaggactggagactctgaaggcaggagctttatctgtgttggtacagacaaccaggttgcaggcttaaattagagagaggcagaataaatatgaaagaggagatgagtttgagtaatatatattagaaagaaataataagacatagagactaattagatgtgtgggtgtcattaatgagacaggcaatgaaggaggaaggccaggttttggatgaaagggatttgtacacattgagcttgagatcgagtgaggtatcagaaagtgaatgaaatatccagaaagcgaatgaaaatacaactctggagatcaggagaggtataagcagagtcatagatctgaataattagtatacagctacaactctcctaccaatctccccctcccctccacccccatcgcccacacacttggatacttcctcttgtctgtatataggtagaacagcactgtccactaaaaatacaatgcaagccccatgcatattttgcaattttctaatagccacattaaaaaagtgatgtggaaaacaggtgacattaattttaagaatatattttatttaacctaatgtatttacaatatcatttcaacattaatataaaaattactaacgagatattttatattgtcctttcatactaagtatttaaaatccaatgtgaattttccactcatgacccaggccatctcaatttggactagccacatttcaaatggcccctgctttggactgtgcaggactacacagtagcctaccagggtgattaggcaccaacatgaacttttttaacccttgaaatttgtggaattaaattaaatggaatttaattttactgatgagagaacaatgaggaagcccgctgggccctccaaatcactgcccaccccaccctcccttctcagagggagtgcaaaggggcagtgttacatgctgttggaagtttaggagacatgaagcatagaaaatcatttcctctaaatgttgccttttaggttattaaataccctgacagcaacctgactgaatttagagccatgaatttgttatctcttaatgtggatatatatctggtctcctgataaatttcctaaggctgttgttcctaaacttcaaatatttgcaaactaacttcataattttgtcatgcctgcataccaccaaaactatatgatttgtttaatatttttatttaactcaactaacctaaaaaaatctaaagacatatttagtgtcatcctaagtaactatatccatgaaatcatgaatttcatatgttgttgtacattttttctactacacattaaaacaaatacatatttaaataaagaacgtttatccatgtctcctaaaatcacctcacaaaccacctgtggtatgattatcaaactttgaaaacactgttcttggggaagggaaaggaacgtaacactataggatcccctctctatgccgccagtgctccgtggggtgcgcctatcctaactcaccgaatccccactctcctatgagcaggctgatggtcactgctacccactggttgtctttcaggcttgcatttattctggctgattagcacttgtgtctgccccgcggtcagaaattttatatggcaacctgtattaactataaggaaattcttaacaatttttatttttgtttttaatttttgtgggtacacagtctttgttttgattttccagaggttacagagctgccaagtctgggatttgagcttttacctataaacatcacaaggcagaggcaactacaacacctaccataatgccctcctaagaggtgttctatttgttgttgttaacaaaatgattttcaattatgaattatcttaaagcccaaagactttaagaaataagagttggtaaatttcaatgatggggatgcgtagtaccaaaatggtttaaaacaaatgtgttatatattaacataagtgcttcttagtgtattaaataacaagatctagtggctagtctaataattactataatttcaaatggtaatacatataaacaatattaaaagatatctgaaattgtagtgtgtattagttagtctattgttgtgtaataaattagcccagaactaagtagctgaaaccaataaacatttactttatcacagtttctgtgggtcagagatttgggcacagcttggctgggtacctctggctcaaagtctatcacaagactgcactcaaggtgtcagctggggctgtgttcccatctgaaagtttgggggagaaactgcttccaagttcactcacatgttgttggcaggattcatttcctgactggctgttggttacaggtctccctcagttctctgcacatgcatctctctataaggcagctcttaacacggtagctggcttccctgagagtgagcaagagagtgagagaaagctcctaagaaagaagccaccgtctttttatacccaaatctcagtctatgaactagatgggaaaaatagtacctctttttcactaacctctagctgaaattttgcatttctttgattatgaatgtagccaacaaactgcagtagcattaacagcactgtgacaccatcaccaatagagctcatagatattttatttcattttgtggcaggcagcttataagatggtccccagtgatctccacctgctgaaattcatgccttggcataagtccctcctcctgaatatgcactggatttaataattcacttttggtgaatgaaatgtgttaaatattaacacagaaaaaacccctgtgttaaaggatgcagtctatcttgcaccatctgaaaaatcagtctggtgctttgtggatgggcacagggattcctcacatacccctggaatccaccatctgtgggcatttactgtgtttgtgaaagattcttaaaaaaagaaaaaaaaaacatgtggtactgctagtgcagctcagaaatagatcaactttgaaaacttccctcacagctgcaaaaggcaagtgtttggcactaataaatcagaattagtggagctcaactaataatgaacctttcatctcctctgggcaggtggtcaccaactgaactatgggagcaaacaagccatggttagatgtaataaccacatttctaatgacaggtaggactagagcagaaagtgagtggaggagaagtcttcccgcaaaattcaaatcttcttaaacttggggccctctgaaaacattaatcaaagttgtgtttctaggggctgggctgacctctgcttattacctttccagtcataaccactgcaggtatttttcttctcgctagtgaaaaacagcctgggatgctatcgacaggcccctatcagagaaccagtgaactagggacacaattataggtttcaattttcccctcctagacgccaatccaaatttgtcatcacctgttcagagaaatgccttccatgtttcatctcacttgggtggaaattgggtgatattcaaaatatttaacaaccaatgaggcacaggcactaaccaattaggacaacataagatgctggagcagggtccaggggcaccctgtgctgtgctggcattcatcctttagttgttgaattatgggagaagtcttaggggttctgggggtgtgctcagggggctgagggtgatgacaattcgccaactggtttttaggcatctcattattttaatacccaggatgtctgcaccagtgcacacaagattgaatattcactgtggaggggggttggggctgctgctcccaagggcccccatggaaggctactggtgtggaagctgaccccatcgccctacagcgttctgacaactggcactatggggacagagccctgtccatttttctgagccctgagctcaggccagagccttaaggtcctggaccacttccaaggcttgcagaacccctcactcaggtctccttggggcggctggctggcagtctcccagttaccaggcactttctgggagcagccagggacagctgctgccggctggcatcaatgggcttctgtgcaactgagggttgagtggaagtttccttgtgggtttgatggagggcatgttctcagtccacaggtgtcataccacccgagtagcctcaccactgtacaggatacaggcctaagaaaagacttggctcatgaatcccctcacttcgaggattggtttagcaacttcctcagctttctgaatgaggtctcaggttttaggcttatcacaaaggagatcattctgcatgacctcttggtctgcattatttcactgaaatgcccgggtttgttttactttactccatgcttctggaaagcaggctggggggctctggatgcacatagacctgggtctgaattccagctctgtggaatgcatcaccacttcacttcacctctctgaggcaatttccacctctgtcaatggggctcatgggagtgcctgcctcataggctggtggagggtccaatgagataatttaaagacaaatttgataactgttttcttgtaagttgagggaaagattaattcaaaacttttagtctcagtttgggctaggaaatgccagtgttattccagggtactaacataggtattttaaaaataagatgctttttgctttcacaagctgactaaaaagtaaagacaaaaagtgacttcagaagtcaaatgtaactcaatagtcttacatgcttagatccaacccagaagaactcagggttctccttcctgaatgaagataatttgaagttgcatatttcgatccatagttggctgaacccacagatgcagagcttgtgaatatggagggccagcggtatctccttttctacaggaagacggcatagtttaattcattaaaatttgtaaaactacataatatctgtttcaatgacaaaaagcaatttcaattatatttaagatgacatttacataaacataaaaattataaccgtctcacaatactctcaactaccttgacataaaagcagaggaaagcttgatttgttaaggtattgcttttgctcattttgtttaaaaaaacttctttttcttaaaataagaattatggaatcattaagttttaagcaataagaagcaaagttcgaaacaagaatcctgattcttcacttctgtttacccaaaagaacattctctctctgatttcagtcccagaaatcaaaccagtgaacacatcactatgcagagtcacattccatgtttttaatggaagttttagaagctacagatgaatttaggagtgatattaaaccaagaccattaagaaagatgacttttttctaggattctaactcctatattcagacacacatatccaactgcccacttgacatctccacttggctgtctgtctcatagacatttcaaactcactatatcccaaacaaaagtcttagtatctcccctccaccccaaattgctgtactcacagcccgccccatctcagtctgatggcatttctattcttactacacttaggccacttcctattttccttaactcctctcttttgcttattatttttcaatccaactgccaatcttgctggttctaccttcaaaataaccagactctaattactcctcaacatctttactgctaacccttgtccatggcaccagcatgtctcactggagtatttcaatagcctcctaactggtccttctcttccactcttgtgctcccacagtctattctcaatacagtggccaaagggagctgttaaatttaaagtcagatcattgtctctttttggatcaaaatcctcccctcactcccagactctggggggaaagccagagtcctaccatgaccaacatggccctccaggatctcacctccaaattactggctccatgttactccttgaatactccaggcatgttccgcttctgcgtcctcaggctttccccatgtggctacatggtgaattatctcaccattttctccatgacagctgcccttaccagctcacctacacccatcctccaccactgtgctctgctcctcctagccccgctagacttctttctccacagcatgtatcccttctaaattcctaatatacatcacctagtattttttagatttattgttttttgtccacatcttttaacttgaatataagatccacatggaagatacttaataaataaatctgaattaagggaaaatgccaaacaagaaaaacaaagagaaaaaactttgaaaacatccagtgtccaaaaaaaggtcttatgattttcttttctttttcttttcttctttccttctttctttcctttctctttctttcctttctttcttcctttctctttctttctctctttttccctcccttccttcctcccttccttccttccttccctccctccttctctctttctttctctttcttttttttttttgagacagtcttcctctgttacccaggctggagtgcagtggtgtgatcatggctcactgcagccttgaccttgacctgctgggctcaagtgatccccctgcctcagcctcctgattagctggaaccacaggtgaatgccaccaaacctggctaatttttaattttttgtagagatggggtcttcctacgttgcccaggctggtctcgaactcctggctcaagcaatcctcaaggccatctcggcctcctagagtcctgggattacatgcatgagacatcacacctggccaggccttgtgatttctaatagcaggacccatgtattacatctcattttttaattttaataatgtttgtggcattttgaagaggagcaacaacaaagtaagcctgacacttaggagaggctgctgtttaccctgaaaagacccctaagagtggcattcttggggaggggtagaacactacatcaagcacagagcgttatcatagaggtccccacatctcccttttatctgggagccagagggatcagactcagaatgtctgagtaaaaattcacaagaggctgctgggcaccccggaatctacaaaaaaatgccatttctttccagtgaccatgtccattgtccagaatatacctttctgagctaatggtacccaggaagttgacttagcattcagaatgtggttcaggggtgttggaatcagtgctaaggatggctaacccttctgaggactgcttaatccatgccgtggtgagccctgataatgcatcacaacagacacttcacaaaagatcttcatccatacttaccaatccacactcatgtccacaagattcaggacctattttccaggccaatactgggcaaccattggaaatttttcctctctgctccatgaggaccagttcattgcccacaacctttctccaggtaggatggattagctttctacccacaaaattccaaccatatggctgtgctgtcttccaggaattacgtagagctcactttgctggagttctggaagttcctcaaatcttcaatctgttactctactcccattaggcacagatctggcctctgtagatcccagaggtgcacctactttcagattcccaagtccttggggcccttcaacatttcccccttatgtcaccagtgtgtagccaggggccttgttctgcaccctctaccatcattaatgagctactttgaccatagacaaatcacctaatctctctgggccttagtttccaaatctaaaaataaaaggatataactctctaaggtcccttctagttgtaaaaaatccaagattatttttttcctacctctttaagatttaaatgatgacaacagcatctttcctaaacttttcctgaggccagatgttcctggcactgaagtagaggaaaaaaatagtttttgaataacctaacatttttgccttttagagaaaattatcctctggcctttttagttccccttcccttacagctacctccttatggacccttaaaggaagtctttaaaacatagagaggctgaggcaggagaattgcttgagcctaggggttcgagactgcagtgtgccatgactgtacctgtgaatagcaactgcactccagatggagttcggcaacatagtgagtctctctctatcaaaaaaaagtaaactatttatccttcctgattcatcaggatcttataaaaaacattgttattttccaaattatttttcttacataaaacctcttaaacagttttattctgataactatgctcatcagccttgactttcctctgttttgcagggaaggctattaaatgctctggggaagaggaataaaaagctcagagacagggccagggaaggaagcatgctgtccatgtaggtaaattctgccctgagctttcacaaggtgatgggcatgaaatggcagaggcgaaagtagggagtggagagaaggggaaaagaagagggaagaagagaaagtctgaaagcatatattgtttgcttagaaaaaagttttaggagaggtctggtggcagttcaagaatgttcacttagttagatgacttctaaactgggacttgcctaagaagccacactgcagggaggaggcggaggtggaacagcagttctcttcctttagcagccctccatctagccttccgcgtagcaggctggtgaggtattgagcagcccctctattggccccgcacccagttttcagaagttaagttcattctacaggtctctaaatgcttcaaggacgaccaaatctatccattgttggcctggaaatcaaagaagacattccaaatcttcaccattcagtaaagcagtgacttactgaaagaattacagtttactagcaaaccccccaaatgaatctctatgtataatacatgcataacttcctagtctgaagatagcagtattccaaataattgtaggctccaagatatcacttagtgacttctaatttaggaaacatatgctctagagaattcctcccattatacacacacacatacacacacgtatatttgtgtgtgcgaacacatatcctactataacaaatgactctgtttttaagccactctaggttacaaaacaatacaatgagttaacttaaaatatgtcatattaaaatctgggcatgaacgcaactagaaaggaagcctaattcataccagaaaatatcaaaacaaagtctggtaagtgtctagctagttagacagtctcaaagcagtagcttctcattagcattgagaaataacaatctgagtggtaatgtgaatacctactgtggaactggtactggatgttgtataagctgggaacagatgcctcttaaattcagtttgttgcactatgacagggttctacttcaaggactcatcttttcccagtttattcttttccaggaaaagctttctatgcactttcatagacaaatgcaactcttcttgtcattttctggttcctttttttgggagaaggggacacttagagcttttttttcccctttaaacagcaccaaccttctgactgatgacgaaatagagggaaattgaaatggcagagtaaaaaatcaatcaggcacataggcaatcccttccctggtagagttacagagtatacattagtattcatgatattttagttaggagacaacatctccagcaaaagaatcaccacacagcactgtgtcaggccgtctatcacatctttcctaccacttccttgcacagaatctgtaatccaaacacctaccatggtcacccctccagaatagccccattggtcttgctccttttcctgggacaacagcccaagtcccctctgcatccttactgctcagaagcaagacatgaacattttgtttgaggcattcctgaagaaaaatgataatgatcttataatatgaggtatcttcaagtttgtgttttgggaggaagagtggtataagaagacacaattgctggataattctcagaagccaaacatagaattacctatgattcagcaattccacttctggggacataccaaaggaactgaatccaggatctcaaagatatgtgcaaacccacgttcatagcagcattagtcacaacagcgaaaaagtagaagcagcccaaatgtccactgatgaatgaagggataaagaaaatgtgatatatacatacaaatatgtttggccttaaaaaggaaggaatgtttgacacgtgctaacaacatggacggaccttaaggacattacgctaagtgaaataaagcagaaacagaacgacaaatattatataattctacttatatgaggtacctagaaaagtcaaattcataaagacagaaagtagaatggtggctgccaagagctgggggaaagggaatggggagttgttgtttaatgggtttaagtttcagttttgcaaaataaagagttctggagattggttgcacaatatgaatatacttaacgctactgaactgtatcttaatggttaagatggtaaattttgttatgtgtcctttatcacaattaaaactcccccaaaacctatagttcttagtatttcccaatatgatggtgataacaataataccttacaaatgtccgggaacttctttctgagaaatccagagacctgggcctccagatttgttcatgccaactcaaaacgataccaaggatgagttcagttgtaaaagttgcacttatcagagtttaactttcttttccccactagcatgaatgtttggtatatatcaccattttatccctctgaaaccagggtcactcagacatctgtggatgtcgacccgcagtgccactctggtattatctgggattcagggaggagaggcctgcctatgttgaggaagaagagagatttgtgaagttagcctcattcctcttctatttagagagttcaggaatgtgtccatactgttcctccccacaaaatttaccattttttctccagattaaaggtgacttcatctctttccactttgacctttaaacttaactcagtattcaacttggcagtcattcctatctaaaaattacacacaagattaatactccaggtgctctctaccacccaacaggatctgttaccttctgccattctgtgtctccactcgttctttcagaacctggggatcagaggttttgtataatgatgacactttataagccattttttgcatctcaaacacaatggaacacagcgcagtgaaagtggaaagatggggaaggggctgagaaataggagagaataaggacccccagaagaaatacaaacagcttttggaaggatgcatttacaaaaatgacatcaggcagctgggtgcagtggctcacacctgtaatcccagcactttgggaggctgaggcgggcggatcacctgaggtcaggagttcaagaccagcctgaccaacacggtgaaaccccgtatctactaaaaatacaatattagccacgtgtggtgatgcatgcctgtaatcccagctgcttgggaggctgaggcaggagaattgcttgaactcagaaggcaggggttgcagtgagccgagacggtgccactgcacttcaacctaggcgacaagagcaaaactccatctcaaaaaaaaaaaaaaaaaaaaaaaaaaagacatcaggcccatctggaaagtattctaacaaaataaaaagataaaaagtccctttctactgtgagcagcagatttgcagaatataaaacttctgaaacagcaaggctgtatagccaactaacaaagcaaaacaaaactgaaagaagagctccttcgagggatgtccagccactgctaagttgtaagcctcttcctggggctcaagggcagtaccaggtacaagaggccttcctactgcagttcccaagtgcgtgtctcctacaggcatttgtgcaaagggctccaaccagtgataaatccaatcttccctccatccctccaaacctgataacaatgtgggctggctctgtcagagctagcacggggtttctgaaaccactagggctgatatgtccagcttagaatcttctcttattctctgtcagctttgtctccattttcttgtacaacttggtggtaaaatatgaaaaaaatgtggcaattggaggacagaatcaaccatgatttttctctttcatcactgttctagttatttggcattactaggatataaacaagttgagtccacgagcccctcaccccttcgttgtttatcatacagacacattttacaacactttgggctagaatgaagacatgaaacaggaagttcctgatcttgctctcctctcctccttatcctccctgtctcagttaacacaataacacagtcaaagatgccgtctagtatgtttcccaaaaacacccagaaagagttcagcagcctctctggctaacctgtcctagagctgcacagcagtccaataatgtaggaacttccttctcttaacttggatttgagacgttttctttttccacatacaggtctgaaagcagcaggccactgcgtaattaaactgtccctcattggcctcaggaagaataatcttgggccctttctatgtttctggacggctgcttcccaaccctctagccgtctttctggctcttttgcagactcttctctaggaagcacaaggctgaagacataaagctctggcaaccgtcacacctcacggcctcttcacggcctgctgggctttgctctgggctgtgcctgctccttaaactctggtgccgggaaaaggatttcctcgtctcatattcaagctgtccctactgctgcttctctactcctgttttgtgttagtaaaagaaggaaggaaagaaaagggggaaggaggacagtagaaaaaataaaaaaaggaaacttaagaatttataatgacatactattttaacatgaaatacaagccaaaagatgagttttatgagatgaaaaccccacaaaacaacaaacttttgcatataacctcgcaagcacgtttttatgcacagtatttctgtattttctaacaccctttgaatgccccacagatgtctgcaaacacaggctgatctgtcccgtttcacatttacattaacaggtaaaaatgacaagaggcctagctgaattccacgaaataagttatttaaagaacatccgaagttttgttctttcagaagcagagaagttctaaacagggaagcaagagattctgagaatttcattttcaccataatggctcagcgtttgttcctctaacaacgtgcagttaacagctgtgcgctggctcttacattcaaagccaaaaagcaagttcttcacattaaagaaatcgttaaagacagttcaaggaaagagaattaggtattttagagtggctacgaaaagttttccagggggcaaaaagcactaacctgtattgttttaatctgctgaaaacaaccaacttctcgagttcccctgctgtcttctagcc
